US007956242B2

(12) United States Patent
Zhang et al.

(10) Patent No.: US 7,956,242 B2
(45) Date of Patent: Jun. 7, 2011

(54) PLANT QUALITY TRAITS

(75) Inventors: James Zhang, Palo Alto, CA (US); Frederick D. Hempel, Hayward, CA (US); Luc J. Adam, Hayward, CA (US)

(73) Assignee: Mendel Biotechnology, Inc., Hayward, CA (US)

( * ) Notice: Subject to any disclaimer, the term of this patent is extended or adjusted under 35 U.S.C. 154(b) by 0 days.

(21) Appl. No.: 12/157,329

(22) Filed: Jun. 9, 2008

(65) Prior Publication Data

US 2008/0313756 A1 Dec. 18, 2008

Related U.S. Application Data

(60) Continuation-in-part of application No. 10/286,264, filed on Nov. 1, 2002, now abandoned, which is a division of application No. 09/533,030, filed on Mar. 22, 2000, now abandoned, application No. 12/157,329, which is a continuation-in-part of application No. 10/675,852, filed on Sep. 30, 2003, and a continuation-in-part of application No. 11/479,226, filed on Jun. 30, 2006, now Pat. No. 7,858,848, which is a continuation-in-part of application No. 09/713,994, filed on Nov. 16, 2000, now abandoned, application No. 12/157,329, which is a continuation-in-part of application No. 10/669,824, filed on Sep. 23, 2003, which is a continuation-in-part of application No. 09/823,676, filed on Mar. 30, 2001, now Pat. No. 6,717,034, application No. 12/157,329, which is a continuation-in-part of application No. 11/725,235, filed on Mar. 16, 2007, now Pat. No. 7,601,893, which is a division of application No. 10/225,068, filed on Aug. 9, 2002, now Pat. No. 7,193,129, and a continuation-in-part of application No. 09/837,944, filed on Apr. 18, 2001, nowabandoned, and a continuation-in-part of application No. 10/171,468, filed on Jun. 14, 2002, now abandoned, application No. 12/157,329, which is a continuation-in-part of application No. 11/728,567, filed on Mar. 26, 2007, now Pat. No. 7,635,800, which is a division of application No. 10/225,066, filed on Aug. 9, 2002, now Pat. No. 7,238,860, application No. 12/157,329, which is a continuation-in-part of application No. 11/375,241, filed on Mar. 13, 2006, now Pat. No. 7,598,429, and a continuation-in-part of application No. 10/225,067, filed on Aug. 9, 2002, now Pat. No. 7,135,616, and a continuation-in-part of application No. 11/069,255, filed on Feb. 28, 2005, which is a continuation of application No. 10/112,887, filed on Mar. 18, 2002, now abandoned, and a continuation-in-part of application No. 10/374,780, filed on Feb. 25, 2003, now Pat. No. 7,511,190, which is a continuation-in-part of application No. 09/934,455, filed on Aug. 22, 2001, now abandoned, said application No. 10/374,780 and a continuation-in-part of application No. 10/225,068, filed on Aug. 9, 2002, now Pat. No. 7,193,129, and a continuation-in-part of application No. 10/225,066, filed on Aug. 9, 2002, now Pat. No. 7,238,860, , said application No. 10/374,780 is a continuation of application No. 10/225,067, filed on Aug. 9, 2002, now Pat. No. 7,135,616, which is a continuation-in-part of application No. 09/837,944, filed on Apr. 18, 2001, now abandoned, which is a continuation-in-part of application No. 10/171,468, filed on Jun. 14, 2002, now abandoned, application No. 12/157,329, filed on Jun. 9, 2008, which is a continuation-in-part of application No. 10/546,266, filed as application No. PCT/US2004/005654 on Feb. 25, 2004, now Pat. No.

(Continued)

(51) Int. Cl.
*A01H 5/00* (2006.01)
*A01H 5/10* (2006.01)
*C12N 5/14* (2006.01)

(52) U.S. Cl. .......................... 800/295; 800/298; 435/419

(58) Field of Classification Search ........................ None
See application file for complete search history.

(56) References Cited

U.S. PATENT DOCUMENTS

| | | | |
|---|---|---|---|
| 5,990,387 A * | 11/1999 | Tomes et al. ................... | 800/293 |
| 6,121,513 A | 9/2000 | Zhang et al. | |
| 6,946,586 B1 | 9/2005 | Fromm et al. | |
| 2002/0142281 A1 | 10/2002 | Broun et al. | |
| 2003/0018993 A1 | 1/2003 | Gutterson et al. | |
| 2003/0041356 A1 | 2/2003 | Reuber et al. | |
| 2003/0046723 A1 | 3/2003 | Heard et al. | |

(Continued)

OTHER PUBLICATIONS

Ooka et al. (DNA Research, 10:239-247, 2003).*
Nakamura et al. (EMBL Sequence Accession No. BAA97530, Published Jun. 2000).*
Souer et al. (Cell, 85:159-170, Apr. 19, 1996).*
U.S. Appl. No. 11/986,992, filed Nov. 26, 2007, Kumimoto, R. et al.
U.S. Appl. No. 09/394,519, filed Sep. 13, 1999, Zhang, J. et al.
U.S. Appl. No. 12/573,311, filed Oct. 5, 2009, Heard, J. et al.
U.S. Appl. No. 12/577,662, filed Oct. 12, 2009, Reuber, T. et al.
U.S. Appl. No. 12/557,449, filed Sep. 10, 2009, Repetti, P. et al.
U.S. Appl. No. 09/627,348, filed Jul. 28, 2000, Thomashow, Michael et al.

(Continued)

*Primary Examiner* — Vinod Kumar
(74) *Attorney, Agent, or Firm* — Cooley LLP

(57) ABSTRACT

The invention relates to plant transcription factor polypeptides, polynucleotides that encode them, homologs from a variety of plant species, and methods of using the polynucleotides and polypeptides to produce transgenic plants having advantageous properties, including increased soluble solids, lycopene, and improved plant volume or yield, as compared to wild-type or control plants. The invention also pertains to expression systems that may be used to regulate these transcription factor polynucleotides, providing constitutive, transient, inducible and tissue-specific regulation.

10 Claims, 3 Drawing Sheets

Figure 1:
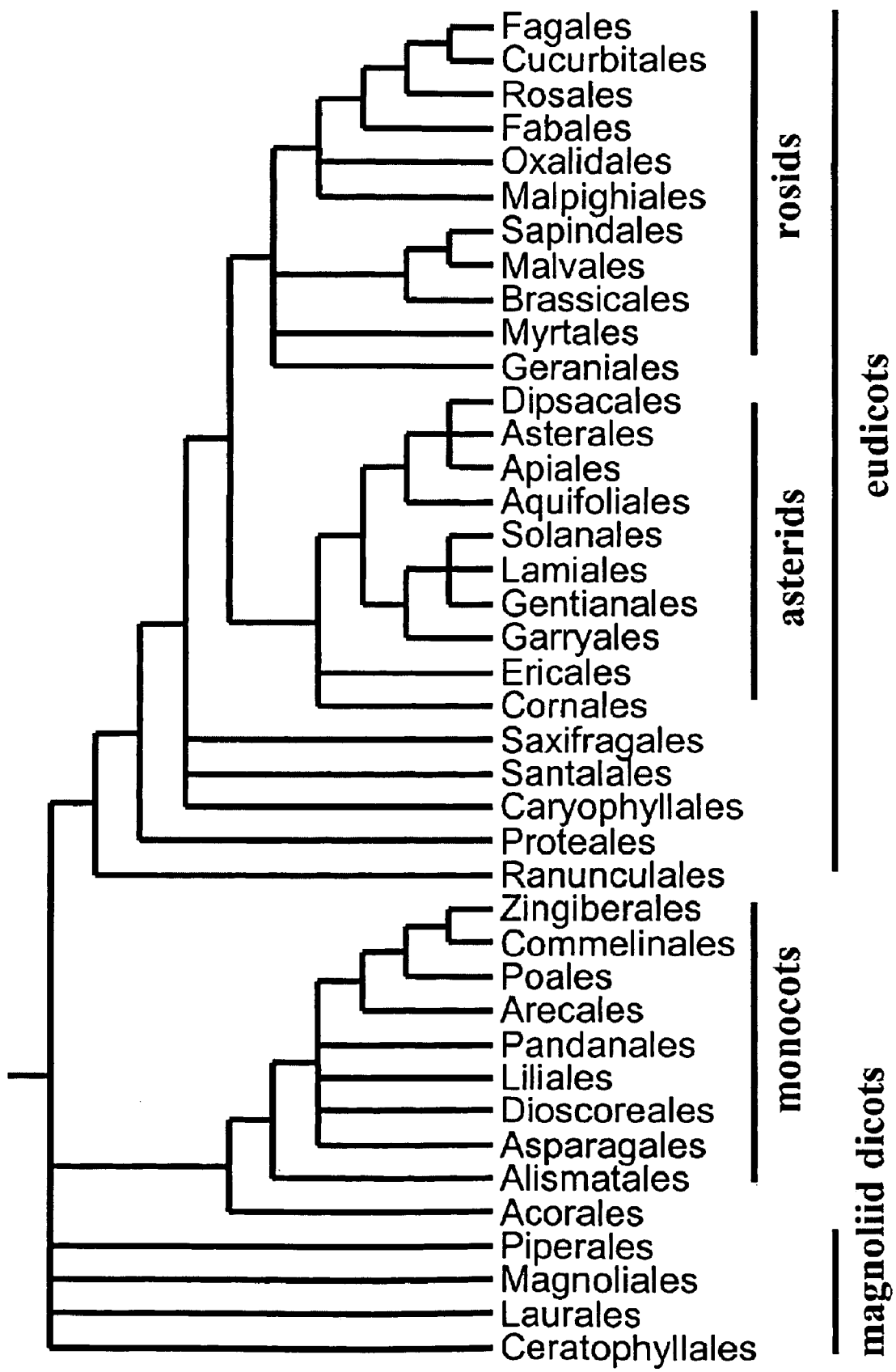

Related U.S. Application Data 7,659,446, which is a continuation-in-part of application No. 10/374,780, filed on Feb. 25, 2003, now Pat. No. 7,511,190, and a continuation-in-part of application No. 10/675,852, filed on Sep. 30, 2003, application No. 12/157,329, filed on Jun. 9, 2008, which is a continuation-in-part of application No. 11/986,992, filed on Nov. 26, 2007, which is a division of application No. 10/412,699, filed on Apr. 10, 2003, now Pat. No. 7,345,217, which is a continuation-in-part of application No. 10/295,403, filed on Nov. 15, 2002, now abandoned, which is a division of application No. 09/394,519, filed on Sep. 13, 1999, now abandoned, said application No. 10/412,699 is a continuation-in-part of application No. 09/489,376, filed on Jan. 21, 2000, now abandoned, and a continuation-in-part of application No. 10/302,267, filed on Nov. 22, 2002, now Pat. No. 7,223,904, which is a division of application No. 09/206,720, filed on Feb. 17, 2000, now abandoned, and a continuation-in-part of application No. 10/278,173, filed on Oct. 21, 2002, now abandoned, which is a division of application No. 09/533,392, filed on Mar. 22, 2000, now abandoned, said application No. 10/412,699 is a continuation-in-part of application No. 09/533,029, filed on Mar. 22, 2000, now Pat. No. 6,664,446, and a continuation-in-part of application No. 10/278,536, filed on Oct. 22, 2002, now abandoned, which is a division of application No. 09/532,591, filed on Mar. 22, 2000, now abandoned, and a continuation-in-part of application No. 09/713,994, filed on Nov. 16, 2000, now abandoned, and a continuation-in-part of application No. 09/819,412, filed on Mar. 27, 2001, now abandoned, and a continuation-in-part of application No. 09/934,455, filed on Aug. 22, 2001, now abandoned, which is a continuation-in-part of application No. 09/713,994, filed on Nov. 16, 2000, now abandoned, and a continuation-in-part of application No. 09/837,944, filed on Apr. 18, 2001, now abandoned, and a continuation-in-part of application No. 10/171,468, filed on Jun. 14, 2002, now abandoned, said application No. 10/412,699 is a continuation-in-part of application No. 10/225,067, filed on Aug. 9, 2002, now Pat. No. 7,135,616, and a continuation-in-part of application No. 10/374,780, filed on Feb. 25, 2003, now Pat. No. 7,511,190, application No. 12/157,329, which is a continuation-in-part of application No. 10/559,441, filed as application No. PCT/US04/017768 on Jun. 4, 2004, now abandoned, which is a continuation-in-part of application No. 10/456,882, filed on Jun. 6, 2003, now abandoned, application No. 12/157,329, which is a continuation-in-part of application No. 11/642,642, filed on Dec. 20, 2006, now Pat. No. 7,825,296, which is a division of application No. 10/666,642, filed on Sep. 18, 2003, now Pat. No. 7,196,245, application No. 12/157,329, which is a continuation-in-part of application No. 10/714,887, filed on Nov. 13, 2003, which is a continuation-in-part of application No. 10/456,882, filed on Jun. 6, 2003, now abandoned, application No. 12/157,329, which is a continuation-in-part of application No. 11/435,388, filed on May 15, 2006, now Pat. No. 7,663,025, which is a continuation-in-part of application No. PCT/US2004/037584, filed on Nov. 12, 2004, which is a continuation-in-part of application No. 10/714,887, filed on Nov. 13, 2003, application No. 12/157,329, which is a continuation-in-part of application No. 11/632,390, filed as application No. PCT/US2005/025010 on Jul. 14, 2004, now abandoned, application No. 12/157,329, which is a continuation-in-part of application No. 12/064,961, filed as application No. PCT/US2006/034615 on Aug. 31, 2006, application No. 12/157,329, which is a continuation-in-part of application No. 10/903,236, filed on Jul. 30, 2004, which is a continuation-in-part of application No. 10/456,882, filed on Jun. 6, 2003, now abandoned, and a continuation-in-part of application No. 10/666,642, filed on Sep. 18, 2003, now Pat. No. 7,196,245, application No. 12/157,329, which is a continuation-in-part of application No. 11/699,973, filed as application No. PCT/US2005/027151 on Jul. 29, 2005, now abandoned, which is a continuation-in-part of application No. 10/903,236, filed on Jul. 30, 2004, application No. 12/157,329, which is a continuation-in-part of application No. 10/870,198, filed on Jun. 16, 2004, and a continuation-in-part of application No. 10/669,824, filed on Sep. 23, 2003, which is a continuation-in-part of application No. 09/823,676, filed on Mar. 30, 2001, now Pat. No. 6,717,034, application No. 12/157,329, which is a continuation-in-part of application No. 10/838,616, filed on May 4, 2004, which is a continuation-in-part of application No. 10/685,922, filed on Oct. 14, 2003, now abandoned, application No. 12/157,329, which is a continuation-in-part of application No. PCT/US2007/017321, filed on Aug. 3, 2007, application No. 12/157,329, which is a continuation-in-part of application No. 11/705,903, filed on Feb. 12, 2007, now Pat. No. 7,868,229, which is a continuation-in-part of application No. PCT/US2006/034615, filed on Aug. 31, 2006, application No. 12/157,329, which is a continuation-in-part of application No. 11/821,448, filed on Jun. 22, 2007, now Pat. No. 7,692,067, application No. 12/157,329, which is a continuation-in-part of application No. PCT/US2007/009124, filed on Apr. 12, 2007, application No. 12/157,329, which is a continuation-in-part of application No. 11/981,667, filed on Mar. 7, 2008, and a continuation-in-part of application No. 11/981,576, filed on Oct. 30, 2007.

(60) Provisional application No. 60/961,403, filed on Jul. 20, 2007, provisional application No. 60/125,814, filed on Mar. 23, 1999, provisional application No. 60/166,228, filed on Nov. 17, 1999, provisional application No. 60/197,899, filed on Apr. 17, 2000, provisional application No. 60/227,439, filed on Aug. 22, 2000, provisional application No. 60/310,847, filed on Aug. 9, 2001, provisional application No. 60/336,049, filed on Nov. 19, 2001, provisional application No. 60/338,692, filed on Dec. 11, 2001, provisional application No. 60/713,952, filed on Aug. 13, 2005, provisional application No. 60/101,349, filed on Sep. 22, 1998, provisional application No. 60/103,312, filed on Oct. 6, 1998, provisional application No. 60/108,734, filed on Nov. 17, 1998, provisional application No. 60/113,409, filed on Dec. 22, 1998, provisional application No. 60/116,841, filed on Jan. 22, 1999, provisional application No. 60/120,880, filed on Feb. 18, 1999, provisional application No. 60/121,137, filed on Feb. 22, 1999, provisional application No. 60/124,278, filed on Mar. 11, 1999, provisional application No. 60/129,450, filed on Apr. 15, 1999, provisional application No. 60/135,134, filed on May 20, 1999, provisional application No. 60/144,153, filed on Jul. 15, 1999, provisional application No. 60/161,143, filed on Oct. 22, 1999, provisional application No. 60/162,656, filed on Nov. 1, 1999, provisional application No. 60/411,837, filed on Sep. 18, 2002, provisional application No. 60/434,166, filed on Dec. 17, 2002, provisional application No. 60/465,809, filed on Apr. 24, 2003, provisional application No. 60/527,658, filed on Dec. 5, 2003, provisional application No. 60/542,928, filed on Feb. 5, 2004, provisional application No. 60/588,405, filed on Jul. 14, 2004, provisional application No. 60/713,952, filed on Aug. 31, 2005, provisional application No. 60/565,948, filed on Apr. 26, 2004, provisional application No. 60/836,243, filed on Aug. 7, 2006, provisional application No. 60/817,886, filed on Jun. 29, 2006, provisional application No. 60/791,663, filed on Apr. 12, 2006.

(56) References Cited

U.S. PATENT DOCUMENTS

| | | |
|---|---|---|
| 2003/0061637 A1 | 3/2003 | Jiang et al. |
| 2003/0093837 A1 | 5/2003 | Keddie et al. |
| 2003/0101481 A1 | 5/2003 | Zhang et al. |
| 2003/0121070 A1 | 6/2003 | Adam et al. |
| 2003/0131386 A1 | 7/2003 | Samaha et al. |
| 2003/0167537 A1 | 9/2003 | Jiang et al. |
| 2003/0188330 A1 | 10/2003 | Heard et al. |
| 2003/0217383 A1 | 11/2003 | Reuber et al. |
| 2003/0226173 A1 | 12/2003 | Ratcliffe et al. |
| 2003/0229915 A1 | 12/2003 | Heard et al. |
| 2004/0019925 A1 | 1/2004 | Heard et al. |
| 2004/0019927 A1 | 1/2004 | Sherman et al. |
| 2004/0034888 A1* | 2/2004 | Liu et al. ............ 800/289 |
| 2004/0045049 A1 | 3/2004 | Zhang et al. |
| 2004/0098764 A1 | 5/2004 | Heard et al. |
| 2004/0128712 A1 | 7/2004 | Jiang et al. |
| 2005/0086718 A1 | 4/2005 | Heard et al. |
| 2005/0097638 A1 | 5/2005 | Jiang et al. |
| 2005/0155117 A1 | 7/2005 | Century et al. |
| 2005/0172364 A1 | 8/2005 | Heard et al. |
| 2006/0008874 A1 | 1/2006 | Creelman et al. |
| 2006/0015972 A1 | 1/2006 | Heard et al. |
| 2006/0162018 A1 | 7/2006 | Gutterson et al. |
| 2006/0195944 A1 | 8/2006 | Heard et al. |
| 2006/0242738 A1 | 10/2006 | Sherman et al. |
| 2006/0272060 A1 | 11/2006 | Heard et al. |
| 2007/0022495 A1 | 1/2007 | Reuber et al. |
| 2007/0033671 A1 | 2/2007 | Jiang et al. |
| 2007/0101454 A1 | 5/2007 | Jiang et al. |
| 2007/0186308 A1 | 8/2007 | Reuber et al. |
| 2007/0199107 A1 | 8/2007 | Ratcliffe et al. |
| 2007/0209086 A1 | 9/2007 | Ratcliffe et al. |
| 2007/0226839 A1 | 9/2007 | Gutterson et al. |
| 2008/0010703 A1 | 1/2008 | Creelman et al. |
| 2008/0155706 A1 | 6/2008 | Riechmann et al. |
| 2008/0163397 A1 | 7/2008 | Ratcliffe et al. |
| 2008/0229448 A1 | 9/2008 | Libby et al. |
| 2008/0301836 A1 | 12/2008 | Century et al. |
| 2008/0301840 A1 | 12/2008 | Gutterson et al. |
| 2008/0301841 A1 | 12/2008 | Ratcliffe et al. |
| 2008/0313756 A1 | 12/2008 | Zhang et al. |
| 2009/0049566 A1 | 2/2009 | Zhang et al. |
| 2009/0138981 A1* | 5/2009 | Repetti et al. ............ 800/263 |
| 2009/0151015 A1 | 6/2009 | Adam et al. |
| 2009/0192305 A1 | 7/2009 | Riechmann et al. |
| 2009/0205063 A1 | 8/2009 | Zhang et al. |
| 2009/0265813 A1 | 10/2009 | Gutterson et al. |

OTHER PUBLICATIONS

U.S. Appl. No. 09/489,376, filed Jan. 21, 2000, Heard, J. et al.
U.S. Appl. No. 09/489,230, filed Jan. 21, 2009, Broun, P. et al.
U.S. Appl. No. 09/506,720, filed Feb. 17, 2000, Keddie, James et al.
U.S. Appl. No. 09/533,030, filed Mar. 22, 2000, Keddie, James et al.
U.S. Appl. No. 09/533,392, filed Mar. 22, 2000, Jiang, C-Z. et al.
U.S. Appl. No. 12/526,042, filed Feb. 7, 2008, Repetti, Peter P. et al.
U.S. Appl. No. 12/338,024, filed Dec. 18, 2008, Sherman, Bradley et al.
U.S. Appl. No. 09/532,591, filed Mar. 22, 2000, Samaha, R. et al.
U.S. Appl. No. 09/533,648, filed Mar. 22, 2000, Riechmann, Jose Luis et al.
U.S. Appl. No. 10/290,627, filed Nov. 7, 2002, Riechmann, Jose Luis et al.
U.S. Appl. No. 09/713,994, filed Nov. 16, 2000, Keddie, James et al.
U.S. Appl. No. 09/837,944, filed Apr. 18, 2001, Creelman, Robert et al.
U.S. Appl. No. 09/594,214, filed Jun. 14, 2000, Jones, J. et al.
U.S. Appl. No. 10/456,882, filed Jun. 6, 2003, Riechmann, Jose Luis et al.
U.S. Appl. No. 10/171,468, filed Jun. 14, 2002, Creelman, Robert et al.
U.S. Appl. No. 12/376,569, filed Aug. 3, 2007, Creelman, Robert et al.
Accession No. BT020305. *Arabidopsis thaliana* At5g46590 gene, complete cds. (Dec. 4, 2004).
Accession No. BT020555. *Arabidopsis thaliana* At5g46590 gene, complete cds. (Jan. 5, 2005).
Accession No. AB028605. *Arabidopsis thaliana* genomic DNA, chromosome 5, BAC clone:F10E10. (Feb. 14, 2004).
GenBank Accession No. AW222093. EST298904 tomato fruit red ripe, TAMU *Solanum lycopersicum* cDNA clone cLEN6L12, mRNA sequence. (Dec. 7, 1999).
GenBank Accession No. AC077693. *Oryza sativa* chromosome 10 BAC OSJNBa0095C07 genomic sequence, complete sequence. (Apr. 24, 2002).
GenBank Accession No. BG933492. WS1_4_A12.b1_A002 Water-stressed 1 (WS1) *Sorghum bicolor* cDNA, mRNA sequence (Jun. 7, 2001).
GenBank Accession No. AW560434. EST315482 DSIR *Medicago truncatula* cDNA clone pDSIR-27I1, mRNA sequence (Mar. 7, 2000).
GenBank Accession No. BG159075. RHIZ2_17_E07.b1_A003 Rhizome2 (RHIZ2) *Sorghum propinquum* cDNA, mRNA sequence. (Feb. 6, 2001).
GenBank Accession No. BI543350. S1A_F6 Sugar Beet peroxide germination cDNA library (subtracted) *Beta vulgaris* cDNA 5-similar to *Arabidopsis* NAC-domain (no apical meristem) protein, mRNA sequence. (Sep. 4, 2001).
GenBank Accession No. BE661301. 588 GmaxSC *Glycine max* cDNA, mRNA sequence. (Sep. 6, 2000).
GenBank Accession No. BG606080. WHE2960_B05_C10ZS Wheat dormant embryo cDNA library *Triticum aestivum* cDNA clone WHE2960_B05_C10, mRNA sequence. (Apr. 17, 2001).
Accession No. AF402603. *Phaseolus vulgaris* NAC domain protein NAC2 mRNA, complete cds. (Aug. 13, 2001).
Accession No. AC005310. *Arabidopsis thaliana* chromosome 2 clone F19D11 map CIC06C03, complete sequence. (Jul. 21, 1998).
Accession No. AL021889. *Arabidopsis thaliana* DNA chromosome 4, BAC clone T6K21 (ESSAII project). (Feb. 18, 1998).
PHRNANAM. Accession No. X92205 P.hybrida mRNA encoding NAM protein. (May 15, 1996).
Accession No. BG132273. Four wk old greenhouse plants were stab inoculated on stem with *Agrobacterium tumefaciens* C58 (Dr. T.J. Burr, Cornell U.). Galls were allowed to develop for another 4 wks, when gall tissue was frozen in liquid nitrogen. (Jan. 31, 2001).
GenBank Accession No. BG350410. Mature tuber lambda ZAP. (Mar. 1, 2001).
Accession No. BAA97530. NAM-like [*Arabidopsis thaliana*]. (Jun. 30, 2000).
Gi6006373. Accession No. BAA84803. putative OsNAC7 protein [*Oryza sativa* Japonica Group] (Oct. 1, 1999).
NM_117908.1 GI:18415001. Reference sequence derived from At4g17980. (Jan. 29, 2002).
Accession No. CAA63101. GI:1279640. NAM [*Petunia x hybrida*]. (Apr. 25, 1996).

Accession No. AAK84884. gi15148914. NAC domain protein NAC2 [*Phaseolus vulgaris*]. (Aug. 13, 2001).
Accession No. CAA99760. gi1418990. (Jun. 28, 1996).
Accession No. AAF68626. gi7716952. NAC1 [*Medicago truncatula*]. (May 8, 2000).
Accession No. CAC42087. gi14485513. putative NAC domain protein [*Solanum tuberosum*]. (Jun. 17, 2001).
Accession No. CAB69232. gi6732156. unnamed protein product [*Triticum monococcum*]. (Jan. 23, 2000).
Accession No. CAA09371. gi4218535. GRAB1 protein [*Triticum* sp.]. (Feb. 3, 1999).

Accession No. BAA78417. gi4996349. NAC-domain protein [*Nicotiana tabacum*]. (Jun. 4, 1999).
Accession No. BAA89800. gi6730942. OsNAC6 protein [*Oryza sativa*]. (Jan. 22, 2000).
Accession No. AAF04915. gi6175246. jasmonic acid 2 [*Lycopersicon esculentum*]. (Nov. 2, 1999).
Accession No. AAC32123. gi2982275. ATAF1-like protein [*Picea mariana*]. (Mar. 25, 1998).

* cited by examiner

PLANT QUALITY TRAITS

RELATIONSHIP TO COPENDING APPLICATIONS

This application claims the benefit of Application No. 60/961,403, filed Jul. 20, 2007(pending). This application is a continuation-in-part of application Ser. No. 10/286,264, filed Nov. 1, 2002(pending), which is a divisional of application Ser. No. 09/533,030, filed Mar. 22, 2000 (abandoned), which claims the benefit of Application No. 60/125,814, filed Mar. 23, 1999. This application is a continuation-in-part of application Ser. No. 10/675,852, filed Sep. 30, 2003(pending). This application is a continuation-in-part of application Ser. No. 11/479,226, filed Jun. 30, 2006(pending), which is a continuation-in-part of application Ser. No. 09/713,994, filed Nov. 16, 2000 (abandoned), which claims the benefit of Application No. 60/166,228, filed Nov. 17, 1999, which also claims the benefit of Application No. 60/197,899, filed Apr. 17, 2000, which also claims the benefit of Application No. 60/227,439, filed Aug. 22, 2000. This application is a continuation-in-part of application Ser. No. 10/669,824, filed Sep. 23, 2003, which is a continuation-in-part of, Ser. No. 09/823,676, filed Mar. 30, 2001 (issued as U.S. Pat. No. 6,717,034). This application is a continuation-in-part of application Ser. No. 11/725,235, filed Mar. 16, 2007(pending), which is a divisional of application Ser. No. 10/225,068, filed Aug. 9, 2002 (issued as U.S. Pat. No. 7,193,129), which claims the benefit of Application No. 60/310,847, filed Aug. 9, 2001, and also claims the benefit of Application No. 60/336,049, filed Nov. 19, 2001, and also claims the benefit of Application No. 60/338,692, filed Dec. 11, 2001; application Ser. No. 10/225,068 is also a continuation-in-part of application Ser. No. 09/837,944, filed Apr. 18, 2001 (abandoned), and is also a continuation-in-part of application Ser. No. 10/171,468, filed Jun. 14, 2002 (abandoned). This application is a continuation-in-part of application Ser. No. 11/728,567, filed Mar. 26, 2007, which is a divisional of application Ser. No. 10/225,066, filed Aug. 9, 2002 (issued as U.S. Pat. No. 7,238,860), which claims the benefit of Application No. 60/310,847, filed Aug. 9, 2001, and also claims the benefit of Application No. 60/336,049, filed Nov. 19, 2001, and also claims the benefit of Application No. 60/338,692, filed Dec. 11, 2001. Application Ser. No. 10/225,066 is also a continuation-in-part of application Ser. No. 09/837,944, filed Apr. 18, 2001 (abandoned), and is a continuation-in-part of application Ser. No. 10/171,468, filed Jun. 14, 2002 (abandoned). This application is a continuation-in-part of application Ser. No. 11/375,241, filed Mar. 16, 2006(pending), which claims the benefit of Application No. 60/713,952, filed Aug. 31, 2005. Application Ser. No. 11/375,241 is also a continuation-in-part of application Ser. No. 10/225,067, filed Aug. 9, 2002 (issued as U.S. Pat. No. 7,135,616), which claims the benefit of Application No. 60/310,847, filed Aug. 9, 2001, which also claims the benefit of Application No. 60/336,049, filed Nov. 19, 2001, and also claims the benefit of Application No. 60/338,692, filed Dec. 11, 2001. Application Ser. No. 10/225,067 is also a continuation-in-part of application Ser. No. 09/837,944, filed Apr. 18, 2001 (abandoned), and is also a continuation-in-part of application Ser. No. 10/171,468, filed Jun. 14, 2002 (abandoned). This application is a continuation-in-part of application Ser. No. 11/069,255, filed Feb. 28, 2005(pending), which is a continuation-in-part of application Ser. No. 10/112,887, filed Mar. 18, 2002 (abandoned). This application is a continuation-in-part of application Ser. No. 10/374,780, filed Feb. 25, 2003(pending), which is a continuation-in-part of application Ser. No. 09/934,455, filed Aug. 22, 2001 (abandoned), which is a continuation-in-part of application Ser. No. 09/713,994, Nov. 16, 2000 (abandoned), which is also a continuation-in-part of application Ser. No. 09/837,944, filed Apr. 18, 2001 (abandoned), which also claims priority to Application No. 60/227,439, filed Aug. 22, 2000. Application Ser. No. 10/374,780 is also a continuation-in-part of application Ser. No. 10/225,068, filed Aug. 9, 2002 (issued as U.S. Pat. No. 7,193,129), which claims the benefit of Application No. 60/310,847, filed Aug. 9, 2001, and also claims the benefit of Application No. 60/336,049, filed Nov. 19, 2001, and also claims the benefit of Application No. 60/338,692, filed Dec. 11, 2001. Application Ser. No. 10/225,068 is also a continuation-in-part of application Ser. No. 09/837,944, filed Apr. 18, 2001 (abandoned), and is also a continuation-in-part of application Ser. No. 10/171,468, filed Jun. 14, 2002 (abandoned). Application Ser. No. 10/374,780 is also a continuation-in-part of application Ser. No. 10/225,066, filed Aug. 9, 2002 (issued as U.S. Pat. No. 7,238,860), which claims the benefit of Application No. 60/310,847, filed Aug. 9, 2001, which also claims the benefit of Application No. 60/336,049, filed Nov. 19, 2001, which also claims the benefit of Application No. 60/338,692, filed Dec. 11, 2001; application Ser. No. 10/225,066 is also a continuation-in-part of application Ser. No. 09/837,944, filed Apr. 18, 2001 (abandoned), and is also a continuation-in-part of application Ser. No. 10/171,468, filed Jun. 14, 2002 (abandoned). Application Ser. No. 10/374,780 is also a continuation-in-part of application Ser. No. 10/225,067, filed Aug. 9, 2002 (issued as U.S. Pat. No. 7,135,616), which claims the benefit of Application No. 60/310,847, filed Aug. 9, 2001, and also claims the benefit of Application No. 60/336,049, filed Nov. 19, 2001, and also claims the benefit of Application No. 60/338,692, filed Dec. 11, 2001; application Ser. No. 10/225,067 is also a continuation-in-part of application Ser. No. 09/837,944, filed Apr. 18, 2001 (abandoned), and is also a continuation-in-part of application Ser. No. 10/171,468, filed Jun. 14, 2002 (abandoned). This application is a continuation-in-part of application Ser. No. 10/546,266, filed Aug. 19, 2005(pending), which is a '371 National Stage filing of International Application No. PCT/US2004005654, filed Feb. 25, 2004 (converted), which is a continuation-in-part of application Ser. No. 10/374,780, filed Feb. 25, 2003(pending), and is also a continuation-in-part of application Ser. No. 10/675,852, filed Sep. 30, 2003(pending). This application is also a continuation-in-part of application Ser. No. 11/986,992, filed Nov. 26, 2007(pending), which is a division of application Ser. No. 10/412,699, filed Apr. 10, 2003 (issued as U.S. Pat. No. 7,345,217), which is a continuation-in-part of application Ser. No. 10/295,403, filed Nov. 15, 2002 (abandoned), which is a divisional of application Ser. No. 09/394,519, filed Sep. 13, 1999 (abandoned), which claims the benefit of Application No. 60/101,349, filed Sep. 22, 1998, which also claims the benefit of Application No. 60/103,312, filed Oct. 6, 1998, which also claims the benefit of Application No. 60/108,734, filed Nov. 17, 1998, which also claims the benefit of Application No. 60/113,409, filed Dec. 22, 1998. Application Ser. No. 10/412,699 is also a continuation-in-part of application Ser. No. 09/489,376, filed Jan. 21, 2000 (abandoned), which claimed priority to Application No. 60/116,841, filed Jan. 22, 1999. Application Ser. No. 10/412,699 is also a continuation-in-part of application Ser. No. 10/302,267, filed Nov. 22, 2002 (issued as U.S. Pat. No. 7,223,904), which is a divisional of application Ser. No. 09/506,720, filed Feb. 17, 2000 (abandoned), which claims the benefit of Application No. 60/120,880, filed Feb. 18, 1999, which also claims the benefit of Application No. 60/121,037, filed Feb. 22, 1999, which also claims the benefit of Application No. 60/124,278, filed Mar.

11, 1999, which also claims the benefit of Application No. 60/129,450, filed Apr. 15, 1999, which also claims the benefit of Application No. 60/135,134, filed May 20, 1999, which also claims the benefit of Application No. 60/144,153, filed Jul. 15, 1999, which also claims the benefit of Application No. 60/161,143, filed Oct. 22, 1999, which also claims the benefit of Application No. 60/162,656, filed Nov. 1, 1999. Application Ser. No. 10/412,699 is also a continuation-in-part of application Ser. No. 10/278,173, filed Oct. 21, 2002 (abandoned), which is a divisional of application Ser. No. 09/533,392, filed Mar. 22, 2000 (abandoned), which claims the benefit of Application No. 60/125,814, filed Mar. 23, 1999. Application Ser. No. 10/412,699 is also a continuation-in-part of application Ser. No. 09/533,029, filed Mar. 22, 2000 (issued as U.S. Pat. No. 6,664,446), which claims the benefit of Application No. 60/125,814, filed Mar. 23, 1999. Application Ser. No. 10/412,699 is also a continuation-in-part of application Ser. No. 10/278,536, filed Oct. 22, 2002 (abandoned), which is a divisional of application Ser. No. 09/532,591, filed Mar. 22, 2000 (abandoned), which claims priority to Application No. 60/125,814, filed Mar. 23, 1999. Application Ser. No. 10/412,699 is also a continuation-in-part of application Ser. No. 09/713,994, filed Nov. 16, 2000 (abandoned), which claims the benefit of Application No. 60/166,228, filed Nov. 17, 1999, which also claims the benefit of Application No. 60/197,899, filed Apr. 17, 2000, which also claims the benefit of Application No. 60/227,439, filed Aug. 22, 2000. Application Ser. No. 10/412,699 is also a continuation-in-part of application Ser. No. 09/819,142, filed Mar. 27, 2001. Application Ser. No. 10/412,699 is also a continuation-in-part of application Ser. No. 09/934,455, filed Aug. 22, 2001 (abandoned), which is a continuation-in-part of application Ser. No. 09/713,994, filed Nov. 16, 2000 (abandoned), which is also a continuation-in-part of application Ser. No. 09/837,944, filed Apr. 18, 2001 (abandoned), which also claim the benefit of Application No. 60/227,439, filed Aug. 22, 2000. Application Ser. No. 10/412,699 is also a continuation-in-part of application Ser. No. 10/225,068, filed Aug. 9, 2002 (issued as U.S. Pat. No. 7,193,129), which claims the benefit of Application No. 60/310,847, filed Aug. 9, 2001, which also claims the benefit of Application No. 60/336,049, filed Nov. 19, 2001, which also claims the benefit of Application No. 60/338,692, filed Dec. 11, 2001; and, application Ser. No. 10/225,068 is also a continuation-in-part of application Ser. No. 09/837,944, filed Apr. 18, 2001 (abandoned), and is also a continuation-in-part of application Ser. No. 10/171,468, filed Jun. 14, 2002 (abandoned). Application Ser. No. 10/412,699 is also a continuation-in-part of application Ser. No. 10/225,066, filed Aug. 9, 2002 (issued as U.S. Pat. No. 7,238,860), which claims the benefit of Application No. 60/310,847, filed Aug. 9, 2001, which also claims the benefit of Application No. 60/336,049, filed Nov. 19, 2001, which also claims the benefit of Application No. 60/338,692, filed Dec. 11, 2001; and, application Ser. No. 10/225,066 is also a continuation-in-part of application Ser. No. 09/837,944, filed Apr. 18, 2001 (abandoned), and is also a continuation-in-part of application Ser. No. 10/171,468, filed Jun. 14, 2002 (abandoned). Application Ser. No. 10/412,699 is also a continuation-in-part of application Ser. No. 10/225,067, filed Aug. 9, 2002 (issued as U.S. Pat. No. 7,135,616), which claims the benefit of Application No. 60/310,847, filed Aug. 9, 2001, which also claims the benefit of Application No. 60/336,049, filed Nov. 19, 2001, which also claims the benefit of Application No. 60/338,692, filed Dec. 11, 2001; and, application Ser. No. 10/225,067 is also a continuation-in-part of application Ser. No. 09/837,944, filed Apr. 18, 2001 (abandoned), and is also a continuation-in-part of application Ser. No. 10/171,468, filed Jun. 14, 2002 (abandoned). Application Ser. No. 10/412,699 is also a continuation-in-part of application Ser. No. 10/374,780, filed Feb. 25, 2003(pending). This application is a continuation-in-part of application Ser. No. 10/559,441, filed Dec. 2, 2005(pending), which is a '371 National Stage filing of International Application No. PCT/US2004/017768, filed Jun. 4, 2004 (converted), which is a continuation-in-part of application Ser. No. 10/456,882, filed Jun. 6, 2003 (abandoned). This application is a continuation-in-part of application Ser. No. 11/642,814, filed Dec. 20, 2006(pending), which is a divisional of application Ser. No. 10/666,642, filed Sep. 18, 2003 (issued as U.S. Pat. No. 7,196,245), which claims the benefit of Application No. 60/411,837, filed Sep. 18, 2002, and also claims the benefit of Application No. 60/434,166, filed Dec. 17, 2002, and also claims the benefit of Application No. 60/465,809, filed Apr. 24, 2003. This application is a continuation-in-part of application Ser. No. 10/714,887, filed Nov. 13, 2003(pending), which is a continuation-in-part of application Ser. No. 10/456,882, filed Jun. 6, 2003 (abandoned); and application Ser. No. 10/714,887 is also a continuation-in-part of application Ser. No. 10/666,642, filed Sep. 18, 2003 (issued as U.S. Pat. No. 7,196,245), which claims the benefit of Application No. 60/411,837, filed Sep. 18, 2002, which also claims the benefit of Application No. 60/434,166, filed Dec. 17, 2002, which also claims the benefit of Application No. 60/465,809, filed Apr. 24, 2003. This application is a continuation-in-part of application Ser. No. 11/435,388, filed May 15, 2006(pending), which is a continuation-in-part of International Application No. PCT/US04/37584, filed Nov. 12, 2004 (converted), which is a continuation-in-part of application Ser. No. 10/714,887, filed Nov. 13, 2003(pending), and also claims the benefit of Application No. 60/527,658, filed Dec. 5, 2003, and also claims the benefit of Application No. 60/542,928, filed Feb. 5, 2004. This application is a continuation-in-part of application Ser. No. 11/632,390, filed Jan. 11, 2007(pending), which is a '371 National Stage filing of International Application No. PCT/US2005/025010, filed Jul. 14, 2005 (converted), which claims the benefit of Application No. 60/588,405, filed Jul. 14, 2004. This application is a continuation-in-part of application Ser. No. 12/064,961, filed Feb. 26, 2008(pending), which is a continuation-in-part of PCT application PCT/US06/34615, filed Aug. 31, 2006 (expired), which claims the benefit of Application No. 60/713,952, filed Aug. 31, 2005. This application is a continuation-in-part of International Application no. PCT/US2006/34615, filed Aug. 31, 2006(pending), which claims the benefit of Application No. 60/713,952, filed Aug. 31, 2005. This application is a continuation-in-part of application Ser. No. 10/903,236, filed Jul. 30, 2004(pending), which is a continuation-in-part of application Ser. No. 10/456,882, filed Jun. 6, 2003 (abandoned), and is also a continuation-in-part of application Ser. No. 10/666,642, filed Sep. 18, 2003 (issued as U.S. Pat. No. 7,196,245), which claims the benefit of Application No. 60/411,837, filed Sep. 18, 2002, and also claims the benefit of Application No. 60/465,809, filed Apr. 24, 2003. This application is a continuation-in-part of application Ser. No. 11/699,973, filed Jan. 29, 2007(pending), which is a continuation-in-part of International Application No. PCT/US2005-027151, filed Jul. 29, 2005 (converted), which is a continuation-in-part of application Ser. No. 10/903,236, filed Jul. 30, 2004(pending). This application is a continuation-in-part of application Ser. No. 10/870,198, filed Jun. 16, 2004(pending), which claims the benefit of Application No. 60/565,948, filed Apr. 26, 2004, which also claims the benefit of Application No. 60/527,658, filed Dec. 5, 2003, which also claims the benefit of Application No. 60/542,928, filed Feb. 5, 2005;

and, application Ser. No. 10/870,198 is also a continuation-in-part of application Ser. No. 10/669,824, filed Sep. 23, 2003 (pending), which is a continuation-in-part of application Ser. No. 09/823,676, filed Mar. 30, 2001 (issued as U.S. Pat. No. 6,717,034). This application is a continuation-in-part of application Ser. No. 10/838,616, filed May 4, 2004(pending), which claims the benefit of Application No. 60/565,948, filed Apr. 26, 2004, and is a continuation-in-part of application Ser. No. 10/685,922, filed Oct. 14, 2003 (abandoned). This application is a continuation-in-part of International Application No. PCT/US2007/17321, filed Aug. 7, 2006(pending), which claims the benefit of Application No. 60/836,243, filed Aug. 7, 2006. This application is a continuation-in-part of application Ser. No. 11/705,903, filed Feb. 12, 2007(pending), which is a continuation-in-part of International Application No. PCT/US2006/34615, filed Aug. 31, 2006 (converted), which claims the benefit of Application No. 60/713,952, filed Aug. 31, 2005. This application is a continuation-in-part of application Ser. No. 11/821,448, filed Jun. 22, 2007(pending), which claims priority to Application No. 60/817,886, filed Jun. 29, 2006. This application is a continuation-in-part of application Ser. No. 11/981,667, filed Oct. 31, 2007(pending). This application is also a continuation-in-part of application Ser. No. 11/981,576 filed Oct. 31, 2007(pending). This application is a continuation-in-part of International Application No. PCT/US2007/09124, filed Apr. 12, 2007(pending), which claims priority to Application No. 60/791,663, filed Apr. 12, 2006. The contents of all applications herein are incorporated by reference in their entirety.

FIELD OF THE INVENTION

The present invention relates to compositions and methods for transforming plants for the purpose of improving plant traits, including yield and fruit quality.

BACKGROUND OF THE INVENTION

Biotechnological Improvement of Plants
To date, almost all improvements in agricultural crops have been achieved using traditional plant breeding techniques. In recent years, biotechnology approaches involving the expression of single transgenes in crops have resulted in the successful commercial introduction of new plant traits, including herbicide resistance (glyphosate (Roundup) resistance), insect resistance (expression of *Bacillus thuringiensis* toxins) and virus resistance (over expression of viral coat proteins). Thus, plant genomics may be used to achieve control over polygenic traits. Some of the traits that may be improved, resulting in better yield and crop quality, are listed below.
Control of Cellular Processes in Plants with Transcription Factors
Strategies for manipulating traits by altering a plant cell's transcription factor content can result in plants and crops with new and/or improved commercially valuable properties. For example, manipulation of the levels of selected transcription factors may result in increased expression of economically useful proteins or biomolecules in plants or improvement in other agriculturally relevant characteristics. Conversely, blocked or reduced expression of a transcription factor may reduce biosynthesis of unwanted compounds or remove an undesirable trait. Therefore, manipulating transcription factor levels in a plant offers tremendous potential in agricultural biotechnology for modifying a plant's traits, including traits that improve a plants survival, yield and product quality.

SUMMARY OF THE INVENTION

The present invention relates to compositions and methods for modifying the genotype of a higher plant for the purpose of impart desirable characteristics. These characteristics are generally yield and/or quality-related, and may specifically pertain to the fruit of the plant. The method steps involve first transforming a host plant cell with a nucleic acid construct or DNA construct (such as an expression vector or a plasmid); the nucleic acid construct comprises a polynucleotide that encodes a transcription factor polypeptide, and the polynucleotide is homologous to any of the polynucleotides of the invention. These include the transcription factor polynucleotides found in the Sequence Listing.

Once the host plant cell is transformed with the nucleic acid construct, a plant may be regenerated from the transformed host plant cell. This plant may then be grown to produce a plant having the desired yield or quality characteristic. Examples of yield and quality characteristics that may be improved by these method steps include increased bright coloration, dark leaf color, etiolated seedlings, increased anthocyanin in leaves, increased anthocyanin in flowers, and increased anthocyanin in fruit, increased seedling anthocyanin, increased seedling vigor, longer internodes, more anthocyanin, more trichomes, and fewer trichomes.

BRIEF DESCRIPTION OF THE SEQUENCE LISTING AND FIGURES

The Sequence Listing provides exemplary polynucleotide and polypeptide sequences of the invention. The traits associated with the use of the sequences are included in the Examples.

CD-ROMs Copy 1, Copy 2 and Copy 3 are read-only memory computer-readable compact discs and contain a copy of the Sequence Listing in ASCII text format filed under PCT Section 801(a). The Sequence Listing is named "MBI-0070-1CIP_ST25.txt" and is 4,887 kilobytes in size. The Sequence Listing files associated with these CD-ROMS were created on Jun. 5, 2008. The copies of the Sequence Listing on the CD-ROM discs are hereby incorporated by reference in their entirety.

FIG. 1 shows a conservative estimate of phylogenetic relationships among the orders of flowering plants (modified from Angiosperm Phylogeny Group (1998)). Those plants with a single cotyledon (monocots) are a monophyletic clade nested within at least two major lineages of dicots; the eudicots are further divided into rosids and asterids. *Arabidopsis* is a rosid eudicot classified within the order *Brassicales*; rice is a member of the monocot order Poales. FIG. 1 was adapted from Daly et al. (2001).

Figure 2:
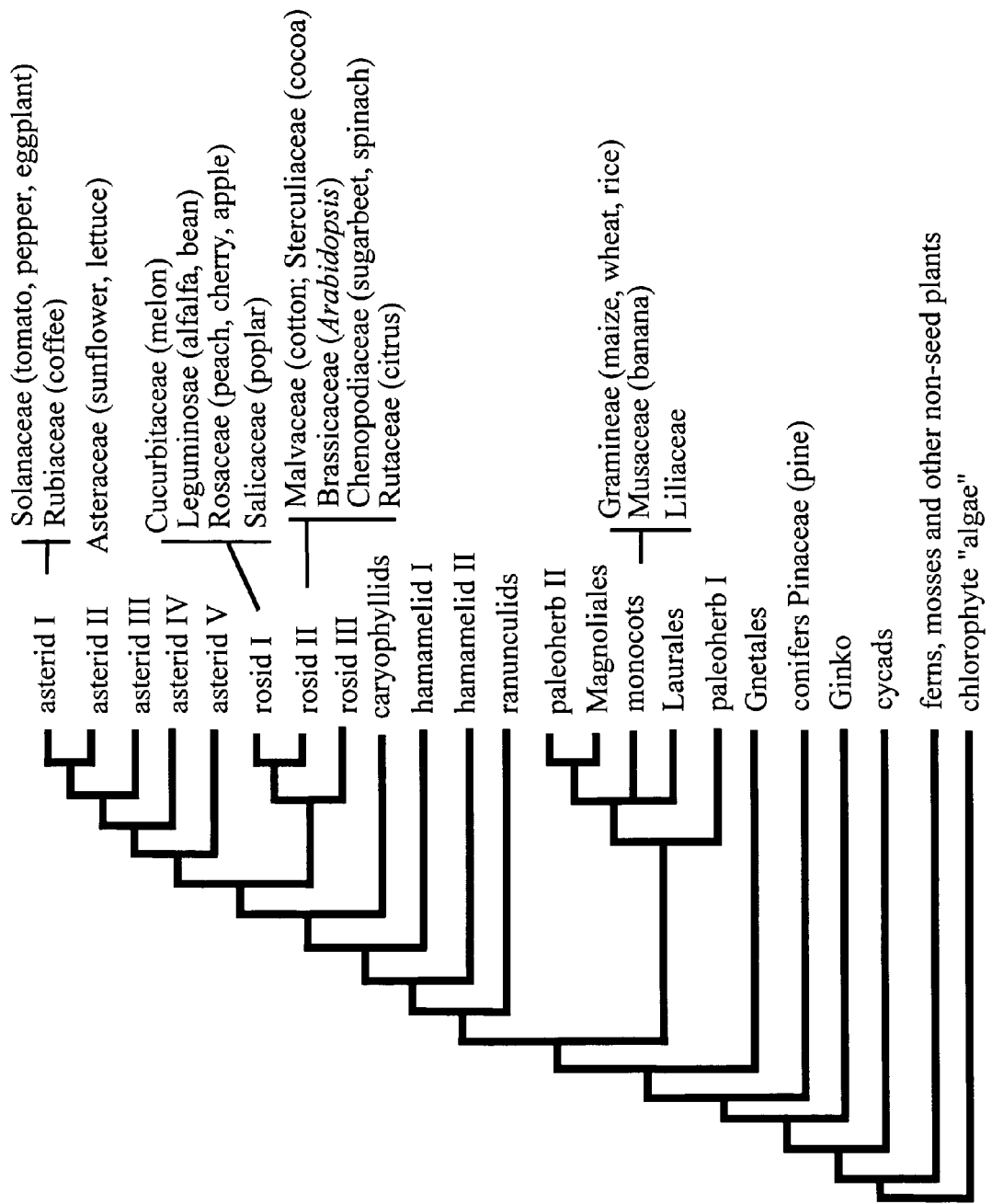

FIG. 2 shows a phylogenic dendogram depicting phylogenetic relationships of higher plant taxa, including clades containing tomato and *Arabidopsis*; adapted from Ku et al. (2000) and Chase et al. (1993).

Figure 3:
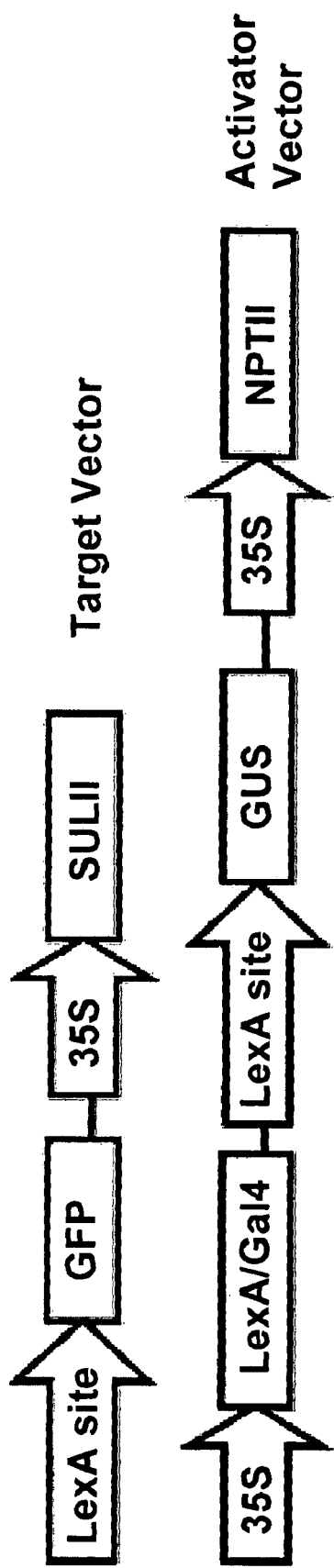

FIG. 3 is a schematic diagram of activator and target vectors used for transformation of tomato to achieve regulated expression of *Arabidopsis* transcription factors in tomato. The activator vector contained a promoter and a LexA-GAL4 or a-LacI-GAL4 transactivator (the transactivator comprises a LexA or LacI DNA binding domain fused to the GAL4 activation domain, and encodes a LexA-Gal4 or LacI-Gal4 transcriptional activator product), a GFP marker, and a neomycin phosphotransferase II (nptII) selectable marker. The target vector contains a transactivator binding site (opLexA) operably linked to a transgene encoding a polypeptide of interest (for example, a transcription factor of the invention), and a sulfonamide selectable marker (in this case, sulII; which encodes the dihydropteroate synthase enzyme for sulfonamide-resistance) necessary for the selection and identification of transformed plants. Binding of the transcriptional activator product encoded by the activator vector to the transactivator binding sites of the target vector initiates transcription of the transgenes of interest.

DESCRIPTION OF THE INVENTION

The present invention relates to polynucleotides for modifying phenotypes of plants, including those associated with improved plant or fruit yield, or improved fruit quality. Throughout this disclosure, various information sources are referred to and/or are specifically incorporated. The information sources include scientific journal articles, patent documents, textbooks, and World Wide Web browser-active and inactive page addresses, for example. While the reference to these information sources clearly indicates that they can be used by one of skill in the art, each and every one of the information sources cited herein are specifically incorporated in their entirety, whether or not a specific mention of "incorporation by reference" is noted. The contents and teachings of each and every one of the information sources can be relied on and used to make and use embodiments of the invention.

As used herein and in the appended claims, the singular forms "a," "an," and "the" include plural reference unless the context clearly dictates otherwise. Thus, for example, a reference to "a plant" includes a plurality of such plants.

Definitions

"Nucleic acid molecule" refers to an oligonucleotide, polynucleotide or any fragment thereof. It may be DNA or RNA of genomic or synthetic origin, double-stranded or single-stranded, and combined with carbohydrate, lipids, protein, or other materials to perform a particular activity such as transformation or form a useful composition such as a peptide nucleic acid (PNA).

"Polynucleotide" is a nucleic acid molecule comprising a plurality of polymerized nucleotides, e.g., at least about 15 consecutive polymerized nucleotides, optionally at least about 30 consecutive nucleotides, at least about 50 consecutive nucleotides. A polynucleotide may be a nucleic acid, oligonucleotide, nucleotide, or any fragment thereof. In many instances, a polynucleotide comprises a nucleotide sequence encoding a polypeptide (or protein) or a domain or fragment thereof. Additionally, the polynucleotide may comprise a promoter, an intron, an enhancer region, a polyadenylation site, a translation initiation site, 5' or 3' untranslated regions, a reporter gene, a selectable marker, or the like. The polynucleotide can be single stranded or double stranded DNA or RNA. The polynucleotide optionally comprises modified bases or a modified backbone. The polynucleotide can be, e.g., genomic DNA or RNA, a transcript (such as an mRNA), a cDNA, a polymerase chain reaction (PCR) product, a cloned DNA, a synthetic DNA or RNA, or the like. The polynucleotide can be combined with carbohydrate, lipids, protein, or other materials to perform a particular activity such as transformation or form a useful composition such as a peptide nucleic acid (PNA). The polynucleotide can comprise a sequence in either sense or antisense orientations. "Oligonucleotide" is substantially equivalent to the terms amplimer, primer, oligomer, element, target, and probe and is preferably single stranded.

"Gene" or "gene sequence" refers to the partial or complete coding sequence of a gene, its complement, and its 5' or 3' untranslated regions. A gene is also a functional unit of inheritance, and in physical terms is a particular segment or sequence of nucleotides along a molecule of DNA (or RNA, in the case of RNA viruses) involved in producing a polypeptide chain. The latter may be subjected to subsequent processing such as splicing and folding to obtain a functional protein or polypeptide. A gene may be isolated, partially isolated, or be found with an organism's genome. By way of example, a transcription factor gene encodes a transcription factor polypeptide, which may be functional or require processing to function as an initiator of transcription.

Operationally, genes may be defined by the cis-trans test, a genetic test that determines whether two mutations occur in the same gene and which may be used to determine the limits of the genetically active unit (Rieger et al. (1976)). A gene generally includes regions preceding ("leaders"; upstream) and following ("trailers"; downstream) of the coding region. A gene may also include intervening, non-coding sequences, referred to as "introns", located between individual coding segments, referred to as "exons". Most genes have an associated promoter region, a regulatory sequence 5' of the transcription initiation codon (there are some genes that do not have an identifiable promoter). The function of a gene may also be regulated by enhancers, operators, and other regulatory elements.

A "recombinant polynucleotide" is a polynucleotide that is not in its native state, e.g., the polynucleotide comprises a nucleotide sequence not found in nature, or the polynucleotide is in a context other than that in which it is naturally found, e.g., separated from nucleotide sequences with which it typically is in proximity in nature, or adjacent (or contiguous with) nucleotide sequences with which it typically is not in proximity. For example, the sequence at issue can be cloned into a vector, or otherwise recombined with one or more additional nucleic acid.

An "isolated polynucleotide" is a polynucleotide whether naturally occurring or recombinant, that is present outside the cell in which it is typically found in nature, whether purified or not. Optionally, an isolated polynucleotide is subject to one or more enrichment or purification procedures, e.g., cell lysis, extraction, centrifugation, precipitation, or the like.

A "polypeptide" is an amino acid sequence comprising a plurality of consecutive polymerized amino acid residues e.g., at least about 15 consecutive polymerized amino acid residues, optionally at least about 30 consecutive polymerized amino acid residues, at least about 50 consecutive polymerized amino acid residues. In many instances, a polypeptide comprises a polymerized amino acid residue sequence that is a transcription factor or a domain or portion or fragment thereof. Additionally, the polypeptide may comprise 1) a localization domain, 2) an activation domain, 3) a repression domain, 4) an oligomerization domain, or 5) a DNA-binding domain, or the like. The polypeptide optionally comprises modified amino acid residues, naturally occurring amino acid residues not encoded by a codon, non-naturally occurring amino acid residues.

"Protein" refers to an amino acid sequence, oligopeptide, peptide, polypeptide or portions thereof whether naturally occurring or synthetic.

"Portion", as used herein, refers to any part of a protein used for any purpose, but especially for the screening of a library of molecules which specifically bind to that portion or for the production of antibodies.

A "recombinant polypeptide" is a polypeptide produced by translation of a recombinant polynucleotide. A "synthetic polypeptide" is a polypeptide created by consecutive polymerization of isolated amino acid residues using methods well known in the art. An "isolated polypeptide," whether a naturally occurring or a recombinant polypeptide, is more enriched in (or out of) a cell than the polypeptide in its natural state in a wild-type cell, e.g., more than about 5% enriched, more than about 10% enriched, or more than about 20%, or more than about 50%, or more, enriched, i.e., alternatively denoted: 105%, 110%, 120%, 150% or more, enriched relative to wild type standardized at 100%. Such an enrichment is not the result of a natural response of a wild-type plant. Alternatively, or additionally, the isolated polypeptide is separated from other cellular components with which it is typically associated, e.g., by any of the various protein purification methods herein.

"Homology" refers to sequence similarity between a reference sequence and at least a fragment of a newly sequenced clone insert or its encoded amino acid sequence. Additionally, the terms "homology" and "homologous sequence(s)" may refer to one or more polypeptide sequences that are modified by chemical or enzymatic means. The homologous sequence may be a sequence modified by lipids, sugars, peptides, organic or inorganic compounds, by the use of modified amino acids or the like. Protein modification techniques are illustrated in Ausubel et al. (1998).

"Identity" or "similarity" refers to sequence similarity between two polynucleotide sequences or between two polypeptide sequences, with identity being a more strict comparison. The phrases "percent identity" and "% identity" refer to the percentage of sequence similarity found in a comparison of two or more polynucleotide sequences or two or more polypeptide sequences. "Sequence similarity" refers to the percent similarity in base pair sequence (as determined by any suitable method) between two or more polynucleotide sequences. Two or more sequences can be anywhere from 0-100% similar, or any integer value therebetween. Identity or similarity can be determined by comparing a position in each sequence that may be aligned for purposes of comparison. When a position in the compared sequence is occupied by the same nucleotide base or amino acid, then the molecules are identical at that position. A degree of similarity or identity between polynucleotide sequences is a function of the number of identical or matching nucleotides at positions shared by the polynucleotide sequences. A degree of identity of polypeptide sequences is a function of the number of identical amino acids at positions shared by the polypeptide sequences. A degree of homology or similarity of polypeptide sequences is a function of the number of amino acids at positions shared by the polypeptide sequences.

With regard to polypeptides, the terms "substantial identity" or "substantially identical" may refer to sequences of sufficient similarity and structure to the transcription factors in the Sequence Listing to produce similar function when expressed, overexpressed, or knocked-out in a plant; in the present invention, this function is improved yield and/or fruit quality. Polypeptide sequences that are at least about 55% identical to the instant polypeptide sequences are considered to have "substantial identity" with the latter. Sequences having lesser degrees of identity but comparable biological activity are considered to be equivalents. The structure required to maintain proper functionality is related to the tertiary structure of the polypeptide. There are discreet domains and motifs within a transcription factor that must be present within the polypeptide to confer function and specificity. These specific structures are required so that interactive sequences will be properly oriented to retain the desired activity. "Substantial identity" may thus also be used with regard to subsequences, for example, motifs that are of sufficient structure and similarity, being at least about 55% identical to similar motifs in other related sequences. Thus, related polypeptides within the G1421 clade have the physical characteristics of substantial identity along their full length and within their AP2-related domains. These polypeptides also share functional characteristics, as the polypeptides within this clade bind to a transcription-regulating region of DNA and improve yield and/or fruit quality in a plant when the polypeptides are overexpressed.

"Alignment" refers to a number of nucleotide or amino acid residue sequences aligned by lengthwise comparison so that components in common (i.e., nucleotide bases or amino acid residues) may be visually and readily identified. The fraction or percentage of components in common is related to the homology or identity between the sequences. Alignments may be used to identify conserved domains and relatedness within these domains. An alignment may suitably be determined by means of computer programs known in the art, such as MacVector (1999) (Accelrys, Inc., San Diego, Calif.).

A "conserved domain" or "conserved region" as used herein refers to a region in heterologous polynucleotide or polypeptide sequences where there is substantial identity between the distinct sequences. bZIPT2-related domains are examples of conserved domains. With respect to polynucleotides encoding presently disclosed transcription factors, a conserved domain is encoded by a sequence preferably at least 10 base pairs (bp) in length. A conserved domain, with respect to presently disclosed polypeptides refers to a domain within a transcription factor family that exhibits a higher degree of sequence homology or substantial identity, such as at least 55%, at least about 56%, at least about 57%, at least about 58%, at least about 59%, at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or about 100% amino acid residue sequence identity to a polypeptide sequence of consecutive amino acid residues such as those of the polypeptides found in the present Sequence Listing.

A fragment or domain can be referred to as outside a conserved domain, outside a consensus sequence, or outside a consensus DNA-binding site that is known to exist or that exists for a particular transcription factor class, family, or sub-family. In this case, the fragment or domain will not include the exact amino acids of a consensus sequence or consensus DNA-binding site of a transcription factor class, family or sub-family, or the exact amino acids of a particular transcription factor consensus sequence or consensus DNA-binding site. Furthermore, a particular fragment, region, or domain of a polypeptide, or a polynucleotide encoding a polypeptide, can be "outside a conserved domain" if all the amino acids of the fragment, region, or domain fall outside of a defined conserved domain(s) for a polypeptide or protein. Sequences having lesser degrees of identity but comparable biological activity are considered to be equivalents.

As one of ordinary skill in the art recognizes, conserved domains may be identified as regions or domains of identity to a specific consensus sequence. Thus, by using alignment methods well known in the art, the conserved domains of the plant transcription factors of the invention (e.g., bZIPT2, MYB-related, CCAAT-box binding, AP2, and AT-hook family transcription factors) may be determined. An alignment of any of the polypeptides of the invention with another polypeptide allows one of skill in the art to identify conserved domains for any of the polypeptides listed or referred to in this disclosure.

"Complementary" refers to the natural hydrogen bonding by base pairing between purines and pyrimidines. For example, the sequence A-C-G-T (5'->3') forms hydrogen bonds with its complements A-C-G-T (5'->3') or A-C-G-U (5'->3'). Two single-stranded molecules may be considered partially complementary, if only some of the nucleotides bond, or "completely complementary" if all of the nucleotides bond. The degree of complementarity between nucleic acid strands affects the efficiency and strength of the hybridization and amplification reactions. "Fully complementary" refers to the case where bonding occurs between every base pair and its complement in a pair of sequences, and the two sequences have the same number of nucleotides.

The terms "highly stringent" or "highly stringent condition" refer to conditions that permit hybridization of DNA strands whose sequences are highly complementary, wherein these same conditions exclude hybridization of significantly mismatched DNAs. Polynucleotide sequences capable of hybridizing under stringent conditions with the polynucleotides of the present invention may be, for example, variants of the disclosed polynucleotide sequences, including allelic or splice variants, or sequences that encode orthologs or paralogs of presently disclosed polypeptides. Nucleic acid hybridization methods are disclosed in detail by Kashima et al. (1985), Sambrook et al. (1989), and by Hames and Higgins (1985), which references are incorporated herein by reference.

In general, stringency is determined by the temperature, ionic strength, and concentration of denaturing agents (e.g., formamide) used in a hybridization and washing procedure (for a more detailed description of establishing and determining stringency, see below). The degree to which two nucleic acids hybridize under various conditions of stringency is correlated with the extent of their similarity. Thus, similar nucleic acid sequences from a variety of sources, such as within a plant's genome (as in the case of paralogs) or from another plant (as in the case of orthologs) that may perform similar functions can be isolated on the basis of their ability to hybridize with known transcription factor sequences. Numerous variations are possible in the conditions and means by which nucleic acid hybridization can be performed to isolate transcription factor sequences having similarity to transcription factor sequences known in the art and are not limited to those explicitly disclosed herein. Such an approach may be used to isolate polynucleotide sequences having various degrees of similarity with disclosed transcription factor sequences, such as, for example, transcription factors having 60% identity, or more preferably greater than about 70% identity, most preferably 72% or greater identity with disclosed transcription factors.

The terms "paralog" and "ortholog" are defined below in the section entitled "Orthologs and Paralogs". In brief, orthologs and paralogs are evolutionarily related genes that have similar sequences and functions. Orthologs are structurally related genes in different species that are derived by a speciation event. Paralogs are structurally related genes within a single species that are derived by a duplication event.

The term "equivalog" describes members of a set of homologous proteins that are conserved with respect to function since their last common ancestor. Related proteins are grouped into equivalog families, and otherwise into protein families with other hierarchically defined homology types. This definition is provided at the Institute for Genomic Research (TIGR) World Wide Web (www) website, "tigr.org" under the heading "Terms associated with TIGRFAMs".

The term "variant", as used herein, may refer to polynucleotides or polypeptides that differ from the presently disclosed polynucleotides or polypeptides, respectively, in sequence from each other, and as set forth below.

With regard to polynucleotide variants, differences between presently disclosed polynucleotides and polynucleotide variants are limited so that the nucleotide sequences of the former and the latter are closely similar overall and, in many regions, identical. Due to the degeneracy of the genetic code, differences between the former and latter nucleotide sequences may be silent (i.e., the amino acids encoded by the polynucleotide are the same, and the variant polynucleotide sequence encodes the same amino acid sequence as the presently disclosed polynucleotide. Variant nucleotide sequences may encode different amino acid sequences, in which case such nucleotide differences will result in amino acid substitutions, additions, deletions, insertions, truncations or fusions with respect to the similar disclosed polynucleotide sequences. These variations result in polynucleotide variants encoding polypeptides that share at least one functional characteristic. The degeneracy of the genetic code also dictates that many different variant polynucleotides can encode identical and/or substantially similar polypeptides in addition to those sequences illustrated in the Sequence Listing.

Also within the scope of the invention is a variant of a transcription factor nucleic acid listed in the Sequence Listing, that is, one having a sequence that differs from the one of the polynucleotide sequences in the Sequence Listing, or a complementary sequence, that encodes a functionally equivalent polypeptide (i.e., a polypeptide having some degree of equivalent or similar biological activity) but differs in sequence from the sequence in the Sequence Listing, due to degeneracy in the genetic code. Included within this definition are polymorphisms that may or may not be readily detectable using a particular oligonucleotide probe of the polynucleotide encoding polypeptide, and improper or unexpected hybridization to allelic variants, with a locus other than the normal chromosomal locus for the polynucleotide sequence encoding polypeptide.

"Allelic variant" or "polynucleotide allelic variant" refers to any of two or more alternative forms of a gene occupying the same chromosomal locus. Allelic variation arises naturally through mutation, and may result in phenotypic polymorphism within populations. Gene mutations may be "silent" or may encode polypeptides having altered amino acid sequence. "Allelic variant" and "polypeptide allelic variant" may also be used with respect to polypeptides, and in this case the terms refer to a polypeptide encoded by an allelic variant of a gene.

"Splice variant" or "polynucleotide splice variant" as used herein refers to alternative forms of RNA transcribed from a gene. Splice variation naturally occurs as a result of alternative sites being spliced within a single transcribed RNA molecule or between separately transcribed RNA molecules, and may result in several different forms of mRNA transcribed from the same gene. This, splice variants may encode polypeptides having different amino acid sequences, which may or may not have similar functions in the organism. "Splice variant" or "polypeptide splice variant" may also refer to a polypeptide encoded by a splice variant of a transcribed mRNA.

As used herein, "polynucleotide variants" may also refer to polynucleotide sequences that encode paralogs and orthologs of the presently disclosed polypeptide sequences. "Polypeptide variants" may refer to polypeptide sequences that are paralogs and orthologs of the presently disclosed polypeptide sequences.

Differences between presently disclosed polypeptides and polypeptide variants are limited so that the sequences of the former and the latter are closely similar overall and, in many regions, identical. Presently disclosed polypeptide sequences and similar polypeptide variants may differ in amino acid sequence by one or more substitutions, additions, deletions, fusions and truncations, which may be present in any combination. These differences may produce silent changes and result in a functionally equivalent transcription factor. Thus, it will be readily appreciated by those of skill in the art, that any of a variety of polynucleotide sequences is capable of encoding the transcription factors and transcription factor homolog polypeptides of the invention. A polypeptide sequence variant may have "conservative" changes, wherein a substituted amino acid has similar structural or chemical properties. Deliberate amino acid substitutions may thus be made on the basis of similarity in polarity, charge, solubility, hydrophobicity, hydrophilicity, and/or the amphipathic nature of the residues, as long as the functional or biological activity of the transcription factor is retained. For example, negatively charged amino acids may include aspartic acid and glutamic acid, positively charged amino acids may include lysine and arginine, and amino acids with uncharged polar head groups having similar hydrophilicity values may include leucine, isoleucine, and valine; glycine and alanine; asparagine and glutamine; serine and threonine; and phenylalanine and tyrosine. More rarely, a variant may have "non-conservative" changes, for example, replacement of a glycine with a tryptophan. Similar minor variations may also include amino acid deletions or insertions, or both. Related polypeptides may comprise, for example, additions and/or deletions of one or more N-linked or O-linked glycosylation sites, or an addition and/or a deletion of one or more cysteine residues. Guidance in determining which and how many amino acid residues may be substituted, inserted or deleted without abolishing functional or biological activity may be found using computer programs well known in the art, for example, DNASTAR software (see U.S. Pat. No. 5,840,544).

"Fragment", with respect to a polynucleotide, refers to a clone or any part of a polynucleotide molecule that retains a usable, functional characteristic. Useful fragments include oligonucleotides and polynucleotides that may be used in hybridization or amplification technologies or in the regulation of replication, transcription or translation. A polynucleotide fragment" refers to any subsequence of a polynucleotide, typically, of at least about 9 consecutive nucleotides, preferably at least about 30 nucleotides, more preferably at least about 50 nucleotides, of any of the sequences provided herein. Exemplary polynucleotide fragments are the first sixty consecutive nucleotides of the transcription factor polynucleotides listed in the Sequence Listing. Exemplary fragments also include fragments that comprise a region that encodes an conserved domain of a transcription factor. Exemplary fragments also include fragments that comprise a conserved domain of a transcription factor. Exemplary fragments include fragments that comprise a conserved domain of a transcription factor, for example, amino acids: 84-146 of G1421, SEQ ID NO: 146, or 59-150 of G1818, SEQ ID NO: 202, or 9-111 of G663, SEQ ID NO: 66, which comprise, are comprised within, or approximate, the AP2 DNA binding domain, the CAAT DNA binding/subunit association domains, or the SANT/Myb DNA binding domain of these polypeptides, respectively.

Fragments may also include subsequences of polypeptides and protein molecules, or a subsequence of the polypeptide. Fragments may have uses in that they may have antigenic potential. In some cases, the fragment or domain is a subsequence of the polypeptide which performs at least one biological function of the intact polypeptide in substantially the same manner, or to a similar extent, as does the intact polypeptide. For example, a polypeptide fragment can comprise a recognizable structural motif or functional domain such as a DNA-binding site or domain that binds to a DNA promoter region, an activation domain, or a domain for protein-protein interactions, and may initiate transcription. Fragments can vary in size from as few as three amino acid residues to the full length of the intact polypeptide, but are preferably at least about 30 amino acid residues in length and more preferably at least about 60 amino acid residues in length.

The invention also encompasses production of DNA sequences that encode transcription factors and transcription factor derivatives, or fragments thereof, entirely by synthetic chemistry. After production, the synthetic sequence may be inserted into any of the many available expression vectors and cell systems using reagents well known in the art. Moreover, synthetic chemistry may be used to introduce mutations into a sequence encoding transcription factors or any fragment thereof.

"Derivative" refers to the chemical modification of a nucleic acid molecule or amino acid sequence. Chemical modifications can include replacement of hydrogen by an alkyl, acyl, or amino group or glycosylation, pegylation, or any similar process that retains or enhances biological activity or lifespan of the molecule or sequence.

The term "plant" includes whole plants, shoot vegetative organs/structures (for example, leaves, stems and tubers), roots, flowers and floral organs/structures (for example, bracts, sepals, petals, stamens, carpels, anthers and ovules), seed (including embryo, endosperm, and seed coat) and fruit (the mature ovary), plant tissue (for example, vascular tissue, ground tissue, and the like) and cells for example, guard cells, egg cells, and the like), and progeny of same. The class of plants that can be used in the method of the invention is generally as broad as the class of higher and lower plants amenable to transformation techniques, including angiosperms (monocotyledonous and dicotyledonous plants), gymnosperms, ferns, horsetails, psilophytes, lycophytes, bryophytes, and multicellular algae (see for example, FIG. 1, adapted from Daly et al. (2001); FIG. 2, adapted from Ku et al. (2000); and see also Tudge (2000).

A "transgenic plant" refers to a plant that contains genetic material not found in a wild-type plant of the same species, variety or cultivar. The genetic material may include a transgene, an insertional mutagenesis event (such as by transposon or T-DNA insertional mutagenesis), an activation tagging sequence, a mutated sequence, a homologous recombination event or a sequence modified by chimeraplasty. Typically, the foreign genetic material has been introduced into the plant by human manipulation, but any method can be used as one of skill in the art recognizes. A transgenic plant includes transformed or transgenic seed that comprise an expression vector or polynucleotide of the invention.

A transgenic plant may contain an expression vector or cassette. The expression cassette typically comprises a polypeptide-encoding sequence operably linked (i.e., under regulatory control of) to appropriate inducible or constitutive regulatory sequences that allow for the controlled expression of polypeptide. The expression cassette can be introduced into a plant by transformation or by breeding after transformation of a parent plant. A plant refers to a whole plant as well as to a plant part, such as seed, fruit, leaf, or root, plant tissue, plant cells or any other plant material, e.g., a plant explant, as well as to progeny thereof, and to in vitro systems that mimic biochemical or cellular components or processes in a cell.

"Wild type" or "wild-type", as used herein, refers to a plant cell, seed, plant component, plant tissue, plant organ or whole plant that has not been genetically modified or treated in an experimental sense. Wild-type cells, seed, components, tissue, organs or whole plants may be used as controls to compare levels of expression and the extent and nature of trait modification with cells, tissue or plants of the same species in which a transcription factor expression is altered, e.g., in that it has been knocked out, overexpressed, or ectopically expressed.

A "control plant" as used in the present invention refers to a plant cell, seed, plant component, plant tissue, plant organ or whole plant used to compare against transgenic or genetically modified plant for the purpose of identifying an enhanced phenotype in the transgenic or genetically modified plant. A control plant may in some cases be a transgenic plant line that comprises an empty vector or marker gene, but does not contain the recombinant polynucleotide of the present invention that is expressed in the transgenic or genetically modified plant being evaluated. In general, a control plant is a plant of the same line or variety as the transgenic or genetically modified plant being tested. A suitable control plant would include a genetically unaltered or non-transgenic plant of the parental line used to generate a transgenic plant herein.

A "trait" refers to a physiological, morphological, biochemical, or physical characteristic of a plant or particular plant material or cell. In some instances, this characteristic is visible to the human eye, such as seed or plant size, or can be measured by biochemical techniques, such as detecting the protein, starch, or oil content of seed or leaves, or by observation of a metabolic or physiological process, e.g. by measuring tolerance to water deprivation or particular salt or sugar concentrations, or by the observation of the expression level of a gene or genes, e.g., by employing Northern analysis, RT-PCR, microarray gene expression assays, or reporter gene expression systems, or by agricultural observations such as osmotic stress tolerance or yield. Any technique can be used to measure the amount of, comparative level of, or difference in any selected chemical compound or macromolecule in the transgenic plants, however.

"Trait modification" refers to a detectable difference in a characteristic in a plant ectopically expressing a polynucleotide or polypeptide of the present invention relative to a plant not doing so, such as a wild-type plant. In some cases, the trait modification can be evaluated quantitatively. For example, the trait modification can entail at least about a 2% increase or decrease, or an even greater difference, in an observed trait as compared with a control or wild-type plant. It is known that there can be a natural variation in the modified trait. Therefore, the trait modification observed entails a change of the normal distribution and magnitude of the trait in the plants as compared to control or wild-type plants.

When two or more plants have "similar morphologies", "substantially similar morphologies", "a morphology that is substantially similar", or are "morphologically similar", the plants have comparable forms or appearances, including analogous features such as overall dimensions, height, width, mass, root mass, shape, glossiness, color, stem diameter, leaf size, leaf dimension, leaf density, internode distance, branching, root branching, number and form of inflorescences, and other macroscopic characteristics, and the individual plants are not readily distinguishable based on morphological characteristics alone.

"Modulates" refers to a change in activity (biological, chemical, or immunological) or lifespan resulting from specific binding between a molecule and either a nucleic acid molecule or a protein.

The term "transcript profile" refers to the expression levels of a set of genes in a cell in a particular state, particularly by comparison with the expression levels of that same set of genes in a cell of the same type in a reference state. For example, the transcript profile of a particular transcription factor in a suspension cell is the expression levels of a set of genes in a cell knocking out or overexpressing that transcription factor compared with the expression levels of that same set of genes in a suspension cell that has normal levels of that transcription factor. The transcript profile can be presented as a list of those genes whose expression level is significantly different between the two treatments, and the difference ratios. Differences and similarities between expression levels may also be evaluated and calculated using statistical and clustering methods.

"Ectopic expression" or "altered expression" in reference to a polynucleotide indicates that the pattern of expression in, e.g., a transgenic plant or plant tissue, is different from the expression pattern in a wild-type or control plant of the same species. The pattern of expression may also be compared with a reference expression pattern in a wild-type plant of the same species. For example, the polynucleotide or polypeptide is expressed in a cell or tissue type other than a cell or tissue type in which the sequence is expressed in the wild-type plant, or by expression at a time other than at the time the sequence is expressed in the wild-type plant, or by a response to different inducible agents, such as hormones or environmental signals, or at different expression levels (either higher or lower) compared with those found in a wild-type plant. The term also refers to altered expression patterns that are produced by lowering the levels of expression to below the detection level or completely abolishing expression. The resulting expression pattern can be transient or stable, constitutive or inducible. In reference to a polypeptide, the term "ectopic expression or altered expression" further may relate to altered activity levels resulting from the interactions of the polypeptides with exogenous or endogenous modulators or from interactions with factors or as a result of the chemical modification of the polypeptides.

The term "overexpression" as used herein refers to a greater expression level of a gene in a plant, plant cell or plant tissue, compared to expression in a wild-type plant, cell or tissue, at any developmental or temporal stage for the gene. Overexpression can occur when, for example, the genes encoding one or more transcription factors are under the control of a strong promoter (e.g., the cauliflower mosaic virus 35S transcription initiation region). Overexpression may also under the control of an inducible or tissue specific promoter. Thus, overexpression may occur throughout a plant, in specific tissues of the plant, or in the presence or absence of particular environmental signals, depending on the promoter used.

Overexpression may take place in plant cells normally lacking expression of polypeptides functionally equivalent or identical to the present transcription factors. Overexpression may also occur in plant cells where endogenous expression of the present transcription factors or functionally equivalent molecules normally occurs, but such normal expression is at a lower level. Overexpression thus results in a greater than normal production, or "overproduction" of the transcription factor in the plant, cell or tissue.

The term "transcription regulating region" refers to a DNA regulatory sequence that regulates expression of one or more genes in a plant when a transcription factor having one or more specific binding domains binds to the DNA regulatory sequence. Transcription factors of the present invention generally possess at least one conserved domain characteristic of a particular transcription factor family. Examples of such conserved domains of the sequences of the invention may be found in Table 6. The transcription factors of the invention may also comprise an amino acid subsequence that forms a transcription activation domain that regulates expression of one or more abiotic stress tolerance genes in a plant when the transcription factor binds to the regulating region.

DETAILED DESCRIPTION

Transcription Factors Modify Expression of Endogenous Genes

A transcription factor may include, but is not limited to, any polypeptide that can activate or repress transcription of a single gene or a number of genes. As one of ordinary skill in the art recognizes, transcription factors can be identified by the presence of a region or domain of structural similarity or identity to a specific consensus sequence or the presence of a specific consensus DNA-binding site or DNA-binding site motif (see, for example, Riechmann et al. (2000). The plant transcription factors may belong to, for example, the bZIPT2-related or other transcription factor families.

Generally, the transcription factors encoded by the present sequences are involved in cell differentiation and proliferation and the regulation of growth. Accordingly, one skilled in the art would recognize that by expressing the present sequences in a plant, one may change the expression of autologous genes or induce the expression of introduced genes. By affecting the expression of similar autologous sequences in a plant that have the biological activity of the present sequences, or by introducing the present sequences into a plant, one may alter a plant's phenotype to one with improved traits related to improved yield and/or fruit quality. The sequences of the invention may also be used to transform a plant and introduce desirable traits not found in the wild-type cultivar or strain. Plants may then be selected for those that produce the most desirable degree of over- or under-expression of target genes of interest and coincident trait improvement.

The sequences of the present invention may be from any species, particularly plant species, in a naturally occurring form or from any source whether natural, synthetic, semi-synthetic or recombinant. The sequences of the invention may also include fragments of the present amino acid sequences. Where "amino acid sequence" is recited to refer to an amino acid sequence of a naturally occurring protein molecule, "amino acid sequence" and like terms are not meant to limit the amino acid sequence to the complete native amino acid sequence associated with the recited protein molecule.

In addition to methods for modifying a plant phenotype by employing one or more polynucleotides and polypeptides of the invention described herein, the polynucleotides and polypeptides of the invention have a variety of additional uses. These uses include their use in the recombinant production (i.e., expression) of proteins; as regulators of plant gene expression, as diagnostic probes for the presence of complementary or partially complementary nucleic acids (including for detection of natural coding nucleic acids); as substrates for further reactions, for example, mutation reactions, PCR reactions, or the like; as substrates for cloning for example, including digestion or ligation reactions; and for identifying exogenous or endogenous modulators of the transcription factors. In many instances, a polynucleotide comprises a nucleotide sequence encoding a polypeptide (or protein) or a domain or fragment thereof. Additionally, the polynucleotide may comprise a promoter, an intron, an enhancer region, a polyadenylation site, a translation initiation site, 5' or 3' untranslated regions, a reporter gene, a selectable marker, or the like. The polynucleotide can be single stranded or double stranded DNA or RNA. The polynucleotide optionally comprises modified bases or a modified backbone. The polynucleotide can be, for example, genomic DNA or RNA, a transcript (such as an mRNA), a cDNA, a PCR product, a cloned DNA, a synthetic DNA or RNA, or the like. The polynucleotide can comprise a sequence in either sense or antisense orientations.

Expression of genes that encode transcription factors that modify expression of endogenous genes, polynucleotides, and proteins are well known in the art. In addition, transgenic plants comprising isolated polynucleotides encoding transcription factors may also modify expression of endogenous genes, polynucleotides, and proteins. Examples include Peng et al. (1997) and Peng et al. (1999). In addition, many others have demonstrated that an *Arabidopsis* transcription factor expressed in an exogenous plant species elicits the same or very similar phenotypic response (see, for example, Fu et al. (2001); Nandi et al. (2000); Coupland (1995); and Weigel and Nilsson (1995)).

In another example, Mandel et al. (1992b) and Suzuki et al. (2001) teach that a transcription factor expressed in another plant species elicits the same or very similar phenotypic response of the endogenous sequence, as often predicted in earlier studies of *Arabidopsis* transcription factors in *Arabidopsis* (see Mandel et al. (1992b); Suzuki et al. (2001)).

Other examples include Müller et al. (2001); Kim et al. (2001); Kyozuka and Shimamoto (2002); Boss and Thomas (2002); He et al. (2000); and Robson et al. (2001).

In yet another example, Gilmour et al. (1998) teach an *Arabidopsis* AP2 transcription factor, CBF1, which, when overexpressed in transgenic plants, increases plant freezing tolerance. Jaglo et al. (2001) further identified sequences in *Brassica napus* that encode CBF-like genes and that transcripts for these genes accumulated rapidly in response to low temperature. Transcripts encoding CBF-like proteins were also found to accumulate rapidly in response to low temperature in wheat, as well as in tomato. An alignment of the CBF proteins from *Arabidopsis, B. napus*, wheat, rye, and tomato revealed the presence of conserved consecutive amino acid residues which bracket the AP2/EREBP DNA binding domains of the proteins and distinguish them from other members of the AP2/EREBP protein family (Jaglo et al. (2001).

Transcription factors mediate cellular responses and control traits through altered expression of genes containing cis-acting nucleotide sequences that are targets of the introduced transcription factor. It is well appreciated in the art that the effect of a transcription factor on cellular responses or a cellular trait is determined by the particular genes whose expression is either directly or indirectly (for example, by a cascade of transcription factor binding events and transcriptional changes) altered by transcription factor binding. In a global analysis of transcription comparing a standard condition with one in which a transcription factor is overexpressed, the resulting transcript profile associated with transcription factor overexpression is related to the trait or cellular process controlled by that transcription factor. For example, the PAP2 gene and other genes in the MYB family have been shown to control anthocyanin biosynthesis through regulation of the expression of genes known to be involved in the anthocyanin biosynthetic pathway (Bruce et al. (2000); Borevitz et al. (2000)). Further, global transcript profiles have been used successfully as diagnostic tools for specific cellular states (for example, cancerous vs. non-cancerous; Bhattacharjee et al. (2001); Xu et al. (2001)). Consequently, it is evident to one skilled in the art that similarity of transcript profile upon overexpression of different transcription factors would indicate similarity of transcription factor function.

Polypeptides and Polynucleotides of the Invention

The present invention provides, among other things, transcription factors, and transcription factor homolog polypeptides, and isolated or recombinant polynucleotides encoding the polypeptides, or novel sequence variant polypeptides or polynucleotides encoding novel variants of transcription factors derived from the specific sequences provided here.

Transcription factors are generally characterized by at least two domains responsible for transcription regulatory activity. Transcription factor domains are art-recognized and may be identified in published sequences, e.g., in a database available from the "National Center for Biotechnology Information "NCBI", or with a publicly available database that may be used to conduct a domain-oriented specialized search such as with the NCBI Conserved Domain Database. These domains may include a 1) a localization domain; 2) an activation domain; 3) a repression domain; 4) an oligomerization domain for protein-protein interactions; or 5) a DNA binding domain that activates transcription. DNA binding domains, for example, tend to be recognizable domains that are used to identify sequences within a particular transcription factor family, and, as with all these domains, are known to be correlated with transcription factor function. Conservative mutations within these domains will result in closely related transcription factor polypeptides having similar activity transcription regulatory activity and functions in plant cells. Although all conservative amino acid substitutions in these domains will not necessarily result in the closely related transcription factors having DNA binding or regulatory activity, those of ordinary skill in the art would expect that many of these conservative substitutions would result in a protein having the DNA binding or regulatory activity. Further, amino acid substitutions outside of the functional domains and other conserved domains in the closely related transcription factor polypeptides are unlikely to greatly affect activity the regulatory activity of the transcription factors.

The polynucleotides of the invention can be or were ectopically expressed in overexpressor plant cells and the changes in the expression levels of a number of genes, polynucleotides, and/or proteins of the plant cells observed. Therefore, the polynucleotides and polypeptides can be employed to change expression levels of a genes, polynucleotides, and/or proteins of plants. These polypeptides and polynucleotides may be employed to modify a plant's characteristics, particularly improvement of yield and/or fruit quality. The polynucleotides of the invention can be or were ectopically expressed in overexpressor or knockout plants and the changes in the characteristic(s) or trait(s) of the plants observed. Therefore, the polynucleotides and polypeptides can be employed to improve the characteristics of plants. The polypeptide sequences of the sequence listing, including *Arabidopsis* sequences, such as those in Table 6, conferred improved characteristics when these polypeptides were overexpressed in tomato plants. These polynucleotides have been shown to confer bright coloration, dark leaf color, etiolated seedlings, increased anthocyanin in leaves, increased anthocyanin in flowers, and increased anthocyanin in fruit, increased seedling anthocyanin, increased seedling vigor, longer internodes, more anthocyanin, more trichomes, and/or fewer trichomes. Paralogs and orthologs of these sequences, listed herein, are expected to function in a similar manner by increasing these positive effects on fruit quality and/or yield.

The invention also encompasses sequences that are complementary to the polynucleotides of the invention. The polynucleotides are also useful for screening libraries of molecules or compounds for specific binding and for creating transgenic plants having improved yield and/or fruit quality. Altering the expression levels of equivalogs of these sequences, including paralogs and orthologs in the Sequence Listing, and other orthologs that are structurally and sequentially similar to the former orthologs, has been shown and is expected to confer similar phenotypes, including improved biomass, yield and/or fruit quality in plants.

In some cases, exemplary polynucleotides encoding the polypeptides of the invention were identified in the *Arabidopsis thaliana* GenBank database using publicly available sequence analysis programs and parameters. Sequences initially identified were then further characterized to identify sequences comprising specified sequence strings corresponding to sequence motifs present in families of known transcription factors. In addition, further exemplary polynucleotides encoding the polypeptides of the invention were identified in the plant GenBank database using publicly available sequence analysis programs and parameters. Sequences initially identified were then further characterized to identify sequences comprising specified sequence strings corresponding to sequence motifs present in families of known transcription factors. Polynucleotide sequences meeting such criteria were confirmed as transcription factors.

Additional polynucleotides of the invention were identified by screening *Arabidopsis thaliana* and/or other plant cDNA libraries with probes corresponding to known transcription factors under low stringency hybridization conditions. Additional sequences, including full length coding sequences were subsequently recovered by the rapid amplification of cDNA ends (RACE) procedure, using a commercially available kit according to the manufacturer's instructions. Where necessary, multiple rounds of RACE are performed to isolate 5' and 3' ends. The full-length cDNA was then recovered by a routine end-to-end PCR using primers specific to the isolated 5' and 3' ends. Exemplary sequences are provided in the Sequence Listing.

The invention also entails an agronomic composition comprising a polynucleotide of the invention in conjunction with a suitable carrier and a method for altering a plant's trait using the composition.

Examples of specific polynucleotide and polypeptides of the invention, and equivalog sequences, along with descriptions of the gene families that comprise these polynucleotides and polypeptides, are provided in Table 6, in the Sequence Listing, and in the description provided below.

Homologous Sequences

Sequences homologous, i.e., that share significant sequence identity or similarity, to those provided in the Sequence Listing, derived from *Arabidopsis thaliana* or from other plants of choice, are also an aspect of the invention. Homologous sequences can be derived from any plant including monocots and dicots and in particular agriculturally important plant species, including but not limited to, crops such as soybean, wheat, corn (maize), potato, cotton, rice, rape, oilseed rape (including canola), sunflower, alfalfa, clover, sugarcane, and turf; or fruits and vegetables, such as banana, blackberry, blueberry, strawberry, and raspberry, cantaloupe, carrot, cauliflower, coffee, cucumber, eggplant, grapes, honeydew, lettuce, mango, melon, onion, papaya, peas, peppers, pineapple, pumpkin, spinach, squash, sweet corn, tobacco, tomato, tomatillo, watermelon, rosaceous fruits (such as apple, peach, pear, cherry and plum) and vegetable brassicas (such as broccoli, cabbage, cauliflower, Brussels sprouts, and kohlrabi). Other crops, including fruits and vegetables, whose phenotype can be changed and which comprise homologous sequences include barley; rye; millet; sorghum; currant; avocado; citrus fruits such as oranges, lemons, grapefruit and tangerines, artichoke, cherries; nuts such as the walnut and peanut; endive; leek; roots such as arrowroot, beet, cassava, turnip, radish, yam, and sweet potato; and beans. The homologous sequences may also be derived from woody species, such pine, poplar and eucalyptus, or mint or other labiates. In addition, homologous sequences may be derived from plants that are evolutionarily related to crop plants, but which may not have yet been used as crop plants. Examples include deadly nightshade (*Atropa belladona*), related to tomato; jimson weed (*Datura strommium*), related to peyote; and teosinte (*Zea* species), related to corn (maize).

Homologous sequences can comprise orthologous or paralogous sequences, described below. Several different methods are known by those of skill in the art for identifying and defining these functionally homologous sequences. General methods for identifying orthologs and paralogs, including phylogenetic methods, sequence similarity and hybridization methods, are described herein; an ortholog or paralog, including equivalogs, may be identified by one or more of the methods described below.

Orthologs and Paralogs

Within a single plant species, gene duplication may cause two copies of a particular gene, giving rise to two or more genes with similar sequence and often similar function known as paralogs. A paralog is therefore a similar gene formed by duplication within the same species. Paralogs typically cluster together or in the same clade (a group of similar genes) when a gene family phylogeny is analyzed using programs such as CLUSTAL (Thompson et al. (1994); Higgins et al. (1996)). Groups of similar genes can also be identified with pair-wise BLAST analysis (Feng and Doolittle (1987)). For example, a clade of very similar MADS domain transcription factors from *Arabidopsis* all share a common function in flowering time (Ratcliffe et al. (2001)), and a group of very similar AP2 domain transcription factors from *Arabidopsis* are involved in tolerance of plants to freezing (Gilmour et al. (1998)). Analysis of groups of similar genes with similar function that fall within one clade can yield sub-sequences that are particular to the clade. These sub-sequences, known as consensus sequences, can not only be used to define the sequences within each clade, but define the functions of these genes; genes within a clade may contain paralogous sequences, or orthologous sequences that share the same function (see also, for example, Mount (2001))

Transcription factor gene sequences are conserved across diverse eukaryotic species lines (Goodrich et al. (1993); Lin et al. (1991); Sadowski et al. (1988)). Plants are no exception to this observation; diverse plant species possess transcription factors that have similar sequences and functions. Speciation, the production of new species from a parental species, gives rise to two or more genes with similar sequence and similar function. These genes, termed orthologs, often have an identical function within their host plants and are often interchangeable between species without losing function. Because plants have common ancestors, many genes in any plant species will have a corresponding orthologous gene in another plant species. Once a phylogenic tree for a gene family of one species has been constructed using a program such as CLUSTAL (Thompson et al. (1994); Higgins et al. (1996)) potential orthologous sequences can be placed into the phylogenetic tree and their relationship to genes from the species of interest can be determined. Orthologous sequences can also be identified by a reciprocal BLAST strategy. Once an orthologous sequence has been identified, the function of the ortholog can be deduced from the identified function of the reference sequence.

As described by Eisen (1998), evolutionary information may be used to predict gene function. It is common for groups of genes that are homologous in sequence to have diverse, although usually related, functions. However, in many cases, the identification of homologs is not sufficient to make specific predictions because not all homologs have the same function. Thus, an initial analysis of functional relatedness based on sequence similarity alone may not provide one with a means to determine where similarity ends and functional relatedness begins. Fortunately, it is well known in the art that protein function can be classified using phylogenetic analysis of gene trees combined with the corresponding species. Functional predictions can be greatly improved by focusing on how the genes became similar in sequence (i.e., by evolutionary processes) rather than on the sequence similarity itself (Eisen (1998)). In fact, many specific examples exist in which gene function has been shown to correlate well with gene phylogeny (Eisen (1998)). Thus, "[t]he first step in making functional predictions is the generation of a phylogenetic tree representing the evolutionary history of the gene of interest and its homologs. Such trees are distinct from clusters and other means of characterizing sequence similarity because they are inferred by techniques that help convert patterns of similarity into evolutionary relationships . . . . After the gene tree is inferred, biologically determined functions of the various homologs are overlaid onto the tree. Finally, the structure of the tree and the relative phylogenetic positions of genes of different functions are used to trace the history of functional changes, which is then used to predict functions of [as yet] uncharacterized genes" (Eisen (1998)).

By using a phylogenetic analysis, one skilled in the art would recognize that the ability to deduce similar functions conferred by closely-related polypeptides is predictable. This predictability has been confirmed by our own many studies in which we have found that a wide variety of polypeptides have orthologous or closely-related homologous sequences that function as does the first, closely-related reference sequence. For example, distinct transcription factors, including:

(i) AP2 family *Arabidopsis* G47 (found in U.S. Pat. No. 7,135,616), a phylogenetically-related sequence from soybean, and two phylogenetically-related homologs from rice all can confer greater tolerance to drought, hyperosmotic stress, or delayed flowering as compared to control plants;

(ii) CAAT family *Arabidopsis* G481 (found in PCT patent publication WO2004076638), and numerous phylogenetically-related sequences from eudicots and monocots can confer greater tolerance to drought-related stress as compared to control plants;

(iii) Myb-related *Arabidopsis* G682 (found in U.S. Pat. Nos. 7,223,904 and 7,193,129) and numerous phylogenetically-related sequences from eudicots and monocots can confer greater tolerance to heat, drought-related stress, cold, and salt as compared to control plants;

(iv) WRKY family *Arabidopsis* G1274 (found in U.S. Pat. No. 7,196,245) and numerous closely-related sequences from eudicots and monocots have been shown to confer increased water deprivation tolerance, and (v) AT-hook family soy sequence G3456 (found in US patent publication 20040128712A1) and numerous phylogenetically-related sequences from eudicots and monocots, increased biomass compared to control plants when these sequences are overexpressed in plants.

The polypeptides sequences belong to distinct clades of polypeptides that include members from diverse species. In each case, most or all of the clade member sequences derived from both eudicots and monocots have been shown to confer increased yield or tolerance to one or more abiotic stresses when the sequences were overexpressed. These studies each demonstrate that evolutionarily conserved genes from diverse species are likely to function similarly (i.e., by regulating similar target sequences and controlling the same traits), and that polynucleotides from one species may be transformed into closely-related or distantly-related plant species to confer or improve traits.

At the polypeptide level, the sequences of the invention will typically share at least about 40%, at least about 41%, at least about 42%, at least about 43%, at least about 44%, at least about 45%, at least about 46%, at least about 47%, at least about 48%, at least about 49%, at least about 50%, at least about 51%, at least about 52%, at least about 53%, at least about 54%, at least about 55%, at least about 56%, at least about 57%, at least about 58%, at least about 59%, at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or about 100% amino acid sequence identity, and have similar functions with the polypeptides listed in Table 6 when these sequences are overexpressed in plants.

Polypeptides that are phylogenetically related to the polypeptides of Table 6 may also have conserved domains that share at least 55%, at least about 56%, at least about 57%, at least about 58%, at least about 59%, at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or about 100% amino acid sequence identity, and have similar functions in that the polypeptides of the invention may, when overexpressed in plants, confer at least one regulatory activity and altered trait selected from the group consisting of bright coloration, dark leaf color, etiolated seedlings, increased anthocyanin in leaves, increased anthocyanin in flowers, and increased anthocyanin in fruit, increased seedling anthocyanin, increased seedling vigor, longer internodes, more anthocyanin, more trichomes, and fewer trichomes, as compared to a control plant.

At the nucleotide level, the sequences of the invention will typically share at least about 30% or 40% nucleotide sequence identity, preferably at least about 50%, 55%, at least about 56%, at least about 57%, at least about 58%, at least about 59%, at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or about 100%, sequence identity to one or more of the listed full-length sequences, or to a listed sequence but excluding or outside of the region(s) encoding a known consensus sequence or consensus DNA-binding site, or outside of the region(s) encoding one or all conserved domains. The degeneracy of the genetic code enables major variations in the nucleotide sequence of a polynucleotide while maintaining the amino acid sequence of the encoded protein.

Percent identity can be determined electronically, e.g., by using the MEGALIGN program (DNASTAR, Inc. Madison, Wis.). The MEGALIGN program can create alignments between two or more sequences according to different methods, for example, the clustal method (see, for example, Higgins and Sharp (1988). The clustal algorithm groups sequences into clusters by examining the distances between all pairs. The clusters are aligned pairwise and then in groups. Other alignment algorithms or programs may be used, including FASTA, BLAST, or ENTREZ, FASTA and BLAST, and which may be used to calculate percent similarity. These are available as a part of the GCG sequence analysis package (University of Wisconsin, Madison, Wis.), and can be used with or without default settings. ENTREZ is available through the National Center for Biotechnology Information. In one embodiment, the percent identity of two sequences can be determined by the GCG program with a gap weight of 1, e.g., each amino acid gap is weighted as if it were a single amino acid or nucleotide mismatch between the two sequences (see U.S. Pat. No. 6,262,333).

Software for performing BLAST analyses is publicly available, e.g., through the National Center for Biotechnology Information (see internet website at www.ncbi.nlm.nih.gov/). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul (1990); Altschul et al. (1993)). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value;

the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff (1991, 1992)). Unless otherwise indicated for comparisons of predicted polynucleotides, "sequence identity" refers to the % sequence identity generated from a tblastx using the NCBI version of the algorithm at the default settings using gapped alignments with the filter "off" (see, for example, internet website at www.ncbi.nlm.nih.gov/).

Other techniques for alignment are described by Doolittle (1996). Preferably, an alignment program that permits gaps in the sequence is utilized to align the sequences. The Smith-Waterman is one type of algorithm that permits gaps in sequence alignments (see Shpaer (1997). Also, the GAP program using the Needleman and Wunsch alignment method can be utilized to align sequences. An alternative search strategy uses MPSRCH software, which runs on a MASPAR computer. MPSRCH uses a Smith-Waterman algorithm to score sequences on a massively parallel computer. This approach improves ability to pick up distantly related matches, and is especially tolerant of small gaps and nucleotide sequence errors. Nucleic acid-encoded amino acid sequences can be used to search both protein and DNA databases.

The percentage similarity between two polypeptide sequences, e.g., sequence A and sequence B, is calculated by dividing the length of sequence A, minus the number of gap residues in sequence A, minus the number of gap residues in sequence B, into the sum of the residue matches between sequence A and sequence B, times one hundred. Gaps of low or of no similarity between the two amino acid sequences are not included in determining percentage similarity. Percent identity between polynucleotide sequences can also be counted or calculated by other methods known in the art, e.g., the Jotun Hein method (see, for example, Hein (1990)) Identity between sequences can also be determined by other methods known in the art, e.g., by varying hybridization conditions (see US Patent Application No. 20010010913).

Thus, the invention provides methods for identifying a sequence similar or paralogous or orthologous or homologous to one or more polynucleotides as noted herein, or one or more target polypeptides encoded by the polynucleotides, or otherwise noted herein and may include linking or associating a given plant phenotype or gene function with a sequence. In the methods, a sequence database is provided (locally or across an internet or intranet) and a query is made against the sequence database using the relevant sequences herein and associated plant phenotypes or gene functions.

In addition, one or more polynucleotide sequences or one or more polypeptides encoded by the polynucleotide sequences may be used to search against a BLOCKS (Bairoch et al. (1997)), PFAM, and other databases which contain previously identified and annotated motifs, sequences and gene functions. Methods that search for primary sequence patterns with secondary structure gap penalties (Smith et al. (1992)) as well as algorithms such as Basic Local Alignment Search Tool (BLAST; Altschul (1990); Altschul et al. (1993)), BLOCKS (Henikoff and Henikoff (1991)), Hidden Markov Models (HMM; Eddy (1996); Sonnhammer et al. (1997)), and the like, can be used to manipulate and analyze polynucleotide and polypeptide sequences encoded by polynucleotides. These databases, algorithms and other methods are well known in the art and are described in Ausubel et al. (1997), and in Meyers (1995).

A further method for identifying or confirming that specific homologous sequences control the same function is by comparison of the transcript profile(s) obtained upon overexpression or knockout of two or more related polypeptides. Since transcript profiles are diagnostic for specific cellular states, one skilled in the art will appreciate that genes that have a highly similar transcript profile (e.g., with greater than 50% regulated transcripts in common, or with greater than 70% regulated transcripts in common, or with greater than 90% regulated transcripts in common) will have highly similar functions. Fowler and Thomashow (2002), have shown that three paralogous AP2 family genes (CBF1, CBF2 and CBF3) are induced upon cold treatment, and each of which can condition improved freezing tolerance, and all have highly similar transcript profiles. Once a polypeptide has been shown to provide a specific function, its transcript profile becomes a diagnostic tool to determine whether paralogs or orthologs have the same function.

Furthermore, methods using manual alignment of sequences similar or homologous to one or more polynucleotide sequences or one or more polypeptides encoded by the polynucleotide sequences may be used to identify regions of similarity and B-box zinc finger domains. Such manual methods are well-known of those of skill in the art and can include, for example, comparisons of tertiary structure between a polypeptide sequence encoded by a polynucleotide that comprises a known function and a polypeptide sequence encoded by a polynucleotide sequence that has a function not yet determined. Such examples of tertiary structure may comprise predicted alpha helices, beta-sheets, amphipathic helices, leucine zipper motifs, zinc finger motifs, proline-rich regions, cysteine repeat motifs, and the like.

Orthologs and paralogs of presently disclosed polypeptides may be cloned using compositions provided by the present invention according to methods well known in the art. cDNAs can be cloned using mRNA from a plant cell or tissue that expresses one of the present sequences. Appropriate mRNA sources may be identified by interrogating Northern blots with probes designed from the present sequences, after which a library is prepared from the mRNA obtained from a positive cell or tissue. Polypeptide-encoding cDNA is then isolated using, for example, PCR, using primers designed from a presently disclosed gene sequence, or by probing with a partial or complete cDNA or with one or more sets of degenerate probes based on the disclosed sequences. The cDNA library may be used to transform plant cells. Expression of the cDNAs of interest is detected using, for example, microarrays, Northern blots, quantitative PCR, or any other technique for monitoring changes in expression. Genomic clones may be isolated using similar techniques to those.

Examples of orthologs of the *Arabidopsis* polypeptide sequences and their functionally similar orthologs are listed in Table 6 and the Sequence Listing. In addition to the sequences in Table 6 and the Sequence Listing, the invention encompasses isolated nucleotide sequences that are phylogenetically and structurally similar to sequences listed in the Sequence Listing) and can function in a plant by increasing yield and/or and abiotic stress tolerance when ectopically expressed in a plant.

Since a significant number of these sequences are phylogenetically and sequentially related to each other and have been shown to increase yield from a plant and/or abiotic stress tolerance, one skilled in the art would predict that other similar, phylogenetically related sequences falling within the present clades of polypeptides would also perform similar functions when ectopically expressed.

Identifying Polynucleotides or Nucleic Acids by Hybridization

Polynucleotides homologous to the sequences illustrated in the Sequence Listing and tables can be identified, e.g., by hybridization to each other under stringent or under highly stringent conditions. Single stranded polynucleotides hybridize when they associate based on a variety of well characterized physical-chemical forces, such as hydrogen bonding, solvent exclusion, base stacking and the like. The stringency of a hybridization reflects the degree of sequence identity of the nucleic acids involved, such that the higher the stringency, the more similar are the two polynucleotide strands. Stringency is influenced by a variety of factors, including temperature, salt concentration and composition, organic and non-organic additives, solvents, etc. present in both the hybridization and wash solutions and incubations (and number thereof), as described in more detail in the references cited below (e.g., Sambrook et al. (1989); Berger and Kimmel (1987); and Anderson and Young (1985)).

Encompassed by the invention are polynucleotide sequences that are capable of hybridizing to the claimed polynucleotide sequences, including any of the transcription factor polynucleotides within the Sequence Listing, and fragments thereof under various conditions of stringency (see, for example, Wahl and Berger (1987); and Kimmel (1987)). In addition to the nucleotide sequences in the Sequence Listing, full length cDNA, orthologs, and paralogs of the present nucleotide sequences may be identified and isolated using well-known methods. The cDNA libraries, orthologs, and paralogs of the present nucleotide sequences may be screened using hybridization methods to determine their utility as hybridization target or amplification probes.

With regard to hybridization, conditions that are highly stringent, and means for achieving them, are well known in the art. See, for example, Sambrook et al. (1989); Berger and Kimmel (1987) pp. 467-469; and Anderson and Young (1985).

Stability of DNA duplexes is affected by such factors as base composition, length, and degree of base pair mismatch. Hybridization conditions may be adjusted to allow DNAs of different sequence relatedness to hybridize. The melting temperature ($T_m$) is defined as the temperature when 50% of the duplex molecules have dissociated into their constituent single strands. The melting temperature of a perfectly matched duplex, where the hybridization buffer contains formamide as a denaturing agent, may be estimated by the following equations:

(I) DNA-DNA:

$$T_m(° C.)=81.5+16.6(\log [Na+])+0.41(\% G+C)-0.62(\% \text{ formamide})-500/L$$

(II) DNA-RNA:

$$T_m(° C.)=79.8+18.5(\log [Na+])+0.58(\% G+C)+0.12(\% G+C)^2-0.5(\% \text{ formamide})-820/L$$

(III) RNA-RNA:

$$T_m(° C.)=79.8+18.5(\log [Na+])+0.58(\% G+C)+0.12(\% G+C)^2-0.35(\% \text{ formamide})-820/L$$

where L is the length of the duplex formed, [Na+] is the molar concentration of the sodium ion in the hybridization or washing solution, and % G+C is the percentage of (guanine+cytosine) bases in the hybrid. For imperfectly matched hybrids, approximately 1° C. is required to reduce the melting temperature for each 1% mismatch.

Hybridization experiments are generally conducted in a buffer of pH between 6.8 to 7.4, although the rate of hybridization is nearly independent of pH at ionic strengths likely to be used in the hybridization buffer (Anderson and Young (1985)). In addition, one or more of the following may be used to reduce non-specific hybridization: sonicated salmon sperm DNA or another non-complementary DNA, bovine serum albumin, sodium pyrophosphate, sodium dodecylsulfate (SDS), polyvinyl-pyrrolidone, ficoll and Denhardt's solution. Dextran sulfate and polyethylene glycol 6000 act to exclude DNA from solution, thus raising the effective probe DNA concentration and the hybridization signal within a given unit of time. In some instances, conditions of even greater stringency may be desirable or required to reduce non-specific and/or background hybridization. These conditions may be created with the use of higher temperature, lower ionic strength and higher concentration of a denaturing agent such as formamide.

Stringency conditions can be adjusted to screen for moderately similar fragments such as homologous sequences from distantly related organisms, or to highly similar fragments such as genes that duplicate functional enzymes from closely related organisms. The stringency can be adjusted either during the hybridization step or in the post-hybridization washes. Salt concentration, formamide concentration, hybridization temperature and probe lengths are variables that can be used to alter stringency (as described by the formula above). As a general guidelines high stringency is typically performed at $T_m-5°$ C. to $T_m-20°$ C., moderate stringency at $T_m-20°$ C. to $T_m-35°$ C. and low stringency at $T_m-35°$ C. to $T_m-50°$ C. for duplex >150 base pairs. Hybridization may be performed at low to moderate stringency (25-50° C. below $T_m$), followed by post-hybridization washes at increasing stringencies. Maximum rates of hybridization in solution are determined empirically to occur at $T_m-25°$ C. for DNA-DNA duplex and $T_m-15°$ C. for RNA-DNA duplex. Optionally, the degree of dissociation may be assessed after each wash step to determine the need for subsequent, higher stringency wash steps.

High stringency conditions may be used to select for nucleic acid sequences with high degrees of identity to the disclosed sequences. An example of stringent hybridization conditions obtained in a filter-based method such as a Southern or northern blot for hybridization of complementary nucleic acids that have more than 100 complementary residues is about 5° C. to 20° C. lower than the thermal melting point ($T_m$) for the specific sequence at a defined ionic strength and pH. Conditions used for hybridization may include about 0.02 M to about 0.15 M sodium chloride, about 0.5% to about 5% casein, about 0.02% SDS or about 0.1% N-laurylsarcosine, about 0.001 M to about 0.03 M sodium citrate, at hybridization temperatures between about 50° C. and about 70° C. More preferably, high stringency conditions are about 0.02 M sodium chloride, about 0.5% casein, about 0.02% SDS, about 0.001 M sodium citrate, at a temperature of about 50° C. Nucleic acid molecules that hybridize under stringent conditions will typically hybridize to a probe based on either the entire DNA molecule or selected portions, e.g., to a unique subsequence, of the DNA.

Stringent salt concentration will ordinarily be less than about 750 mM NaCl and 75 mM trisodium citrate. Increasingly stringent conditions may be obtained with less than about 500 mM NaCl and 50 mM trisodium citrate, to even greater stringency with less than about 250 mM NaCl and 25 mM trisodium citrate. Low stringency hybridization can be obtained in the absence of organic solvent, e.g., formamide, whereas high stringency hybridization may be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. with formamide present. Varying additional parameters, such as hybridization time, the concentration of detergent, e.g., sodium dodecyl sulfate (SDS) and ionic strength, are well known to those skilled in the art. Various levels of stringency are accomplished by combining these various conditions as needed.

The washing steps that follow hybridization may also vary in stringency; the post-hybridization wash steps primarily determine hybridization specificity, with the most critical factors being temperature and the ionic strength of the final wash solution. Wash stringency can be increased by decreasing salt concentration or by increasing temperature. Stringent salt concentration for the wash steps will preferably be less than about 30 mM NaCl and 3 mM trisodium citrate, and most preferably less than about 15 mM NaCl and 1.5 mM trisodium citrate.

Thus, hybridization and wash conditions that may be used to bind and remove polynucleotides with less than the desired homology to the nucleic acid sequences or their complements that encode the present transcription factors include, for example:

hybridization at 6×SSC at 65° C.;
50% formamide, 4×SSC at 42° C.;
0.5×SSC, 0.1% SDS at 65° C.; or
0.1×SSC to 2×SSC, 0.1% SDS at 50° C.-65° C.;
with, for example, two wash steps of 10 minutes each, or 10-30 minutes each, such as with:
about 6×SSC at 65° C.;
about 20% (v/v) formamide in 0.1×SSC at 42° C.;
about 0.1×-0.5×SSC, 0.1% SDS at 65° C.; or
about 20% (v/v) formamide in 0.1×SSC at 42° C. with a subsequent wash step for 10 minutes with 0.2×SSC and 0.1% SDS at 65° C.

Useful variations on these conditions will be readily apparent to those skilled in the art.

A person of skill in the art would not expect substantial variation among polynucleotide species encompassed within the scope of the present invention because the highly stringent conditions set forth in the above formulae yield structurally similar polynucleotides.

If desired, one may employ wash steps of even greater stringency, including about 0.2×SSC, 0.1% SDS at 65° C. and washing twice, each wash step being about 30 min, or about 0.1×SSC, 0.1% SDS at 65° C. and washing twice for 30 min. The temperature for the wash solutions will ordinarily be at least about 25° C., and for greater stringency at least about 42° C. Hybridization stringency may be increased further by using the same conditions as in the hybridization steps, with the wash temperature raised about 3° C. to about 5° C., and stringency may be increased even further by using the same conditions except the wash temperature is raised about 6° C. to about 9° C. For identification of less closely related homologs, wash steps may be performed at a lower temperature, e.g., 50° C.

An example of a low stringency wash step employs a solution and conditions of at least 25° C. in 30 mM NaCl, 3 mM trisodium citrate, and 0.1% SDS over 30 min. Greater stringency may be obtained at 42° C. in 15 mM NaCl, with 1.5 mM trisodium citrate, and 0.1% SDS over 30 min. Even higher stringency wash conditions are obtained at 65° C.-68° C. in a solution of 15 mM NaCl, 1.5 mM trisodium citrate, and 0.1% SDS. Wash procedures will generally employ at least two final wash steps. Additional variations on these conditions will be readily apparent to those skilled in the art (see, for example, US Patent Application No. 20010010913).

Stringency conditions can be selected such that an oligonucleotide that is perfectly complementary to the coding oligonucleotide hybridizes to the coding oligonucleotide with at least about a 5-10× higher signal to noise ratio than the ratio for hybridization of the perfectly complementary oligonucleotide to a nucleic acid encoding a transcription factor known as of the filing date of the application. It may be desirable to select conditions for a particular assay such that a higher signal to noise ratio, that is, about 15× or more, is obtained. Accordingly, a subject nucleic acid will hybridize to a unique coding oligonucleotide with at least a 2× or greater signal to noise ratio as compared to hybridization of the coding oligonucleotide to a nucleic acid encoding known polypeptide. The particular signal will depend on the label used in the relevant assay, e.g., a fluorescent label, a colorimetric label, a radioactive label, or the like. Labeled hybridization or PCR probes for detecting related polynucleotide sequences may be produced by oligolabeling, nick translation, end-labeling, or PCR amplification using a labeled nucleotide.

Encompassed by the invention are polynucleotide sequences that are capable of hybridizing to the claimed polynucleotide sequences, for example, to SEQ ID NO: 2N−1, where N=1 to 447, and fragments thereof under various conditions of stringency (see, e.g., Wahl and Berger (1987); Kimmel (1987)). Estimates of homology are provided by either DNA-DNA or DNA-RNA hybridization under conditions of stringency as is well understood by those skilled in the art (Hames and Higgins (1985). Stringency conditions can be adjusted to screen for moderately similar fragments, such as homologous sequences from distantly related organisms, to highly similar fragments, such as genes that duplicate functional enzymes from closely related organisms. Post-hybridization washes determine stringency conditions.

Identifying Polynucleotides or Nucleic Acids with Expression Libraries

In addition to hybridization methods, transcription factor homolog polypeptides can be obtained by screening an expression library using antibodies specific for one or more transcription factors. With the provision herein of the disclosed transcription factor, and transcription factor homolog nucleic acid sequences, the encoded polypeptide(s) can be expressed and purified in a heterologous expression system (e.g., *E. coli*) and used to raise antibodies (monoclonal or polyclonal) specific for the polypeptide(s) in question. Antibodies can also be raised against synthetic peptides derived from transcription factor, or transcription factor homolog, amino acid sequences. Methods of raising antibodies are well known in the art and are described in Harlow and Lane (1988). Such antibodies can then be used to screen an expression library produced from the plant from which it is desired to clone additional transcription factor homologs, using the methods described above. The selected cDNAs can be confirmed by sequencing and enzymatic activity.

Producing Polypeptides

The polynucleotides of the invention include sequences that encode transcription factors and transcription factor homolog polypeptides and sequences complementary thereto, as well as unique fragments of coding sequence, or sequence complementary thereto. Such polynucleotides can be, for example, DNA or RNA, the latter including mRNA, cRNA, synthetic RNA, genomic DNA, cDNA synthetic DNA, oligonucleotides, etc. The polynucleotides are either double-stranded or single-stranded, and include either, or both sense (i.e., coding) sequences and antisense (i.e., non-coding, complementary) sequences. The polynucleotides include the coding sequence of a transcription factor, or transcription factor homolog polypeptide, in isolation, in combination with additional coding sequences (e.g., a purification tag, a localization signal, as a fusion-protein, as a pre-protein, or the like), in combination with non-coding sequences (for example, introns or inteins, regulatory elements such as promoters, enhancers, terminators, and the like), and/or in a vector or host environment in which the polynucleotide encoding a transcription factor or transcription factor homolog polypeptide is an endogenous or exogenous gene.

A variety of methods exist for producing the polynucleotides of the invention. Procedures for identifying and isolating DNA clones are well known to those of skill in the art, and are described in, for example, Berger and Kimmel (1987); Sambrook et al. (1989) and Ausubel et al. (1998; supplemented through 2000).

Alternatively, polynucleotides of the invention, can be produced by a variety of in vitro amplification methods adapted to the present invention by appropriate selection of specific or degenerate primers. Examples of protocols sufficient to direct persons of skill through in vitro amplification methods, including the polymerase chain reaction (PCR) the ligase chain reaction (LCR), Qβ-replicase amplification and other RNA polymerase mediated techniques (for example, NASBA), e.g., for the production of the homologous nucleic acids of the invention are found in Berger and Kimmel (1987), Sambrook (1989), and Ausubel (2000), as well as Mullis et al. (1990). Improved methods for cloning in vitro amplified nucleic acids are described in U.S. Pat. No. 5,426,039. Improved methods for amplifying large nucleic acids by PCR are summarized in Cheng et al. (1994) and the references cited therein, in which PCR amplicons of up to 40 kb are generated. One of skill will appreciate that essentially any RNA can be converted into a double stranded DNA suitable for restriction digestion, PCR expansion and sequencing using reverse transcriptase and a polymerase. See, e.g., Ausubel (2000), Sambrook (1989) and Berger and Kimmel (1987).

Alternatively, polynucleotides and oligonucleotides of the invention can be assembled from fragments produced by solid-phase synthesis methods. Typically, fragments of up to approximately 100 bases are individually synthesized and then enzymatically or chemically ligated to produce a desired sequence, e.g., a polynucleotide encoding all or part of a transcription factor. For example, chemical synthesis using the phosphoramidite method is described, e.g., by Beaucage et al. (1981) and Matthes et al. (1984). According to such methods, oligonucleotides are synthesized, purified, annealed to their complementary strand, ligated and then optionally cloned into suitable vectors. And if so desired, the polynucleotides and polypeptides of the invention can be custom ordered from any of a number of commercial suppliers.

Sequence Variations

It will readily be appreciated by those of skill in the art, that any of a variety of polynucleotide sequences are capable of encoding the transcription factors and transcription factor homolog polypeptides of the invention. Due to the degeneracy of the genetic code, many different polynucleotides can encode identical and/or substantially similar polypeptides in addition to those sequences illustrated in the Sequence Listing. Nucleic acids having a sequence that differs from the sequences shown in the Sequence Listing, or complementary sequences, that encode functionally equivalent peptides (i.e., peptides having some degree of equivalent or similar biological activity) but differ in sequence from the sequence shown in the Sequence Listing due to degeneracy in the genetic code, are also within the scope of the invention.

Altered polynucleotide sequences encoding polypeptides include those sequences with deletions, insertions, or substitutions of different nucleotides, resulting in a polynucleotide encoding a polypeptide with at least one functional characteristic of the instant polypeptides. Included within this definition are polymorphisms that may or may not be readily detectable using a particular oligonucleotide probe of the polynucleotide encoding the instant polypeptides, and improper or unexpected hybridization to allelic variants, with a locus other than the normal chromosomal locus for the polynucleotide sequence encoding the instant polypeptides.

Allelic variant refers to any of two or more alternative forms of a gene occupying the same chromosomal locus. Allelic variation arises naturally through mutation, and may result in phenotypic polymorphism within populations. Gene mutations can be silent (i.e., no change in the encoded polypeptide) or may encode polypeptides having altered amino acid sequence. The term allelic variant is also used herein to denote a protein encoded by an allelic variant of a gene. Splice variant refers to alternative forms of RNA transcribed from a gene. Splice variation arises naturally through use of alternative splicing sites within a transcribed RNA molecule, or less commonly between separately transcribed RNA molecules, and may result in several mRNAs transcribed from the same gene. Splice variants may encode polypeptides having altered amino acid sequence. The term splice variant is also used herein to denote a protein encoded by a splice variant of an mRNA transcribed from a gene.

Those skilled in the art would recognize that, for example, G1818, SEQ ID NO: 202, represents a single transcription factor; allelic variation and alternative splicing may be expected to occur. Allelic variants of SEQ ID NO: 201 can be cloned by probing cDNA or genomic libraries from different individual organisms according to standard procedures. Allelic variants of the DNA sequence shown in SEQ ID NO: 201, including those containing silent mutations and those in which mutations result in amino acid sequence changes, are within the scope of the present invention, as are proteins which are allelic variants of SEQ ID NO: 202. cDNAs generated from alternatively spliced mRNAs, which retain the properties of the transcription factor are included within the scope of the present invention, as are polypeptides encoded by such cDNAs and mRNAs. Allelic variants and splice variants of these sequences can be cloned by probing cDNA or genomic libraries from different individual organisms or tissues according to standard procedures known in the art (see U.S. Pat. No. 6,388,064).

Thus, in addition to the sequences set forth in the Sequence Listing, the invention also encompasses related nucleic acid molecules that include allelic or splice variants of the sequences of the invention, for example, allelic or splice variants of the Sequence Listing, including, but not limited to, SEQ ID NO: 2N−1, where N=1 to 447, and include sequences that are complementary to any of the above nucleotide sequences. Related nucleic acid molecules also include nucleotide sequences encoding a polypeptide comprising a substitution, modification, addition and/or deletion of one or more amino acid residues compared to the polypeptide sequences of Sequence Listing. Such related polypeptides may comprise, for example, additions and/or deletions of one or more N-linked or O-linked glycosylation sites, or an addition and/or a deletion of one or more cysteine residues.

Sequence alterations that do not change the amino acid sequence encoded by the polynucleotide are termed "silent" variations. With the exception of the codons ATG and TGG, encoding methionine and tryptophan, respectively, any of the possible codons for the same amino acid can be substituted by a variety of techniques, e.g., site-directed mutagenesis, available in the art. Accordingly, any and all such variations of a sequence selected from the above table are a feature of the invention.

In addition to silent variations, other conservative variations that alter one, or a few amino acid residues in the encoded polypeptide, can be made without altering the function of the polypeptide, these conservative variants are, likewise, a feature of the invention.

For example, substitutions, deletions and insertions introduced into the sequences provided in the Sequence Listing, are also envisioned by the invention. Such sequence modifications can be engineered into a sequence by site-directed mutagenesis (Wu (1993) or the other methods noted below. Amino acid substitutions are typically of single residues; insertions usually will be on the order of about from 1 to 10 amino acid residues; and deletions will range about from 1 to 30 residues. In preferred embodiments, deletions or insertions are made in adjacent pairs, e.g., a deletion of two residues or insertion of two residues. Substitutions, deletions, insertions or any combination thereof can be combined to arrive at a sequence. The mutations that are made in the polynucleotide encoding the transcription factor should not place the sequence out of reading frame and should not create complementary regions that could produce secondary mRNA structure. Preferably, the polypeptide encoded by the DNA performs the desired function.

Conservative substitutions are those in which at least one residue in the amino acid sequence has been removed and a different residue inserted in its place.

Similar substitutions are those in which at least one residue in the amino acid sequence has been removed and a different residue inserted in its place. Substitutions that are less conservative can be selected by picking residues that differ more significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. The substitutions which in general are expected to produce the greatest changes in protein properties will be those in which (a) a hydrophilic residue, e.g., seryl or threonyl, is substituted for (or by) a hydrophobic residue, e.g., leucyl, isoleucyl, phenylalanyl, valyl or alanyl; (b) a cysteine or proline is substituted for (or by) any other residue; (c) a residue having an electropositive side chain, e.g., lysyl, arginyl, or histidyl, is substituted for (or by) an electronegative residue, e.g., glutamyl or aspartyl; or (d) a residue having a bulky side chain, e.g., phenylalanine, is substituted for (or by) one not having a side chain, e.g., glycine.

Further Modifying Sequences of the Invention—Mutation/Forced Evolution

In addition to generating silent or conservative substitutions as noted, above, the present invention optionally includes methods of modifying the sequences of the Sequence Listing. In the methods, nucleic acid or protein modification methods are used to alter the given sequences to produce new sequences and/or to chemically or enzymatically modify given sequences to change the properties of the nucleic acids or proteins.

Thus, in one embodiment, given nucleic acid sequences are modified, e.g., according to standard mutagenesis or artificial evolution methods to produce modified sequences. The modified sequences may be created using purified natural polynucleotides isolated from any organism or may be synthesized from purified compositions and chemicals using chemical means well know to those of skill in the art. For example, Ausubel (2000), provides additional details on mutagenesis methods. Artificial forced evolution methods are described, for example, by Stemmer (1994a), Stemmer (1994b), and U.S. Pat. Nos. 5,811,238, 5,837,500, and 6,242,568. Methods for engineering synthetic transcription factors and other polypeptides are described, for example, by Zhang et al. (2000), Liu et al. (2001), and Isalan et al. (2001). Many other mutation and evolution methods are also available and expected to be within the skill of the practitioner.

Similarly, chemical or enzymatic alteration of expressed nucleic acids and polypeptides can be performed by standard methods. For example, sequence can be modified by addition of lipids, sugars, peptides, organic or inorganic compounds, by the inclusion of modified nucleotides or amino acids, or the like. For example, protein modification techniques are illustrated in Ausubel (2000). Further details on chemical and enzymatic modifications can be found herein. These modification methods can be used to modify any given sequence, or to modify any sequence produced by the various mutation and artificial evolution modification methods noted herein.

Accordingly, the invention provides for modification of any given nucleic acid by mutation, evolution, chemical or enzymatic modification, or other available methods, as well as for the products produced by practicing such methods, e.g., using the sequences herein as a starting substrate for the various modification approaches.

For example, optimized coding sequence containing codons preferred by a particular prokaryotic or eukaryotic host can be used e.g., to increase the rate of translation or to produce recombinant RNA transcripts having desirable properties, such as a longer half-life, as compared with transcripts produced using a non-optimized sequence. Translation stop codons can also be modified to reflect host preference. For example, preferred stop codons for *Saccharomyces cerevisiae* and mammals are TAA and TGA, respectively. The preferred stop codon for monocotyledonous plants is TGA, whereas insects and *E. coli* prefer to use TAA as the stop codon.

The polynucleotide sequences of the present invention can also be engineered in order to alter a coding sequence for a variety of reasons, including but not limited to, alterations which modify the sequence to facilitate cloning, processing and/or expression of the gene product. For example, alterations are optionally introduced using techniques which are well known in the art, e.g., site-directed mutagenesis, to insert new restriction sites, to alter glycosylation patterns, to change codon preference, to introduce splice sites, etc.

Furthermore, a fragment or domain derived from any of the polypeptides of the invention can be combined with domains derived from other transcription factors or synthetic domains to modify the biological activity of a transcription factor. For instance, a DNA-binding domain derived from a transcription factor of the invention can be combined with the activation domain of another transcription factor or with a synthetic activation domain. A transcription activation domain assists in initiating transcription from a DNA-binding site. Examples include the transcription activation region of VP16 or GAL4 (Moore et al. (1998); Aoyama et al. (1995)), peptides derived from bacterial sequences (Ma and Ptashne (1987)) and synthetic peptides (Giniger and Ptashne (1987)).

Expression and Modification of Polypeptides

Typically, polynucleotide sequences of the invention are incorporated into recombinant DNA (or RNA) molecules that direct expression of polypeptides of the invention in appropriate host cells, transgenic plants, in vitro translation systems, or the like. Due to the inherent degeneracy of the genetic code, nucleic acid sequences which encode substantially the same or a functionally equivalent amino acid sequence can be substituted for any listed sequence to provide for cloning and expressing the relevant homolog.

The transgenic plants of the present invention comprising recombinant polynucleotide sequences are generally derived from parental plants, which may themselves be non-transformed (or non-transgenic) plants. These transgenic plants may either have a transcription factor gene "knocked out" (for example, with a genomic insertion by homologous recombination, an antisense or ribozyme construct) or expressed to a normal or wild-type extent. However, overexpressing transgenic "progeny" plants will exhibit greater mRNA levels, wherein the mRNA encodes a transcription factor, that is, a DNA-binding protein that is capable of binding to a DNA regulatory sequence and inducing transcription, and preferably, expression of a plant trait gene, such as a gene that improves plant and/or fruit quality and/or yield. Preferably, the mRNA expression level will be at least three-fold greater than that of the parental plant, or more preferably at least ten-fold greater mRNA levels compared to said parental plant, and most preferably at least fifty-fold greater compared to said parental plant.

Modified Amino Acid Residues

Polypeptides of the invention may contain one or more modified amino acid residues. The presence of modified amino acids may be advantageous in, for example, increasing polypeptide half-life, reducing polypeptide antigenicity or toxicity, increasing polypeptide storage stability, or the like. Amino acid residue(s) are modified, for example, co-translationally or post-translationally during recombinant production or modified by synthetic or chemical means.

Non-limiting examples of a modified amino acid residue include incorporation or other use of acetylated amino acids, glycosylated amino acids, sulfated amino acids, prenylated (e.g., farnesylated, geranylgeranylated) amino acids, PEG modified (e.g., "PEGylated") amino acids, biotinylated amino acids, carboxylated amino acids, phosphorylated amino acids, etc. References adequate to guide one of skill in the modification of amino acid residues are replete throughout the literature.

The modified amino acid residues may prevent or increase affinity of the polypeptide for another molecule, including, but not limited to, polynucleotide, proteins, carbohydrates, lipids and lipid derivatives, and other organic or synthetic compounds.

Identification of Additional Protein Factors

A transcription factor provided by the present invention can also be used to identify additional endogenous or exogenous molecules that can affect a phenotype or trait of interest. Such molecules include endogenous molecules that are acted upon either at a transcriptional level by a transcription factor of the invention to modify a phenotype as desired. For example, the transcription factors can be employed to identify one or more downstream genes that are subject to a regulatory effect of the transcription factor. In one approach, a transcription factor or transcription factor homolog of the invention is expressed in a host cell, e.g., a transgenic plant cell, tissue or explant, and expression products, either RNA or protein, of likely or random targets are monitored, e.g., by hybridization to a microarray of nucleic acid probes corresponding to genes expressed in a tissue or cell type of interest, by two-dimensional gel electrophoresis of protein products, or by any other method known in the art for assessing expression of gene products at the level of RNA or protein. Alternatively, a transcription factor of the invention can be used to identify promoter sequences (such as binding sites on DNA sequences) involved in the regulation of a downstream target. After identifying a promoter sequence, interactions between the transcription factor and the promoter sequence can be modified by changing specific nucleotides in the promoter sequence or specific amino acids in the transcription factor that interact with the promoter sequence to alter a plant trait. Typically, transcription factor DNA-binding sites are identified by gel shift assays. After identifying the promoter regions, the promoter region sequences can be employed in double-stranded DNA arrays to identify molecules that affect the interactions of the transcription factors with their promoters (Bulyk et al. (1999)).

The identified transcription factors are also useful to identify proteins that modify the activity of the transcription factor. Such modification can occur by covalent modification, such as by phosphorylation, or by protein-protein (homo or -heteropolymer) interactions. Any method suitable for detecting protein-protein interactions can be employed. Among the methods that can be employed are co-immunoprecipitation, cross-linking and co-purification through gradients or chromatographic columns, and the two-hybrid yeast system.

The two-hybrid system detects protein interactions in vivo and is described in Chien et al. (1991) and is commercially available from Clontech (Palo Alto, Calif.). In such a system, plasmids are constructed that encode two hybrid proteins: one consists of the DNA-binding domain of a transcription activator protein fused to the transcription factor polypeptide and the other consists of the transcription activator protein's activation domain fused to an unknown protein that is encoded by a cDNA that has been recombined into the plasmid as part of a cDNA library. The DNA-binding domain fusion plasmid and the cDNA library are transformed into a strain of the yeast *Saccharomyces cerevisiae* that contains a reporter gene (e.g., lacZ) whose regulatory region contains the transcription activator's binding site. Either hybrid protein alone cannot activate transcription of the reporter gene. Interaction of the two hybrid proteins reconstitutes the functional activator protein and results in expression of the reporter gene, which is detected by an assay for the reporter gene product. Then, the library plasmids responsible for reporter gene expression are isolated and sequenced to identify the proteins encoded by the library plasmids. After identifying proteins that interact with the transcription factors, assays for compounds that interfere with the transcription factor protein-protein interactions can be preformed.

Subsequences

Also contemplated are uses of polynucleotides, also referred to herein as oligonucleotides, typically having at least 12 bases, preferably at least 50 bases, which hybridize under stringent conditions to a polynucleotide sequence described above. The polynucleotides may be used as probes, primers, sense and antisense agents, and the like, according to methods as noted above.

Subsequences of the polynucleotides of the invention, including polynucleotide fragments and oligonucleotides are useful as nucleic acid probes and primers. An oligonucleotide suitable for use as a probe or primer is at least about 15 nucleotides in length, more often at least about 18 nucleotides, often at least about 21 nucleotides, frequently at least about 30 nucleotides, or about 40 nucleotides, or more in length. A nucleic acid probe is useful in hybridization protocols, e.g., to identify additional polypeptide homologs of the invention, including protocols for microarray experiments. Primers can be annealed to a complementary target DNA strand by nucleic acid hybridization to form a hybrid between the primer and the target DNA strand, and then extended along the target DNA strand by a DNA polymerase enzyme. Primer pairs can be used for amplification of a nucleic acid sequence, e.g., by the polymerase chain reaction (PCR) or other nucleic-acid amplification methods. See Sambrook (1989), and Ausubel (2000).

In addition, the invention includes an isolated or recombinant polypeptide including a subsequence of at least about 15 contiguous amino acids encoded by the recombinant or isolated polynucleotides of the invention. For example, such polypeptides, or domains or fragments thereof, can be used as immunogens, e.g., to produce antibodies specific for the polypeptide sequence, or as probes for detecting a sequence of interest. A subsequence can range in size from about 15 amino acids in length up to and including the full length of the polypeptide.

To be encompassed by the present invention, an expressed polypeptide which comprises such a polypeptide subsequence performs at least one biological function of the intact polypeptide in substantially the same manner, or to a similar extent, as does the intact polypeptide. For example, a polypeptide fragment can comprise a recognizable structural motif or functional domain such as a DNA binding domain that activates transcription, e.g., by binding to a specific DNA promoter region an activation domain, or a domain for protein-protein interactions.

Vectors, Promoters, and Expression Systems

This section describes vectors, promoters, and expression systems that may be used with the present invention. Expression constructs that have been used to transform plants for testing in field trials are also described in Example III. The present invention includes recombinant constructs comprising one or more of the nucleic acid sequences herein. The constructs typically comprise a vector, such as a plasmid, a cosmid, a phage, a virus (e.g., a plant virus), a bacterial artificial chromosome (BAC), a yeast artificial chromosome (YAC), or the like, into which a nucleic acid sequence of the invention has been inserted, in a forward or reverse orientation. In a preferred aspect of this embodiment, the construct further comprises regulatory sequences, including, for example, a promoter, operably linked to the sequence. Large numbers of suitable vectors and promoters are known to those of skill in the art, and are commercially available.

General texts that describe molecular biological techniques useful herein, including the use and production of vectors, promoters and many other relevant topics, include Berger and Kimmel (1987), Sambrook (1989) and Ausubel (2000). Any of the identified sequences can be incorporated into a cassette or vector, e.g., for expression in plants. A number of expression vectors suitable for stable transformation of plant cells or for the establishment of transgenic plants have been described including those described in Weissbach and Weissbach (1989) and Gelvin et al. (1990). Specific examples include those derived from a Ti plasmid of *Agrobacterium tumefaciens*, as well as those disclosed by Herrera-Estrella et al. (1983), Bevan (1984), and Klee (1985) for dicotyledonous plants.

Alternatively, non-Ti vectors can be used to transfer the DNA into monocotyledonous plants and cells by using free DNA delivery techniques. Such methods can involve, for example, the use of liposomes, electroporation, microprojectile bombardment, silicon carbide whiskers, and viruses. By using these methods transgenic plants such as wheat, rice (Christou (1991) and corn (Gordon-Kamm (1990) can be produced. An immature embryo can also be a good target tissue for monocots for direct DNA delivery techniques by using the particle gun (Weeks et al. (1993); Vasil (1993a); Wan and Lemeaux (1994), and for *Agrobacterium*-mediated DNA transfer (Ishida et al. (1996)).

Typically, plant transformation vectors include one or more cloned plant coding sequence (genomic or cDNA) under the transcriptional control of 5' and 3' regulatory sequences and a dominant selectable marker. Such plant transformation vectors typically also contain a promoter (e.g., a regulatory region controlling inducible or constitutive, environmentally- or developmentally-regulated, or cell- or tissue-specific expression), a transcription initiation start site, an RNA processing signal (such as intron splice sites), a transcription termination site, and/or a polyadenylation signal.

A potential utility for the transcription factor polynucleotides disclosed herein is the isolation of promoter elements from these genes that can be used to program expression in plants of any genes. Each transcription factor gene disclosed herein is expressed in a unique fashion, as determined by promoter elements located upstream of the start of translation, and additionally within an intron of the transcription factor gene or downstream of the termination codon of the gene. As is well known in the art, for a significant portion of genes, the promoter sequences are located entirely in the region directly upstream of the start of translation. In such cases, typically the promoter sequences are located within 2.0 KB of the start of translation, or within 1.5 KB of the start of translation, frequently within 1.0 KB of the start of translation, and sometimes within 0.5 KB of the start of translation.

The promoter sequences can be isolated according to methods known to one skilled in the art.

Examples of constitutive plant promoters which can be useful for expressing the transcription factor sequence include: the cauliflower mosaic virus (CaMV) 35S promoter, which confers constitutive, high-level expression in most plant tissues (see, e.g., Odell et al. (1985)); the nopaline synthase promoter (An et al. (1988)); and the octopine synthase promoter (Fromm et al. (1989)).

The transcription factors of the invention may be operably linked with a specific promoter that causes the transcription factor to be expressed in response to environmental, tissue-specific or temporal signals. A variety of plant gene promoters that regulate gene expression in response to environmental, hormonal, chemical, developmental signals, and in a tissue-active manner can be used for expression of a transcription factor sequence in plants. Choice of a promoter is based largely on the phenotype of interest and is determined by such factors as tissue (e.g., seed, fruit, root, pollen, vascular tissue, flower, carpel, etc.), inducibility (e.g., in response to wounding, heat, cold, drought, light, pathogens, etc.), timing, developmental stage, and the like. Numerous known promoters have been characterized and can favorably be employed to promote expression of a polynucleotide of the invention in a transgenic plant or cell of interest. For example, tissue specific promoters include: seed-specific promoters (such as the napin, phaseolin or DC3 promoter described in U.S. Pat. No. 5,773,697), fruit-specific promoters that are active during fruit ripening (such as the dru 1 promoter (U.S. Pat. No. 5,783,393), or the 2A11 promoter (U.S. Pat. No. 4,943,674) and the tomato polygalacturonase promoter (Bird et al. (1988)), root-specific promoters, such as those disclosed in U.S. Pat. Nos. 5,618,988, 5,837,848 and 5,905,186, pollen-active promoters such as PTA29, PTA26 and PTA 13 (U.S. Pat. No. 5,792,929), promoters active in vascular tissue (Ringli and Keller (1998)), flower-specific (Kaiser et al. (1995)), pollen (Baerson et al. (1994)), carpels (Ohl et al. (1990)), pollen and ovules (Baerson et al. (1993)), auxin-inducible promoters (such as that described in van der Kop et al. (1999) or Baumann et al. (1999)), cytokinin-inducible promoter (Guevara-Garcia (1998)), promoters responsive to gibberellin (Shi et al. (1998), Willmott et al. (1998)) and the like. Additional promoters are those that elicit expression in response to heat (Ainley et al. (1993)), light (e.g., the pea rbcS-3A promoter, Kuhlemeier et al. (1989)), and the maize rbcS promoter, Schaffner and Sheen (1991)); wounding (e.g., wun1, Siebertz et al. (1989)); pathogens (such as the PR-1 promoter described in Buchel et al. (1999) and the PDF1.2 promoter described in Manners et al. (1998), and chemicals such as methyl jasmonate or salicylic acid (Gatz (1997)). In addition, the timing of the expression can be controlled by using promoters such as those acting at senescence (Gan and Amasino (1995)); or late seed development (Odell et al. (1994)). Examples of promoters that can be used to provide expression of transcription factors or other proteins in fruit tissue are provided in Table 1.

Expression Hosts

The present invention also relates to host cells which are transduced with vectors of the invention, and the production of polypeptides of the invention (including fragments thereof) by recombinant techniques. Host cells are genetically engineered (i.e., nucleic acids are introduced, e.g., transduced, transformed or transfected) with the vectors of this invention, which may be, for example, a cloning vector or an expression vector comprising the relevant nucleic acids herein. The vector is optionally a plasmid, a viral particle, a phage, a naked nucleic acid, etc. The engineered host cells can be cultured in conventional nutrient media modified as appropriate for activating promoters, selecting transformants, or amplifying the relevant gene. The culture conditions, such as

TABLE 1

Promoters, promoter constructs and expression patterns that may be used to regulate protein expression in fruit

| Promoter | PID and SEQ ID NO: of promoter construct | General expression patterns | References |
| --- | --- | --- | --- |
| CaMV35S ("35S") | P6506 SEQ ID NO: 1586 | Constitutive, high levels of expression in all throughout the plant and fruit | Odell et al (1985) |
| SHOOT MERISTEMLESS (STM) | P5318 SEQ ID NO: 1581 | Expressed in meristematic tissues, including apical meristems, cambium. Low levels of expression also in some differentiating tissues. In fruit, most strongly expressed in vascular tissues and endosperm. | Long and Barton (1998) Long and Barton (2000) |
| ASYMMETRIC LEAVES 1 (AS1) | P5319 SEQ ID NO: 1582 | Expressed predominately in differentiating tissues. In fruit, most strongly expressed in vascular tissues and in endosperm. | Byrne et al (2000) Ori et al. (2000) |
| LIPID TRANSFER PROTEIN 1 (LTP1) | P5287 SEQ ID NO: 1574 | In vegetative tissues, expression is predominately in the epidermis. Low levels of expression are also evident in vascular tissue. In the fruit, expression is strongest in the pith-like columella/placental tissue. | Thoma et al. (1994) |
| RIBULOSE-1,5-BISPHOSPHATE CARBOXYLASE, SMALL SUBUNIT 3 (RbcS3) | P5284 SEQ ID NO: 1573 | Expression predominately in highly photosynthetic vegetative tissues. Fruit expression predominately in the pericarp. | Wanner and Gruissem (1991) |
| ROOT SYSTEM INDUCIBLE 1 (RSI-1) | P5310 SEQ ID NO: 1579 | Expression generally limited to roots. Also expressed in the vascular tissues of the fruit. | Taylor and Scheuring (1994) |
| APETALA 1 (AP1) | P5326 SEQ ID NO: 1584 | Light expression in leaves increases with maturation. Highest expression in flower primordia and flower organs. In fruits, predominately in pith-like columella/placental tissue. | Mandel et al. (1992a) Hempel et al. (1997) |
| POLYGALACTURONASE (PG) | P5297 SEQ ID NO: 1577 | High expression throughout the fruit, comparable to 35S. Strongest late in fruit development. | Nicholass et al. (1995) Montgomery et al. (1993) |
| PHYTOENE DESATURASE (PD) | P5303 SEQ ID NO: 1578 | Moderate expression in fruit tissues. | Corona et al. (1996) |
| CRUCIFERIN 1 (Cru) | P5324 SEQ ID NO: 1583 | Expressed at low levels in fruit vascular tissue and columella. Seen and endosperm expression. | Breen and Crouch (1992) Sjodahl et al. (1995) |

Plant expression vectors can also include RNA processing signals that can be positioned within, upstream or downstream of the coding sequence. In addition, the expression vectors can include additional regulatory sequences from the 3'-untranslated region of plant genes, e.g., a 3' terminator region to increase mRNA stability of the mRNA, such as the PI-II terminator region of potato or the octopine or nopaline synthase 3' terminator regions.

temperature, pH and the like, are those previously used with the host cell selected for expression, and will be apparent to those skilled in the art and in the references cited herein, including, Sambrook (1989) and Ausubel (2000).

The host cell can be a eukaryotic cell, such as a yeast cell, or a plant cell, or the host cell can be a prokaryotic cell, such as a bacterial cell. Plant protoplasts are also suitable for some applications. For example, the DNA fragments are introduced into plant tissues, cultured plant cells or plant protoplasts by standard methods including electroporation (Fromm et al. (1985)), infection by viral vectors such as cauliflower mosaic virus (CaMV) (Hohn et al. (1982); U.S. Pat. No. 4,407,956), high velocity ballistic penetration by small particles with the nucleic acid either within the matrix of small beads or particles, or on the surface (Klein et al. (1987)), use of pollen as vector (WO 85/01856), or use of *Agrobacterium tumefaciens* or *A. rhizogenes* carrying a T-DNA plasmid in which DNA fragments are cloned. The T-DNA plasmid is transmitted to plant cells upon infection by *Agrobacterium tumefaciens*, and a portion is stably integrated into the plant genome (Horsch et al. (1984); Fraley et al. (1983)).

The cell can include a nucleic acid of the invention that encodes a polypeptide, wherein the cell expresses a polypeptide of the invention. The cell can also include vector sequences, or the like. Furthermore, cells and transgenic plants that include any polypeptide or nucleic acid above or throughout this specification, e.g., produced by transduction of a vector of the invention, are an additional feature of the invention.

For long-term, high-yield production of recombinant proteins, stable expression can be used. Host cells transformed with a nucleotide sequence encoding a polypeptide of the invention are optionally cultured under conditions suitable for the expression and recovery of the encoded protein from cell culture. The protein or fragment thereof produced by a recombinant cell may be secreted, membrane-bound, or contained intracellularly, depending on the sequence and/or the vector used. As will be understood by those of skill in the art, expression vectors containing polynucleotides encoding mature proteins of the invention can be designed with signal sequences which direct secretion of the mature polypeptides through a prokaryotic or eukaryotic cell membrane.

Potential Applications of the Presently Disclosed Sequences that Improve Plant Yield and/or Fruit Yield or Quality The genes identified by the experiment presently disclosed represent potential regulators of plant yield and/or fruit yield or quality. As such, these sequences, or their functional equivalogs, orthologs or paralogs, can be introduced into plant species, including commercial plant species, in order to produce higher yield and/or quality, including higher fruit yield and/or quality.

Production of Transgenic Plants

Modification of Traits

The polynucleotides of the invention are favorably employed to produce transgenic plants with various traits, or characteristics, that have been modified in a desirable manner, e.g., to improve the fruit quality characteristics of a plant. For example, alteration of expression levels or patterns (e.g., spatial or temporal expression patterns) of one or more of the transcription factors (or transcription factor homologs) of the invention, as compared with the levels of the same protein found in a wild-type plant, can be used to modify a plant's traits. An illustrative example of trait modification, improved characteristics, by altering expression levels of a particular transcription factor is described further in the Examples and the Sequence Listing.

Homologous Genes Introduced into transgenic Plants.

Homologous genes that may be derived from any plant, or from any source whether natural, synthetic, semi-synthetic or recombinant, and that share significant sequence identity or similarity to those provided by the present invention, may be introduced into plants, for example, crop plants, to confer desirable or improved traits. Consequently, transgenic plants may be produced that comprise a recombinant expression vector or cassette with a promoter operably linked to one or more sequences homologous to presently disclosed sequences. The promoter may be, for example, a plant or viral promoter.

The invention thus provides for methods for preparing transgenic plants, and for modifying plant traits. These methods include introducing into a plant a recombinant expression vector or cassette comprising a functional promoter operably linked to one or more sequences homologous to presently disclosed sequences. Plants and kits for producing these plants that result from the application of these methods are also encompassed by the present invention.

Genes, Traits and Utilities that Affect Plant Characteristics

Plant transcription factors can modulate gene expression, and, in turn, be modulated by the environmental experience of a plant. Significant alterations in a plant's environment invariably result in a change in the plant's transcription factor gene expression pattern. Altered transcription factor expression patterns generally result in phenotypic changes in the plant. Transcription factor gene product(s) in transgenic plants then differ(s) in amounts or proportions from that found in wild-type or non-transformed plants, and those transcription factors likely represent polypeptides that are used to alter the response to the environmental change. By way of example, it is well accepted in the art that analytical methods based on altered expression patterns may be used to screen for phenotypic changes in a plant far more effectively than can be achieved using traditional methods.

Antisense and Co-suppression

In addition to expression of the nucleic acids of the invention as gene replacement or plant phenotype modification nucleic acids, the nucleic acids are also useful for sense and anti-sense suppression of expression, e.g. to down-regulate expression of a nucleic acid of the invention, e.g. as a further mechanism for modulating plant phenotype. That is, the nucleic acids of the invention, or subsequences or anti-sense sequences thereof, can be used to block expression of naturally occurring homologous nucleic acids. A variety of sense and anti-sense technologies are known in the art, e.g. as set forth in Lichtenstein and Nellen (1997). Antisense regulation is also described in Crowley et al. (1985); Rosenberg et al. (1985); Preiss et al. (1985); Melton (1985); Izant and Weintraub (1985); and Kim and Wold (1985). Additional methods for antisense regulation are known in the art. Antisense regulation has been used to reduce or inhibit expression of plant genes in, for example in European Patent Publication No. 271988. Antisense RNA may be used to reduce gene expression to produce a visible or biochemical phenotypic change in a plant (Smith et al. (1988); Smith et al. (1990)). In general, sense or anti-sense sequences are introduced into a cell, where they are optionally amplified, e.g. by transcription. Such sequences include both simple oligonucleotide sequences and catalytic sequences such as ribozymes.

For example, a reduction or elimination of expression (i.e., a "knock-out") of a transcription factor or transcription factor homolog polypeptide in a transgenic plant, e.g., to modify a plant trait, can be obtained by introducing an antisense construct corresponding to the polypeptide of interest as a cDNA. For antisense suppression, the transcription factor or homolog cDNA is arranged in reverse orientation (with respect to the coding sequence) relative to the promoter sequence in the expression vector. The introduced sequence need not be the full-length cDNA or gene, and need not be identical to the cDNA or gene found in the plant type to be transformed. Typically, the antisense sequence need only be capable of hybridizing to the target gene or RNA of interest. Thus, where the introduced sequence is of shorter length, a higher degree of homology to the endogenous transcription factor sequence will be needed for effective antisense suppression. While antisense sequences of various lengths can be utilized, preferably, the introduced antisense sequence in the vector will be at least 30 nucleotides in length, and improved antisense suppression will typically be observed as the length of the antisense sequence increases. Preferably, the length of the antisense sequence in the vector will be greater than 100 nucleotides. Transcription of an antisense construct as described results in the production of RNA molecules that are the reverse complement of mRNA molecules transcribed from the endogenous transcription factor gene in the plant cell.

Suppression of endogenous transcription factor gene expression can also be achieved using RNA interference, or RNAi. RNAi is a post-transcriptional, targeted gene-silencing technique that uses double-stranded RNA (dsRNA) to incite degradation of messenger RNA (mRNA) containing the same sequence as the dsRNA (Constans (2002)). Small interfering RNAs, or siRNAs are produced in at least two steps: an endogenous ribonuclease cleaves longer dsRNA into shorter, 21-23 nucleotide-long RNAs. The siRNA segments then mediate the degradation of the target mRNA (Zamore (2001). RNAi has been used for gene function determination in a manner similar to antisense oligonucleotides (Constans (2002)). Expression vectors that continually express siRNAs in transiently and stably transfected have been engineered to express small hairpin RNAs (shRNAs), which get processed in vivo into siRNAs-like molecules capable of carrying out gene-specific silencing (Brummelkamp et al. (2002), and Paddison, et al. (2002)). Post-transcriptional gene silencing by double-stranded RNA is discussed in further detail by Hammond et al. (2001), Fire et al. (1998) and Timmons and Fire (1998). Vectors in which RNA encoded by a transcription factor or transcription factor homolog cDNA is over-expressed can also be used to obtain co-suppression of a corresponding endogenous gene, e.g., in the manner described in U.S. Pat. No. 5,231,020 to Jorgensen. Such co-suppression (also termed sense suppression) does not require that the entire transcription factor cDNA be introduced into the plant cells, nor does it require that the introduced sequence be exactly identical to the endogenous transcription factor gene of interest. However, as with antisense suppression, the suppressive efficiency will be enhanced as specificity of hybridization is increased, e.g., as the introduced sequence is lengthened, and/or as the sequence similarity between the introduced sequence and the endogenous transcription factor gene is increased.

Vectors expressing an untranslatable form of the transcription factor mRNA, e.g., sequences comprising one or more stop codon, or nonsense mutation) can also be used to suppress expression of an endogenous transcription factor, thereby reducing or eliminating its activity and modifying one or more traits. Methods for producing such constructs are described in U.S. Pat. No. 5,583,021. Preferably, such constructs are made by introducing a premature stop codon into the transcription factor gene. Alternatively, a plant trait can be modified by gene silencing using double-strand RNA (Sharp (1999)). Another method for abolishing the expression of a gene is by insertion mutagenesis using the T-DNA of *Agrobacterium tumefaciens*. After generating the insertion mutants, the mutants can be screened to identify those containing the insertion in a transcription factor or transcription factor homolog gene. Plants containing a single transgene insertion event at the desired gene can be crossed to generate homozygous plants for the mutation. Such methods are well known to those of skill in the art (see for example Koncz et al. (1992a, 1992b)).

Alternatively, a plant phenotype can be altered by eliminating an endogenous gene, such as a transcription factor or transcription factor homolog, e.g., by homologous recombination (Kempin et al. (1997)).

A plant trait can also be modified by using the Cre-lox system (for example, as described in U.S. Pat. No. 5,658,772). A plant genome can be modified to include first and second lox sites that are then contacted with a Cre recombinase. If the lox sites are in the same orientation, the intervening DNA sequence between the two sites is excised. If the lox sites are in the opposite orientation, the intervening sequence is inverted.

The polynucleotides and polypeptides of this invention can also be expressed in a plant in the absence of an expression cassette by manipulating the activity or expression level of the endogenous gene by other means, such as, for example, by ectopically expressing a gene by T-DNA activation tagging (Ichikawa et al. (1997); Kakimoto et al. (1996)). This method entails transforming a plant with a gene tag containing multiple transcriptional enhancers and once the tag has inserted into the genome, expression of a flanking gene coding sequence becomes deregulated. In another example, the transcriptional machinery in a plant can be modified so as to increase transcription levels of a polynucleotide of the invention (see, e.g., PCT Publications WO 96/06166 and WO 98/53057 which describe the modification of the DNA-binding specificity of zinc finger proteins by changing particular amino acids in the DNA-binding motif).

The transgenic plant can also include the machinery necessary for expressing or altering the activity of a polypeptide encoded by an endogenous gene, for example, by altering the phosphorylation state of the polypeptide to maintain it in an activated state.

Transgenic plants (or plant cells, or plant explants, or plant tissues) incorporating the polynucleotides of the invention and/or expressing the polypeptides of the invention can be produced by a variety of well established techniques as described above. Following construction of a vector, most typically an expression cassette, including a polynucleotide, e.g., encoding a transcription factor or transcription factor homolog, of the invention, standard techniques can be used to introduce the polynucleotide into a plant, a plant cell, a plant explant or a plant tissue of interest. Optionally, the plant cell, explant or tissue can be regenerated to produce a transgenic plant.

The plant can be any higher plant, including gymnosperms, monocotyledonous and dicotyledonous plants. Suitable protocols are available for Leguminosae (alfalfa, soybean, clover, etc.), Umbelliferae (carrot, celery, parsnip), Cruciferae (cabbage, radish, rapeseed, broccoli, etc.), Curcurbitaceae (melons and cucumber), Gramineae (wheat, corn, rice, barley, millet, etc.), Solanaceae (potato, tomato, tobacco, peppers, etc.), and various other crops. See protocols described in Ammirato et al. (1984); Shimamoto et al. (1989); Fromm et al. (1990); and Vasil et al. (1990).

Transformation and regeneration of both monocotyledonous and dicotyledonous plant cells is now routine, and the selection of the most appropriate transformation technique will be determined by the practitioner. The choice of method will vary with the type of plant to be transformed; those skilled in the art will recognize the suitability of particular methods for given plant types. Suitable methods can include, but are not limited to: electroporation of plant protoplasts; liposome-mediated transformation; polyethylene glycol (PEG) mediated transformation; transformation using viruses; micro-injection of plant cells; micro-projectile bombardment of plant cells; vacuum infiltration; and *Agrobacte-*

*rium tumefaciens* mediated transformation. Transformation means introducing a nucleotide sequence into a plant in a manner to cause stable or transient expression of the sequence.

Successful examples of the modification of plant characteristics by transformation with cloned sequences which serve to illustrate the current knowledge in this field of technology, and which are herein incorporated by reference, include: U.S. Pat. Nos. 5,571,706; 5,677,175; 5,510,471; 5,750,386; 5,597,945; 5,589,615; 5,750,871; 5,268,526; 5,780,708; 5,538,880; 5,773,269; 5,736,369 and 5,610,042.

Following transformation, plants are preferably selected using a dominant selectable marker incorporated into the transformation vector. Typically, such a marker will confer antibiotic or herbicide resistance on the transformed plants, and selection of transformants can be accomplished by exposing the plants to appropriate concentrations of the antibiotic or herbicide.

After transformed plants are selected and grown to maturity, those plants showing a modified trait are identified using methods well known in the art that are specifically directed to improved fruit or yield characteristics. Methods that may be used are provided in Examples II through VI. The modified trait can be any of those traits described above. Additionally, to confirm that the modified trait is due to changes in expression levels or activity of the polypeptide or polynucleotide of the invention can be determined by analyzing mRNA expression using Northern blots, RT-PCR or microarrays, or protein expression using immunoblots or Western blots or gel shift assays.

Integrated Systems—Sequence Identity

Additionally, the present invention may be an integrated system, computer or computer readable medium that comprises an instruction set for determining the identity of one or more sequences in a database. In addition, the instruction set can be used to generate or identify sequences that meet any specified criteria. Furthermore, the instruction set may be used to associate or link certain functional benefits, such improved characteristics, with one or more identified sequence.

For example, the instruction set can include, e.g., a sequence comparison or other alignment program, e.g., an available program such as, for example, the Wisconsin Package Version 10.0, such as BLAST, FASTA, PILEUP, FINDPATTERNS or the like (GCG, Madison, Wis.). Public sequence databases such as GenBank, EMBL, Swiss-Prot and PIR or private sequence databases such as PHYTOSEQ sequence database (Incyte Genomics, Wilmington, Del.) can be searched.

Alignment of sequences for comparison can be conducted by the local homology algorithm of Smith and Waterman (1981), by the homology alignment algorithm of Needleman and Wunsch (1970, by the search for similarity method of Pearson and Lipman (1988), or by computerized implementations of these algorithms. After alignment, sequence comparisons between two (or more) polynucleotides or polypeptides are typically performed by comparing sequences of the two sequences over a comparison window to identify and compare local regions of sequence similarity. The comparison window can be a segment of at least about 20 contiguous positions, usually about 50 to about 200, more usually about 100 to about 150 contiguous positions. A description of the method is provided in Ausubel (2000).

A variety of methods for determining sequence relationships can be used, including manual alignment and computer assisted sequence alignment and analysis. This later approach is a preferred approach in the present invention, due to the increased throughput afforded by computer assisted methods. As noted above, a variety of computer programs for performing sequence alignment are available, or can be produced by one of skill.

One example algorithm that is suitable for determining percent sequence identity and sequence similarity is the BLAST algorithm, which is described in Altschul et al. (1990). Software for performing BLAST analyses is publicly available, e.g., through the National Library of Medicine's National Center for Biotechnology Information (ncbi.nlm.nih; see at world wide web (www) National Institutes of Health US government (gov) website). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul (1993); Altschul et al. (1990)). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff and Henikoff (1992)). Unless otherwise indicated, "sequence identity" here refers to the % sequence identity generated from a tblastx using the NCBI version of the algorithm at the default settings using gapped alignments with the filter "off" (see, for example, NIH NLM NCBI website at ncbi.nlm.nih).

In addition to calculating percent sequence identity, the BLAST algorithm also performs a statistical analysis of the similarity between two sequences (see, e.g. Karlin and Altschul (1993)). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence (and, therefore, in this context, homologous) if the smallest sum probability in a comparison of the test nucleic acid to the reference nucleic acid is less than about 0.1, or less than about 0.01, and or even less than about 0.001. An additional example of a useful sequence alignment algorithm is PILEUP. PILEUP creates a multiple sequence alignment from a group of related sequences using progressive, pairwise alignments. The program can align, e.g., up to 300 sequences of a maximum length of 5,000 letters.

The integrated system, or computer typically includes a user input interface allowing a user to selectively view one or more sequence records corresponding to the one or more character strings, as well as an instruction set which aligns the one or more character strings with each other or with an additional character string to identify one or more region of sequence similarity. The system may include a link of one or more character strings with a particular phenotype or gene function. Typically, the system includes a user readable output element that displays an alignment produced by the alignment instruction set.

The methods of this invention can be implemented in a localized or distributed computing environment. In a distributed environment, the methods may be implemented on a single computer comprising multiple processors or on a multiplicity of computers. The computers can be linked, e.g. through a common bus, but more preferably the computer(s) are nodes on a network. The network can be a generalized or a dedicated local or wide-area network and, in certain preferred embodiments, the computers may be components of an intra-net or an internet.

Thus, the invention provides methods for identifying a sequence similar or homologous to one or more polynucleotides as noted herein, or one or more target polypeptides encoded by the polynucleotides, or otherwise noted herein and may include linking or associating a given plant phenotype or gene function with a sequence. In the methods, a sequence database is provided (locally or across an inter or intra net) and a query is made against the sequence database using the relevant sequences herein and associated plant phenotypes or gene functions.

Any sequence herein can be entered into the database, before or after querying the database. This provides for both expansion of the database and, if done before the querying step, for insertion of control sequences into the database. The control sequences can be detected by the query to ensure the general integrity of both the database and the query. As noted, the query can be performed using a web browser based interface. For example, the database can be a centralized public database such as those noted herein, and the querying can be done from a remote terminal or computer across an internet or intranet. Any sequence herein can be used to identify a similar, homologous, paralogous, or orthologous sequence in another plant. This provides means for identifying endogenous sequences in other plants that may be useful to alter a trait of progeny plants, which results from crossing two plants of different strain. For example, sequences that encode an ortholog of any of the sequences herein that naturally occur in a plant with a desired trait can be identified using the sequences disclosed herein. The plant is then crossed with a second plant of the same species but which does not have the desired trait to produce progeny which can then be used in further crossing experiments to produce the desired trait in the second plant. Therefore the resulting progeny plant contains no transgenes; expression of the endogenous sequence may also be regulated by treatment with a particular chemical or other means, such as EMR. Some examples of such compounds well known in the art include: ethylene; cytokinins; phenolic compounds, which stimulate the transcription of the genes needed for infection; specific monosaccharides and acidic environments which potentiate vir gene induction; acidic polysaccharides which induce one or more chromosomal genes; and opines; other mechanisms include light or dark treatment (for a review of examples of such treatments, see Winans (1992), Eyal et al. (1992), Chrispeels et al. (2000), or Piazza et al. (2002)).

Of particular interest is the structure of a transcription factor in the region of its conserved domain(s). Structural analyses may be performed by comparing the structure of the known transcription factor around its conserved domain with those of orthologs and paralogs. Analysis of a number of polypeptides within a transcription factor group or clade, including the functionally or sequentially similar polypeptides provided in the Sequence Listing, may also provide an understanding of structural elements required to regulate transcription within a given family.

Methods for Increasing Plant Yield or Quality by Modifying Transcription Factor Expression The present invention includes compositions and methods for increasing the yield and quality of a plant or its products, including those derived from a crop plant. These methods incorporate steps described in the Examples listed below, and may be achieved by inserting a nucleic acid sequence of the invention into the genome of a plant cell: (i) a promoter that functions in the cell; and (ii) a nucleic acid sequence that is substantially identical to a transcription factor polynucleotide of the Sequence Listing (for example, SEQ ID NOs: 2n−1, where n=1-447) or a conserved domain found in the Sequence Listing (for example, SEQ ID NOs: 895-1420), where the promoter is operably linked to the nucleic acid sequence. A transformed plant may then be generated from the cell. One may either obtain transformed seeds from that plant or its progeny, or propagate the transformed plant asexually. Alternatively, the transformed plant may be grow and harvested for plant products directly.

EXAMPLES

It is to be understood that this invention is not limited to the particular devices, machines, materials and methods described. Although particular embodiments are described, equivalent embodiments may be used to practice the invention.

The invention, now being generally described, will be more readily understood by reference to the following examples, which are included merely for purposes of illustration of certain aspects and embodiments of the present invention and are not intended to limit the invention. It will be recognized by one of skill in the art that a transcription factor that is associated with a particular first trait may also be associated with at least one other, unrelated and inherent second trait which was not predicted by the first trait.

Example I

Isolation and Cloning of Full-length Plant Transcription Factor cDNAs

Putative transcription factor sequences (genomic or ESTs) related to known transcription factors were identified in the *Arabidopsis thaliana* GenBank database using the tblastn sequence analysis program using default parameters and a P-value cutoff threshold of B4 or B5 or lower, depending on the length of the query sequence. Putative transcription factor sequence hits were then screened to identify those containing particular sequence strings. If the sequence hits contained such sequence strings, the sequences were confirmed as transcription factors.

Alternatively, *Arabidopsis thaliana* cDNA libraries derived from different tissues or treatments, or genomic libraries were screened to identify novel members of a transcription family using a low stringency hybridization approach. Probes were synthesized using gene specific primers in a standard PCR reaction (annealing temperature 60° C.) and labeled with $^{32}$P dCTP using the High Prime DNA Labeling Kit (Roche Diagnostics Corp., Indianapolis, Ind.). Purified radiolabelled probes were added to filters immersed in Church hybridization medium (0.5 M NaPO$_4$ pH 7.0, 7%

SDS, 1% w/v bovine serum albumin) and hybridized overnight at 60° C. with shaking. Filters were washed two times for 45 to 60 minutes with 1×SCC, 1% SDS at 60° C.

To identify additional sequence 5' or 3' of a partial cDNA sequence in a cDNA library, 5' and 3' rapid amplification of cDNA ends (RACE) was performed using the MARATHON cDNA amplification kit (Clontech, Palo Alto, Calif.). Generally, the method entailed first isolating poly(A) mRNA, performing first and second strand cDNA synthesis to generate double stranded cDNA, blunting cDNA ends, followed by ligation of the MARATHON Adaptor to the cDNA to form a library of adaptor-ligated ds cDNA.

Gene-specific primers were designed to be used along with adaptor specific primers for both 5' and 3' RACE reactions. Nested primers, rather than single primers, were used to increase PCR specificity. Using 5' and 3' RACE reactions, 5' and 3' RACE fragments were obtained, sequenced and cloned. The process can be repeated until 5' and 3' ends of the full-length gene were identified. Then the full-length cDNA was generated by PCR using primers specific to 5' and 3' ends of the gene by end-to-end PCR.

Example II

Strategy to Produce a Tomato Population Expressing all Transcription Factors

The cauliflower mosaic virus 35S promoter was chosen to control the expression of transcription factors in tomato for the purpose of evaluating complex traits in fruit development. This promoter is constitutively expressed in various tissues, including fruit.

Transgenic tomato lines expressing all *Arabidopsis* transcription factors driven by the CaMV 35S promoter relied on the use of a two-component system similar to that developed by Guyer et al. (1998) that uses the DNA binding domain of the yeast GAL4 transcriptional activator fused to the activation domains of the maize C1 or the herpes simplex virus VP 16 transcriptional activators, respectively. Modifications used either the *E. coli* lactose repressor DNA binding domain (LacI) or the *E. coli* LexA DNA binding domain fused to the GAL4 activation domain. The LexA-based system was the most reliable in activating tissue-specific GFP expression in tomato and was used to generate the tomato population. A diagram of the test transformation vectors is shown in FIG. 3. *Arabidopsis* transcription factor genes replaced the GFP gene in the target vector. The 35S promoter was used in the activator plasmid. Both families of vectors were used to transform tomato to yield one set of transgenic lines harboring different target vector constructs of transcription factor genes and a second population harboring the activator vector constructs of promoter-LexA/GAL4 fusions. Transgenic plants harboring the activator vector construct of promoter-LexA/GAL4 fusions were screened to identify plants with appropriate and high level expression of GUS. In addition, five of each of the transgenic plants harboring the target vector constructs of transcription factor genes were grown and crossed with a 35S activator line. F1 progeny were assayed to ensure that the transgene was capable of being activated by the LexA/GAL4 activator protein. The best plants constitutively expressing transcription factors were selected for subsequent crossing to the ten transgenic activator lines. Several of these initial lines have been evaluated and preliminary results of seedling traits indicate that similar phenotypes observed in *Arabidopsis* were also observed in tomato when the same transcription factor was constitutively overexpressed. Thus, each parental line harboring either a promoter-LexA/GAL4 activator or an activatible *Arabidopsis* transcription factors gene were pre-selected based on a functional assessment. These parental lines were used in sexual crosses to generate, 000 F1 (hemizygous for the activator and target genes) lines representing the complete set of *Arabidopsis* transcription factors under the regulation of the 35S promoter. The transgenic tomato population was grown field conditions for evaluation.

Example III

Test Constructs

The Two-Component Multiplication System vectors have an activator vector and a target vector. The LexA version of these is shown in FIG. 3. The LacI versions are identical except that LacI replaces LexA portions. Both LacI and LexA DNA binding regions were tested in otherwise identical vectors. These regions were made from portions of the test vectors described above, using standard cloning methods. They were cloned into a binary vector that had been previously tested in tomato transformations. These vectors were then introduced into *Arabidopsis* and tomato plants to verify their functionality. The LexA-based system was determined to be the most reliable in activating tissue-specific GFP expression in tomato and was used to generate the tomato population.

A useful feature of the PTF Tool Kit vectors described in FIG. 3 is the use of two different resistance markers, one in the activator vector and another in the target vector. This greatly facilitates identifying the activator and target plant transcription factor genes in plants following crosses. The presence of both the activator and target in the same plant can be confirmed by resistance to both markers. Additionally, plants homozygous for one or both genes can be identified by scoring the segregation ratios of resistant progeny. These resistance markers are useful for making the technology easier to use for the breeder.

Another useful feature of the PTF Tool Kit activator vector described in FIG. 3 is the use of a target GFP construct to characterize the expression pattern of each of the 10 activator promoters listed in Table 1. The Activator vector contains a construct consisting of multiple copies of the LexA (or LacI) binding sites and a TATA box upstream of the gene encoding the green fluorescence protein (GFP). This GFP reporter construct verifies that the activator gene is functional and that the promoter has the desired expression pattern before extensive plant crossing and characterizations proceed. The GFP reporter gene is also useful in plants derived from crossing the activator and target parents because it provides an easy method to detect the pattern of expression of expressed plant transcription factor genes.

Example IV

Tomato Transformation and Sulfonamide Selection

After the activator and target vectors were constructed, the vectors were used to transform *Agrobacterium tumefaciens* cells. Since the target vector comprised a polypeptide or interest (in the example given in FIG. 3, the polypeptide of interest was green fluorescent protein; other polypeptides of interest may include transcription factor polypeptides of the invention), it was expected that plants containing both vectors would be conferred with improved and useful traits. Methods for generating transformed plants with expression vectors are well known in the art; this Example also describes a novel method for transforming tomato plants with a sulfonamide selection marker. In this Example, tomato cotyledon explants were transformed with *Agrobacterium* cultures comprising target vectors having a sulfonamide selection marker.

Seed Sterilization

T63 seeds were surface sterilized in a sterilization solution of 20% bleach (containing 6% sodium hypochlorite) for 20 minutes with constant stirring. Two drops of Tween 20 were added to the sterilization solution as a wetting agent. Seeds were rinsed five times with sterile distilled water, blotted dry with sterile filter paper and transferred to Sigma P4928 phytacons (25 seeds per phytacon) containing 84 ml of MSO medium (the formula for MS medium may be found in Murashige and Skoog (1962); MSO is supplemented as indicated in Table 2).

Seed Germination and Explanting

Phytacons were placed in a growth room at 24° C. with a 16 hour photoperiod. Seedlings were grown for seven days.

Explanting plates were prepared by placing a 9 cm Whatman No. 2 filter paper onto a plate of 100 mm×25 mm Petri dish containing 25 ml of R1F medium. Tomato seedlings were cut and placed into a 100 mm×25 mm Petri dish containing a 9 cm Whatman No. 2 filter paper and 3 ml of distilled water. Explants were prepared by cutting cotyledons into three pieces. The two proximal pieces were transferred onto the explanting plate, and the distal section was discarded. One hundred twenty explants were placed on each plate. A control plate was also prepared that was not subjected to the *Agrobacterium* transformation procedure. Explants were kept in the dark at 24° C. for 24 hours.

Agrobacterium Culture Preparation and Cocultivation

The stock of *Agrobacterium tumefaciens* cells for transformation were made as described by Nagel et al. (1990). *Agrobacterium* strain ABI was grown in 250 ml LB medium (Sigma) overnight at 28° C. with shaking until an absorbance over 1 cm at 600 nm ($A_{600}$) of 0.5-1.0 was reached. Cells were harvested by centrifugation at 4,000×g for 15 minutes at 4° C. Cells were then resuspended in 250 µl chilled buffer (1 mM HEPES, pH adjusted to 7.0 with KOH). Cells were centrifuged again as described above and resuspended in 125 µl chilled buffer. Cells were then centrifuged and resuspended two more times in the same HEPES buffer as described above at a volume of 100 µl and 750 µl, respectively. Resuspended cells were then distributed into 40 µl aliquots, quickly frozen in liquid nitrogen, and stored at −80° C.

*Agrobacterium* cells were transformed with vectors prepared as described above following the protocol described by Nagel et al. (1990). For each DNA construct to be transformed, 50 to 100 ng DNA (generally resuspended in 10 mM Tris-HCl, 1 mM EDTA, pH 8.0) were mixed with 40 µl of *Agrobacterium* cells. The DNA/cell mixture was then transferred to a chilled cuvette with a 2 mm electrode gap and subject to a 2.5 kV charge dissipated at 25 µF and 200 µF using a Gene Pulser II apparatus (Bio-Rad, Hercules, Calif.). After electroporation, cells were immediately resuspended in 1.0 ml LB and allowed to recover without antibiotic selection for 2-4 hours at 28° C. in a shaking incubator. After recovery, cells were plated onto selective medium of LB broth containing 100 µg/ml spectinomycin (Sigma) and incubated for 24-48 hours at 28° C. Single colonies were then picked and inoculated in fresh medium. The presence of the vector construct was verified by PCR amplification and sequence analysis.

*Agrobacteria* were cultured in two sequential overnight cultures. On day 1, the *agrobacteria* containing the target vectors having the sulfonamide selection vector (FIG. 3) were grown in 25 ml of liquid 523 medium (Moore et al. (1988)) plus 100 mg spectinomycin, 50 mg kanamycin, and 25 mg chloramphenicol per liter. On day 2, five ml of the first overnight suspension were added to 25 ml of AB medium to which is added 100 mg spectinomycin, 50 mg kanamycin, and 25 mg chloramphenicol per liter. Cultures were grown at 28° C. with constant shaking on a gyratory shaker. The second overnight suspension was centrifuged in a 38 ml sterile Oakridge tubes for 5 minutes at 8000 rpm in a Beckman JA20 rotor. The pellet was resuspended in 10 ml of MSO liquid medium containing 600 µm acetosyringone (for each 20 ml of MSO medium, 40 µl of 0.3 M stock acetosyringone were added). The *Agrobacterium* concentration was adjusted to an $A_{600}$ of 0.25.

Seven milliliters of the *Agrobacterium* suspension were added to each of explanting plates. After 20 min., the *Agrobacterium* suspension was aspirated and the explants were blotted dry three times with sterile filter paper. The plates were sealed with Parafilm and incubated in the dark at 21° C. for 48 hours.

Regeneration

Cocultivated explants were transferred after 48 hours in the dark to 100 mm×25 mm Petri plates (20 explants per plate) containing 25 ml of R1SB10 medium (this medium and subsequently used media contained sulfadiazine, the sulfonamide antibiotic used to select transformants). Plates were kept in the dark for 72 hours and then placed in low light. After 14 days, the explants were transferred to fresh RZ1/2SB25 medium. After an additional 14 days, the regenerating tissues at the edge of the explants were excised away from the primary explants and were transferred onto fresh RZ1/2SB25 medium. After another 14 day interval, regenerating tissues were again transferred to fresh ROSB25 medium. After this period, the regenerating tissues were subsequently rotated between ROSB25 and RZ1/2SB25 media at two week intervals. The well defined shoots that appeared were excised and transferred to ROSB100 medium for rooting.

Shoot Analysis

Once shoots were rooted on ROSB100 medium, small leaf pieces from the rooted shoots were sampled and analyzed with a polymerase chain reaction procedure (PCR) for the presence of the SulA gene. The PCR-positive shoots (T0) were then grown to maturity in the greenhouses. Some T0 plants were crossed to plants containing the CaMV 35S activator vector. The T0 self pollinated seeds were saved for later crosses to different activator promoters.

TABLE 2

| | \multicolumn{6}{c|}{Media Compositions (amounts per liter)} |
|---|---|---|---|---|---|---|
| | MSO | R1F | R1SB10 | RZ1/2SB25 | ROSB25 | ROSB100 |
| Gibco MS Salts | 4.3 g | 4.3 g | 4.3 g | 4.3 g | 4.3 g | 4.3 g |
| RO Vitamins (100X) | 10 ml | | | 5 ml | 10 ml | 10 ml |
| R1 Vitamins (100X) | | 10 ml | 10 ml | | | |
| RZ Vitamins (100X) | | | | 5 ml | | |
| Glucose | 16.0 g | 16.0 g | 16.0 g | 16.0 g | 16.0 g | 16.0 g |

TABLE 2-continued

| Media Compositions (amounts per liter) | | | | | | |
|---|---|---|---|---|---|---|
| | MSO | R1F | R1SB10 | RZ1/2SB25 | ROSB25 | ROSB100 |
| Timentin ® | | | 100 mg | | | |
| Carbenicillin | | | | 350 mg | 350 mg | 350 mg |
| Noble Agar | 8 | 11.5 | 10.3 | 10.45 | 10.45 | 10.45 |
| MES | | | 0.6 g | 0.6 g | 0.6 g | 0.6 g |
| Sulfadiazine free acid (10 mg/ml stock) | | | 1 ml | 2.5 ml | 2.5 ml | 10 ml |
| pH | 5.7 | 5.7 | 5.7 | 5.7 | 5.7 | 5.7 |

TABLE 3

| 100x Vitamins (amounts per liter) | | | |
|---|---|---|---|
| | RO | R1 | RZ |
| Nicotinic acid | 500 mg | 500 mg | 500 mg |
| Thiamine HCl | 50 mg | 50 mg | 50 mg |
| Pyridoxine HCl | 50 mg | 50 mg | 50 mg |
| Myo-inositol | 20 g | 20 g | 20 g |
| Glycine | 200 mg | 200 mg | 200 mg |
| Zeatin | | 0.65 mg | 0.65 mg |
| IAA | | 1.0 mg | |
| pH | 5.7 | 5.7 | 5.7 |

TABLE 4

| 523 Medium (amounts per liter) | |
|---|---|
| Sucrose | 10 g |
| Casein Enzymatic Hydrolysate | 8 g |
| Yeast Extract | 4 g |
| $K_2HPO_4$ | 2 g |
| $MgSO_4 \cdot 7H_2O$ | 0.3 g |
| pH | 7.00 |

TABLE 5

| AB Medium | | | |
|---|---|---|---|
| Part A | | Part B (10X stock) | |
| $K_2HPO_4$ | 3 g | $MgSO_4 \cdot 7H_2O$ | 3 g |
| $NaH_2PO_4$ | 1 g | $CaCl_2$ | 0.1 g |
| $NH_4Cl$ | 1 g | $FeSO_4 \cdot 7H_2O$ | 0.025 g |
| KCl | 0.15 g | Glucose | 50 g |
| pH | 7.00 | | 7.00 |
| Volume | 900 ml | | 1000 ml |

Prepared by autoclaving and mixing 900 ml Part A with 100 ml Part B.

Example V

Population Characterization and Measurements

After the crosses were made (to generate plants having both activator and target vectors), general characterization of the F1 population was performed in the field. General evaluation included photographs of seedling and adult plant morphology, photographs of leaf shape, open flower morphology and of mature green and ripe fruit. Vegetative plant size, a measure of plant biomass, was measured by ruler at approximately two months after transplant. Plant volume was obtained by the multiplication of the three dimensions. In addition, observations were made to determine fruit number per plant. Three red-ripe fruit were harvested from each individual plant when possible and were used for the various assays. Two weeks later, six fruits per promoter::gene grouping were harvested, with two fruits per plant harvested when possible. The fruits were pooled, weighed, and seeds collected.

Source/sink activities. Source/sink activities were determined by screening for lines in which *Arabidopsis* transcription factors were driven by the RbcS-3 (leaf mesophyll expression), LTP1 (epidermis and vascular expression) and the PD (early fruit development) promoters. These promoters target source processes localized in photosynthetically active cells (RbcS-3), sink processes localized in developing fruit (PD) or transport processes active in vascular tissues (LTP1) that link source and sink activities. Leaf punches were collected within one hour of sunrise, in the seventh week after transplant, and stored in ethanol. The leaves were then stained with iodine, and plants with notably high or low levels of starch were noted.

Fruit ripening regulation. Screening for traits associated with fruit ripening focused on transgenic tomato lines in which *Arabidopsis* transcription factors are driven by the PD (early fruit development) and PG (fruit ripening) promoters. These promoters target fruit regulatory processes that lead to fruit maturation or which trigger ripening or components of the ripening process. In order to identify lines expressing transcription factors that impact ripening, fruits at 1 cm stage, a developmental time 7-10 days post anthesis and shortly after fruit set were tagged. Tagging occurred over a single two-day period per field trial at a time when plants are in the early fruiting stage to ensure tagging of one to two fruits per plant, and four to six fruits per line. Tagged fruit at the "breaker" stage on any given inspection were marked with a second colored and dated tag. Later inspections included monitoring of breaker-tagged fruit to identify any that have reached the full red ripe stage. To assess the regulation of components of the ripening process, fruit at the mature green and red ripe stage have been harvested and fruit texture analyzed by force necessary to compress equator of the fruit by 2 mm.

Example VI

Screening CaMV 35S Activator Line Progeny with the Transcription Factor Target Lines to Identify Lines Expressing Plant Transcription Factors The plant transcription factor target plants that were initially prepared lacked an activator gene to faciliate later crosses to various activator promoter lines. In order to find transformants that were adequately expressed in the presence of an activator, the plant transcription factor plants were crossed to the CaMV 35S promoter activator line and screened for transcription factor expression by RT-PCR. The mRNA was reverse transcribed into cDNA and the amount of product was measured by quantitative PCR.

Because the parental lines were each heterozygous for the transgenes, T1 hybrid progeny were sprayed with chlorsulfuron and cyanamide to find the 25% of the progeny containing both the activator (chlorsulfuron resistant) and target (cyanamide resistant) transgenes. Segregation ratios were measured and lines with abnormal ratios were discarded. Too high a ratio indicated multiple inserts, while too low a ratio indicated a variety of possible problems. The ideal inserts produced 50% resistant progeny. Progeny containing both inserts appeared at 25% because they also required the other herbicidal markers from the Activator parental line (50%×50%).

These T1 hybrid progeny were then screened in a 96 well format for plant transcription factor gene expression by RT-PCR to ensure expression of the target plant transcription factor gene, as certain chromosomal positions can be silent or very poorly expressed or the gene can be disrupted during the integration process. The 96 well format was also used for cDNA synthesis and PCR. This procedure involves the use of one primer in the transcribed portion of the vector and a second gene-specific primer.

Because both the activator and target genes are dominant in their effects, phenotypes were observable in hybrid progeny containing both genes. These T1F1 plants were examined for visual phenotypes. However, more detailed analysis for increased color, high solids and disease resistance were also conducted once the best lines were identified and reproduced on a larger scale.

Example VII

Results of Overexpressing Specific Promoter::Transcription Factor Combinations in Tomato Plants Using the methods described in the above Examples, a number of *Arabidopsis* sequences were identified that resulted in bright coloration, dark leaf color, etiolated seedlings, increased anthocyanin in leaves, increased anthocyanin in flowers, and increased anthocyanin in fruit, increased seedling anthocyanin, increased seedling vigor, longer internodes, more anthocyanin, more trichomes, and fewer trichomes, among other improved traits when expressed in tomato plants. Table 6 shows a number of polypeptides of the invention shown to improve fruit or yield characteristics. SEQ ID NOs and GID (Gene IDentifiers) are listed in Columns 1 and 2. The conserved domains in amino acid coordinates (beginning from the n-terminus of each polypeptide) of each polypeptide associates with particular Transcription Factor Family, and the Transcription Factor Families to which the polypeptide belongs, are listed in Columns 3 and 4. The PID (Plasmid IDentifier) and PID SEQ ID NOs are listed in Columns 5 and 6. The 35S promoter was used to drive expression of the polynucleotides encoding the polypeptides and the traits that were observed in tomato plants when each polypeptide sequence was overexpressed in tomato plants, relative to traits observed in control tomato plants, are listed in Column 7.

TABLE 6

Polypeptides of the invention, their conserved domains, families and the traits conferred by overexpressing the polypeptides in tomato plants under the regulatory control of the CaMV 35S promoter

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G2 | 2 | AP2 (129-195, 221-288) | P6506 (const. 35S prom.) | P8197 | 1550 | Etiolated seedling |
| G3 | 4 | AP2 (28-95) | P6506 (const. 35S prom.) | P3375 | 1425 | Etiolated seedlings |
| G8 | 6 | AP2 (151-217, 243-293) | P6506 (const. 35S prom.) | P6038 | 1499 | More anthocyanin |
| G12 | 8 | AP2 (27-94) | P6506 (const. 35S prom.) | P6838 | 1512 | Etiolated seedlings |
| G15 | 10 | AP2 (281-357, 383-451) | P6506 (const. 35S prom.) | P9218 | 1570 | More anthocyanin |
| G33 | 12 | AP2 (50-117) | P6506 (const. 35S prom.) | P3643 | 1440 | Inc. seedling vigor |
| G35 | 14 | AP2 (NA) | P6506 (const. 35S prom.) | P5130 | 1487 | Dark leaf color |
| G47 | 16 | AP2 (10-75) | P6506 (const. 35S prom.) | P3853 | 1445 | Bright coloration |
| G201 | 18 | MYB-(R1)R2R3 (14-114) | P6506 (const. 35S prom.) | P6426 | 1505 | Bright coloration |
| G202 | 20 | MYB-(R1)R2R3 (13-116) | P6506 (const. 35S prom.) | P3761 | 1442 | More anthocyanin |
| G214 | 22 | MYB-related (25-71) | P6506 (const. 35S prom.) | P5731 | 1494 | Dark leaf color |
| G261 | 24 | HS (15-106) | P6506 (const. 35S prom.) | P5145 | 1488 | Etiolated seedlings |
| G280 | 26 | AT-hook (97-104, 130-137-155-162, 185-192) | P6506 (const. 35S prom.) | P6901 | 1515 | Etiolated seedlings |
| G350 | 28 | Z-C2H2 (91-113, 150-170) | P6506 (const. 35S prom.) | P6197 | 1501 | More anthocyanin |
| G365 | 30 | Z-C2H2 (70-90) | P6506 (const. 35S prom.) | P6820 | 1510 | Inc. seedling vigor |
| G367 | 32 | Z-C2H2 (63-84) | P6506 (const. 35S prom.) | P5748 | 1495 | More anthocyanin |

TABLE 6-continued

Polypeptides of the invention, their conserved domains, families and the traits conferred by overexpressing the polypeptides in tomato plants under the regulatory control of the CaMV 35S promoter

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G368 | 34 | Z-C2H2 (NA) | P6506 (const. 35S prom.) | P5262 | 1489 | Etiolated seedlings |
| G369 | 36 | Z-C2H2 (37-57) | P6506 (const. 35S prom.) | P9035 | 1567 | More anthocyanin |
| G373 | 38 | RING/C3HC4 (129-168) | P6506 (const. 35S prom.) | P7058 | 1517 | More anthocyanin |
| G398 | 40 | HB (128-191) | P6506 (const. 35S prom.) | P5868 | 1497 | Bright coloration |
| G448 | 42 | IAA (11-20, 83-95, 111-128, 180-214) | P6506 (const. 35S prom.) | P9080 | 1568 | Dark leaf color |
| G459 | 44 | IAA (12-21, 53-65, 76-92, 128-161) | P6506 (const. 35S prom.) | P7026 | 1516 | Etiolated seedlings |
| G481 | 46 | CAAT (20-109) | P6506 (const. 35S prom.) | P6812 | 1509 | Inc. seedling vigor |
| G486 | 48 | CAAT (3-66) | P6506 (const. 35S prom.) | P3777 | 1443 | Etiolated seedlings |
| G501 | 50 | NAC (10-131) | P6506 (const. 35S prom.) | P5272 | 1490 | Dark leaf color |
| G504 | 52 | NAC (16-178) | P6506 (const. 35S prom.) | P4230 | 1452 | Etiolated seedlings |
| G513 | 54 | NAC (16-161) | P6506 (const. 35S prom.) | P5507 | 1491 | More anthocyanin |
| G517 | 56 | NAC (6-153) | P6506 (const. 35S prom.) | P7858 | 1543 | Inc. seedling vigor |
| G559 | 58 | bZIP (203-264) | P6506 (const. 35S prom.) | P3585 | 1432 | Inc. seedling vigor |
| G567 | 60 | bZIP (210-270) | P6506 (const. 35S prom.) | P4762 | 1479 | Inc. seedling vigor |
| G594 | 62 | HLH/MYC (144-202) | P6506 (const. 35S prom.) | P6823 | 1511 | Inc. seedling vigor |
| G619 | 64 | ARF (64-406) | P6506 (const. 35S prom.) | P5706 | 1493 | Etiolated seedlings |
| G619 | 64 | ARF (64-406) | P6506 (const. 35S prom.) | P5706 | 1493 | Dark leaf color |
| G663 | 66 | MYB-(R1)R2R3 (9-111) | P6506 (const. 35S prom.) | P5094 | 1485 | More anthocyanin |
| G663 | 66 | MYB-(R1)R2R3 (9-111) | P6506 (const. 35S prom.) | P5094 | 1485 | Inc. seedling anthocyanin |
| G663 | 66 | MYB-(R1)R2R3 (9-111) | P6506 (const. 35S prom.) | P5094 | 1485 | Inc. leaf, flower, and fruit anthocyanin |
| G668 | 68 | MYB-(R1)R2R3 (14-115) | P6506 (const. 35S prom.) | P3574 | 1431 | Bright leaf coloration |
| G674 | 70 | MYB-(R1)R2R3 (20-120) | P6506 (const. 35S prom.) | P7123 | 1526 | More anthocyanin |
| G680 | 72 | MYB-related (25-71) | P6506 (const. 35S prom.) | P6409 | 1502 | Inc. seedling vigor |
| G680 | 72 | MYB-related (25-71) | P6506 (const. 35S prom.) | P6409 | 1502 | Dark leaf color |
| G729 | 74 | GARP (224-272) | P6506 (const. 35S prom.) | P4528 | 1463 | More anthocyanin |
| G779 | 76 | HLH/MYC (117-174) | P6506 (const. 35S prom.) | P3623 | 1436 | Etiolated seedlings |
| G786 | 78 | HLH/MYC (183-240) | P6506 (const. 35S prom.) | P5110 | 1486 | Dark leaf color |
| G812 | 80 | HS (29-120) | P6506 (const. 35S prom.) | P3650 | 1441 | Etiolated seedlings |
| G860 | 82 | MADS (2-57) | P6506 (const. 35S prom.) | P4033 | 1449 | More trichomes |
| G860 | 82 | MADS (2-57) | P6506 (const. 35S prom.) | P4033 | 1449 | Bright coloration |
| G904 | 84 | RING/C3H2C3 (117-158) | P6506 (const. 35S prom.) | P4748 | 1475 | Inc. seedling vigor |
| G913 | 86 | AP2 (62-128) | P6506 (const. 35S prom.) | P3598 | 1433 | Bright coloration |
| G936 | 88 | GARP (59-107) | P6506 (const. 35S prom.) | P7536 | 1535 | More anthocyanin |
| G940 | 90 | EIL (86-96) | P6506 (const. 35S prom.) | P6037 | 1498 | Etiolated seedlings |
| G975 | 92 | AP2 (4-71) | P6506 (const. 35S prom.) | P3367 | 1421 | Etiolated seedlings |

TABLE 6-continued

Polypeptides of the invention, their conserved domains, families and the traits conferred by overexpressing the polypeptides in tomato plants under the regulatory control of the CaMV 35S promoter

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G977 | 94 | AP2 (5-72) | P6506 (const. 35S prom.) | P3630 | 1437 | Inc. seedling vigor |
| G1004 | 96 | AP2 (153-221) | P6506 (const. 35S prom.) | P4764 | 1480 | Etiolated seedlings |
| G1020 | 98 | AP2 (28-95) | P6506 (const. 35S prom.) | P7091 | 1519 | Inc. seedling vigor |
| G1038 | 100 | GARP (198-247) | P6506 (const. 35S prom.) | P7105 | 1523 | Inc. seedling vigor |
| G1047 | 102 | bZIP (129-180) | P6506 (const. 35S prom.) | P3368 | 1422 | Inc. seedling vigor |
| G1063 | 104 | HLH/MYC (125-182) | P6506 (const. 35S prom.) | P4411 | 1461 | Etiolated seedlings |
| G1070 | 106 | AT-hook (105-113, 114-259) | P6506 (const. 35S prom.) | P3634 | 1439 | Dark leaf color |
| G1075 | 108 | AT-hook (78-86, 87-229) | P6506 (const. 35S prom.) | P7111 | 1524 | More trichomes |
| G1082 | 110 | BZIPT2 (1-53, 503-613) | P6506 (const. 35S prom.) | P6171 | 1500 | Inc. seedling vigor |
| G1084 | 112 | BZIPT2 (1-53, 490-619) | P6506 (const. 35S prom.) | P4779 | 1482 | Inc. seedling vigor |
| G1090 | 114 | AP2 (17-84) | P6506 (const. 35S prom.) | P7093 | 1520 | Inc. seedling vigor |
| G1100 | 116 | RING/C3H2C3 (96-137) | P6506 (const. 35S prom.) | P6459 | 1507 | Bright coloration |
| G1108 | 118 | RING/C3H2C3 (363-403) | P6506 (const. 35S prom.) | P8231 | 1552 | Inc. seedling vigor |
| G1145 | 122 | bZIP (227-270) | P6506 (const. 35S prom.) | P4030 | 1448 | More trichomes |
| G1137 | 120 | HLH/MYC (257-314) | P6506 (const. 35S prom.) | P3410 | 1426 | Etiolated seedlings |
| G1197 | 126 | GARP (NA) | P6506 (const. 35S prom.) | P5678 | 1492 | Bright coloration |
| G1198 | 128 | bZIP (173-223) | P6506 (const. 35S prom.) | P4766 | 1481 | Inc. seedling vigor |
| G1146 | 124 | PAZ (886-896) | P6506 (const. 35S prom.) | P7061 | 1518 | Etiolated seedlings |
| G1228 | 130 | HLH/MYC (172-231) | P6506 (const. 35S prom.) | P3411 | 1427 | Etiolated seedlings |
| G1245 | 132 | MYB-(R1)R2R3 (22-122) | P6506 (const. 35S prom.) | P8193 | 1549 | More anthocyanin |
| G1275 | 134 | WRKY (113-169) | P6506 (const. 35S prom.) | P3412 | 1428 | Etiolated seedlings |
| G1276 | 136 | AP2 (158-224, 250-305) | P6506 (const. 35S prom.) | P7502 | 1531 | Etiolated seedlings |
| G1290 | 138 | AKR (270-366) | P6506 (const. 35S prom.) | P6462 | 1508 | Long Internode |
| G1308 | 140 | MYB-(R1)R2R3 (1-128) | P6506 (const. 35S prom.) | P3830 | 1444 | Etiolated seedlings |
| G1326 | 142 | MYB-(R1)R2R3 (18-121) | P6506 (const. 35S prom.) | P3417 | 1429 | Bright coloration |
| G1361 | 144 | NAC (59-200) | P6506 (const. 35S prom.) | P7770 | 1539 | Inc. seedling vigor |
| G1421 | 146 | AP2 (84-146) | P6506 (const. 35S prom.) | P3631 | 1438 | More trichomes |
| G1463 | 148 | NAC (9-156) | P6506 (const. 35S prom.) | P4337 | 1453 | More anthocyanin |
| G1464 | 150 | NAC (12-160) | P6506 (const. 35S prom.) | P4338 | 1454 | Bright coloration |
| G1476 | 152 | Z-C2H2 (37-57) | P6506 (const. 35S prom.) | P8068 | 1545 | More trichomes |
| G1482 | 154 | Z-CO-like (2-33, 60-102) | P6506 (const. 35S prom.) | P4704 | 1469 | More anthocyanin |
| G1492 | 156 | GARP (34-83) | P6506 (const. 35S prom.) | P4534 | 1464 | More anthocyanin |
| G1537 | 158 | HB (14-74) | P6506 (const. 35S prom.) | P7119 | 1525 | More anthocyanin |
| G1539 | 160 | HB (76-136) | P6506 (const. 35S prom.) | P7119 | 1525 | More anthocyanin |
| G1543 | 162 | HB (135-195) | P6506 (const. 35S prom.) | P3424 | 1430 | Etiolated seedlings |

TABLE 6-continued

Polypeptides of the invention, their conserved domains, families and the traits conferred by overexpressing the polypeptides in tomato plants under the regulatory control of the CaMV 35S promoter

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G1555 | 164 | GARP (28-177) | P6506 (const. 35S prom.) | P7855 | 1542 | More anthocyanin |
| G1560 | 166 | HS (61-152) | P6506 (const. 35S prom.) | P6870 | 1514 | Etiolated seedlings |
| G1584 | 168 | HB (49-109) | P6506 (const. 35S prom.) | P7102 | 1522 | More anthocyanin |
| G1594 | 170 | HB (308-343) | P6506 (const. 35S prom.) | P7171 | 1528 | Bright coloration |
| G1635 | 172 | MYB-related (56-102) | P6506 (const. 35S prom.) | P3606 | 1435 | Etiolated seedlings |
| G1655 | 174 | HLH/MYC (129-186) | P6506 (const. 35S prom.) | P4788 | 1484 | Dark leaf color |
| G1662 | 176 | DBP (44-69, 295-330) | P6506 (const. 35S prom.) | P4703 | 1468 | Long Internode |
| G1671 | 178 | NAC (1-158) | P6506 (const. 35S prom.) | P4341 | 1455 | Etiolated seedlings |
| G1747 | 180 | MYB-(R1)R2R3 (11-114) | P6506 (const. 35S prom.) | P6456 | 1506 | Bright coloration |
| G1753 | 182 | AP2 (12-80) | P6506 (const. 35S prom.) | P7777 | 1540 | Dark leaf color |
| G1755 | 184 | AP2 (71-133) | P6506 (const. 35S prom.) | P4407 | 1460 | Dark leaf color |
| G1756 | 186 | WRKY (138-200) | P6506 (const. 35S prom.) | P6848 | 1513 | Dark leaf color |
| G1757 | 188 | WRKY (158-218) | P6506 (const. 35S prom.) | P6412 | 1503 | Dark leaf color |
| G1760 | 190 | MADS (2-57) | P6506 (const. 35S prom.) | P3371 | 1423 | Etiolated seedlings |
| G1795 | 192 | AP2 (11-75) | P6506 (const. 35S prom.) | P6424 | 1504 | Fewer trichomes |
| G1795 | 192 | AP2 (11-75) | P6506 (const. 35S prom.) | P6424 | 1504 | Bright coloration |
| G1798 | 194 | MADS (1-57) | P6506 (const. 35S prom.) | P8535 | 1558 | Dark leaf color |
| G1798 | 194 | MADS (1-57) | P6506 (const. 35S prom.) | P8535 | 1558 | More trichomes |
| G1809 | 196 | bZIP (23-35, 68-147) | P6506 (const. 35S prom.) | P3982 | 1447 | Etiolated seedlings |
| G1812 | 198 | PCOMB (32-365) | P6506 (const. 35S prom.) | P7789 | 1541 | Inc. seedling vigor |
| G1817 | 200 | PMR (47-331) | P6506 (const. 35S prom.) | P4758 | 1478 | Bright coloration |
| G1818 | 202 | CAAT (24-116) | P6506 (const. 35S prom.) | P4399 | 1458 | Inc. seedling vigor |
| G1825 | 204 | GARP (55-103) | P6506 (const. 35S prom.) | P8217 | 1551 | Etiolated seedlings |
| G1826 | 206 | GARP (87-135) | P6506 (const. 35S prom.) | P8661 | 1565 | More anthocyanin |
| G1836 | 208 | CAAT (24-110) | P6506 (const. 35S prom.) | P3603 | 1434 | Inc. seedling vigor |
| G1844 | 210 | MADS (2-57) | P6506 (const. 35S prom.) | P4403 | 1459 | Inc. seedling vigor |
| G1883 | 212 | Z-Dof (82-124) | P6506 (const. 35S prom.) | P5749 | 1496 | Bright coloration |
| G1895 | 214 | Z-Dof (58-100) | P6506 (const. 35S prom.) | P4546 | 1465 | Etiolated seedlings |
| G1902 | 216 | Z-Dof (31-59) | P6506 (const. 35S prom.) | P3973 | 1446 | Etiolated seedlings |
| G1911 | 218 | MYB-related (12-62) | P6506 (const. 35S prom.) | P4781 | 1483 | Dark leaf color |
| G1930 | 220 | AP2 (59-124, 179-273) | P6506 (const. 35S prom.) | P3373 | 1424 | Etiolated seedlings |
| G1935 | 222 | MADS (1-57) | P6506 (const. 35S prom.) | P4393 | 1456 | Etiolated seedlings |
| G1942 | 224 | HLH/MYC (188-246) | P6506 (const. 35S prom.) | P4188 | 1451 | Inc. seedling vigor |
| G1944 | 226 | AT-hook (87-100) | P6506 (const. 35S prom.) | P4146 | 1450 | Etiolated seedlings |
| G1985 | 228 | Z-C2H2 (37-57) | P6506 (const. 35S prom.) | P8506 | 1556 | Inc. seedling vigor |

TABLE 6-continued

Polypeptides of the invention, their conserved domains, families and the traits conferred by overexpressing the polypeptides in tomato plants under the regulatory control of the CaMV 35S promoter

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G1985 | 228 | Z-C2H2 (37-57) | P6506 (const. 35S prom.) | P8506 | 1556 | Etiolated seedlings |
| G2052 | 230 | NAC (7-158) | P6506 (const. 35S prom.) | P4423 | 1462 | Inc. seedling vigor |
| G2128 | 232 | GARP (49-100) | P6506 (const. 35S prom.) | P4582 | 1466 | More anthocyanin |
| G2141 | 234 | HLH/MYC (306-364) | P6506 (const. 35S prom.) | P4753 | 1476 | Etiolated seedlings |
| G2146 | 236 | HLH/MYC (132-189) | P6506 (const. 35S prom.) | P7492 | 1529 | Dark leaf color |
| G2148 | 238 | HLH/MYC (135-192) | P6506 (const. 35S prom.) | P7877 | 1544 | Dark leaf color |
| G2150 | 240 | HLH/MYC (194-252) | P6506 (const. 35S prom.) | P4598 | 1467 | Etiolated seedlings |
| G2226 | 242 | RING/C3H2C3 (103-144) | P6506 (const. 35S prom.) | P8236 | 1553 | Dark leaf color |
| G2251 | 244 | RING/C3H2C3 (89-132) | P6506 (const. 35S prom.) | P8249 | 1554 | Dark leaf color |
| G2251 | 244 | RING/C3H2C3 (89-132) | P6506 (const. 35S prom.) | P8249 | 1554 | More trichomes |
| G2291 | 246 | AP2 (113-180) | P6506 (const. 35S prom.) | P7125 | 1527 | Inc. seedling vigor |
| G2346 | 248 | SBP (59-135) | P6506 (const. 35S prom.) | P4734 | 1474 | Inc. seedling vigor |
| G2425 | 250 | MYB-(R1)R2R3 (12-119) | P6506 (const. 35S prom.) | P4396 | 1457 | Inc. seedling vigor |
| G2454 | 252 | YABBY (25-64, 136-183) | P6506 (const. 35S prom.) | P8594 | 1559 | More anthocyanin |
| G2484 | 254 | Z-C4HC3 (202-250) | P6506 (const. 35S prom.) | P7094 | 1521 | Inc. seedling vigor |
| G2514 | 256 | AP2 (16-82) | P6506 (const. 35S prom.) | P7503 | 1532 | Dark leaf color |
| G2520 | 258 | HLH/MYC (139-197) | P6506 (const. 35S prom.) | P4755 | 1477 | Etiolated seedlings |
| G2573 | 260 | AP2 (31-98) | P6506 (const. 35S prom.) | P4715 | 1470 | Dark leaf color |
| G2573 | 260 | AP2 (31-98) | P6506 (const. 35S prom.) | P4715 | 1470 | Fewer trichomes |
| G2574 | 262 | WRKY (225-284) | P6506 (const. 35S prom.) | P7507 | 1533 | More anthocyanin |
| G2577 | 264 | AP2 (208-281, 307-375) | P6506 (const. 35S prom.) | P8647 | 1564 | Bright coloration |
| G2583 | 266 | AP2 (4-71) | P6506 (const. 35S prom.) | P4716 | 1471 | Bright coloration |
| G2590 | 268 | MADS (2-57) | P6506 (const. 35S prom.) | P4719 | 1472 | Etiolated seedlings |
| G2606 | 270 | Z-C2H2 (120-140, 192-214) | P6506 (const. 35S prom.) | P7753 | 1538 | More anthocyanin |
| G2674 | 272 | HB (56-116) | P6506 (const. 35S prom.) | P9272 | 1572 | More anthocyanin |
| G2686 | 274 | WRKY (122-173) | P6506 (const. 35S prom.) | P8080 | 1546 | More anthocyanin |
| G2719 | 276 | MYB-(R1)R2R3 (56-154) | P6506 (const. 35S prom.) | P4723 | 1473 | Inc. seedling vigor |
| G2741 | 278 | GARP (149-197) | P6506 (const. 35S prom.) | P8498 | 1555 | Inc. seedling vigor |
| G2742 | 280 | GARP (28-76) | P6506 (const. 35S prom.) | P8637 | 1563 | More anthocyanin |
| G2747 | 282 | ABI3/VP-1 (19-113) | P6506 (const. 35S prom.) | P8127 | 1547 | More anthocyanin |
| G2763 | 284 | HLH/MYC (141-201) | P6506 (const. 35S prom.) | P7493 | 1530 | Dark leaf color |
| G2831 | 286 | Z-C2H2 (72-92, 148-168) | P6506 (const. 35S prom.) | P8618 | 1562 | More anthocyanin |
| G2832 | 288 | Z-C2H2 (11-31, 66-86, 317-337) | P6506 (const. 35S prom.) | P8612 | 1561 | Dark leaf color |
| G2859 | 290 | HLH/MYC (150-208) | P6506 (const. 35S prom.) | P8607 | 1560 | Etiolated seedlings |
| G2885 | 292 | GARP (196-243) | P6506 (const. 35S prom.) | P8143 | 1548 | More trichomes |

TABLE 6-continued

Polypeptides of the invention, their conserved domains, families and the traits conferred by overexpressing the polypeptides in tomato plants under the regulatory control of the CaMV 35S promoter

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G2990 | 294 | ZF-HB (54-109, 200-263) | P6506 (const. 35S prom.) | P7515 | 1534 | More anthocyanin |
| G3032 | 296 | GARP (285-333) | P6506 (const. 35S prom.) | P8674 | 1566 | Inc. seedling vigor |
| G3034 | 298 | GARP (218-266) | P6506 (const. 35S prom.) | P9194 | 1569 | More anthocyanin |
| G3044 | 300 | HLH/MYC (226-284) | P6506 (const. 35S prom.) | P7569 | 1537 | Etiolated seedlings |
| G3061 | 302 | Z-C2H2 (73-90, 174-193) | P6506 (const. 35S prom.) | P8510 | 1557 | Bright coloration |
| G3070 | 304 | Z-C2H2 (129-150) | P6506 (const. 35S prom.) | P9236 | 1571 | Bright coloration |
| G3080 | 306 | bZIP-ZW2 (76-106, 210-237) | P6506 (const. 35S prom.) | P7546 | 1536 | Etiolated seedlings |

Abbreviations:
Inc. = increased
Const. 35S prom. = constitutive cauliflower mosaic virus promoter Regulation of pigment levels in commercial species may be of value because increased anthocyanin may lead to greater photoinhibition; protection from ultraviolet, or increase the antioxidant potential of edible products. Dark leaf color may indicate altered light perception in a plant, which may positively impact ability to grow at a higher density and hence improve yield. Dark leaves may also indicate increased photosynthetic capacity.

Etiolation of seedlings may also demonstrate altered light perception in a plant, which may indicate an altered shade tolerance phenotype, potentially providing the ability to grow at a higher density and improve yield.

Bright coloration can be a consequence of changes in epicuticular wax content or composition. Manipulation of wax composition, amount, or distribution can be used to modify plant tolerance to drought, low humidity or resistance to insects.

Long internodes may also indicate a shade tolerance phenotype. Long internodes may also indicate fast growth. In woody plants, long internodes and fast growth may provide more biomass or fewer knots.

Increased seedling vigor, which helps plants establish quickly, particularly when abiotic or biotic stresses are present, was generally demonstrated by seedling size about 125% of controls several days after germination.

Example VIII

Orthologs and Paralogs of the Sequences of the Invention

The Sequence Listing includes sequences within the National Center for Biotechnology Information (NCBI) UniGene database determined to be orthologous to many of the transcription factor sequences of the present invention. These orthologous sequences, including SEQ ID NO: 1588 to 3372, were identified by a reciprocal BLAST strategy. The reciprocal analysis is performed by using an *Arabidopsis* sequence as a query sequence to identify homologs in diverse species, and a sequence from another species so identified is BLASTed against an *Arabidopsis* database to identify the most closely related *Arabidopsis* sequence. If the latter BLAST analysis returns as a "top hit" the original query sequence, the *Arabidopsis* query sequence and the sequence from another species are considered putative orthologs. Thus, the function of the orthologs can be deduced from the identified function of the query or reference sequence. This type of analysis can also be performed with query sequences from non-*Arabidopsis* species.

Paralogous sequences may also be identified by a BLAST analysis conducted within a database of sequences from a single species and using a query sequence from that species.

Table 7 lists sequences discovered to be orthologous or paralogous to a number of transcription factors of the instant Sequence Listing. The columns headings include, from left to right: Column 1: the SEQ ID NO; Column 2: the corresponding *Arabidopsis* Gene identification (GID) numbers; Column 3: the sequence type (DNA or protein, PRT); Column 4: the species from which the sequence derives; and Column 5: the relationship to other sequences in this table and the Sequence Listing.

TABLE 7

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 1 | G2 | DNA | *Arabidopsis thaliana* | Predicted polypeptide sequence is paralogous to G1416 |
| 2 | G2 | PRT | *Arabidopsis thaliana* | Paralogous to G1416 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 3 | G3 | DNA | *Arabidopsis thaliana* | Predicted polypeptide sequence is paralogous to G10 |
| 4 | G3 | PRT | *Arabidopsis thaliana* | Paralogous to G10 |
| 7 | G12 | DNA | *Arabidopsis thaliana* | Predicted polypeptide sequence is paralogous to G1277, G1379, G24; orthologous to G3656 |
| 8 | G12 | PRT | *Arabidopsis thaliana* | Paralogous to G1277, G1379, G24; Orthologous to G3656 |
| 13 | G35 | DNA | *Arabidopsis thaliana* | Predicted polypeptide sequence is paralogous to G2138 |
| 14 | G35 | PRT | *Arabidopsis thaliana* | Paralogous to G2138 |
| 15 | G47 | DNA | *Arabidopsis thaliana* | Predicted polypeptide sequence is paralogous to G2133; orthologous to G3643, G3644, G3645, G3646, G3647, G3649, G3650, G3651 |
| 16 | G47 | PRT | *Arabidopsis thaliana* | Paralogous to G2133; Orthologous to G3643, G3644, G3645, G3646, G3647, G3649, G3650, G3651 |
| 17 | G201 | DNA | *Arabidopsis thaliana* | Predicted polypeptide sequence is paralogous to G202, G243 |
| 18 | G201 | PRT | *Arabidopsis thaliana* | Paralogous to G202, G243 |
| 19 | G202 | DNA | *Arabidopsis thaliana* | Predicted polypeptide sequence is paralogous to G201, G243 |
| 20 | G202 | PRT | *Arabidopsis thaliana* | Paralogous to G201, G243 |
| 21 | G214 | DNA | *Arabidopsis thaliana* | Predicted polypeptide sequence is paralogous to G680 |
| 22 | G214 | PRT | *Arabidopsis thaliana* | Paralogous to G680 |
| 23 | G261 | DNA | *Arabidopsis thaliana* | Predicted polypeptide sequence is paralogous to G265 |
| 24 | G261 | PRT | *Arabidopsis thaliana* | Paralogous to G265 |
| 27 | G350 | DNA | *Arabidopsis thaliana* | Predicted polypeptide sequence is paralogous to G351, G545 |
| 28 | G350 | PRT | *Arabidopsis thaliana* | Paralogous to G351, G545 |
| 31 | G367 | DNA | *Arabidopsis thaliana* | Predicted polypeptide sequence is paralogous to G2665 |
| 32 | G367 | PRT | *Arabidopsis thaliana* | Paralogous to G2665 |
| 39 | G398 | DNA | *Arabidopsis thaliana* | Predicted polypeptide sequence is paralogous to G399, G964 |
| 40 | G398 | PRT | *Arabidopsis thaliana* | Paralogous to G399, G964 |
| 41 | G448 | DNA | *Arabidopsis thaliana* | Predicted polypeptide sequence is paralogous to G450, G455, G456 |
| 42 | G448 | PRT | *Arabidopsis thaliana* | Paralogous to G450, G455, G456 |
| 45 | G481 | DNA | *Arabidopsis thaliana* | Predicted polypeptide sequence is paralogous to G1364, G2345, G482, G485; orthologous to G3394, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 46 | G481 | PRT | *Arabidopsis thaliana* | Paralogous to G1364, G2345, G482, G485; Orthologous to G3394, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 49 | G501 | DNA | *Arabidopsis thaliana* | Predicted polypeptide sequence is paralogous to G502, G519, G767 |
| 50 | G501 | PRT | *Arabidopsis thaliana* | Paralogous to G502, G519, G767 |
| 51 | G504 | DNA | *Arabidopsis thaliana* | Predicted polypeptide sequence is paralogous to G1425, G1454; orthologous to G3809 |
| 52 | G504 | PRT | *Arabidopsis thaliana* | Paralogous to G1425, G1454; Orthologous to G3809 |
| 53 | G513 | DNA | *Arabidopsis thaliana* | Predicted polypeptide sequence is paralogous to G1426, G1455, G960 |
| 54 | G513 | PRT | *Arabidopsis thaliana* | Paralogous to G1426, G1455, G960 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 55 | G517 | DNA | *Arabidopsis thaliana* | Predicted polypeptide sequence is paralogous to G2053, G515, G516 |
| 56 | G517 | PRT | *Arabidopsis thaliana* | Paralogous to G2053, G515, G516 |
| 57 | G559 | DNA | *Arabidopsis thaliana* | Predicted polypeptide sequence is paralogous to G631 |
| 58 | G559 | PRT | *Arabidopsis thaliana* | Paralogous to G631 |
| 61 | G594 | DNA | *Arabidopsis thaliana* | Predicted polypeptide sequence is paralogous to G1496 |
| 62 | G594 | PRT | *Arabidopsis thaliana* | Paralogous to G1496 |
| 65 | G663 | DNA | *Arabidopsis thaliana* | Predicted polypeptide sequence is paralogous to G1329, G2421, G2422 |
| 66 | G663 | PRT | *Arabidopsis thaliana* | Paralogous to G1329, G2421, G2422 |
| 67 | G668 | DNA | *Arabidopsis thaliana* | Predicted polypeptide sequence is paralogous to G256, G666, G932; orthologous to G3384, G3385, G3386, G3500, G3501, G3502, G3537, G3538, G3539, G3540, G3541 |
| 68 | G668 | PRT | *Arabidopsis thaliana* | Paralogous to G256, G666, G932; Orthologous to G3384, G3385, G3386, G3500, G3501, G3502, G3537, G3538, G3539, G3540, G3541 |
| 71 | G680 | DNA | *Arabidopsis thaliana* | Predicted polypeptide sequence is paralogous to G214 |
| 72 | G680 | PRT | *Arabidopsis thaliana* | Paralogous to G214 |
| 73 | G729 | DNA | *Arabidopsis thaliana* | Predicted polypeptide sequence is paralogous to G1040, G3034, G730 |
| 74 | G729 | PRT | *Arabidopsis thaliana* | Paralogous to G1040, G3034, G730 |
| 79 | G812 | DNA | *Arabidopsis thaliana* | Predicted polypeptide sequence is paralogous to G2467 |
| 80 | G812 | PRT | *Arabidopsis thaliana* | Paralogous to G2467 |
| 81 | G860 | DNA | *Arabidopsis thaliana* | Predicted polypeptide sequence is paralogous to G152, G153, G1760; orthologous to G3479, G3480, G3481, G3482, G3483, G3484, G3485, G3487, G3488, G3489, G3980, G3981, G3982 |
| 82 | G860 | PRT | *Arabidopsis thaliana* | Paralogous to G152, G153, G1760; Orthologous to G3479, G3480, G3481, G3482, G3483, G3484, G3485, G3487, G3488, G3489, G3980, G3981, G3982 |
| 85 | G913 | DNA | *Arabidopsis thaliana* | Predicted polypeptide sequence is paralogous to G2514, G976, G1753 |
| 86 | G913 | PRT | *Arabidopsis thaliana* | Paralogous to G2514, G976, G1753 |
| 89 | G940 | DNA | *Arabidopsis thaliana* | Predicted polypeptide sequence is paralogous to G938, G941 |
| 90 | G940 | PRT | *Arabidopsis thaliana* | Paralogous to G938, G941 |
| 91 | G975 | DNA | *Arabidopsis thaliana* | Predicted polypeptide sequence is paralogous to G1387, G2583; orthologous to G4294 |
| 92 | G975 | PRT | *Arabidopsis thaliana* | Paralogous to G1387, G2583; Orthologous to G4294 |
| 95 | G1004 | DNA | *Arabidopsis thaliana* | Predicted polypeptide sequence is paralogous to G1419, G43, G46, G29; orthologous to G3849 |
| 96 | G1004 | PRT | *Arabidopsis thaliana* | Paralogous to G1419, G43, G46, G29; Orthologous to G3849 |
| 97 | G1020 | DNA | *Arabidopsis thaliana* | Predicted polypeptide sequence is paralogous to G6 |
| 98 | G1020 | PRT | *Arabidopsis thaliana* | Paralogous to G6 |
| 101 | G1047 | DNA | *Arabidopsis thaliana* | Predicted polypeptide sequence is paralogous to G1808 |
| 102 | G1047 | PRT | *Arabidopsis thaliana* | Paralogous to G1808 |
| 103 | G1063 | DNA | *Arabidopsis thaliana* | Predicted polypeptide sequence is paralogous to G2143 |
| 104 | G1063 | PRT | *Arabidopsis thaliana* | Paralogous to G2143 |
| 105 | G1070 | DNA | *Arabidopsis thaliana* | Predicted polypeptide sequence is paralogous to G2657; orthologous to G3404, G3405 |
| 106 | G1070 | PRT | *Arabidopsis thaliana* | Paralogous to G2657; Orthologous to G3404, G3405 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 107 | G1075 | DNA | *Arabidopsis thaliana* | Predicted polypeptide sequence is paralogous to G1076; orthologous to G3406, G3407, G3458, G3459, G3460, G3461 |
| 108 | G1075 | PRT | *Arabidopsis thaliana* | Paralogous to G1076; Orthologous to G3406, G3407, G3458, G3459, G3460, G3461 |
| 109 | G1082 | DNA | *Arabidopsis thaliana* | Predicted polypeptide sequence is paralogous to G576 |
| 110 | G1082 | PRT | *Arabidopsis thaliana* | Paralogous to G576 |
| 117 | G1108 | DNA | *Arabidopsis thaliana* | Predicted polypeptide sequence is paralogous to G2394 |
| 118 | G1108 | PRT | *Arabidopsis thaliana* | Paralogous to G2394 |
| 119 | G1137 | DNA | *Arabidopsis thaliana* | Predicted polypeptide sequence is paralogous to G1133 |
| 120 | G1137 | PRT | *Arabidopsis thaliana* | Paralogous to G1133 |
| 121 | G1145 | DNA | *Arabidopsis thaliana* | Predicted polypeptide sequence is paralogous to G1056 |
| 122 | G1145 | PRT | *Arabidopsis thaliana* | Paralogous to G1056 |
| 123 | G1146 | DNA | *Arabidopsis thaliana* | Predicted polypeptide sequence is paralogous to G1149, G1152 |
| 124 | G1146 | PRT | *Arabidopsis thaliana* | Paralogous to G1149, G1152 |
| 125 | G1197 | DNA | *Arabidopsis thaliana* | Predicted polypeptide sequence is paralogous to G1959 |
| 126 | G1197 | PRT | *Arabidopsis thaliana* | Paralogous to G1959 |
| 127 | G1198 | DNA | *Arabidopsis thaliana* | Predicted polypeptide sequence is paralogous to G1806, G554, G555, G556, G558, G578, G629 |
| 128 | G1198 | PRT | *Arabidopsis thaliana* | Paralogous to G1806, G554, G555, G556, G558, G578, G629 |
| 129 | G1228 | DNA | *Arabidopsis thaliana* | Predicted polypeptide sequence is paralogous to G1227 |
| 130 | G1228 | PRT | *Arabidopsis thaliana* | Paralogous to G1227 |
| 131 | G1245 | DNA | *Arabidopsis thaliana* | Predicted polypeptide sequence is paralogous to G1247 |
| 132 | G1245 | PRT | *Arabidopsis thaliana* | Paralogous to G1247 |
| 133 | G1275 | DNA | *Arabidopsis thaliana* | Predicted polypeptide sequence is paralogous to G1274; orthologous to G3722, G3723, G3724, G3731, G3732, G3803, G3719, G3720, G3721, G3725, G3726, G3727, G3728, G3729, G3730, G3733, G3795, G3797, G3802, G3804 |
| 134 | G1275 | PRT | *Arabidopsis thaliana* | Paralogous to G1274; Orthologous to G3722, G3723, G3724, G3731, G3732, G3803, G3719, G3720, G3721, G3725, G3726, G3727, G3728, G3729, G3730, G3733, G3795, G3797, G3802, G3804 |
| 137 | G1290 | DNA | *Arabidopsis thaliana* | Predicted polypeptide sequence is paralogous to G278 |
| 138 | G1290 | PRT | *Arabidopsis thaliana* | Paralogous to G278 |
| 145 | G1421 | DNA | *Arabidopsis thaliana* | Predicted polypeptide sequence is paralogous to G1750, G440, G864; orthologous to G4079, G4080, G4283, G4284, G4285, G4286, G4287, G4288, G4289, G4290, G4291, G4292, G4293 |
| 146 | G1421 | PRT | *Arabidopsis thaliana* | Paralogous to G1750, G440, G864; Orthologous to G4079, G4080, G4283, G4284, G4285, G4286, G4287, G4288, G4289, G4290, G4291, G4292, G4293 |
| 147 | G1463 | DNA | *Arabidopsis thaliana* | Predicted polypeptide sequence is paralogous to G1461, G1462, G1464, G1465 |
| 148 | G1463 | PRT | *Arabidopsis thaliana* | Paralogous to G1461, G1462, G1464, G1465 |
| 149 | G1464 | DNA | *Arabidopsis thaliana* | Predicted polypeptide sequence is paralogous to G1461, G1462, G1463, G1465 |
| 150 | G1464 | PRT | *Arabidopsis thaliana* | Paralogous to G1461, G1462, G1463, G1465 |
| 153 | G1482 | DNA | *Arabidopsis thaliana* | Predicted polypeptide sequence is paralogous to G1888; orthologous to G5159 |
| 154 | G1482 | PRT | *Arabidopsis thaliana* | Paralogous to G1888; Orthologous to G5159 |
| 155 | G1492 | DNA | *Arabidopsis thaliana* | Predicted polypeptide sequence is paralogous to G2742 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 156 | G1492 | PRT | *Arabidopsis thaliana* | Paralogous to G2742 |
| 161 | G1543 | DNA | *Arabidopsis thaliana* | Predicted polypeptide sequence is orthologous to G3510, G3490, G3524, G4371 |
| 162 | G1543 | PRT | *Arabidopsis thaliana* | Orthologous to G3510, G3490, G3524, G4371 |
| 169 | G1594 | DNA | *Arabidopsis thaliana* | Predicted polypeptide sequence is paralogous to G428 |
| 170 | G1594 | PRT | *Arabidopsis thaliana* | Paralogous to G428 |
| 179 | G1747 | DNA | *Arabidopsis thaliana* | Predicted polypeptide sequence is paralogous to G251 |
| 180 | G1747 | PRT | *Arabidopsis thaliana* | Paralogous to G251 |
| 181 | G1753 | DNA | *Arabidopsis thaliana* | Predicted polypeptide sequence is paralogous to G913, G2514, G976 |
| 182 | G1753 | PRT | *Arabidopsis thaliana* | Paralogous to G913, G2514, G976 |
| 183 | G1755 | DNA | *Arabidopsis thaliana* | Predicted polypeptide sequence is paralogous to G1754 |
| 184 | G1755 | PRT | *Arabidopsis thaliana* | Paralogous to G1754 |
| 187 | G1757 | DNA | *Arabidopsis thaliana* | Predicted polypeptide sequence is paralogous to G1847 |
| 188 | G1757 | PRT | *Arabidopsis thaliana* | Paralogous to G1847 |
| 189 | G1760 | DNA | *Arabidopsis thaliana* | Predicted polypeptide sequence is paralogous to G152, G153, G860; orthologous to G3479, G3480, G3481, G3482, G3483, G3484, G3485, G3487, G3488, G3489, G3980, G3981, G3982 |
| 190 | G1760 | PRT | *Arabidopsis thaliana* | Paralogous to G152, G153, G860; Orthologous to G3479, G3480, G3481, G3482, G3483, G3484, G3485, G3487, G3488, G3489, G3980, G3981, G3982 |
| 191 | G1795 | DNA | *Arabidopsis thaliana* | Predicted polypeptide sequence is paralogous to G1791, G1792, G30; orthologous to G3380, G3381, G3383, G3515, G3516, G3517, G3518, G3519, G3520, G3735, G3736, G3737, G3794, G3739, G3929, G4328, G4329, G4330 |
| 192 | G1795 | PRT | *Arabidopsis thaliana* | Paralogous to G1791, G1792, G30; Orthologous to G3380, G3381, G3383, G3515, G3516, G3517, G3518, G3519, G3520, G3735, G3736, G3737, G3794, G3739, G3929, G4328, G4329, G4330 |
| 193 | G1798 | DNA | *Arabidopsis thaliana* | Predicted polypeptide sequence is paralogous to G149, G627, G1011, G154, G1797; orthologous to G4061, G4062, G4063, G4064, G4065, G4066, G4067 |
| 194 | G1798 | PRT | *Arabidopsis thaliana* | Paralogous to G149, G627, G1011, G154, G1797; Orthologous to G4061, G4062, G4063, G4064, G4065, G4066, G4067 |
| 195 | G1809 | DNA | *Arabidopsis thaliana* | Predicted polypeptide sequence is paralogous to G557; orthologous to G4627, G4630, G4631, G4632, G5158 |
| 196 | G1809 | PRT | *Arabidopsis thaliana* | Paralogous to G557; Orthologous to G4627, G4630, G4631, G4632, G5158 |
| 199 | G1817 | DNA | *Arabidopsis thaliana* | Predicted polypeptide sequence is paralogous to G2316 |
| 200 | G1817 | PRT | *Arabidopsis thaliana* | Paralogous to G2316 |
| 201 | G1818 | DNA | *Arabidopsis thaliana* | Predicted polypeptide sequence is paralogous to G1836 |
| 202 | G1818 | PRT | *Arabidopsis thaliana* | Paralogous to G1836 |
| 207 | G1836 | DNA | *Arabidopsis thaliana* | Predicted polypeptide sequence is paralogous to G1818 |
| 208 | G1836 | PRT | *Arabidopsis thaliana* | Paralogous to G1818 |
| 209 | G1844 | DNA | *Arabidopsis thaliana* | Predicted polypeptide sequence is paralogous to G157, G1759, G1842, G1843, G859 |
| 210 | G1844 | PRT | *Arabidopsis thaliana* | Paralogous to G157, G1759, G1842, G1843, G859 |
| 211 | G1883 | DNA | *Arabidopsis thaliana* | Predicted polypeptide sequence is paralogous to G648 |
| 212 | G1883 | PRT | *Arabidopsis thaliana* | Paralogous to G648 |
| 213 | G1895 | DNA | *Arabidopsis thaliana* | Predicted polypeptide sequence is paralogous to G1903 |
| 214 | G1895 | PRT | *Arabidopsis thaliana* | Paralogous to G1903 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 215 | G1902 | DNA | *Arabidopsis thaliana* | Predicted polypeptide sequence is paralogous to G1901 |
| 216 | G1902 | PRT | *Arabidopsis thaliana* | Paralogous to G1901 |
| 217 | G1911 | DNA | *Arabidopsis thaliana* | Predicted polypeptide sequence is paralogous to G1789, G2721, G997 |
| 218 | G1911 | PRT | *Arabidopsis thaliana* | Paralogous to G1789, G2721, G997 |
| 219 | G1930 | DNA | *Arabidopsis thaliana* | Predicted polypeptide sequence is paralogous to G867, G9, G993; orthologous to G3388, G3389, G3390, G3391, G3432, G3433, G3451, G3452, G3453, G3454, G3455 |
| 220 | G1930 | PRT | *Arabidopsis thaliana* | Paralogous to G867, G9, G993; Orthologous to G3388, G3389, G3390, G3391, G3432, G3433, G3451, G3452, G3453, G3454, G3455 |
| 221 | G1935 | DNA | *Arabidopsis thaliana* | Predicted polypeptide sequence is paralogous to G2058, G2578 |
| 222 | G1935 | PRT | *Arabidopsis thaliana* | Paralogous to G2058, G2578 |
| 223 | G1942 | DNA | *Arabidopsis thaliana* | Predicted polypeptide sequence is paralogous to G2144 |
| 224 | G1942 | PRT | *Arabidopsis thaliana* | Paralogous to G2144 |
| 225 | G1944 | DNA | *Arabidopsis thaliana* | Predicted polypeptide sequence is paralogous to G605 |
| 226 | G1944 | PRT | *Arabidopsis thaliana* | Paralogous to G605 |
| 229 | G2052 | DNA | *Arabidopsis thaliana* | Predicted polypeptide sequence is paralogous to G506 |
| 230 | G2052 | PRT | *Arabidopsis thaliana* | Paralogous to G506 |
| 231 | G2128 | DNA | *Arabidopsis thaliana* | Predicted polypeptide sequence is paralogous to G1491 |
| 232 | G2128 | PRT | *Arabidopsis thaliana* | Paralogous to G1491 |
| 237 | G2148 | DNA | *Arabidopsis thaliana* | Predicted polypeptide sequence is paralogous to G2145 |
| 238 | G2148 | PRT | *Arabidopsis thaliana* | Paralogous to G2145 |
| 251 | G2454 | DNA | *Arabidopsis thaliana* | Predicted polypeptide sequence is paralogous to G2456 |
| 252 | G2454 | PRT | *Arabidopsis thaliana* | Paralogous to G2456 |
| 253 | G2484 | DNA | *Arabidopsis thaliana* | Predicted polypeptide sequence is paralogous to G1232 |
| 254 | G2484 | PRT | *Arabidopsis thaliana* | Paralogous to G1232 |
| 255 | G2514 | DNA | *Arabidopsis thaliana* | Predicted polypeptide sequence is paralogous to G913, G976, G1753 |
| 256 | G2514 | PRT | *Arabidopsis thaliana* | Paralogous to G913, G976, G1753 |
| 261 | G2574 | DNA | *Arabidopsis thaliana* | Predicted polypeptide sequence is paralogous to G2110 |
| 262 | G2574 | PRT | *Arabidopsis thaliana* | Paralogous to G2110 |
| 265 | G2583 | DNA | *Arabidopsis thaliana* | Predicted polypeptide sequence is paralogous to G1387, G975; orthologous to G4294 |
| 266 | G2583 | PRT | *Arabidopsis thaliana* | Paralogous to G1387, G975; Orthologous to G4294 |
| 273 | G2686 | DNA | *Arabidopsis thaliana* | Predicted polypeptide sequence is paralogous to G2586, G2587 |
| 274 | G2686 | PRT | *Arabidopsis thaliana* | Paralogous to G2586, G2587 |
| 275 | G2719 | DNA | *Arabidopsis thaliana* | Predicted polypeptide sequence is paralogous to G216 |
| 276 | G2719 | PRT | *Arabidopsis thaliana* | Paralogous to G216 |
| 277 | G2741 | DNA | *Arabidopsis thaliana* | Predicted polypeptide sequence is paralogous to G1435; orthologous to G4240, G4241, G4243, G4244, G4245 |
| 278 | G2741 | PRT | *Arabidopsis thaliana* | Paralogous to G1435; Orthologous to G4240, G4241, G4243, G4244, G4245 |
| 279 | G2742 | DNA | *Arabidopsis thaliana* | Predicted polypeptide sequence is paralogous to G1492 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 280 | G2742 | PRT | *Arabidopsis thaliana* | Paralogous to G1492 |
| 281 | G2747 | DNA | *Arabidopsis thaliana* | Predicted polypeptide sequence is paralogous to G1010 |
| 282 | G2747 | PRT | *Arabidopsis thaliana* | Paralogous to G1010 |
| 285 | G2831 | DNA | *Arabidopsis thaliana* | Predicted polypeptide sequence is paralogous to G903 |
| 286 | G2831 | PRT | *Arabidopsis thaliana* | Paralogous to G903 |
| 289 | G2859 | DNA | *Arabidopsis thaliana* | Predicted polypeptide sequence is paralogous to G2779 |
| 290 | G2859 | PRT | *Arabidopsis thaliana* | Paralogous to G2779 |
| 293 | G2990 | DNA | *Arabidopsis thaliana* | Predicted polypeptide sequence is paralogous to G2989; orthologous to G3680, G3681, G3691, G3859, G3860, G3861, G3934 |
| 294 | G2990 | PRT | *Arabidopsis thaliana* | Paralogous to G2989; Orthologous to G3680, G3681, G3691, G3859, G3860, G3861, G3934 |
| 297 | G3034 | DNA | *Arabidopsis thaliana* | Predicted polypeptide sequence is paralogous to G1040, G729, G730 |
| 298 | G3034 | PRT | *Arabidopsis thaliana* | Paralogous to G1040, G729, G730 |
| 301 | G3061 | DNA | *Arabidopsis thaliana* | Predicted polypeptide sequence is paralogous to G1350 |
| 302 | G3061 | PRT | *Arabidopsis thaliana* | Paralogous to G1350 |
| 305 | G3080 | DNA | *Arabidopsis thaliana* | Predicted polypeptide sequence is paralogous to G3079 |
| 306 | G3080 | PRT | *Arabidopsis thaliana* | Paralogous to G3079 |
| 307 | G10 | DNA | *Arabidopsis thaliana* | Predicted polypeptide sequence is paralogous to G3 |
| 308 | G10 | PRT | *Arabidopsis thaliana* | Paralogous to G3 |
| 309 | G1010 | DNA | *Arabidopsis thaliana* | Predicted polypeptide sequence is paralogous to G2747 |
| 310 | G1010 | PRT | *Arabidopsis thaliana* | Paralogous to G2747 |
| 311 | G1011 | DNA | *Arabidopsis thaliana* | Predicted polypeptide sequence is paralogous to G149, G627, G154, G1797, G1798; orthologous to G4061, G4062, G4063, G4064, G4065, G4066, G4067 |
| 312 | G1011 | PRT | *Arabidopsis thaliana* | Paralogous to G149, G627, G154, G1797, G1798; Orthologous to G4061, G4062, G4063, G4064, G4065, G4066, G4067 |
| 313 | G1040 | DNA | *Arabidopsis thaliana* | Predicted polypeptide sequence is paralogous to G3034, G729, G730 |
| 314 | G1040 | PRT | *Arabidopsis thaliana* | Paralogous to G3034, G729, G730 |
| 315 | G1056 | DNA | *Arabidopsis thaliana* | Predicted polypeptide sequence is paralogous to G1145 |
| 316 | G1056 | PRT | *Arabidopsis thaliana* | Paralogous to G1145 |
| 317 | G1076 | DNA | *Arabidopsis thaliana* | Predicted polypeptide sequence is paralogous to G1075; orthologous to G3406, G3407, G3458, G3459, G3460, G3461 |
| 318 | G1076 | PRT | *Arabidopsis thaliana* | Paralogous to G1075; Orthologous to G3406, G3407, G3458, G3459, G3460, G3461 |
| 319 | G1133 | DNA | *Arabidopsis thaliana* | Predicted polypeptide sequence is paralogous to G1137 |
| 320 | G1133 | PRT | *Arabidopsis thaliana* | Paralogous to G1137 |
| 321 | G1149 | DNA | *Arabidopsis thaliana* | Predicted polypeptide sequence is paralogous to G1146, G1152 |
| 322 | G1149 | PRT | *Arabidopsis thaliana* | Paralogous to G1146, G1152 |
| 323 | G1152 | DNA | *Arabidopsis thaliana* | Predicted polypeptide sequence is paralogous to G1146, G1149 |
| 324 | G1152 | PRT | *Arabidopsis thaliana* | Paralogous to G1146, G1149 |
| 325 | G1227 | DNA | *Arabidopsis thaliana* | Predicted polypeptide sequence is paralogous to G1228 |
| 326 | G1227 | PRT | *Arabidopsis thaliana* | Paralogous to G1228 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 327 | G1232 | DNA | *Arabidopsis thaliana* | Predicted polypeptide sequence is paralogous to G2484 |
| 328 | G1232 | PRT | *Arabidopsis thaliana* | Paralogous to G2484 |
| 329 | G1247 | DNA | *Arabidopsis thaliana* | Predicted polypeptide sequence is paralogous to G1245 |
| 330 | G1247 | PRT | *Arabidopsis thaliana* | Paralogous to G1245 |
| 331 | G1274 | DNA | *Arabidopsis thaliana* | Predicted polypeptide sequence is paralogous to G1275; orthologous to G3722, G3723, G3724, G3731, G3732, G3803, G3719, G3720, G3721, G3725, G3726, G3727, G3728, G3729, G3730, G3733, G3795, G3797, G3802, G3804 |
| 332 | G1274 | PRT | *Arabidopsis thaliana* | Paralogous to G1275; Orthologous to G3722, G3723, G3724, G3731, G3732, G3803, G3719, G3720, G3721,63725, G3726, G3727, G3728, G3729, G3730, G3733, G3795, G3797, G3802, G3804 |
| 333 | G1277 | DNA | *Arabidopsis thaliana* | Predicted polypeptide sequence is paralogous to G12, G1379, G24; orthologous to G3656 |
| 334 | G1277 | PRT | *Arabidopsis thaliana* | Paralogous to G12, G1379, G24; Orthologous to G3656 |
| 335 | G1329 | DNA | *Arabidopsis thaliana* | Predicted polypeptide sequence is paralogous to G2421, G2422, G663 |
| 336 | G1329 | PRT | *Arabidopsis thaliana* | Paralogous to G2421, G2422, G663 |
| 337 | G1350 | DNA | *Arabidopsis thaliana* | Predicted polypeptide sequence is paralogous to G3061 |
| 338 | G1350 | PRT | *Arabidopsis thaliana* | Paralogous to G3061 |
| 339 | G1364 | DNA | *Arabidopsis thaliana* | Predicted polypeptide sequence is paralogous to G2345, G481, G482, G485; orthologous to G3394, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 340 | G1364 | PRT | *Arabidopsis thaliana* | Paralogous to G2345, G481, G482, G485; Orthologous to G3394, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 341 | G1379 | DNA | *Arabidopsis thaliana* | Predicted polypeptide sequence is paralogous to G12, G1277, G24; orthologous to G3656 |
| 342 | G1379 | PRT | *Arabidopsis thaliana* | Paralogous to G12, G1277, G24; Orthologous to G3656 |
| 343 | G1387 | DNA | *Arabidopsis thaliana* | Predicted polypeptide sequence is paralogous to G2583, G975; orthologous to G4294 |
| 344 | G1387 | PRT | *Arabidopsis thaliana* | Paralogous to G2583, G975; Orthologous to G4294 |
| 345 | G1416 | DNA | *Arabidopsis thaliana* | Predicted polypeptide sequence is paralogous to G2 |
| 346 | G1416 | PRT | *Arabidopsis thaliana* | Paralogous to G2 |
| 347 | G1419 | DNA | *Arabidopsis thaliana* | Predicted polypeptide sequence is paralogous to G43, G46, G1004, G29; orthologous to G3849 |
| 348 | G1419 | PRT | *Arabidopsis thaliana* | Paralogous to G43, G46, G1004, G29; Orthologous to G3849 |
| 349 | G1425 | DNA | *Arabidopsis thaliana* | Predicted polypeptide sequence is paralogous to G1454, G504; orthologous to G3809 |
| 350 | G1425 | PRT | *Arabidopsis thaliana* | Paralogous to G1454, G504; Orthologous to G3809 |
| 351 | G1426 | DNA | *Arabidopsis thaliana* | Predicted polypeptide sequence is paralogous to G1455, G513, G960 |
| 352 | G1426 | PRT | *Arabidopsis thaliana* | Paralogous to G1455, G513, G960 |
| 353 | G1435 | DNA | *Arabidopsis thaliana* | Predicted polypeptide sequence is paralogous to G2741; orthologous to G4240, G4241, G4243, G4244, G4245 |
| 354 | G1435 | PRT | *Arabidopsis thaliana* | Paralogous to G2741; Orthologous to G4240, G4241, G4243, G4244, G4245 |
| 355 | G1454 | DNA | *Arabidopsis thaliana* | Predicted polypeptide sequence is paralogous to G1425, G504; orthologous to G3809 |
| 356 | G1454 | PRT | *Arabidopsis thaliana* | Paralogous to G1425, G504; Orthologous to G3809 |
| 357 | G1455 | DNA | *Arabidopsis thaliana* | Predicted polypeptide sequence is paralogous to G1426, G513, G960 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 358 | G1455 | PRT | *Arabidopsis thaliana* | Paralogous to G1426, G513, G960 |
| 359 | G1461 | DNA | *Arabidopsis thaliana* | Predicted polypeptide sequence is paralogous to G1462, G1463, G1464, G1465 |
| 360 | G1461 | PRT | *Arabidopsis thaliana* | Paralogous to G1462, G1463, G1464, G1465 |
| 361 | G1462 | DNA | *Arabidopsis thaliana* | Predicted polypeptide sequence is paralogous to G1461, G1463, G1464, G1465 |
| 362 | G1462 | PRT | *Arabidopsis thaliana* | Paralogous to G1461, G1463, G1464, G1465 |
| 363 | G1465 | DNA | *Arabidopsis thaliana* | Predicted polypeptide sequence is paralogous to G1461, G1462, G1463, G1464 |
| 364 | G1465 | PRT | *Arabidopsis thaliana* | Paralogous to G1461, G1462, G1463, G1464 |
| 365 | G149 | DNA | *Arabidopsis thaliana* | Predicted polypeptide sequence is paralogous to G627, G1011, G154, G1797, G1798; orthologous to G4061, G4062, G4063, G4064, G4065, G4066, G4067 |
| 366 | G149 | PRT | *Arabidopsis thaliana* | Paralogous to G627, G1011, G154, G1797, G1798; Orthologous to G4061, G4062, G4063, G4064, G4065, G4066, G4067 |
| 367 | G1491 | DNA | *Arabidopsis thaliana* | Predicted polypeptide sequence is paralogous to G2128 |
| 368 | G1491 | PRT | *Arabidopsis thaliana* | Paralogous to G2128 |
| 369 | G1496 | DNA | *Arabidopsis thaliana* | Predicted polypeptide sequence is paralogous to G594 |
| 370 | G1496 | PRT | *Arabidopsis thaliana* | Paralogous to G594 |
| 371 | G152 | DNA | *Arabidopsis thaliana* | Predicted polypeptide sequence is paralogous to G153, G1760, G860; orthologous to G3479, G3480, G3481, G3482, G3483, G3484, G3485, G3487, G3488, G3489, G3980, G3981, G3982 |
| 372 | G152 | PRT | *Arabidopsis thaliana* | Paralogous to G153, G1760, G860; Orthologous to G3479, G3480, G3481, G3482, G3483, G3484, G3485, G3487, G3488, G3489, G3980, G3981, G3982 |
| 373 | G153 | DNA | *Arabidopsis thaliana* | Predicted polypeptide sequence is paralogous to G152, G1760, G860; orthologous to G3479, G3480, G3481, G3482, G3483, G3484, G3485, G3487, G3488, G3489, G3980, G3981, G3982 |
| 374 | G153 | PRT | *Arabidopsis thaliana* | Paralogous to G152, G1760, G860; Orthologous to G3479, G3480, G3481, G3482, G3483, G3484, G3485, G3487, G3488, G3489, G3980, G3981, G3982 |
| 375 | G154 | DNA | *Arabidopsis thaliana* | Predicted polypeptide sequence is paralogous to G149, G627, G1011, G1797, G1798; orthologous to G4061, G4062, G4063, G4064, G4065, G4066, G4067 |
| 376 | G154 | PRT | *Arabidopsis thaliana* | Paralogous to G149, G627, G1011, G1797, G1798; Orthologous to G4061, G4062, G4063, G4064, G4065, G4066, G4067 |
| 377 | G157 | DNA | *Arabidopsis thaliana* | Predicted polypeptide sequence is paralogous to G1759, G1842, G1843, G1844, G859 |
| 378 | G157 | PRT | *Arabidopsis thaliana* | Paralogous to G1759, G1842, G1843, G1844, G859 |
| 379 | G1750 | DNA | *Arabidopsis thaliana* | Predicted polypeptide sequence is paralogous to G1421, G440, G864; orthologous to G4079, G4080, G4283, G4284, G4285, G4286, G4287, G4288, G4289, G4290, G4291, G4292, G4293 |
| 380 | G1750 | PRT | *Arabidopsis thaliana* | Paralogous to G1421, G440, G864; Orthologous to G4079, G4080, G4283, G4284, G4285, G4286, G4287, G4288, G4289, G4290, G4291, G4292, G4293 |
| 381 | G1754 | DNA | *Arabidopsis thaliana* | Predicted polypeptide sequence is paralogous to G1755 |
| 382 | G1754 | PRT | *Arabidopsis thaliana* | Paralogous to G1755 |
| 383 | G1759 | DNA | *Arabidopsis thaliana* | Predicted polypeptide sequence is paralogous to G157, G1842, G1843, G1844, G859 |
| 384 | G1759 | PRT | *Arabidopsis thaliana* | Paralogous to G157, G1842, G1843, G1844, G859 |
| 385 | G1789 | DNA | *Arabidopsis thaliana* | Predicted polypeptide sequence is paralogous to G1911, G2721, G997 |
| 386 | G1789 | PRT | *Arabidopsis thaliana* | Paralogous to G1911, G2721, G997 |
| 387 | G1791 | DNA | *Arabidopsis thaliana* | Predicted polypeptide sequence is paralogous to G1792, G1795, G30; orthologous to G3380, G3381, G3383, G3515, G3516, G3517, G3518, G3519, G3520, G3735, G3736, G3737, G3794, G3739, G3929, G4328, G4329, G4330 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 388 | G1791 | PRT | *Arabidopsis thaliana* | Paralogous to G1792, G1795, G30; Orthologous to G3380, G3381, G3383, G3515, G3516, G3517, G3518, G3519, G3520, G3735, G3736, G3737, G3794, G3739, G3929, G4328, G4329, G4330 |
| 389 | G1792 | DNA | *Arabidopsis thaliana* | Predicted polypeptide sequence is paralogous to G1791, G1795, G30; orthologous to G3380, G3381, G3383, G3515, G3516, G3517, G3518, G3519, G3520, G3735, G3736, G3737, G3794, G3739, G3929, G4328, G4329, G4330 |
| 390 | G1792 | PRT | *Arabidopsis thaliana* | Paralogous to G1791, G1795, G30; Orthologous to G3380, G3381, G3383, G3515, G3516, G3517, G3518, G3519, G3520, G3735, G3736, G3737, G3794, G3739, G3929, G4328, G4329, G4330 |
| 391 | G1797 | DNA | *Arabidopsis thaliana* | Predicted polypeptide sequence is paralogous to G149, G627, G1011, G154, G1798; orthologous to G4061, G4062, G4063, G4064, G4065, G4066, G4067 |
| 392 | G1797 | PRT | *Arabidopsis thaliana* | Paralogous to G149, G627, G1011, G154, G1798; Orthologous to G4061, G4062, G4063, G4064, G4065, G4066, G4067 |
| 393 | G1806 | DNA | *Arabidopsis thaliana* | Predicted polypeptide sequence is paralogous to G1198, G554, G555, G556, G558, G578, G629 |
| 394 | G1806 | PRT | *Arabidopsis thaliana* | Paralogous to G1198, G554, G555, G556, G558, G578, G629 |
| 395 | G1808 | DNA | *Arabidopsis thaliana* | Predicted polypeptide sequence is paralogous to G1047 |
| 396 | G1808 | PRT | *Arabidopsis thaliana* | Paralogous to G1047 |
| 397 | G1842 | DNA | *Arabidopsis thaliana* | Predicted polypeptide sequence is paralogous to G157, G1759, G1843, G1844, G859 |
| 398 | G1842 | PRT | *Arabidopsis thaliana* | Paralogous to G157, G1759, G1843, G1844, G859 |
| 399 | G1843 | DNA | *Arabidopsis thaliana* | Predicted polypeptide sequence is paralogous to G157, G1759, G1842, G1844, G859 |
| 400 | G1843 | PRT | *Arabidopsis thaliana* | Paralogous to G157, G1759, G1842, G1844, G859 |
| 401 | G1847 | DNA | *Arabidopsis thaliana* | Predicted polypeptide sequence is paralogous to G1757 |
| 402 | G1847 | PRT | *Arabidopsis thaliana* | Paralogous to G1757 |
| 403 | G1888 | DNA | *Arabidopsis thaliana* | Predicted polypeptide sequence is paralogous to G1482; orthologous to G5159 |
| 404 | G1888 | PRT | *Arabidopsis thaliana* | Paralogous to G1482; Orthologous to G5159 |
| 405 | G1901 | DNA | *Arabidopsis thaliana* | Predicted polypeptide sequence is paralogous to G1902 |
| 406 | G1901 | PRT | *Arabidopsis thaliana* | Paralogous to G1902 |
| 407 | G1903 | DNA | *Arabidopsis thaliana* | Predicted polypeptide sequence is paralogous to G1895 |
| 408 | G1903 | PRT | *Arabidopsis thaliana* | Paralogous to G1895 |
| 409 | G1959 | DNA | *Arabidopsis thaliana* | Predicted polypeptide sequence is paralogous to G1197 |
| 410 | G1959 | PRT | *Arabidopsis thaliana* | Paralogous to G1197 |
| 411 | G2053 | DNA | *Arabidopsis thaliana* | Predicted polypeptide sequence is paralogous to G515, G516, G517 |
| 412 | G2053 | PRT | *Arabidopsis thaliana* | Paralogous to G515, G516, G517 |
| 413 | G2058 | DNA | *Arabidopsis thaliana* | Predicted polypeptide sequence is paralogous to G1935, G2578 |
| 414 | G2058 | PRT | *Arabidopsis thaliana* | Paralogous to G1935, G2578 |
| 415 | G2110 | DNA | *Arabidopsis thaliana* | Predicted polypeptide sequence is paralogous to G2574 |
| 416 | G2110 | PRT | *Arabidopsis thaliana* | Paralogous to G2574 |
| 417 | G2133 | DNA | *Arabidopsis thaliana* | Predicted polypeptide sequence is paralogous to G47; orthologous to G3643, G3644, G3645, G3646, G3647, G3649, G3650, G3651 |
| 418 | G2133 | PRT | *Arabidopsis thaliana* | Paralogous to G47; Orthologous to G3643, G3644, G3645, G3646, G3647, G3649, G3650, G3651 |
| 419 | G2138 | DNA | *Arabidopsis thaliana* | Predicted polypeptide sequence is paralogous to G35 |
| 420 | G2138 | PRT | *Arabidopsis thaliana* | Paralogous to G35 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 421 | G2143 | DNA | *Arabidopsis thaliana* | Predicted polypeptide sequence is paralogous to G1063 |
| 422 | G2143 | PRT | *Arabidopsis thaliana* | Paralogous to G1063 |
| 423 | G2144 | DNA | *Arabidopsis thaliana* | Predicted polypeptide sequence is paralogous to G1942 |
| 424 | G2144 | PRT | *Arabidopsis thaliana* | Paralogous to G1942 |
| 425 | G2145 | DNA | *Arabidopsis thaliana* | Predicted polypeptide sequence is paralogous to G2148 |
| 426 | G2145 | PRT | *Arabidopsis thaliana* | Paralogous to G2148 |
| 427 | G216 | DNA | *Arabidopsis thaliana* | Predicted polypeptide sequence is paralogous to G2719 |
| 428 | G216 | PRT | *Arabidopsis thaliana* | Paralogous to G2719 |
| 429 | G2316 | DNA | *Arabidopsis thaliana* | Predicted polypeptide sequence is paralogous to G1817 |
| 430 | G2316 | PRT | *Arabidopsis thaliana* | Paralogous to G1817 |
| 431 | G2345 | DNA | *Arabidopsis thaliana* | Predicted polypeptide sequence is paralogous to G1364, G481, G482, G485; orthologous to G3394, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 432 | G2345 | PRT | *Arabidopsis thaliana* | Paralogous to G1364, G481, G482, G485; Orthologous to G3394, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 433 | G2394 | DNA | *Arabidopsis thaliana* | Predicted polypeptide sequence is paralogous to G1108 |
| 434 | G2394 | PRT | *Arabidopsis thaliana* | Paralogous to G1108 |
| 435 | G24 | DNA | *Arabidopsis thaliana* | Predicted polypeptide sequence is paralogous to G12, G1277, G1379; orthologous to G3656 |
| 436 | G24 | PRT | *Arabidopsis thaliana* | Paralogous to G12, G1277, G1379; Orthologous to G3656 |
| 437 | G2421 | DNA | *Arabidopsis thaliana* | Predicted polypeptide sequence is paralogous to G1329, G2422, G663 |
| 438 | G2421 | PRT | *Arabidopsis thaliana* | Paralogous to G1329, G2422, G663 |
| 439 | G2422 | DNA | *Arabidopsis thaliana* | Predicted polypeptide sequence is paralogous to G1329, G2421, G663 |
| 440 | G2422 | PRT | *Arabidopsis thaliana* | Paralogous to G1329, G2421, G663 |
| 441 | G243 | DNA | *Arabidopsis thaliana* | Predicted polypeptide sequence is paralogous to G201, G202 |
| 442 | G243 | PRT | *Arabidopsis thaliana* | Paralogous to G201, G202 |
| 443 | G2456 | DNA | *Arabidopsis thaliana* | Predicted polypeptide sequence is paralogous to G2454 |
| 444 | G2456 | PRT | *Arabidopsis thaliana* | Paralogous to G2454 |
| 445 | G2467 | DNA | *Arabidopsis thaliana* | Predicted polypeptide sequence is paralogous to G812 |
| 446 | G2467 | PRT | *Arabidopsis thaliana* | Paralogous to G812 |
| 447 | G251 | DNA | *Arabidopsis thaliana* | Predicted polypeptide sequence is paralogous to G1747 |
| 448 | G251 | PRT | *Arabidopsis thaliana* | Paralogous to G1747 |
| 449 | G256 | DNA | *Arabidopsis thaliana* | Predicted polypeptide sequence is paralogous to G666, G668, G932; orthologous to G3384, G3385, G3386, G3500, G3501, G3502, G3537, G3538, G3539, G3540, G3541 |
| 450 | G256 | PRT | *Arabidopsis thaliana* | Paralogous to G666, G668, G932; Orthologous to G3384, G3385, G3386, G3500, G3501, G3502, G3537, G3538, G3539, G3540, G3541 |
| 451 | G2578 | DNA | *Arabidopsis thaliana* | Predicted polypeptide sequence is paralogous to G1935, G2058 |
| 452 | G2578 | PRT | *Arabidopsis thaliana* | Paralogous to G1935, G2058 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 453 | G2586 | DNA | *Arabidopsis thaliana* | Predicted polypeptide sequence is paralogous to G2587, G2686 |
| 454 | G2586 | PRT | *Arabidopsis thaliana* | Paralogous to G2587, G2686 |
| 455 | G2587 | DNA | *Arabidopsis thaliana* | Predicted polypeptide sequence is paralogous to G2586, G2686 |
| 456 | G2587 | PRT | *Arabidopsis thaliana* | Paralogous to G2586, G2686 |
| 457 | G265 | DNA | *Arabidopsis thaliana* | Predicted polypeptide sequence is paralogous to G261 |
| 458 | G265 | PRT | *Arabidopsis thaliana* | Paralogous to G261 |
| 459 | G2657 | DNA | *Arabidopsis thaliana* | Predicted polypeptide sequence is paralogous to G1070; orthologous to G3404, G3405 |
| 460 | G2657 | PRT | *Arabidopsis thaliana* | Paralogous to G1070; Orthologous to G3404, G3405 |
| 461 | G2665 | DNA | *Arabidopsis thaliana* | Predicted polypeptide sequence is paralogous to G367 |
| 462 | G2665 | PRT | *Arabidopsis thaliana* | Paralogous to G367 |
| 463 | G2721 | DNA | *Arabidopsis thaliana* | Predicted polypeptide sequence is paralogous to G1789, G1911, G997 |
| 464 | G2721 | PRT | *Arabidopsis thaliana* | Paralogous to G1789, G1911, G997 |
| 465 | G2779 | DNA | *Arabidopsis thaliana* | Predicted polypeptide sequence is paralogous to G2859 |
| 466 | G2779 | PRT | *Arabidopsis thaliana* | Paralogous to G2859 |
| 467 | G278 | DNA | *Arabidopsis thaliana* | Predicted polypeptide sequence is paralogous to G1290 |
| 468 | G278 | PRT | *Arabidopsis thaliana* | Paralogous to G1290 |
| 469 | G29 | DNA | *Arabidopsis thaliana* | Predicted polypeptide sequence is paralogous to G1419, G43, G46, G1004; orthologous to G3849 |
| 470 | G29 | PRT | *Arabidopsis thaliana* | Paralogous to G1419, G43, G46, G1004; Orthologous to G3849 |
| 471 | G2989 | DNA | *Arabidopsis thaliana* | Predicted polypeptide sequence is paralogous to G2990; orthologous to G3680, G3681, G3691, G3859, G3860, G3861, G3934 |
| 472 | G2989 | PRT | *Arabidopsis thaliana* | Paralogous to G2990; Orthologous to G3680, G3681, G3691, G3859, G3860, G3861, G3934 |
| 473 | G30 | DNA | *Arabidopsis thaliana* | Predicted polypeptide sequence is paralogous to G1791, G1792, G1795; orthologous to G3380, G3381, G3383, G3515, G3516, G3517, G3518, G3519, G3520, G3735, G3736, G3737, G3794, G3739, G3929, G4328, G4329, G4330 |
| 474 | G30 | PRT | *Arabidopsis thaliana* | Paralogous to G1791, G1792, G1795; Orthologous to G3380, G3381, G3383, G3515, G3516, G3517, G3518, G3519, G3520, G3735, G3736, G3737, G3794, G3739, G3929, G4328, G4329, G4330 |
| 475 | G3079 | DNA | *Arabidopsis thaliana* | Predicted polypeptide sequence is paralogous to G3080 |
| 476 | G3079 | PRT | *Arabidopsis thaliana* | Paralogous to G3080 |
| 477 | G3380 | DNA | *Oryza sativa* | Predicted polypeptide sequence is paralogous to G3381, G3383, G3515, G3737; orthologous to G1791, G1792, G1795, G30, G3516, G3517, G3518, G3519, G3520, G3735, G3736, G3794, G3739, G3929, G4328, G4329, G4330 |
| 478 | G3380 | PRT | *Oryza sativa* | Paralogous to G3381, G3383, G3515, G3737; Orthologous to G1791, G1792, G1795, G30, G3516, G3517, G3518, G3519, G3520, G3735, G3736, G3794, G3739, G3929, G4328, G4329, G4330 |
| 479 | G3381 | DNA | *Oryza sativa* | Predicted polypeptide sequence is paralogous to G3380, G3383, G3515, G3737; orthologous to G1791, G1792, G1795, G30, G3516, G3517, G3518, G3519, G3520, G3735, G3736, G3794, G3739, G3929, G4328, G4329, G4330 |
| 480 | G3381 | PRT | *Oryza sativa* | Paralogous to G3380, G3383, G3515, G3737; Orthologous to G1791, G1792, G1795, G30, G3516, G3517, G3518, G3519, G3520, G3735, G3736, G3794, G3739, G3929, G4328, G4329, G4330 |
| 481 | G3383 | DNA | *Oryza sativa* | Predicted polypeptide sequence is paralogous to G3380, G3381, G3515, G3737; orthologous to G1791, G1792, G1795, G30, G3516, G3517, G3518, G3519, G3520, G3735, G3736, G3794, G3739, G3929, G4328, G4329, G4330 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 482 | G3383 | PRT | *Oryza sativa* | Paralogous to G3380, G3381, G3515, G3737; Orthologous to G1791, G1792, G1795, G30, G3516, G3517, G3518, G3519, G3520, G3735, G3736, G3794, G3739, G3929, G4328, G4329, G4330 |
| 483 | G3384 | DNA | *Oryza sativa* | Predicted polypeptide sequence is paralogous to G3385, G3386, G3502; orthologous to G256, G666, G668, G932, G3500, G3501, G3537, G3538, G3539, G3540, G3541 |
| 484 | G3384 | PRT | *Oryza sativa* | Paralogous to G3385, G3386, G3502; Orthologous to G256, G666, G668, G932, G3500, G3501, G3537, G3538, G3539, G3540, G3541 |
| 485 | G3385 | DNA | *Oryza sativa* | Predicted polypeptide sequence is paralogous to G3384, G3386, G3502; orthologous to G256, G666, G668, G932, G3500, G3501, G3537, G3538, G3539, G3540, G3541 |
| 486 | G3385 | PRT | *Oryza sativa* | Paralogous to G3384, G3386, G3502; Orthologous to G256, G666, G668, G932, G3500, G3501, G3537, G3538, G3539, G3540, G3541 |
| 487 | G3386 | DNA | *Oryza sativa* | Predicted polypeptide sequence is paralogous to G3384, G3385, G3502; orthologous to G256, G666, G668, G932, G3500, G3501, G3537, G3538, G3539, G3540, G3541 |
| 488 | G3386 | PRT | *Oryza sativa* | Paralogous to G3384, G3385, G3502; Orthologous to G256, G666, G668, G932, G3500, G3501, G3537, G3538, G3539, G3540, G3541 |
| 489 | G3388 | DNA | *Oryza sativa* | Predicted polypeptide sequence is paralogous to G3389, G3390, G3391; orthologous to G1930, G867, G9, G993, G3432, G3433, G3451, G3452, G3453, G3454, G3455 |
| 490 | G3388 | PRT | *Oryza sativa* | Paralogous to G3389, G3390, G3391; Orthologous to G1930, G867, G9, G993, G3432, G3433, G3451, G3452, G3453, G3454, G3455 |
| 491 | G3389 | DNA | *Oryza sativa* | Predicted polypeptide sequence is paralogous to G3388, G3390, G3391; orthologous to G1930, G867, G9, G993, G3432, G3433, G3451, G3452, G3453, G3454, G3455 |
| 492 | G3389 | PRT | *Oryza sativa* | Paralogous to G3388, G3390, G3391; Orthologous to G1930, G867, G9, G993, G3432, G3433, G3451, G3452, G3453, G3454, G3455 |
| 493 | G3390 | DNA | *Oryza sativa* | Predicted polypeptide sequence is paralogous to G3388, G3389, G3391; orthologous to G1930, G867, G9, G993, G3432, G3433, G3451, G3452, G3453, G3454, G3455 |
| 494 | G3390 | PRT | *Oryza sativa* | Paralogous to G3388, G3389, G3391; Orthologous to G1930, G867, G9, G993, G3432, G3433, G3451, G3452, G3453, G3454, G3455 |
| 495 | G3391 | DNA | *Oryza sativa* | Predicted polypeptide sequence is paralogous to G3388, G3389, G3390; orthologous to G1930, G867, G9, G993, G3432, G3433, G3451, G3452, G3453, G3454, G3455 |
| 496 | G3391 | PRT | *Oryza sativa* | Paralogous to G3388, G3389, G3390; Orthologous to G1930, G867, G9, G993, G3432, G3433, G3451, G3452, G3453, G3454, G3455 |
| 497 | G3394 | DNA | *Oryza sativa* | Predicted polypeptide sequence is orthologous to G1364, G2345, G481, G482, G485, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 498 | G3394 | PRT | *Oryza sativa* | Orthologous to G1364, G2345, G481, G482, G485, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 499 | G3395 | DNA | *Oryza sativa* | Predicted polypeptide sequence is paralogous to G3396, G3397, G3398, G3429, G3938; orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |
| 500 | G3395 | PRT | *Oryza sativa* | Paralogous to G3396, G3397, G3398, G3429, G3938; Orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |
| 501 | G3396 | DNA | *Oryza sativa* | Predicted polypeptide sequence is paralogous to G3395, G3397, G3398, G3429, G3938; orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 502 | G3396 | PRT | *Oryza sativa* | Paralogous to G3395, G3397, G3398, G3429, G3938; Orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |
| 503 | G3397 | DNA | *Oryza sativa* | Predicted polypeptide sequence is paralogous to G3395, G3396, G3398, G3429, G3938; orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |
| 504 | G3397 | PRT | *Oryza sativa* | Paralogous to G3395, G3396, G3398, G3429, G3938; Orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |
| 505 | G3398 | DNA | *Oryza sativa* | Predicted polypeptide sequence is paralogous to G3395, G3396, G3397, G3429, G3938; orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |
| 506 | G3398 | PRT | *Oryza sativa* | Paralogous to G3395, G3396, G3397, G3429, G3938; Orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |
| 507 | G3404 | DNA | *Oryza sativa* | Predicted polypeptide sequence is paralogous to G3405; orthologous to G1070, G2657 |
| 508 | G3404 | PRT | *Oryza sativa* | Paralogous to G3405; Orthologous to G1070, G2657 |
| 509 | G3405 | DNA | *Oryza sativa* | Predicted polypeptide sequence is paralogous to G3404; orthologous to G1070, G2657 |
| 510 | G3405 | PRT | *Oryza sativa* | Paralogous to G3404; Orthologous to G1070, G2657 |
| 511 | G3406 | DNA | *Oryza sativa* | Predicted polypeptide sequence is paralogous to G3407; orthologous to G1075, G1076, G3458, G3459, G3460, G3461 |
| 512 | G3406 | PRT | *Oryza sativa* | Paralogous to G3407; Orthologous to G1075, G1076, G3458, G3459, G3460, G3461 |
| 513 | G3407 | DNA | *Oryza sativa* | Predicted polypeptide sequence is paralogous to G3406; orthologous to G1075, G1076, G3458, G3459, G3460, G3461 |
| 514 | G3407 | PRT | *Oryza sativa* | Paralogous to G3406; Orthologous to G1075, G1076, G3458, G3459, G3460, G3461 |
| 515 | G3429 | DNA | *Oryza sativa* | Predicted polypeptide sequence is paralogous to G3395, G3396, G3397, G3398, G3938; orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |
| 516 | G3429 | PRT | *Oryza sativa* | Paralogous to G3395, G3396, G3397, G3398, G3938; Orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |
| 517 | G3432 | DNA | *Zea mays* | Predicted polypeptide sequence is paralogous to G3433; orthologous to G1930, G867, G9, G993, G3388, G3389, G3390, G3391, G3451, G3452, G3453, G3454, G3455 |
| 518 | G3432 | PRT | *Zea mays* | Paralogous to G3433; Orthologous to G1930, G867, G9, G993, G3388, G3389, G3390, G3391, G3451, G3452, G3453, G3454, G3455 |
| 519 | G3433 | DNA | *Zea mays* | Predicted polypeptide sequence is paralogous to G3432; orthologous to G1930, G867, G9, G993, G3388, G3389, G3390, G3391, G3451, G3452, G3453, G3454, G3455 |
| 520 | G3433 | PRT | *Zea mays* | Paralogous to G3432; Orthologous to G1930, G867, G9, G993, G3388, G3389, G3390, G3391, G3451, G3452, G3453, G3454, G3455 |
| 521 | G3434 | DNA | *Zea mays* | Predicted polypeptide sequence is paralogous to G3435, G3436, G3437, G3866, G3876, G4272, G4276; orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 522 | G3434 | PRT | *Zea mays* | Paralogous to G3435, G3436, G3437, G3866, G3876, G4272, G4276; Orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 523 | G3435 | DNA | *Zea mays* | Predicted polypeptide sequence is paralogous to G3434, G3436, G3437, G3866, G3876, G4272, G4276; orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 524 | G3435 | PRT | *Zea mays* | Paralogous to G3434, G3436, G3437, G3866, G3876, G4272, G4276; Orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 525 | G3436 | DNA | *Zea mays* | Predicted polypeptide sequence is paralogous to G3434, G3435, G3437, G3866, G3876, G4272, G4276; orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 526 | G3436 | PRT | *Zea mays* | Paralogous to G3434, G3435, G3437, G3866, G3876, G4272, G4276; Orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 527 | G3437 | DNA | *Zea mays* | Predicted polypeptide sequence is paralogous to G3434, G3435, G3436, G3866, G3876, G4272, G4276; orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 528 | G3437 | PRT | *Zea mays* | Paralogous to G3434, G3435, G3436, G3866, G3876, G4272, G4276; Orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 529 | G3451 | DNA | *Glycine max* | Predicted polypeptide sequence is paralogous to G3452, G3453, G3454, G3455; orthologous to G1930, G867, G9, G993, G3388, G3389, G3390, G3391, G3432, G3433 |
| 530 | G3451 | PRT | *Glycine max* | Paralogous to G3452, G3453, G3454, G3455; Orthologous to G1930, G867, G9, G993, G3388, G3389, G3390, G3391, G3432, G3433 |
| 531 | G3452 | DNA | *Glycine max* | Predicted polypeptide sequence is paralogous to G3451, G3453, G3454, G3455; orthologous to G1930, G867, G9, G993, G3388, G3389, G3390, G3391, G3432, G3433 |
| 532 | G3452 | PRT | *Glycine max* | Paralogous to G3451, G3453, G3454, G3455; Orthologous to G1930, G867, G9, G993, G3388, G3389, G3390, G3391, G3432, G3433 |
| 533 | G3453 | DNA | *Glycine max* | Predicted polypeptide sequence is paralogous to G3451, G3452, G3454, G3455; orthologous to G1930, G867, G9, G993, G3388, G3389, G3390, G3391, G3432, G3433 |
| 534 | G3453 | PRT | *Glycine max* | Paralogous to G3451, G3452, G3454, G3455; Orthologous to G1930, G867, G9, G993, G3388, G3389, G3390, G3391, G3432, G3433 |
| 535 | G3454 | DNA | *Glycine max* | Predicted polypeptide sequence is paralogous to G3451, G3452, G3453, G3455; orthologous to G1930, G867, G9, G993, G3388, G3389, G3390, G3391, G3432, G3433 |
| 536 | G3454 | PRT | *Glycine max* | Paralogous to G3451, G3452, G3453, G3455; Orthologous to G1930, G867, G9, G993, G3388, G3389, G3390, G3391, G3432, G3433 |
| 537 | G3455 | DNA | *Glycine max* | Predicted polypeptide sequence is paralogous to G3451, G3452, G3453, G3454; orthologous to G1930, G867, G9, G993, G3388, G3389, G3390, G3391, G3432, G3433 |
| 538 | G3455 | PRT | *Glycine max* | Paralogous to G3451, G3452, G3453, G3454; Orthologous to G1930, G867, G9, G993, G3388, G3389, G3390, G3391, G3432, G3433 |
| 539 | G3458 | DNA | *Glycine max* | Predicted polypeptide sequence is paralogous to G3459, G3460, G3461; orthologous to G1075, G1076, G3406, G3407 |
| 540 | G3458 | PRT | *Glycine max* | Paralogous to G3459, G3460, G3461; Orthologous to G1075, G1076, G3406, G3407 |
| 541 | G3459 | DNA | *Glycine max* | Predicted polypeptide sequence is paralogous to G3458, G3460, G3461; orthologous to G1075, G1076, G3406, G3407 |
| 542 | G3459 | PRT | *Glycine max* | Paralogous to G3458, G3460, G3461; Orthologous to G1075, G1076, G3406, G3407 |
| 543 | G3460 | DNA | *Glycine max* | Predicted polypeptide sequence is paralogous to G3458, G3459, G3461; orthologous to G1075, G1076, G3406, G3407 |
| 544 | G3460 | PRT | *Glycine max* | Paralogous to G3458, G3459, G3461; Orthologous to G1075, G1076, G3406, G3407 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 545 | G3461 | DNA | *Glycine max* | Predicted polypeptide sequence is paralogous to G3458, G3459, G3460; orthologous to G1075, G1076, G3406, G3407 |
| 546 | G3461 | PRT | *Glycine max* | Paralogous to G3458, G3459, G3460; Orthologous to G1075, G1076, G3406, G3407 |
| 547 | G3470 | DNA | *Glycine max* | Predicted polypeptide sequence is paralogous to G3471, G3472, G3473, G3474, G3475, G3476, G3478, G3873, G3874, G3875; orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 548 | G3470 | PRT | *Glycine max* | Paralogous to G3471, G3472, G3473, G3474, G3475, G3476, G3478, G3873, G3874, G3875; Orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 549 | G3471 | DNA | *Glycine max* | Predicted polypeptide sequence is paralogous to G3470, G3472, G3473, G3474, G3475, G3476, G3478, G3873, G3874, G3875; orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 550 | G3471 | PRT | *Glycine max* | Paralogous to G3470, G3472, G3473, G3474, G3475, G3476, G3478, G3873, G3874, G3875; Orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 551 | G3472 | DNA | *Glycine max* | Predicted polypeptide sequence is paralogous to G3470, G3471, G3473, G3474, G3475, G3476, G3478, G3873, G3874, G3875; orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 552 | G3472 | PRT | *Glycine max* | Paralogous to G3470, G3471, G3473, G3474, G3475, G3476, G3478, G3873, G3874, G3875; Orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 553 | G3473 | DNA | *Glycine max* | Predicted polypeptide sequence is paralogous to G3470, G3471, G3472, G3474, G3475, G3476, G3478, G3873, G3874, G3875; orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 554 | G3473 | PRT | *Glycine max* | Paralogous to G3470, G3471, G3472, G3474, G3475, G3476, G3478, G3873, G3874, G3875; Orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 555 | G3474 | DNA | *Glycine max* | Predicted polypeptide sequence is paralogous to G3470, G3471, G3472, G3473, G3475, G3476, G3478, G3873, G3874, G3875; orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 556 | G3474 | PRT | *Glycine max* | Paralogous to G3470, G3471, G3472, G3473, G3475, G3476, G3478, G3873, G3874, G3875; Orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 557 | G3475 | DNA | *Glycine max* | Predicted polypeptide sequence is paralogous to G3470, G3471, G3472, G3473, G3474, G3476, G3478, G3873, G3874, G3875; orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 558 | G3475 | PRT | *Glycine max* | Paralogous to G3470, G3471, G3472, G3473, G3474, G3476, G3478, G3873, G3874, G3875; Orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 559 | G3476 | DNA | *Glycine max* | Predicted polypeptide sequence is paralogous to G3470, G3471, G3472, G3473, G3474, G3475, G3478, G3873, G3874, G3875; orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 560 | G3476 | PRT | *Glycine max* | Paralogous to G3470, G3471, G3472, G3473, G3474, G3475, G3478, G3873, G3874, G3875; Orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 561 | G3478 | DNA | *Glycine max* | Predicted polypeptide sequence is paralogous to G3470, G3471, G3472, G3473, G3474, G3475, G3476, G3873, G3874, G3875; orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 562 | G3478 | PRT | *Glycine max* | Paralogous to G3470, G3471, G3472, G3473, G3474, G3475, G3476, G3873, G3874, G3875; Orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 563 | G3479 | DNA | *Oryza sativa* | Predicted polypeptide sequence is paralogous to G3480, G3481, G3482, G3483; orthologous to G152, G153, G1760, G860, G3484, G3485, G3487, G3488, G3489, G3980, G3981, G3982 |
| 564 | G3479 | PRT | *Oryza sativa* | Paralogous to G3480, G3481, G3482, G3483; Orthologous to G152, G153, G1760, G860, G3484, G3485, G3487, G3488, G3489, G3980, G3981, G3982 |
| 565 | G3480 | DNA | *Oryza sativa* | Predicted polypeptide sequence is paralogous to G3479, G3481, G3482, G3483; orthologous to G152, G153, G1760, G860, G3484, G3485, G3487, G3488, G3489, G3980, G3981, G3982 |
| 566 | G3480 | PRT | *Oryza sativa* | Paralogous to G3479, G3481, G3482, G3483; Orthologous to G152, G153, G1760, G860, G3484, G3485, G3487, G3488, G3489, G3980, G3981, G3982 |
| 567 | G3481 | DNA | *Oryza sativa* | Predicted polypeptide sequence is paralogous to G3479, G3480, G3482, G3483; orthologous to G152, G153, G1760, G860, G3484, G3485, G3487, G3488, G3489, G3980, G3981, G3982 |
| 568 | G3481 | PRT | *Oryza sativa* | Paralogous to G3479, G3480, G3482, G3483; Orthologous to G152, G153, G1760, G860, G3484, G3485, G3487, G3488, G3489, G3980, G3981, G3982 |
| 569 | G3482 | DNA | *Oryza sativa* | Predicted polypeptide sequence is paralogous to G3479, G3480, G3481, G3483; orthologous to G152, G153, G1760, G860, G3484, G3485, G3487, G3488, G3489, G3980, G3981, G3982 |
| 570 | G3482 | PRT | *Oryza sativa* | Paralogous to G3479, G3480, G3481, G3483; Orthologous to G152, G153, G1760, G860, G3484, G3485, G3487, G3488, G3489, G3980, G3981, G3982 |
| 571 | G3483 | DNA | *Oryza sativa* | Predicted polypeptide sequence is paralogous to G3479, G3480, G3481, G3482; orthologous to G152, G153, G1760, G860, G3484, G3485, G3487, G3488, G3489, G3980, G3981, G3982 |
| 572 | G3483 | PRT | *Oryza sativa* | Paralogous to G3479, G3480, G3481, G3482; Orthologous to G152, G153, G1760, G860, G3484, G3485, G3487, G3488, G3489, G3980, G3981, G3982 |
| 573 | G3484 | DNA | *Glycine max* | Predicted polypeptide sequence is paralogous to G3485, G3980, G3981; orthologous to G152, G153, G1760, G860, G3479, G3480, G3481, G3482, G3483, G3487, G3488, G3489, G3982 |
| 574 | G3484 | PRT | *Glycine max* | Paralogous to G3485, G3980, G3981; Orthologous to G152, G153, G1760, G860, G3479, G3480, G3481, G3482, G3483, G3487, G3488, G3489, G3982 |
| 575 | G3485 | DNA | *Glycine max* | Predicted polypeptide sequence is paralogous to G3484, G3980, G3981; orthologous to G152, G153, G1760, G860, G3479, G3480, G3481, G3482, G3483, G3487, G3488, G3489, G3982 |
| 576 | G3485 | PRT | *Glycine max* | Paralogous to G3484, G3980, G3981; Orthologous to G152, G153, G1760, G860, G3479, G3480, G3481, G3482, G3483, G3487, G3488, G3489, G3982 |
| 577 | G3487 | DNA | *Zea mays* | Predicted polypeptide sequence is paralogous to G3488, G3489; orthologous to G152, G153, G1760, G860, G3479, G3480, G3481, G3482, G3483, G3484, G3485, G3980, G3981, G3982 |
| 578 | G3487 | PRT | *Zea mays* | Paralogous to G3488, G3489; Orthologous to G152, G153, G1760, G860, G3479, G3480, G3481, G3482, G3483, G3484, G3485, G3980, G3981, G3982 |
| 579 | G3488 | DNA | *Zea mays* | Predicted polypeptide sequence is paralogous to G3487, G3489; orthologous to G152, G153, G1760, G860, G3479, G3480, G3481, G3482, G3483, G3484, G3485, G3980, G3981, G3982 |
| 580 | G3488 | PRT | *Zea mays* | Paralogous to G3487, G3489; Orthologous to G152, G153, G1760, G860, G3479, G3480, G3481, G3482, G3483, G3484, G3485, G3980, G3981, G3982 |
| 581 | G3489 | DNA | *Zea mays* | Predicted polypeptide sequence is paralogous to G3487, G3488; orthologous to G152, G153, G1760, G860, G3479, G3480, G3481, G3482, G3483, G3484, G3485, G3980, G3981, G3982 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 582 | G3489 | PRT | Zea mays | Paralogous to G3487, G3488; Orthologous to G152, G153, G1760, G860, G3479, G3480, G3481, G3482, G3483, G3484, G3485, G3980, G3981, G3982 |
| 583 | G3490 | DNA | Zea mays | Predicted polypeptide sequence is orthologous to G1543, G3510, G3524, G4371 |
| 584 | G3490 | PRT | Zea mays | Orthologous to G1543, G3510, G3524, G4371 |
| 585 | G3500 | DNA | Solanum lycopersicum | Predicted polypeptide sequence is paralogous to G3501; orthologous to G256, G666, G668, G932, G3384, G3385, G3386, G3502, G3537, G3538, G3539, G3540, G3541 |
| 586 | G3500 | PRT | Solanum lycopersicum | Paralogous to G3501; Orthologous to G256, G666, G668, G932, G3384, G3385, G3386, G3502, G3537, G3538, G3539, G3540, G3541 |
| 587 | G3501 | DNA | Solanum lycopersicum | Predicted polypeptide sequence is paralogous to G3500; orthologous to G256, G666, G668, G932, G3384, G3385, G3386, G3502, G3537, G3538, G3539, G3540, G3541 |
| 588 | G3501 | PRT | Solanum lycopersicum | Paralogous to G3500; Orthologous to G256, G666, G668, G932, G3384, G3385, G3386, G3502, G3537, G3538, G3539, G3540, G3541 |
| 589 | G3502 | DNA | Oryza sativa | Predicted polypeptide sequence is paralogous to G3384, G3385, G3386; orthologous to G256, G666, G668, G932, G3500, G3501, G3537, G3538, G3539, G3540, G3541 |
| 590 | G3502 | PRT | Oryza sativa | Paralogous to G3384, G3385, G3386; Orthologous to G256, G666, G668, G932, G3500, G3501, G3537, G3538, G3539, G3540, G3541 |
| 591 | G351 | DNA | Arabidopsis thaliana | Predicted polypeptide sequence is paralogous to G350, G545 |
| 592 | G351 | PRT | Arabidopsis thaliana | Paralogous to G350, G545 |
| 593 | G3510 | DNA | Oryza sativa | Predicted polypeptide sequence is orthologous to G1543, G3490, G3524, G4371 |
| 594 | G3510 | PRT | Oryza sativa | Orthologous to G1543, G3490, G3524, G4371 |
| 595 | G3515 | DNA | Oryza sativa | Predicted polypeptide sequence is paralogous to G3380, G3381, G3383, G3737; orthologous to G1791, G1792, G1795, G30, G3516, G3517, G3518, G3519, G3520, G3735, G3736, G3794, G3739, G3929, G4328, G4329, G4330 |
| 596 | G3515 | PRT | Oryza sativa | Paralogous to G3380, G3381, G3383, G3737; Orthologous to G1791, G1792, G1795, G30, G3516, G3517, G3518, G3519, G3520, G3735, G3736, G3794, G3739, G3929, G4328, G4329, G4330 |
| 597 | G3516 | DNA | Zea mays | Predicted polypeptide sequence is paralogous to G3517, G3794, G3739, G3929; orthologous to G1791, G1792, G1795, G30, G3380, G3381, G3383, G3515, G3518, G3519, G3520, G3735, G3736, G3737, G4328, G4329, G4330 |
| 598 | G3516 | PRT | Zea mays | Paralogous to G3517, G3794, G3739, G3929; Orthologous to G1791, G1792, G1795, G30, G3380, G3381, G3383, G3515, G3518, G3519, G3520, G3735, G3736, G3737, G4328, G4329, G4330 |
| 599 | G3517 | DNA | Zea mays | Predicted polypeptide sequence is paralogous to G3516, G3794, G3739, G3929; orthologous to G1791, G1792, G1795, G30, G3380, G3381, G3383, G3515, G3518, G3519, G3520, G3735, G3736, G3737, G4328, G4329, G4330 |
| 600 | G3517 | PRT | Zea mays | Paralogous to G3516, G3794, G3739, G3929; Orthologous to G1791, G1792, G1795, G30, G3380, G3381, G3383, G3515, G3518, G3519, G3520, G3735, G3736, G3737, G4328, G4329, G4330 |
| 601 | G3518 | DNA | Glycine max | Predicted polypeptide sequence is paralogous to G3519, G3520; orthologous to G1791, G1792, G1795, G30, G3380, G3381, G3383, G3515, G3516, G3517, G3735, G3736, G3737, G3794, G3739, G3929, G4328, G4329, G4330 |
| 602 | G3518 | PRT | Glycine max | Paralogous to G3519, G3520; Orthologous to G1791, G1792, G1795, G30, G3380, G3381, G3383, G3515, G3516, G3517, G3735, G3736, G3737, G3794, G3739, G3929, G4328, G4329, G4330 |
| 603 | G3519 | DNA | Glycine max | Predicted polypeptide sequence is paralogous to G3518, G3520; orthologous to G1791, G1792, G1795, G30, G3380, G3381, G3383, G3515, G3516, G3517, G3735, G3736, G3737, G3794, G3739, G3929, G4328, G4329, G4330 |
| 604 | G3519 | PRT | Glycine max | Paralogous to G3518, G3520; Orthologous to G1791, G1792, G1795, G30, G3380, G3381, G3383, G3515, G3516, G3517, G3735, G3736, G3737, G3794, G3739, G3929, G4328, G4329, G4330 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 605 | G3520 | DNA | *Glycine max* | Predicted polypeptide sequence is paralogous to G3518, G3519; orthologous to G1791, G1792, G1795, G30, G3380, G3381, G3383, G3515, G3516, G3517, G3735, G3736, G3737, G3794, G3739, G3929, G4328, G4329, G4330 |
| 606 | G3520 | PRT | *Glycine max* | Paralogous to G3518, G3519; Orthologous to G1791, G1792, G1795, G30, G3380, G3381, G3383, G3515, G3516, G3517, G3735, G3736, G3737, G3794, G3739, G3929, G4328, G4329, G4330 |
| 607 | G3524 | DNA | *Glycine max* | Predicted polypeptide sequence is paralogous to G4371; orthologous to G1543, G3510, G3490 |
| 608 | G3524 | PRT | *Glycine max* | Paralogous to G4371; Orthologous to G1543, G3510, G3490 |
| 609 | G3537 | DNA | *Glycine max* | Predicted polypeptide sequence is paralogous to G3538, G3539; orthologous to G256, G666, G668, G932, G3384, G3385, G3386, G3500, G3501, G3502, G3540, G3541 |
| 610 | G3537 | PRT | *Glycine max* | Paralogous to G3538, G3539; Orthologous to G256, G666, G668, G932, G3384, G3385, G3386, G3500, G3501, G3502, G3540, G3541 |
| 611 | G3538 | DNA | *Glycine max* | Predicted polypeptide sequence is paralogous to G3537, G3539; orthologous to G256, G666, G668, G932, G3384, G3385, G3386, G3500, G3501, G3502, G3540, G3541 |
| 612 | G3538 | PRT | *Glycine max* | Paralogous to G3537, G3539; Orthologous to G256, G666, G668, G932, G3384, G3385, G3386, G3500, G3501, G3502, G3540, G3541 |
| 613 | G3539 | DNA | *Glycine max* | Predicted polypeptide sequence is paralogous to G3537, G3538; orthologous to G256, G666, G668, G932, G3384, G3385, G3386, G3500, G3501, G3502, G3540, G3541 |
| 614 | G3539 | PRT | *Glycine max* | Paralogous to G3537, G3538; Orthologous to G256, G666, G668, G932, G3384, G3385, G3386, G3500, G3501, G3502, G3540, G3541 |
| 615 | G3540 | DNA | *Zea mays* | Predicted polypeptide sequence is paralogous to G3541; orthologous to G256, G666, G668, G932, G3384, G3385, G3386, G3500, G3501, G3502, G3537, G3538, G3539 |
| 616 | G3540 | PRT | *Zea mays* | Paralogous to G3541; Orthologous to G256, G666, G668, G932, G3384, G3385, G3386, G3500, G3501, G3502, G3537, G3538, G3539 |
| 617 | G3541 | DNA | *Zea mays* | Predicted polypeptide sequence is paralogous to G3540; orthologous to G256, G666, G668, G932, G3384, G3385, G3386, G3500, G3501, G3502, G3537, G3538, G3539 |
| 618 | G3541 | PRT | *Zea mays* | Paralogous to G3540; Orthologous to G256, G666, G668, G932, G3384, G3385, G3386, G3500, G3501, G3502, G3537, G3538, G3539 |
| 619 | G3643 | DNA | *Glycine max* | Predicted polypeptide sequence is orthologous to G2133, G47, G3644, G3645, G3646, G3647, G3649, G3650, G3651 |
| 620 | G3643 | PRT | *Glycine max* | Orthologous to G2133, G47, G3644, G3645, G3646, G3647, G3649, G3650, G3651 |
| 621 | G3644 | DNA | *Oryza sativa* | Predicted polypeptide sequence is paralogous to G3649, G3651; orthologous to G2133, G47, G3643, G3645, G3646, G3647, G3650 |
| 622 | G3644 | PRT | *Oryza sativa* | Paralogous to G3649, G3651; Orthologous to G2133, G47, G3643, G3645, G3646, G3647, G3650 |
| 623 | G3645 | DNA | *Brassica rapa* subsp. *Pekinensis* | Predicted polypeptide sequence is orthologous to G2133, G47, G3643, G3644, G3646, G3647, G3649, G3650, G3651 |
| 624 | G3645 | PRT | *Brassica rapa* subsp. *Pekinensis* | Orthologous to G2133, G47, G3643, G3644, G3646, G3647, G3649, G3650, G3651 |
| 625 | G3646 | DNA | *Brassica oleracea* | Predicted polypeptide sequence is orthologous to G2133, G47, G3643, G3644, G3645, G3647, G3649, G3650, G3651 |
| 626 | G3646 | PRT | *Brassica oleracea* | Orthologous to G2133, G47, G3643, G3644, G3645, G3647, G3649, G3650, G3651 |
| 627 | G3647 | DNA | *Zinnia elegans* | Predicted polypeptide sequence is orthologous to G2133, G47, G3643, G3644, G3645, G3646, G3649, G3650, G3651 |
| 628 | G3647 | PRT | *Zinnia elegans* | Orthologous to G2133, G47, G3643, G3644, G3645, G3646, G3649, G3650, G3651 |
| 629 | G3649 | DNA | *Oryza sativa* | Predicted polypeptide sequence is paralogous to G3644, G3651; orthologous to G2133, G47, G3643, G3645, G3646, G3647, G3650 |
| 630 | G3649 | PRT | *Oryza sativa* | Paralogous to G3644, G3651; Orthologous to G2133, G47, G3643, G3645, G3646, G3647, G3650 |
| 631 | G3650 | DNA | *Zea mays* | Predicted polypeptide sequence is orthologous to G2133, G47, G3643, G3644, G3645, G3646, G3647, G3649, G3651 |
| 632 | G3650 | PRT | *Zea mays* | Orthologous to G2133, G47, G3643, G3644, G3645, G3646, G3647, G3649, G3651 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 633 | G3651 | DNA | *Oryza sativa* | Predicted polypeptide sequence is paralogous to G3644, G3649; orthologous to G2133, G47, G3643, G3645, G3646, G3647, G3650 |
| 634 | G3651 | PRT | *Oryza sativa* | Paralogous to G3644, G3649; Orthologous to G2133, G47, G3643, G3645, G3646, G3647, G3650 |
| 635 | G3656 | DNA | *Zea mays* | Predicted polypeptide sequence is orthologous to G12, G1277, G1379, G24 |
| 636 | G3656 | PRT | *Zea mays* | Orthologous to G12, G1277, G1379, G24 |
| 637 | G3680 | DNA | *Zea mays* | Predicted polypeptide sequence is paralogous to G3681; orthologous to G2989, G2990, G3691, G3859, G3860, G3861, G3934 |
| 638 | G3680 | PRT | *Zea mays* | Paralogous to G3681; Orthologous to G2989, G2990, G3691, G3859, G3860, G3861, G3934 |
| 639 | G3681 | DNA | *Zea mays* | Predicted polypeptide sequence is paralogous to G3680; orthologous to G2989, G2990, G3691, G3859, G3860, G3861, G3934 |
| 640 | G3681 | PRT | *Zea mays* | Paralogous to G3680; Orthologous to G2989, G2990, G3691, G3859, G3860, G3861, G3934 |
| 641 | G3691 | DNA | *Oryza sativa* | Predicted polypeptide sequence is orthologous to G2989, G2990, G3680, G3681, G3859, G3860, G3861, G3934 |
| 642 | G3691 | PRT | *Oryza sativa* | Orthologous to G2989, G2990, G3680, G3681, G3859, G3860, G3861, G3934 |
| 643 | G3719 | DNA | *Zea mays* | Predicted polypeptide sequence is paralogous to G3722, G3720, G3727, G3728, G3804; orthologous to G1274, G3723, G3724, G3731, G3732, G3803, G1275, G3721, G3725, G3726, G3729, G3730, G3733, G3795, G3797, G3802 |
| 644 | G3719 | PRT | *Zea mays* | Paralogous to G3722, G3720, G3727, G3728, G3804; Orthologous to G1274, G3723, G3724, G3731, G3732, G3803, G1275, G3721, G3725, G3726, G3729, G3730, G3733, G3795, G3797, G3802 |
| 645 | G3720 | DNA | *Zea mays* | Predicted polypeptide sequence is paralogous to G3722, G3719, G3727, G3728, G3804; orthologous to G1274, G3723, G3724, G3731, G3732, G3803, G1275, G3721, G3725, G3726, G3729, G3730, G3733, G3795, G3797, G3802 |
| 646 | G3720 | PRT | *Zea mays* | Paralogous to G3722, G3719, G3727, G3728, G3804; Orthologous to G1274, G3723, G3724, G3731, G3732, G3803, G1275, G3721, G3725, G3726, G3729, G3730, G3733, G3795, G3797, G3802 |
| 647 | G3721 | DNA | *Oryza sativa* | Predicted polypeptide sequence is paralogous to G3725, G3726, G3729, G3730; orthologous to G1274, G3722, G3723, G3724, G3731, G3732, G3803, G1275, G3719, G3720, G3727, G3728, G3733, G3795, G3797, G3802, G3804 |
| 648 | G3721 | PRT | *Oryza sativa* | Paralogous to G3725, G3726, G3729, G3730; Orthologous to G1274, G3722, G3723, G3724, G3731, G3732, G3803, G1275, G3719, G3720, G3727, G3728, G3733, G3795, G3797, G3802, G3804 |
| 649 | G3722 | DNA | *Zea mays* | Predicted polypeptide sequence is paralogous to G3719, G3720, G3727, G3728, G3804; orthologous to G1274, G3723, G3724, G3731, G3732, G3803, G1275, G3721, G3725, G3726, G3729, G3730, G3733, G3795, G3797, G3802 |
| 650 | G3722 | PRT | *Zea mays* | Paralogous to G3719, G3720, G3727, G3728, G3804; Orthologous to G1274, G3723, G3724, G3731, G3732, G3803, G1275, G3721, G3725, G3726, G3729, G3730, G3733, G3795, G3797, G3802 |
| 651 | G3723 | DNA | *Glycine max* | Predicted polypeptide sequence is paralogous to G3724, G3803; orthologous to G1274, G3722, G3731, G3732, G1275, G3719, G3720, G3721, G3725, G3726, G3727, G3728, G3729, G3730, G3733, G3795, G3797, G3802, G3804 |
| 652 | G3723 | PRT | *Glycine max* | Paralogous to G3724, G3803; Orthologous to G1274, G3722, G3731, G3732, G1275, G3719, G3720, G3721, G3725, G3726, G3727, G3728, G3729, G3730, G3733, G3795, G3797, G3802, G3804 |
| 653 | G3724 | DNA | *Glycine max* | Predicted polypeptide sequence is paralogous to G3723, G3803; orthologous to G1274, G3722, G3731, G3732, G1275, G3719, G3720, G3721, G3725, G3726, G3727, G3728, G3729, G3730, G3733, G3795, G3797, G3802, G3804 |
| 654 | G3724 | PRT | *Glycine max* | Paralogous to G3723, G3803; Orthologous to G1274, G3722, G3731, G3732, G1275, G3719, G3720, G3721, G3725, G3726, G3727, G3728, G3729, G3730, G3733, G3795, G3797, G3802, G3804 |
| 655 | G3725 | DNA | *Oryza sativa* | Predicted polypeptide sequence is paralogous to G3721, G3726, G3729, G3730; orthologous to G1274, G3722, G3723, G3724, G3731, G3732, G3803, G1275, G3719, G3720, G3727, G3728, G3733, G3795, G3797, G3802, G3804 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 656 | G3725 | PRT | *Oryza sativa* | Paralogous to G3721, G3726, G3729, G3730; Orthologous to G1274, G3722, G3723, G3724, G3731, G3732, G3803, G1275, G3719, G3720, G3727, G3728, G3733, G3795, G3797, G3802, G3804 |
| 657 | G3726 | DNA | *Oryza sativa* | Predicted polypeptide sequence is paralogous to G3721, G3725, G3729, G3730; orthologous to G1274, G3722, G3723, G3724, G3731, G3732, G3803, G1275, G3719, G3720, G3727, G3728, G3733, G3795, G3797, G3802, G3804 |
| 658 | G3726 | PRT | *Oryza sativa* | Paralogous to G3721, G3725, G3729, G3730; Orthologous to G1274, G3722, G3723, G3724, G3731, G3732, G3803, G1275, G3719, G3720, G3727, G3728, G3733, G3795, G3797, G3802, G3804 |
| 659 | G3727 | DNA | *Zea mays* | Predicted polypeptide sequence is paralogous to G3722, G3719, G3720, G3728, G3804; orthologous to G1274, G3723, G3724, G3731, G3732, G3803, G1275, G3721, G3725, G3726, G3729, G3730, G3733, G3795, G3797, G3802 |
| 660 | G3727 | PRT | *Zea mays* | Paralogous to G3722, G3719, G3720, G3728, G3804; Orthologous to G1274, G3723, G3724, G3731, G3732, G3803, G1275, G3721, G3725, G3726, G3729, G3730, G3733, G3795, G3797, G3802 |
| 661 | G3728 | DNA | *Zea mays* | Predicted polypeptide sequence is paralogous to G3722, G3719, G3720, G3727, G3804; orthologous to G1274, G3723, G3724, G3731, G3732, G3803, G1275, G3721, G3725, G3726, G3729, G3730, G3733, G3795, G3797, G3802 |
| 662 | G3728 | PRT | *Zea mays* | Paralogous to G3722, G3719, G3720, G3727, G3804; Orthologous to G1274, G3723, G3724, G3731, G3732, G3803, G1275, G3721, G3725, G3726, G3729, G3730, G3733, G3795, G3797, G3802 |
| 663 | G3729 | DNA | *Oryza sativa* | Predicted polypeptide sequence is paralogous to G3721, G3725, G3726, G3730; orthologous to G1274, G3722, G3723, G3724, G3731, G3732, G3803, G1275, G3719, G3720, G3727, G3728, G3733, G3795, G3797, G3802, G3804 |
| 664 | G3729 | PRT | *Oryza sativa* | Paralogous to G3721, G3725, G3726, G3730; Orthologous to G1274, G3722, G3723, G3724, G3731, G3732, G3803, G1275, G3719, G3720, G3727, G3728, G3733, G3795, G3797, G3802, G3804 |
| 665 | G3730 | DNA | *Oryza sativa* | Predicted polypeptide sequence is paralogous to G3721, G3725, G3726, G3729; orthologous to G1274, G3722, G3723, G3724, G3731, G3732, G3803, G1275, G3719, G3720, G3727, G3728, G3733, G3795, G3797, G3802, G3804 |
| 666 | G3730 | PRT | *Oryza sativa* | Paralogous to G3721, G3725, G3726, G3729; Orthologous to G1274, G3722, G3723, G3724, G3731, G3732, G3803, G1275, G3719, G3720, G3727, G3728, G3733, G3795, G3797, G3802, G3804 |
| 667 | G3731 | DNA | *Solanum lycopersicum* | Predicted polypeptide sequence is orthologous to G1274, G3722, G3723, G3724, G3732, G3803, G1275, G3719, G3720, G3721, G3725, G3726, G3727, G3728, G3729, G3730, G3733, G3795, G3797, G3802, G3804 |
| 668 | G3731 | PRT | *Solanum lycopersicum* | Orthologous to G1274, G3722, G3723, G3724, G3732, G3803, G1275, G3719, G3720, G3721, G3725, G3726, G3727, G3728, G3729, G3730, G3733, G3795, G3797, G3802, G3804 |
| 669 | G3732 | DNA | *Solanum tuberosum* | Predicted polypeptide sequence is orthologous to G1274, G3722, G3723, G3724, G3731, G3803, G1275, G3719, G3720, G3721, G3725, G3726, G3727, G3728, G3729, G3730, G3733, G3795, G3797, G3802, G3804 |
| 670 | G3732 | PRT | *Solanum tuberosum* | Orthologous to G1274, G3722, G3723, G3724, G3731, G3803, G1275, G3719, G3720, G3721, G3725, G3726, G3727, G3728, G3729, G3730, G3733, G3795, G3797, G3802, G3804 |
| 671 | G3733 | DNA | *Hordeum vulgare* | Predicted polypeptide sequence is orthologous to G1274, G3722, G3723, G3724, G3731, G3732, G3803, G1275, G3719, G3720, G3721, G3725, G3726, G3727, G3728, G3729, G3730, G3795, G3797, G3802, G3804 |
| 672 | G3733 | PRT | *Hordeum vulgare* | Orthologous to G1274, G3722, G3723, G3724, G3731, G3732, G3803, G1275, G3719, G3720, G3721, G3725, G3726, G3727, G3728, G3729, G3730, G3795, G3797, G3802, G3804 |
| 673 | G3735 | DNA | *Medicago truncatula* | Predicted polypeptide sequence is orthologous to G1791, G1792, G1795, G30, G3380, G3381, G3383, G3515, G3516, G3517, G3518, G3519, G3520, G3736, G3737, G3794, G3739, G3929, G4328, G4329, G4330 |
| 674 | G3735 | PRT | *Medicago truncatula* | Orthologous to G1791, G1792, G1795, G30, G3380, G3381, G3383, G3515, G3516, G3517, G3518, G3519, G3520, G3736, G3737, G3794, G3739, G3929, G4328, G4329, G4330 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 675 | G3736 | DNA | *Triticum aestivum* | Predicted polypeptide sequence is orthologous to G1791, G1792, G1795, G30, G3380, G3381, G3383, G3515, G3516, G3517, G3518, G3519, G3520, G3735, G3737, G3794, G3739, G3929, G4328, G4329, G4330 |
| 676 | G3736 | PRT | *Triticum aestivum* | Orthologous to G1791, G1792, G1795, G30, G3380, G3381, G3383, G3515, G3516, G3517, G3518, G3519, G3520, G3735, G3737, G3794, G3739, G3929, G4328, G4329, G4330 |
| 677 | G3737 | DNA | *Oryza sativa* | Predicted polypeptide sequence is paralogous to G3380, G3381, G3383, G3515; orthologous to G1791, G1792, G1795, G30, G3516, G3517, G3518, G3519, G3520, G3735, G3736, G3794, G3739, G3929, G4328, G4329, G4330 |
| 678 | G3737 | PRT | *Oryza sativa* | Paralogous to G3380, G3381, G3383, G3515; Orthologous to G1791, G1792, G1795, G30, G3516, G3517, G3518, G3519, G3520, G3735, G3736, G3794, G3739, G3929, G4328, G4329, G4330 |
| 679 | G3739 | DNA | *Zea mays* | Predicted polypeptide sequence is paralogous to G3516, G3517, G3794, G3929; orthologous to G1791, G1792, G1795, G30, G3380, G3381, G3383, G3515, G3518, G3519, G3520, G3735, G3736, G3737, G4328, G4329, G4330 |
| 680 | G3739 | PRT | *Zea mays* | Paralogous to G3516, G3517, G3794, G3929; Orthologous to G1791, G1792, G1795, G30, G3380, G3381, G3383, G3515, G3518, G3519, G3520, G3735, G3736, G3737, G4328, G4329, G4330 |
| 681 | G3794 | DNA | *Zea mays* | Predicted polypeptide sequence is paralogous to G3516, G3517, G3739, G3929; orthologous to G1791, G1792, G1795, G30, G3380, G3381, G3383, G3515, G3518, G3519, G3520, G3735, G3736, G3737, G4328, G4329, G4330 |
| 682 | G3794 | PRT | *Zea mays* | Paralogous to G3516, G3517, G3739, G3929; Orthologous to G1791, G1792, G1795, G30, G3380, G3381, G3383, G3515, G3518, G3519, G3520, G3735, G3736, G3737, G4328, G4329, G4330 |
| 683 | G3795 | DNA | *Capsicum annuum* | Predicted polypeptide sequence is orthologous to G1274, G3722, G3723, G3724, G3731, G3732, G3803, G1275, G3719, G3720, G3721, G3725, G3726, G3727, G3728, G3729, G3730, G3733, G3797, G3802, G3804 |
| 684 | G3795 | PRT | *Capsicum annuum* | Orthologous to G1274, G3722, G3723, G3724, G3731, G3732, G3803, G1275, G3719, G3720, G3721, G3725, G3726, G3727, G3728, G3729, G3730, G3733, G3797, G3802, G3804 |
| 685 | G3797 | DNA | *Lactuca sativa* | Predicted polypeptide sequence is orthologous to G1274, G3722, G3723, G3724, G3731, G3732, G3803, G1275, G3719, G3720, G3721, G3725, G3726, G3727, G3728, G3729, G3730, G3733, G3795, G3802, G3804 |
| 686 | G3797 | PRT | *Lactuca sativa* | Orthologous to G1274, G3722, G3723, G3724, G3731, G3732, G3803, G1275, G3719, G3720, G3721, G3725, G3726, G3727, G3728, G3729, G3730, G3733, G3795, G3802, G3804 |
| 687 | G3802 | DNA | *Sorghum bicolor* | Predicted polypeptide sequence is orthologous to G1274, G3722, G3723, G3724, G3731, G3732, G3803, G1275, G3719, G3720, G3721, G3725, G3726, G3727, G3728, G3729, G3730, G3733, G3795, G3797, G3804 |
| 688 | G3802 | PRT | *Sorghum bicolor* | Orthologous to G1274, G3722, G3723, G3724, G3731, G3732, G3803, G1275, G3719, G3720, G3721, G3725, G3726, G3727, G3728, G3729, G3730, G3733, G3795, G3797, G3804 |
| 689 | G3803 | DNA | *Glycine max* | Predicted polypeptide sequence is paralogous to G3723, G3724; orthologous to G1274, G3722, G3731, G3732, G1275, G3719, G3720, G3721, G3725, G3726, G3727, G3728, G3729, G3730, G3733, G3795, G3797, G3802, G3804 |
| 690 | G3803 | PRT | *Glycine max* | Paralogous to G3723, G3724; Orthologous to G1274, G3722, G3731, G3732, G1275, G3719, G3720, G3721, G3725, G3726, G3727, G3728, G3729, G3730, G3733, G3795, G3797, G3802, G3804 |
| 691 | G3804 | DNA | *Zea mays* | Predicted polypeptide sequence is paralogous to G3722, G3719, G3720, G3727, G3728; orthologous to G1274, G3723, G3724, G3731, G3732, G3803, G1275, G3721, G3725, G3726, G3729, G3730, G3733, G3795, G3797, G3802 |
| 692 | G3804 | PRT | *Zea mays* | Paralogous to G3722, G3719, G3720, G3727, G3728; Orthologous to G1274, G3723, G3724, G3731, G3732, G3803, G1275, G3721, G3725, G3726, G3729, G3730, G3733, G3795, G3797, G3802 |
| 693 | G3809 | DNA | *Oryza sativa* | Predicted polypeptide sequence is orthologous to G1425, G1454, G504 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 694 | G3809 | PRT | *Oryza sativa* | Orthologous to G1425, G1454, G504 |
| 695 | G3849 | DNA | *Solanum lycopersicum* | Predicted polypeptide sequence is orthologous to G1419, G43, G46, G1004, G29 |
| 696 | G3849 | PRT | *Solanum lycopersicum* | Orthologous to G1419, G43, G46, G1004, G29 |
| 697 | G3859 | DNA | *Flaveria trinervia* | Predicted polypeptide sequence is orthologous to G2989, G2990, G3680, G3681, G3691, G3860, G3861, G3934 |
| 698 | G3859 | PRT | *Flaveria trinervia* | Orthologous to G2989, G2990, G3680, G3681, G3691, G3860, G3861, G3934 |
| 699 | G3860 | DNA | *Flaveria bidentis* | Predicted polypeptide sequence is paralogous to G3861; orthologous to G2989, G2990, G3680, G3681, G3691, G3859, G3934 |
| 700 | G3860 | PRT | *Flaveria bidentis* | Paralogous to G3861; Orthologous to G2989, G2990, G3680, G3681, G3691, G3859, G3934 |
| 701 | G3861 | DNA | *Flaveria bidentis* | Predicted polypeptide sequence is paralogous to G3860; orthologous to G2989, G2990, G3680, G3681, G3691, G3859, G3934 |
| 702 | G3861 | PRT | *Flaveria bidentis* | Paralogous to G3860; Orthologous to G2989, G2990, G3680, G3681, G3691, G3859, G3934 |
| 703 | G3866 | DNA | *Zea mays* | Predicted polypeptide sequence is paralogous to G3434, G3435, G3436, G3437, G3876, G4272, G4276; orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 704 | G3866 | PRT | *Zea mays* | Paralogous to G3434, G3435, G3436, G3437, G3876, G4272, G4276; Orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 705 | G3868 | DNA | *Physcomitrella patens* | Predicted polypeptide sequence is paralogous to G3870; orthologous to G1364, G2345, G481, G482, G485, G3394, G3395, G3396, G3397, G3398, G3429, G3434, G3435, G3436, G3437, G3470, G3471, G3472, G3473, G3474, G3475, G3476, G3478, G3866, G3873, G3874, G3875, G3876, G3938, G4272, G4276 |
| 706 | G3868 | PRT | *Physcomitrella patens* | Paralogous to G3870; Orthologous to G1364, G2345, G481, G482, G485, G3394, G3395, G3396, G3397, G3398, G3429, G3434, G3435, G3436, G3437, G3470, G3471, G3472, G3473, G3474, G3475, G3476, G3478, G3866, G3873, G3874, G3875, G3876, G3938, G4272, G4276 |
| 707 | G3870 | DNA | *Physcomitrella patens* | Predicted polypeptide sequence is paralogous to G3868; orthologous to G1364, G2345, G481, G482, G485, G3394, G3395, G3396, G3397, G3398, G3429, G3434, G3435, G3436, G3437, G3470, G3471, G3472, G3473, G3474, G3475, G3476, G3478, G3866, G3873, G3874, G3875, G3876, G3938, G4272, G4276 |
| 708 | G3870 | PRT | *Physcomitrella patens* | Paralogous to G3868; Orthologous to G1364, G2345, G481, G482, G485, G3394, G3395, G3396, G3397, G3398, G3429, G3434, G3435, G3436, G3437, G3470, G3471, G3472, G3473, G3474, G3475, G3476, G3478, G3866, G3873, G3874, G3875, G3876, G3938, G4272, G4276 |
| 709 | G3873 | DNA | *Glycine max* | Predicted polypeptide sequence is paralogous to G3470, G3471, G3472, G3473, G3474, G3475, G3476, G3478, G3874, G3875; orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 710 | G3873 | PRT | *Glycine max* | Paralogous to G3470, G3471, G3472, G3473, G3474, G3475, G3476, G3478, G3874, G3875; Orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 711 | G3874 | DNA | *Glycine max* | Predicted polypeptide sequence is paralogous to G3470, G3471, G3472, G3473, G3474, G3475, G3476, G3478, G3873, G3875; orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 712 | G3874 | PRT | *Glycine max* | Paralogous to G3470, G3471, G3472, G3473, G3474, G3475, G3476, G3478, G3873, G3875; Orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 713 | G3875 | DNA | *Glycine max* | Predicted polypeptide sequence is paralogous to G3470, G3471, G3472, G3473, G3474, G3475, G3476, G3478, G3873, G3874; orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 714 | G3875 | PRT | *Glycine max* | Paralogous to G3470, G3471, G3472, G3473, G3474, G3475, G3476, G3478, G3873, G3874; Orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 715 | G3876 | DNA | *Zea mays* | Predicted polypeptide sequence is paralogous to G3434, G3435, G3436, G3437, G3866, G4272, G4276; orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 716 | G3876 | PRT | *Zea mays* | Paralogous to G3434, G3435, G3436, G3437, G3866, G4272, G4276; Orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 717 | G3929 | DNA | *Zea mays* | Predicted polypeptide sequence is paralogous to G3516, G3517, G3794, G3739; orthologous to G1791, G1792, G1795, G30, G3380, G3381, G3383, G3515, G3518, G3519, G3520, G3735, G3736, G3737, G4328, G4329, G4330 |
| 718 | G3929 | PRT | *Zea mays* | Paralogous to G3516, G3517, G3794, G3739; Orthologous to G1791, G1792, G1795, G30, G3380, G3381, G3383, G3515, G3518, G3519, G3520, G3735, G3736, G3737, G4328, G4329, G4330 |
| 719 | G3934 | DNA | *Glycine max* | Predicted polypeptide sequence is orthologous to G2989, G2990, G3680, G3681, G3691, G3859, G3860, G3861 |
| 720 | G3934 | PRT | *Glycine max* | Orthologous to G2989, G2990, G3680, G3681, G3691, G3859, G3860, G3861 |
| 721 | G3938 | DNA | *Oryza sativa* | Predicted polypeptide sequence is paralogous to G3395, G3396, G3397, G3398, G3429; orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |
| 722 | G3938 | PRT | *Oryza sativa* | Paralogous to G3395, G3396, G3397, G3398, G3429; Orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |
| 723 | G3980 | DNA | *Glycine max* | Predicted polypeptide sequence is paralogous to G3484, G3485, G3981; orthologous to G152, G153, G1760, G860, G3479, G3480, G3481, G3482, G3483, G3487, G3488, G3489, G3982 |
| 724 | G3980 | PRT | *Glycine max* | Paralogous to G3484, G3485, G3981; Orthologous to G152, G153, G1760, G860, G3479, G3480, G3481, G3482, G3483, G3487, G3488, G3489, G3982 |
| 725 | G3981 | DNA | *Glycine max* | Predicted polypeptide sequence is paralogous to G3484, G3485, G3980; orthologous to G152, G153, G1760, G860, G3479, G3480, G3481, G3482, G3483, G3487, G3488, G3489, G3982 |
| 726 | G3981 | PRT | *Glycine max* | Paralogous to G3484, G3485, G3980; Orthologous to G152, G153, G1760, G860, G3479, G3480, G3481, G3482, G3483, G3487, G3488, G3489, G3982 |
| 727 | G3982 | DNA | *Antirrhinum majus* | Predicted polypeptide sequence is orthologous to G152, G153, G1760, G860, G3479, G3480, G3481, G3482, G3483, G3484, G3485, G3487, G3488, G3489, G3980, G3981 |
| 728 | G3982 | PRT | *Antirrhinum majus* | Orthologous to G152, G153, G1760, G860, G3479, G3480, G3481, G3482, G3483, G3484, G3485, G3487, G3488, G3489, G3980, G3981 |
| 729 | G399 | DNA | *Arabidopsis thaliana* | Predicted polypeptide sequence is paralogous to G398, G964 |
| 730 | G399 | PRT | *Arabidopsis thaliana* | Paralogous to G398, G964 |
| 731 | G4061 | DNA | *Solanum lycopersicum* | Predicted polypeptide sequence is orthologous to G149, G627, G1011, G154, G1797, G1798, G4062, G4063, G4064, G4065, G4066, G4067 |
| 732 | G4061 | PRT | *Solanum lycopersicum* | Orthologous to G149, G627, G1011, G154, G1797, G1798, G4062, G4063, G4064, G4065, G4066, G4067 |
| 733 | G4062 | DNA | *Brassica rapa* | Predicted polypeptide sequence is orthologous to G149, G627, G1011, G154, G1797, G1798, G4061, G4063, G4064, G4065, G4066, G4067 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 734 | G4062 | PRT | *Brassica rapa* | Orthologous to G149, G627, G1011, G154, G1797, G1798, G4061, G4063, G4064, G4065, G4066, G4067 |
| 735 | G4063 | DNA | *Glycine max* | Predicted polypeptide sequence is paralogous to G4064; orthologous to G149, G627, G1011, G154, G1797, G1798, G4061, G4062, G4065, G4066, G4067 |
| 736 | G4063 | PRT | *Glycine max* | Paralogous to G4064; Orthologous to G149, G627, G1011, G154, G1797, G1798, G4061, G4062, G4065, G4066, G4067 |
| 737 | G4064 | DNA | *Glycine max* | Predicted polypeptide sequence is paralogous to G4063; orthologous to G149, G627, G1011, G154, G1797, G1798, G4061, G4062, G4065, G4066, G4067 |
| 738 | G4064 | PRT | *Glycine max* | Paralogous to G4063; Orthologous to G149, G627, G1011, G154, G1797, G1798, G4061, G4062, G4065, G4066, G4067 |
| 739 | G4065 | DNA | *Zea mays* | Predicted polypeptide sequence is orthologous to G149, G627, G1011, G154, G1797, G1798, G4061, G4062, G4063, G4064, G4066, G4067 |
| 740 | G4065 | PRT | *Zea mays* | Orthologous to G149, G627, G1011, G154, G1797, G1798, G4061, G4062, G4063, G4064, G4066, G4067 |
| 741 | G4066 | DNA | *Oryza sativa* | Predicted polypeptide sequence is paralogous to G4067; orthologous to G149, G627, G1011, G154, G1797, G1798, G4061, G4062, G4063, G4064, G4065 |
| 742 | G4066 | PRT | *Oryza sativa* | Paralogous to G4067; Orthologous to G149, G627, G1011, G154, G1797, G1798, G4061, G4062, G4063, G4064, G4065 |
| 743 | G4067 | DNA | *Oryza sativa* | Predicted polypeptide sequence is paralogous to G4066; orthologous to G149, G627, G1011, G154, G1797, G1798, G4061, G4062, G4063, G4064, G4065 |
| 744 | G4067 | PRT | *Oryza sativa* | Paralogous to G4066; Orthologous to G149, G627, G1011, G154, G1797, G1798, G4061, G4062, G4063, G4064, G4065 |
| 745 | G4079 | DNA | *Solanum lycopersicum* | Predicted polypeptide sequence is orthologous to G1750, G1421, G4080, G440, G864, G4283, G4284, G4285, G4286, G4287, G4288, G4289, G4290, G4291, G4292, G4293 |
| 746 | G4079 | PRT | *Solanum lycopersicum* | Orthologous to G1750, G1421, G4080, G440, G864, G4283, G4284, G4285, G4286, G4287, G4288, G4289, G4290, G4291, G4292, G4293 |
| 747 | G4080 | DNA | *Nicotiana tabacum* | Predicted polypeptide sequence is orthologous to G1750, G1421, G4079, G440, G864, G4283, G4284, G4285, G4286, G4287, G4288, G4289, G4290, G4291, G4292, G4293 |
| 748 | G4080 | PRT | *Nicotiana tabacum* | Orthologous to G1750, G1421, G4079, G440, G864, G4283, G4284, G4285, G4286, G4287, G4288, G4289, G4290, G4291, G4292, G4293 |
| 749 | G4240 | DNA | *Zea mays* | Predicted polypeptide sequence is orthologous to G1435, G2741, G4241, G4243, G4244, G4245 |
| 750 | G4240 | PRT | *Zea mays* | Orthologous to G1435, G2741, G4241, G4243, G4244, G4245 |
| 751 | G4241 | DNA | *Oryza sativa* | Predicted polypeptide sequence is orthologous to G1435, G2741, G4240, G4243, G4244, G4245 |
| 752 | G4241 | PRT | *Oryza sativa* | Orthologous to G1435, G2741, G4240, G4243, G4244, G4245 |
| 753 | G4243 | DNA | *Glycine max* | Predicted polypeptide sequence is paralogous to G4244; orthologous to G1435, G2741, G4240, G4241, G4245 |
| 754 | G4243 | PRT | *Glycine max* | Paralogous to G4244; Orthologous to G1435, G2741, G4240, G4241, G4245 |
| 755 | G4244 | DNA | *Glycine max* | Predicted polypeptide sequence is paralogous to G4243; orthologous to G1435, G2741, G4240, G4241, G4245 |
| 756 | G4244 | PRT | *Glycine max* | Paralogous to G4243; Orthologous to G1435, G2741, G4240, G4241, G4245 |
| 757 | G4245 | DNA | *Solanum lycopersicum* | Predicted polypeptide sequence is orthologous to G1435, G2741, G4240, G4241, G4243, G4244 |
| 758 | G4245 | PRT | *Solanum lycopersicum* | Orthologous to G1435, G2741, G4240, G4241, G4243, G4244 |
| 759 | G4272 | DNA | *Zea mays* | Predicted polypeptide sequence is paralogous to G3434, G3435, G3436, G3437, G3866, G3876, G4276; orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 760 | G4272 | PRT | *Zea mays* | Paralogous to G3434, G3435, G3436, G3437, G3866, G3876, G4276; Orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 761 | G4276 | DNA | *Zea mays* | Predicted polypeptide sequence is paralogous to G3434, G3435, G3436, G3437, G3866, G3876, G4272; orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 762 | G4276 | PRT | *Zea mays* | Paralogous to G3434, G3435, G3436, G3437, G3866, G3876, G4272; Orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 763 | G428 | DNA | *Arabidopsis thaliana* | Predicted polypeptide sequence is paralogous to G1594 |
| 764 | G428 | PRT | *Arabidopsis thaliana* | Paralogous to G1594 |
| 765 | G4283 | DNA | *Zea mays* | Predicted polypeptide sequence is paralogous to G4284; orthologous to G1750, G1421, G4079, G4080, G440, G864, G4285, G4286, G4287, G4288, G4289, G4290, G4291, G4292, G4293 |
| 766 | G4283 | PRT | *Zea mays* | Paralogous to G4284; Orthologous to G1750, G1421, G4079, G4080, G440, G864, G4285, G4286, G4287, G4288, G4289, G4290, G4291, G4292, G4293 |
| 767 | G4284 | DNA | *Zea mays* | Predicted polypeptide sequence is paralogous to G4283; orthologous to G1750, G1421, G4079, G4080, G440, G864, G4285, G4286, G4287, G4288, G4289, G4290, G4291, G4292, G4293 |
| 768 | G4284 | PRT | *Zea mays* | Paralogous to G4283; Orthologous to G1750, G1421, G4079, G4080, G440, G864, G4285, G4286, G4287, G4288, G4289, G4290, G4291, G4292, G4293 |
| 769 | G4285 | DNA | *Glycine max* | Predicted polypeptide sequence is paralogous to G4286, G4287; orthologous to G1750, G1421, G4079, G4080, G440, G864, G4283, G4284, G4288, G4289, G4290, G4291, G4292, G4293 |
| 770 | G4285 | PRT | *Glycine max* | Paralogous to G4286, G4287; Orthologous to G1750, G1421, G4079, G4080, G440, G864, G4283, G4284, G4288, G4289, G4290, G4291, G4292, G4293 |
| 771 | G4286 | DNA | *Glycine max* | Predicted polypeptide sequence is paralogous to G4285, G4287; orthologous to G1750, G1421, G4079, G4080, G440, G864, G4283, G4284, G4288, G4289, G4290, G4291, G4292, G4293 |
| 772 | G4286 | PRT | *Glycine max* | Paralogous to G4285, G4287; Orthologous to G1750, G1421, G4079, G4080, G440, G864, G4283, G4284, G4288, G4289, G4290, G4291, G4292, G4293 |
| 773 | G4287 | DNA | *Glycine max* | Predicted polypeptide sequence is paralogous to G4285, G4286; orthologous to G1750, G1421, G4079, G4080, G440, G864, G4283, G4284, G4288, G4289, G4290, G4291, G4292, G4293 |
| 774 | G4287 | PRT | *Glycine max* | Paralogous to G4285, G4286; Orthologous to G1750, G1421, G4079, G4080, G440, G864, G4283, G4284, G4288, G4289, G4290, G4291, G4292, G4293 |
| 775 | G4288 | DNA | *Oryza sativa* | Predicted polypeptide sequence is paralogous to G4289, G4290, G4291, G4292, G4293; orthologous to G1750, G1421, G4079, G4080, G440, G864, G4283, G4284, G4285, G4286, G4287 |
| 776 | G4288 | PRT | *Oryza sativa* | Paralogous to G4289, G4290, G4291, G4292, G4293; Orthologous to G1750, G1421, G4079, G4080, G440, G864, G4283, G4284, G4285, G4286, G4287 |
| 777 | G4289 | DNA | *Oryza sativa* | Predicted polypeptide sequence is paralogous to G4288, G4290, G4291, G4292, G4293; orthologous to G1750, G1421, G4079, G4080, G440, G864, G4283, G4284, G4285, G4286, G4287 |
| 778 | G4289 | PRT | *Oryza sativa* | Paralogous to G4288, G4290, G4291, G4292, G4293; Orthologous to G1750, G1421, G4079, G4080, G440, G864, G4283, G4284, G4285, G4286, G4287 |
| 779 | G4290 | DNA | *Oryza sativa* | Predicted polypeptide sequence is paralogous to G4288, G4289, G4291, G4292, G4293; orthologous to G1750, G1421, G4079, G4080, G440, G864, G4283, G4284, G4285, G4286, G4287 |
| 780 | G4290 | PRT | *Oryza sativa* | Paralogous to G4288, G4289, G4291, G4292, G4293; Orthologous to G1750, G1421, G4079, G4080, G440, G864, G4283, G4284, G4285, G4286, G4287 |
| 781 | G4291 | DNA | *Oryza sativa* | Predicted polypeptide sequence is paralogous to G4288, G4289, G4290, G4292, G4293; orthologous to G1750, G1421, G4079, G4080, G440, G864, G4283, G4284, G4285, G4286, G4287 |
| 782 | G4291 | PRT | *Oryza sativa* | Paralogous to G4288, G4289, G4290, G4292, G4293; Orthologous to G1750, G1421, G4079, G4080, G440, G864, G4283, G4284, G4285, G4286, G4287 |
| 783 | G4292 | DNA | *Oryza sativa* | Predicted polypeptide sequence is paralogous to G4288, G4289, G4290, G4291, G4293; orthologous to G1750, G1421, G4079, G4080, G440, G864, G4283, G4284, G4285, G4286, G4287 |
| 784 | G4292 | PRT | *Oryza sativa* | Paralogous to G4288, G4289, G4290, G4291, G4293; Orthologous to G1750, G1421, G4079, G4080, G440, G864, G4283, G4284, G4285, G4286, G4287 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 785 | G4293 | DNA | *Oryza sativa* | Predicted polypeptide sequence is paralogous to G4288, G4289, G4290, G4291, G4292; orthologous to G1750, G1421, G4079, G4080, G440, G864, G4283, G4284, G4285, G4286, G4287 |
| 786 | G4293 | PRT | *Oryza sativa* | Paralogous to G4288, G4289, G4290, G4291, G4292; Orthologous to G1750, G1421, G4079, G4080, G440, G864, G4283, G4284, G4285, G4286, G4287 |
| 787 | G4294 | DNA | *Oryza sativa* | Predicted polypeptide sequence is orthologous to G1387, G2583, G975 |
| 788 | G4294 | PRT | *Oryza sativa* | Orthologous to G1387, G2583, G975 |
| 789 | G43 | DNA | *Arabidopsis thaliana* | Predicted polypeptide sequence is paralogous to G1419, G46, G1004, G29; orthologous to G3849 |
| 790 | G43 | PRT | *Arabidopsis thaliana* | Paralogous to G1419, G46, G1004, G29; Orthologous to G3849 |
| 791 | G4328 | DNA | *Solanum tuberosum* | Predicted polypeptide sequence is orthologous to G1791, G1792, G1795, G30, G3380, G3381, G3383, G3515, G3516, G3517, G3518, G3519, G3520, G3735, G3736, G3737, G3794, G3739, G3929, G4329, G4330 |
| 792 | G4328 | PRT | *Solanum tuberosum* | Orthologous to G1791, G1792, G1795, G30, G3380, G3381, G3383, G3515, G3516, G3517, G3518, G3519, G3520, G3735, G3736, G3737, G3794, G3739, G3929, G4329, G4330 |
| 793 | G4329 | DNA | *Petunia x hybrida* | Predicted polypeptide sequence is orthologous to G1791, G1792, G1795, G30, G3380, G3381, G3383, G3515, G3516, G3517, G3518, G3519, G3520, G3735, G3736, G3737, G3794, G3739, G3929, G4328, G4330 |
| 794 | G4329 | PRT | *Pelunia x hybrida* | Orthologous to G1791, G1792, G1795, G30, G3380, G3381, G3383, G3515, G3516, G3517, G3518, G3519, G3520, G3735, G3736, G3737, G3794, G3739, G3929, G4328, G4330 |
| 795 | G4330 | DNA | *Populus trichocarpa x Populus nigra* | Predicted polypeptide sequence is orthologous to G1791, G1792, G1795, G30, G3380, G3381, G3383, G3515, G3516, G3517, G3518, G3519, G3520, G3735, G3736, G3737, G3794, G3739, G3929, G4328, G4329 |
| 796 | G4330 | PRT | *Populus trichocarpa x Populus nigra* | Orthologous to G1791, G1792, G1795, G30, G3380, G3381, G3383, G3515, G3516, G3517, G3518, G3519, G3520, G3735, G3736, G3737, G3794, G3739, G3929, G4328, G4329 |
| 797 | G4371 | DNA | *Glycine max* | Predicted polypeptide sequence is paralogous to G3524; orthologous to G1543, G3510, G3490 |
| 798 | G4371 | PRT | *Glycine max* | Paralogous to G3524; Orthologous to G1543, G3510, G3490 |
| 799 | G440 | DNA | *Arabidopsis thaliana* | Predicted polypeptide sequence is paralogous to G1750, G1421, G864; orthologous to G4079, G4080, G4283, G4284, G4285, G4286, G4287, G4288, G4289, G4290, G4291, G4292, G4293 |
| 800 | G440 | PRT | *Arabidopsis thaliana* | Paralogous to G1750, G1421, G864; Orthologous to G4079, G4080, G4283, G4284, G4285, G4286, G4287, G4288, G4289, G4290, G4291, G4292, G4293 |
| 801 | G450 | DNA | *Arabidopsis thaliana* | Predicted polypeptide sequence is paralogous to G448, G455, G456 |
| 802 | G450 | PRT | *Arabidopsis thaliana* | Paralogous to G448, G455, G456 |
| 803 | G455 | DNA | *Arabidopsis thaliana* | Predicted polypeptide sequence is paralogous to G448, G450, G456 |
| 804 | G455 | PRT | *Arabidopsis thaliana* | Paralogous to G448, G450, G456 |
| 805 | G456 | DNA | *Arabidopsis thaliana* | Predicted polypeptide is paralogous to G448, G450, G455 |
| 806 | G456 | PRT | *Arabidopsis thaliana* | Paralogous to G448, G450, G455 |
| 807 | G46 | DNA | *Arabidopsis thaliana* | Predicted polypeptide sequence is paralogous to G1419, G43, G1004, G29; orthologous to G3849 |
| 808 | G46 | PRT | *Arabidopsis thaliana* | Paralogous to G1419, G43, G1004, G29; Orthologous to G3849 |
| 809 | G4627 | DNA | *Oryza sativa* | Predicted polypeptide sequence is paralogous to G4630, G5158; orthologous to G1809, G557, G4631, G4632 |
| 810 | G4627 | PRT | *Oryza sativa* | Paralogous to G4630, G5158; Orthologous to G1809, G557, G4631, G4632 |
| 811 | G4630 | DNA | *Oryza sativa* | Predicted polypeptide sequence is paralogous to G4627, G5158; orthologous to G1809, G557, G4631, G4632 |
| 812 | G4630 | PRT | *Oryza sativa* | Paralogous to G4627, G5158; Orthologous to G1809, G557, G4631, G4632 |
| 813 | G4631 | DNA | *Glycine max* | Predicted polypeptide sequence is orthologous to G1809, G557, G4627, G4630, G4632, G5158 |
| 814 | G4631 | PRT | *Glycine max* | Orthologous to G1809, G557, G4627, G4630, G4632, G5158 |
| 815 | G4632 | DNA | *Zea mays* | Predicted polypeptide sequence is orthologous to G1809, G557, G4627, G4630, G4631, G5158 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 816 | G4632 | PRT | *Zea mays* | Orthologous to G1809, G557, G4627, G4630, G4631, G5158 |
| 817 | G482 | DNA | *Arabidopsis thaliana* | Predicted polypeptide sequence is paralogous to G1364, G2345, G481, G485; orthologous to G3394, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 818 | G482 | PRT | *Arabidopsis thaliana* | Paralogous to G1364, G2345, G481, G485; Orthologous to G3394, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 819 | G485 | DNA | *Arabidopsis thaliana* | Predicted polypeptide sequence is paralogous to G1364, G2345, G481, G482; orthologous to G3394, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 820 | G485 | PRT | *Arabidopsis thaliana* | Paralogous to G1364, G2345, G481, G482; Orthologous to G3394, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 821 | G502 | DNA | *Arabidopsis thaliana* | Predicted polypeptide sequence is paralogous to G501, G519, G767 |
| 822 | G502 | PRT | *Arabidopsis thaliana* | Paralogous to G501, G519, G767 |
| 823 | G506 | DNA | *Arabidopsis thaliana* | Predicted polypeptide sequence is paralogous to G2052 |
| 824 | G506 | PRT | *Arabidopsis thaliana* | Paralogous to G2052 |
| 825 | G515 | DNA | *Arabidopsis thaliana* | Predicted polypeptide sequence is paralogous to G2053, G516, G517 |
| 826 | G515 | PRT | *Arabidopsis thaliana* | Paralogous to G2053, G516, G517 |
| 827 | G5158 | DNA | *Oryza sativa* | Predicted polypeptide sequence is paralogous to G4627, G4630; orthologous to G1809, G557, G4631, G4632 |
| 828 | G5158 | PRT | *Oryza sativa* | Paralogous to G4627, G4630; Orthologous to G1809, G557, G4631, G4632 |
| 829 | G5159 | DNA | *Oryza sativa* | Predicted polypeptide sequence is orthologous to G1482, G1888 |
| 830 | G5159 | PRT | *Oryza sativa* | Orthologous to G1482, G1888 |
| 831 | G516 | DNA | *Arabidopsis thaliana* | Predicted polypeptide sequence is paralogous to G2053, G515, G517 |
| 832 | G516 | PRT | *Arabidopsis thaliana* | Paralogous to G2053, G515, G517 |
| 833 | G519 | DNA | *Arabidopsis thaliana* | Predicted polypeptide sequence is paralogous to G501, G502, G767 |
| 834 | G519 | PRT | *Arabidopsis thaliana* | Paralogous to G501, G502, G767 |
| 835 | G545 | DNA | *Arabidopsis thaliana* | Predicted polypeptide sequence is paralogous to G350, G351 |
| 836 | G545 | PRT | *Arabidopsis thaliana* | Paralogous to G350, G351 |
| 837 | G554 | DNA | *Arabidopsis thaliana* | Predicted polypeptide sequence is paralogous to G1198, G1806, G555, G556, G558, G578, G629 |
| 838 | G554 | PRT | *Arabidopsis thaliana* | Paralogous to G1198, G1806, G555, G556, G558, G578, G629 |
| 839 | G555 | DNA | *Arabidopsis thaliana* | Predicted polypeptide sequence is paralogous to G1198, G1806, G554, G556, G558, G578, G629 |
| 840 | G555 | PRT | *Arabidopsis thaliana* | Paralogous to G1198, G1806, G554, G556, G558, G578, G629 |
| 841 | G556 | DNA | *Arabidopsis thaliana* | Predicted polypeptide sequence is paralogous to G1198, G1806, G554, G555, G558, G578, G629 |
| 842 | G556 | PRT | *Arabidopsis thaliana* | Paralogous to G1198, G1806, G554, G555, G558, G578, G629 |
| 843 | G557 | DNA | *Arabidopsis thaliana* | Predicted polypeptide sequence is paralogous to G1809; orthologous to G4627, G4630, G4631, G4632, G5158 |
| 844 | G557 | PRT | *Arabidopsis thaliana* | Paralogous to G1809; Orthologous to G4627, G4630, G4631, G4632, G5158 |
| 845 | G558 | DNA | *Arabidopsis thaliana* | Predicted polypeptide sequence is paralogous to G1198, G1806, G554, G555, G556, G578, G629 |
| 846 | G558 | PRT | *Arabidopsis thaliana* | Paralogous to G1198, G1806, G554, G555, G556, G578, G629 |
| 847 | G576 | DNA | *Arabidopsis thaliana* | Predicted polypeptide sequence is paralogous to G1082 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 848 | G576 | PRT | *Arabidopsis thaliana* | Paralogous to G1082 |
| 849 | G578 | DNA | *Arabidopsis thaliana* | Predicted polypeptide sequence is paralogous to G1198, G1806, G554, G555, G556, G558, G629 |
| 850 | G578 | PRT | *Arabidopsis thaliana* | Paralogous to G1198, G1806, G554, G555, G556, G558, G629 |
| 851 | G6 | DNA | *Arabidopsis thaliana* | Predicted polypeptide sequence is paralogous to G1020 |
| 852 | G6 | PRT | *Arabidopsis thaliana* | Paralogous to G1020 |
| 853 | G605 | DNA | *Arabidopsis thaliana* | Predicted polypeptide sequence is paralogous to G1944 |
| 854 | G605 | PRT | *Arabidopsis thaliana* | Paralogous to G1944 |
| 855 | G627 | DNA | *Arabidopsis thaliana* | Predicted polypeptide sequence is paralogous to G149, G1011, G154, G1797, G1798; orthologous to G4061, G4062, G4063, G4064, G4065, G4066, G4067 |
| 856 | G627 | PRT | *Arabidopsis thaliana* | Paralogous to G149, G1011, G154, G1797, G1798; Orthologous to G4061, G4062, G4063, G4064, G4065, G4066, G4067 |
| 857 | G629 | DNA | *Arabidopsis thaliana* | Predicted polypeptide sequence is paralogous to G1198, G1806, G554, G555, G556, G558, G578 |
| 858 | G629 | PRT | *Arabidopsis thaliana* | Paralogous to G1198, G1806, G554, G555, G556, G558, G578 |
| 859 | G631 | DNA | *Arabidopsis thaliana* | Predicted polypeptide sequence is paralogous to G559 |
| 860 | G631 | PRT | *Arabidopsis thaliana* | Paralogous to G559 |
| 861 | G648 | DNA | *Arabidopsis thaliana* | Predicted polypeptide sequence is paralogous to G1883 |
| 862 | G648 | PRT | *Arabidopsis thaliana* | Paralogous to G1883 |
| 863 | G666 | DNA | *Arabidopsis thaliana* | Predicted polypeptide sequence is paralogous to G256, G668, G932; orthologous to G3384, G3385, G3386, G3500, G3501, G3502, G3538, G3539, G3540, G3541 |
| 864 | G666 | PRT | *Arabidopsis thaliana* | Paralogous to G256, G668, G932; Orthologous to G3384, G3385, G3386, G3500, G3501, G3502, G3537, G3538, G3539, G3540, G3541 |
| 865 | G730 | DNA | *Arabidopsis thaliana* | Predicted polypeptide sequence is paralogous to G1040, G3034, G729 |
| 866 | G730 | PRT | *Arabidopsis thaliana* | Paralogous to G1040, G3034, G729 |
| 867 | G767 | DNA | *Arabidopsis thaliana* | Predicted polypeptide sequence is paralogous to G501, G502, G519 |
| 868 | G767 | PRT | *Arabidopsis thaliana* | Paralogous to G501, G502, G519 |
| 869 | G859 | DNA | *Arabidopsis thaliana* | Predicted polypeptide sequence is paralogous to G157, G1759, G1842, G1843, G1844 |
| 870 | G859 | PRT | *Arabidopsis thaliana* | Paralogous to G157, G1759, G1842, G1843, G1844 |
| 871 | G864 | DNA | *Arabidopsis thaliana* | Predicted polypeptide sequence is paralogous to G1750, G1421, G440; orthologous to G4079, G4080, G4283, G4284, G4285, G4286, G4287, G4288, G4289, G4290, G4291, G4292, G4293 |
| 872 | G864 | PRT | *Arabidopsis thaliana* | Paralogous to G1750, G1421, G440; Orthologous to G4079, G4080, G4283, G4284, G4285, G4286, G4287, G4288, G4289, G4290, G4291, G4292, G4293 |
| 873 | G867 | DNA | *Arabidopsis thaliana* | Predicted polypeptide sequence is paralogous to G1930, G9, G993; orthologous to G3388, G3389, G3390, G3391, G3432, G3433, G3451, G3452, G3453, G3454, G3455 |
| 874 | G867 | PRT | *Arabidopsis thaliana* | Paralogous to G1930, G9, G993; Orthologous to G3388, G3389, G3390, G3391, G3432, G3433, G3451, G3452, G3453, G3454, G3455 |
| 875 | G9 | DNA | *Arabidopsis thaliana* | Predicted polypeptide sequence is paralogous to G1930, G867, G993; orthologous to G3388, G3389, G3390, G3391, G3432, G3433, G3451, G3452, G3453, G3454, G3455 |
| 876 | G9 | PRT | *Arabidopsis thaliana* | Paralogous to G1930, G867, G993; Orthologous to G3388, G3389, G3390, G3391, G3432, G3433, G3451, G3452, G3453, G3454, G3455 |
| 877 | G903 | DNA | *Arabidopsis thaliana* | Predicted polypeptide sequence is paralogous to G2831 |
| 878 | G903 | PRT | *Arabidopsis thaliana* | Paralogous to G2831 |

TABLE 7-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 879 | G932 | DNA | *Arabidopsis thaliana* | Predicted polypeptide sequence is paralogous to G256, G666, G668; orthologous to G3384, G3385, G3386, G3500, G3501, G3502, G3537, G3538, G3539, G3540, G3541 |
| 880 | G932 | PRT | *Arabidopsis thaliana* | Paralogous to G256, G666, G668; Orthologous to G3384, G3385, G3386, G3500, G3501, G3502, G3537, G3538, G3539, G3540, G3541 |
| 881 | G938 | DNA | *Arabidopsis thaliana* | Predicted polypeptide sequence is paralogous to G940, G941 |
| 882 | G938 | PRT | *Arabidopsis thaliana* | Paralogous to G940, G941 |
| 883 | G941 | DNA | *Arabidopsis thaliana* | Predicted polypeptide sequence is paralogous to G938, G940 |
| 884 | G941 | PRT | *Arabidopsis thaliana* | Paralogous to G938, G940 |
| 885 | G960 | DNA | *Arabidopsis thaliana* | Predicted polypeptide sequence is paralogous to G1426, G1455, G513 |
| 886 | G960 | PRT | *Arabidopsis thaliana* | Paralogous to G1426, G1455, G513 |
| 887 | G964 | DNA | *Arabidopsis thaliana* | Predicted polypeptide sequence is paralogous to G398, G399 |
| 888 | G964 | PRT | *Arabidopsis thaliana* | Paralogous to G398, G399 |
| 889 | G976 | DNA | *Arabidopsis thaliana* | Predicted polypeptide sequence is paralogous to G913, G2514, G1753 |
| 890 | G976 | PRT | *Arabidopsis thaliana* | Paralogous to G913, G2514, G1753 |
| 891 | G993 | DNA | *Arabidopsis thaliana* | Predicted polypeptide sequence is paralogous to G1930, G867, G9; orthologous to G3388, G3389, G3390, G3391, G3432, G3433, G3451, G3452, G3453, G3454, G3455 |
| 892 | G993 | PRT | *Arabidopsis thaliana* | Paralogous to G1930, G867, G9; Orthologous to G3388, G3389, G3390, G3391, G3432, G3433, G3451, G3452, G3453, G3454, G3455 |
| 893 | G997 | DNA | *Arabidopsis thaliana* | Predicted polypeptide sequence is paralogous to G1789, G1911, G2721 |
| 894 | G997 | PRT | *Arabidopsis thaliana* | Paralogous to G1789, G1911, G2721 |

Example IX

Introduction of Polynucleotides into Dicotyledonous Plants and Cereal Plants

Transcription factor sequences listed in the Sequence Listing recombined into expression vectors, such as pMEN20 or pMEN65, may be transformed into a plant for the purpose of modifying plant traits. It is now routine to produce transgenic plants using most dicot plants (see Weissbach and Weissbach, (1989); Gelvin et al. (1990); Herrera-Estrella et al. (1983); Bevan (1984); and Klee (1985)). Methods for analysis of traits are routine in the art and examples are disclosed above.

The cloning vectors of the invention may also be introduced into a variety of cereal plants. Cereal plants such as, but not limited to, corn, wheat, rice, sorghum, or barley, may also be transformed with the present polynucleotide sequences in pMEN20 or pMEN65 expression vectors for the purpose of modifying plant traits. For example, pMEN020 may be modified to replace the NptII coding region with the BAR gene of *Streptomyces hygroscopicus* that confers resistance to phosphinothricin. The KpnI and BglII sites of the Bar gene are removed by site-directed mutagenesis with silent codon changes.

The cloning vector may be introduced into a variety of cereal plants by means well known in the art such as, for example, direct DNA transfer or *Agrobacterium tumefaciens*-mediated transformation. It is now routine to produce transgenic plants of most cereal crops (Vasil (1994)) such as corn, wheat, rice, sorghum (Cassas et al. (1993)), and barley (Wan and Lemeaux (1994)). DNA transfer methods such as the microprojectile can be used for corn (Fromm et al. (1990); Gordon-Kamm et al. (1990); Ishida (1990)), wheat (Vasil et al. (1992); Vasil et al. (1993b); Weeks et al. (1993)), and rice (Christou (1991); Hiei et al. (1994); Aldemita and Hodges (1996); and Hiei et al. (1997)). For most cereal plants, embryogenic cells derived from immature scutellum tissues are the preferred cellular targets for transformation (Hiei et al. (1997); Vasil (1994)).

Vectors according to the present invention may be transformed into corn embryogenic cells derived from immature scutellar tissue by using microprojectile bombardment, with the A188XB73 genotype as the preferred genotype (Fromm et al. (1990); Gordon-Kamm et al. (1990)). After microprojectile bombardment the tissues are selected on phosphinothricin to identify the transgenic embryogenic cells (Gordon-Kamm et al. (1990)). Transgenic plants are regenerated by standard corn regeneration techniques (Fromm et al. (1990); Gordon-Kamm et al. (1990)).

The vectors prepared as described above can also be used to produce transgenic wheat and rice plants (Christou (1991); Hiei et al. (1994); Aldemita and Hodges (1996); and Hiei et al. (1997)) that coordinately express genes of interest by following standard transformation protocols known to those skilled in the art for rice and wheat (Vasil et al. (1992); Vasil et al. (1993); and Weeks et al. (1993)), where the bar gene is used as the selectable marker.

Example X

Genes that Confer Significant Improvements to Diverse Plant Species

The function of specific orthologs of the sequences of the invention may be further characterized and incorporated into crop plants. The ectopic overexpression of these orthologs may be regulated using constitutive, inducible, or tissue specific regulatory elements. Genes that have been examined and have been shown to modify plant traits (including increasing lycopene, soluble solids and disease tolerance) encode orthologs of the transcription factor polypeptides found in the Sequence Listing, Table 6 or Table 7. In addition to these sequences, it is expected that related polynucleotide sequences encoding polypeptides found in the Sequence Listing can also induce altered traits, including increasing lycopene, soluble solids and disease tolerance, when transformed into a considerable variety of plants of different species, and including dicots and monocots. The polynucleotide and polypeptide sequences derived from monocots (e.g., the rice sequences) may be used to transform both monocot and dicot plants, and those derived from dicots (e.g., the *Arabidopsis* and soy genes) may be used to transform either group, although it is expected that some of these sequences will function best if the gene is transformed into a plant from the same group as that from which the sequence is derived.

Transgenic plants are subjected to assays to measure plant volume, lycopene, soluble solids, disease tolerance, and fruit set according to the methods disclosed in the above Examples.

These experiments demonstrate that a significant number the transcription factor polypeptide sequences of the invention can be identified and shown to increased volume, lycopene, soluble solids and disease tolerance. It is expected that the same methods may be applied to identify and eventually make use of other members of the clades of the present transcription factor polypeptides, with the transcription factor polypeptides deriving from a diverse range of species.

All publications and patent applications mentioned in this specification are herein incorporated by reference to the same extent as if each individual publication or patent application was specifically and individually indicated to be incorporated by reference.

The present invention is not limited by the specific embodiments described herein. The invention now being fully described, it will be apparent to one of ordinary skill in the art that many changes and modifications can be made thereto without departing from the spirit or scope of the Claims. Modifications that become apparent from the foregoing description and accompanying figures fall within the scope of the following Claims.

REFERENCES CITED

Aldemita and Hodges (1996) *Planta* 199:612-617
Ainley et al. (1993) *Plant Mol. Biol.* 22: 13-23
Altschul et al. (1990) *J. Mol. Biol.* 215: 403-410
Altschul (1993) *J. Mol. Evol.* 36: 290-300
Ammirato et al., eds. (1984) *Handbook of Plant Cell Culture-Crop Species*, Macmillan Publ. Co., NY, N.Y.
An et al. (1988) *Plant Physiol.* 88: 547-552
Anderson and Young (1985) "Quantitative Filter Hybridisation." In: Hames and Higgins, ed., *Nucleic Acid Hybridisation, A Practical Approach*. Oxford, IRL Press, 73-111
Angiosperm Phylogeny Group (1998) *Ann. Missouri Bot. Gard.* 84: 1-49
Aoyama et al. (1995) *Plant Cell* 7: 1773-1785
Ausubel et al. (1997) *Short Protocols in Molecular Biology*, John Wiley & Sons, New York, N.Y., unit 7.7
Ausubel et al., eds. (1998-2000) *Current Protocols in Molecular Biology*, Greene Publishing Associates, Inc. and John Wiley & Sons, Inc., (supplemented through 2000) ("Ausubel")
Baerson et al. (1993) *Plant Mol. Biol.* 22: 255-267
Baerson et al. (1994) *Plant Mol. Biol.* 26: 1947-1959
Bairoch et al. (1997) *Nucleic Acids Res.* 25: 217-221
Baumann et al., (1999) *Plant Cell* 11: 323-334
Beaucage et al. (1981) *Tetrahedron Letters* 22: 1859-1869
Berger and Kimmel (1987) *Guide to Molecular Cloning Techniques, Methods in Enzymology*, vol. 152 Academic Press, Inc., San Diego, Calif. ("Berger and Kimmel")
Bevan (1984) *Nucleic Acids Res.* 12: 8711-8721
Bhattacharjee et al. (2001) *Proc Natl. Acad. Sci., USA*, 98: 13790-13795
Bird et al. (1988) *Plant Mol. Biol.* 11: 651-662
Borevitz et al. (2000) *Plant Cell* 12: 2383-2394
Boss and Thomas (2002) *Nature*, 416: 847-850
Breen and Crouch (1992) *Plant Mol. Biol.* 19:1049-1055
Bruce et al. (2000) *Plant Cell*, 12: 65-79
Buchel et al. (1999) *Plant Mol. Biol.* 40: 387-396
Bulyk et al. (1999) *Nature Biotechnol.* 17: 573-577
Brummelkamp et al. (2002) *Science* 296:550-553
Byrne et al (2000) *Nature* 408: 967-971
Cassas et al. (1993) *Proc. Natl. Acad. Sci.* 90: 11212-11216
Chase et al. (1993) *Ann. Missouri Bot. Gard.* 80: 528-580
Cheng et al. (1994) *Nature* 369: 684-685
Chien et al. (1991) *Proc. Natl. Acad. Sci.* 88: 9578-9582
Chrispeels et al. (2000) *Plant Mol. Biol.* 42: 279-290
Christou (1991) *Bio/Technology* 9: 957-962
Constans (2002) *The Scientist* 16: 36
Corona et al. (1996) *Plant J.* 9: 505-512
Coupland (1995) *Nature* 377: 482-483
Crowley et al. (1985) *Cell* 43: 633-641
Daly et al. (2001) *Plant Physiol.* 127: 1328-1333
Doolittle, ed., (1996) *Methods Enzymol.*, vol. 266, "Computer Methods for Macromolecular Sequence Analysis", Academic Press, Inc., San Diego, Calif., USA
Eddy (1996) *Curr. Opin. Str. Biol.* 6: 361-365
Eisen (1998) *Genome Res.* 8: 163-167
Eyal et al. (1992) *Plant Mol. Biol.* 19: 589-599
Feng and Doolittle (1987) *J. Mol. Evol.* 25: 351-360
Fire et al. (1998) *Nature* 391: 806-811
Fluhr et al (1986) *EMBO J.* 5: 2063-2071
Fowler and Thomashow (2002) *Plant Cell* 14: 1675-1690
Fraley et al. (1983) *Proc. Natl. Acad. Sci.* 80: 4803-4807
Fromm et al. (1985) *Proc. Natl. Acad. Sci.* 82: 5824-5828
Fromm et al. (1989) *Plant Cell* 1: 977-984
Fromm et al. (1990) *Bio/Technol.* 8: 833-839
Fu et al. (2001) *Plant Cell* 13: 1791-1802
Gan and Amasino (1995) *Science* 270: 1986-1988
Gatz (1997) *Annu. Rev. Plant Physiol. Plant Mol. Biol.* 48: 89-108
Gelvin et al. (1990) *Plant Molecular Biology Manual*, Kluwer Academic Publishers
Giniger and Ptashne (1987) *Nature* 330: 670-672
Gilmour et al. (1998) *Plant J.* 16: 433-442
Goodrich et al. (1993) *Cell* 75: 519-530
Gordon-Kamm (1990) *Plant Cell* 2: 603-618

Guevara-Garcia (1998) *Plant Mol. Biol.* 38: 743-753
Guyer et al. (1998) *Genetics* 149: 633-639
Hames and Higgins, eds. (1985) *Nucleic Acid Hybridisation: A Practical Approach*, IRL Press, Oxford, U. K.
Hammond et al. (2001) *Nature Rev Gen* 2: 110-119
Harlow and Lane (1988), *Antibodies: A Laboratory Manual*, Cold Spring Harbor Laboratory, New York
He et al. (2000) *Transgenic Res.* 9: 223-227
Hein (1990) *Methods Enzymol.* 183: 626-645
Hempel et al. (1997) *Development* 124: 3845-3853
Henikoff and Henikoff (1991) *Nucleic Acids Res.* 19: 6565-6572
Henikoff and Henikoff (1992) *Proc. Natl. Acad. Sci.* 89: 10915-10919
Herrera-Estrella et al. (1983) *Nature* 303: 209
Hiei et al. (1994) *Plant J.* 6:271-282
Hiei et al. (1997) *Plant Mol. Biol.* 35:205-218
Higgins and Sharp (1988) *Gene* 73: 237-244
Higgins et al. (1996) *Methods Enzymol.* 266: 383-402
Hohn et al. (1982) *Molecular Biology of Plant Tumors* Academic Press, New York, N.Y., pp. 549-560
Horsch et al. (1984) *Science* 233: 496-498
Ichikawa et al. (1997) *Nature* 390 698-701
Isalan et al. (2001) *Nature Biotechnol.* 19: 656-660
Ishida (1990) *Nature Biotechnol.* 14:745-750
Ishida et al. (1996) *Nature Biotechnol.* 14: 745-750
Izant and Weintraub (1985) *Science* 229: 345-352
Jaglo et al. (2001) *Plant Physiol.* 127: 910-917
Jones et al. (1992) *Transgenic Res.* 1: 285-297
Kaiser et al. (1995) *Plant Mol. Biol.* 28: 231-243
Kakimoto et al. (1996) *Science* 274: 982-985
Karlin and Altschul (1993) *Proc. Natl. Acad. Sci.* 90: 5873-5787
Kashima et al. (1985) *Nature* 313:402-404
Kempin et al. (1997) *Nature* 389: 802-803
Kim and Wold (1985) *Cell* 42: 129-138
Kim et al. (2001) *Plant J.* 25: 247-259
Kimmel (1987) *Methods Enzymol.* 152: 507-511
Klee (1985) *Bio/Technology* 3: 637-642
Klein et al. (1987) *Nature* 327: 70-73
Koncz et al. (1992a) *Methods in Arabidopsis Research*, World Scientific, River Edge, N.J.
Koncz et al (1992b) *Plant Molec. Biol.* 20: 963-976
Kop et al. (1999) *Plant Mol. Biol.* 39: 979-990
Ku et al. (2000) *Proc. Natl. Acad. Sci.* 97: 9121-9126
Kuhlemeier et al. (1989) *Plant Cell* 1: 471-478
Kyozuka and Shimamoto (2002) *Plant Cell Physiol.* 43: 130-135
Lehming et al (1987) *EMBO J.* 6: 3145-3153
Lichtenstein and Nellen (1997) *Antisense Technology: A Practical Approach* IRL Press at Oxford University Press, Oxford, U.K
Lin et al. (1991) *Nature* 353: 569-571
Liu et al. (2001) *J. Biol. Chem.* 276: 11323-11334
Long and Barton (1998) *Development* 125: 3027-3035
Long and Barton (2000) *Dev. Biol.* 218: 341-353
Ma and Ptashne (1987) *Cell* 51: 113-119
Mandel et al. (1992a) *Nature* 360: 273-277
Mandel et al. (1992b) *Cell* 71: 133-143
Manners et al. (1998) *Plant Mol. Biol.* 38: 1071-1080
Matthes et al. (1984) *EMBO J.* 3: 801-805
Melton (1985) *Proc. Natl. Acad. Sci.* 82: 144-148
Meyers (1995) *Molecular Biology and Biotechnology*, Wiley VCH, New York, N.Y., p 856-853
Montgomery et al. (1993) *Plant Cell* 5: 1049-1062
Moore et al. (1988) in Schaad, ed., *Laboratory Guide for the Identification of Plant Pathogenic Bacteria*. APS Press, St. Paul, Minn.
Moore et al. (1998) *Proc. Natl. Acad. Sci.* 95: 376-381
Mount (2001) in *Bioinformatics: Sequence and Genome Analysis* Cold Spring Harbor Laboratory Press, Cold Spring Harbor, N.Y., page 543
Müller et al. (2001) *Plant J.* 28: 169-179
Mullis et al. (1990) *PCR Protocols A Guide to Methods and Applications* (Innis et al. eds) Academic Press Inc. San Diego, Calif.
Murashige and Skoog (1962) *Plant Physiol.* 15: 473-497
Nagel et al. (1990) *FEMS Microbiol Letts.* 67: 325-328
Nandi et al. (2000) *Curr. Biol.* 10: 215-218
Needleman and Wunsch (1970) *J. Mol. Biol.* 48: 443-453
Nicholass et al. (1995) *Plant Mol. Biol.* 28: 423-435
Odell et al. (1985) *Nature* 313: 810-812
Odell et al. (1994) *Plant Physiol.* 106: 447-458
Ohl et al. (1990) *Plant Cell* 2: 837-848
Ori et al. (2000) *Development* 127: 5523-5532
Paddison, et al. (2002) *Genes & Dev.* 16: 948-958
Pearson and Lipman (1988) *Proc. Natl. Acad. Sci.* 85: 2444-2448
Peng et al. (1997) *Genes Development* 11: 3194-3205
Peng et al. (1999) *Nature* 400: 256-261
Piazza et al. (2002) *Plant Physiol.* 128: 1077-1086
Preiss et al. (1985) *Nature* 313: 27-32
Ratcliffe et al. (2001) *Plant Physiol.* 126: 122-132
Riechmann et al. (2000) *Science* 290: 2105-2110
Rieger et al. (1976) *Glossary of Genetics and Cytogenetics: Classical and Molecular*, 4th ed., Springer Verlag, Berlin
Ringli and Keller (1998) *Plant Mol. Biol.* 37: 977-988
Robson et al. (2001) *Plant J.* 28: 619-631
Rosenberg et al. (1985) *Nature* 313: 703-706
Sadowski et al. (1988) *Nature* 335: 563-564
Sambrook et al. (1989) *Molecular Cloning: A Laboratory Manual*, 2nd Ed., Vol. 1-3, Cold Spring Harbor Laboratory, Cold Spring Harbor, N.Y. ("Sambrook")
Schaffner and Sheen (1991) *Plant Cell* 3: 997-1012
Sharp (1999) *Genes and Development* 13: 139-141
Shi et al. (1998) *Plant Mol. Biol.* 38: 1053-1060
Shimamoto et al. (1989) *Nature* 338: 274-276
Shpaer (1997) *Methods Mol. Biol.* 70: 173-187
Siebertz et al. (1989) *Plant Cell* 1: 961-968
Sjodahl et al. (1995) *Planta* 197: 264-271
Smith and Waterman (1981) *Adv. Appl. Math.* 2: 482-489
Smith et al. (1988) *Nature*, 334: 724-726
Smith et al. (1990) *Plant Mol. Biol.* 14: 369-379
Smith et al. (1992) *Protein Engineering* 5: 35-51
Sonnhammer et al. (1997) *Proteins* 28: 405-420
Stemmer (1994a) *Nature* 370: 389-391
Stemmer (1994b) *Proc. Natl. Acad. Sci.* 91: 10747-10751
Suzuki et al. (2001) *Plant J.* 28: 409-418
Taylor and Scheuring (1994) *Mol. Gen. Genet.* 243: 148-157
Thoma et al. (1994) *Plant Physiol.* 105: 35-45
Thompson et al. (1994) *Nucleic Acids Res.* 22: 4673-4680
Timmons and Fire (1998) *Nature* 395: 854
Tudge (2000) in *The Variety of Life*, Oxford University Press, New York, N.Y., pp. 547-606
Vasil et al. (1990) *Bio/Technol.* 8: 429-434
Vasil et al. (1992) *Bio/Technol.* 10:667-674
Vasil (1993a) *Bio/Technology* 10: 667-674
Vasil et al. (1993 b) *Bio/Technol.* 11:1553-1558
Vasil (1994) *Plant Mol. Biol.* 25: 925-937
Wahl and Berger (1987) *Methods Enzymol.* 152: 399-407
Wan and Lemeaux (1994) *Plant Physiol.* 104: 37-48
Wanner and Gruissem (1991) *Plant Cell* 3: 1289-1303

Weeks et al. (1993) *Plant Physiol.* 102: 1077-1084
Weigel and Nilsson (1995) *Nature* 377: 482-500
Weissbach and Weissbach (1989) *Methods for Plant Molecular Biology*, Academic Press
Willmott et al. (1998) *Plant Molec. Biol.* 38: 817-825
Winans (1992) *Microbiol. Rev.* 56: 12-31
Wu, ed. (1993) *Methods Enzymol.* (vol. 217, Academic Press, San Diego)
Xu et al. (2001) *Proc. Natl. Acad. Sci.*, USA, 98: 15089-15094
Zamore (2001) *Nature Struct. Biol.,* 8: 746-750
Zhang et al. (2000) *J. Biol. Chem.* 275: 33850-33860

SEQUENCE LISTING (3372 sequences)

SEQ ID NO: 1 - DNA, 1680 bp, Arabidopsis thaliana
  G2,family:AP2
ctctctctctctctttagctctttttttttttttgttttcattaaagtttttattttattttctaccaaccaaaagcttttctctttggtttctcttatttagcttctaaccttgaggagaatataccagaggattgaagtttgaaccttcaaagatcaaaatcaagaaaccaaaaaaaaacaaaaaaaatgtgggatctaaacgacgcaccacaccaaacacaaagagaagaagaatctgaagagttttgttattcttcaccaagtaaacgggttggatctttctctaattcaagctcttcagctgttgttatcgaagatggatccgatgacgatgaacttaaccgggtcagacccaataacccacttgtcacccatcagttcttccctgagatggattctaacggcggtggtgttgcttctggctttcctcgggctcactggtttggtgttaagttttgtcagtcggatctagccaccggatcgtccgcgggtaaagctaccaacgttgccgctgccgtagtggagccggcacagccgttgaaaaagagtcggcgtggaccaagatcaagaagttctcagtatagaggtgttacgttttaccggcgtaccggaagatgggaatctcatatttgggactgtgggaaacaagtttacttaggtggatttgacactgctcatgcagcagctcgagcatatgatagagctgctattaaattccgtggagtagaagcggatatcaatttcaacatcgacgattatgatgatgacttgaaacagatgactaatttaaccaaggaagagttcgtacacgtacttcgccgacaaagcacaggcttccctcgaggaagttcgaagtatagaggtgtcactttgcataagtgtggtcgttgggaagctcgtatgggtcaattcttaggcaaaaagtatgtttatttgggtttgttcgacaccgaggtcgaagctgctagagcttacgataaagctgcaatcaaatgtaacggcaaagacgccgtgaccaactttgatccgagtatttacgatgaggaactcaatgccgagtcatcagggaatcctactactccacaagatcacaacctcgatctgagcttgggaaattcggctaattcgaagcataaaagtcaagatatgcggctcaggatgaaccaacaacaacaagattctctccactctaatgaagttcttggattaggtcaaaccggaatgcttaaccatactcccaattcaaaccaccaatttccgggcagcagcaacattggtagcggaggcggattctcactgtttccggcggctgagaaccaccggtttgatggtcgggcctcgacgaaccaagtgttgacaaatgctgcagcatcatcaggattctctcctcatcatcacaatcagatttttaattctacttctactcctcatcaaaattggctgcagacaaatggcttccaacctcctctcatgagaccttcttgaatcttttatatttttaaggtttattattatataagaaaaacaaaaatgaacctttgaaatccccacatgttcttggtcatttcattaatcatcggcttatattttgcttattttcccctaaatcctcttgttaacttaggcgaacaaaaaaaattaatggaaatctttttccctccatcggttacaaaaata

SEQ ID NO: 2 - protein, 432 aa, Arabidopsis thaliana
  G2,AP2 domain coordinates 129-195,221-288
MWDLNDAPHQTQREEESEEFCYSSPSKRVGSFSNSSSSAVVIEDGSDDDELNRVRPNNPLVTHQFFPEMDSNGGGVASGFPRAHWFGVKFCQSDLATGSSAGKATNVAAAVVEPAQPLKKSRRGPRSRSSQYRGVTFYRRTGRWESHIWDCGKQVYLGGFDTAHAAARAYDRAAIKFRGVEADINFNIDDYDDDLKQMTNLTKEEFVHVLRRQSTGFPRGSSKYRGVTLHKCGRWEARMGQFLGKKYVYLGLFDTEVEAARAYDKAAIKCNGKDAVTNFDPSIYDEELNAESSGNPTTPQDHNLDLSLGNSANSKHKSQDMRLRMNQQQQDSLHSNEVLGLGQTGMLNHTPNSNHQFPGSSNIGSGGGFSLFPAAENHRFDGRASTNQVLTNAAASSGFSPHHHNQIFNSTSTPHQNWLQTNGFQPPLMRPS

SEQ ID NO: 3 - DNA, 759 bp, Arabidopsis thaliana
  G3,family:AP2
gtttgtcttttatcaatggaaagagaacaagaagagtctacgatgagaaagagaaggcagccacctcaagaagaagtgcctaaccacgtggctacaaggaagccgtacagagggatacggaggaggaagtggggcaagtgggtggctgagattcgtgagcctaacaaacgctcacggctttggcttggctcttacacaaccgatatcgccgccgctagagcctacgacgtggccgtcttctacctccgtggcccctccgcacgtctcaacttccctgatcttctcttgcaagaagaggaccatctctcagccgccaccaccgctgacatgcccgcagctcttataagggaaaaagcggcggaggtcggcgccagagtcgacgctcttctagcttctgccgctccttcgatggctcactccactccgccggtaataaaacccgacttgaatcaaatacccgaatccggagatatatagtcaatttatatacatgtagtttgttttgtttgattagaagattacatttacatacaagatacacatagatactggaaaatataggtatgtatacattcataaattatcttatgtatcaaagaattttatagattctgattagctttttgtttttgtttttgataagaactctgattagttgtccggagacaaaaccggctaagagcaatccatgagaagctagcgagtgttttttagttcaagttgtaatataaatgcatattaattctttagtaattttgt

SEQ ID NO: 4 - protein, 153 aa, Arabidopsis thaliana
  G3,AP2 domain coordinates 28-95
MEREQEESTMRKRRQPPQEEVPNHVATRKPYRGIRRRKWGKWVAEIREPNKRSRLWLGSYTTDIAAARAYDVAVFYLRGPSARLNFPDLLLQEEDHLSAATTADMPAALIREKAAEVGARVDALLASAAPSMAHSTPPVIKPDLNQIPESGDI

SEQ ID NO: 5 - DNA, 1713 bp, Arabidopsis thaliana
  G8,family:AP2
aaaaaaaaatatccgtctcactctctcgccgccggtaacatttcccggcgacaaaacttctctactctcaccattcctccatcgtaatctctaaattcttctccattctcttcttcctcccgatcatctcgagctcttcgtgagagattatgtgattatgtaatcgttgttgctgtagaagacgatctctaacaactgattccttcatcatcaccttcgctagatttgtaattttcagagcttgagatgttggatcttaacctcaacgctgattctcccgagtcgactcagtacggtggtgactcatacttagatcggcagacatcagacaactccgccgggaatcgagtggaagagtccggtacatcgacgtcgtcagttatcaatgccgatggagacgaagactcttgctctactcgagctttcactctcagtttcgatattttaaaagtcggaagtagtagcggcggagacgaaagccccgccgcttcagcttccgttactaaagagttttttccggtgagtggagactgtggacatctacgagatgttgaaggatcatcaagctctagaaactggatagatctttcttttgaccgtattggtgacggagaaacgaaattggtaactccggttccgactccggctccggttccggctcaggttaaaaagagtcggagaggaccaaggtctagaagttcacagtatagaggagttactttttatagaagaactggtcgatgggagtcacatatttgggattgtgggaaacaagtttatttaggtggtttcgacactgctcatgctgcagctagagcttatgatcgagctgctattaaatttagaggtgttgatgctgatatcaactttactcttggtgattatgaggaagatatgaaacaggtacaaaacttgagtaaggaagagtttgtgcatatactgcgtagacagagcacggggttttcgcgggggagttcgaagtatcgaggggttacgttacacaaatgtggtagatgggaagctaggatggggcagtttcttggtaaaaaggcttatgacaaggctgcaatcaacactaatggtagagaagcagtcacgaacttcgagatgagttcataccaaaatgagattaactctgagagcaataactctgagattgacctcaacttgggaatctctttatcgaccggtaatgcgccaaagcaaaatgggaggctctttcacttcccttctaatacttatgaaactcagcgtggagttagcttgaggatagataacgaatacatgggaaagccggtgaatacacctcttccttatggatcctcggatcatcgcctttactggaacggagcatgcccgagttataataatcccgccgagggaagagcaacagaaaagagaagtgaagctgaagggatgatgagtaactggggatggcagagaccggggcaaacaagcgccgtgagaccgcagccaccgggaccacaaccaccaccattgttctcagttgcagcagcatcatcaggattctcacatttccggccacaacctcccaatgacaatgcaacacgtggttacttttatccacacccttaacttgtaaggggacatatgagagtttttttaccatctctctctctctcaacactctagtcccctttcaaaaatgtcatttgggttttagatttttcacatacaatgatcaatttttcc

SEQ ID NO: 6 - protein, 449 aa, Arabidopsis thaliana
  G8,AP2 domain coordinates 151-217,243-293
MLDLNLNADSPESTQYGGDSYLDRQTSDNSAGNRVEESGTSTSSVINADGDEDSCSTRAFTLSFDILKVGSSSGGDESPAASASVTKEFFPVSGDCGHLRDVEGSSSSRNWIDLSFDRIGDGETKLVTPVPTPAPVPAQVKKSRRGPRSRSSQYRGVTFYRRTGRWESHIWDCGKQVYLGGFDTAHAAARAYDRAAIKFRGVDADINFTLGDYEEDMKQVQNLSKEEFVHILRRQSTGFSRGSSKYRGVTLHKCGRWEARMGQFLGKKAYDKAAINTNGREAVTNFEMSSYQNEINSESNNSEIDLNLGISLSTGNAPKQNGRLFHFPSNTYETQRGVSLRIDNEYMGKPVNTPLPYGSSDHRLYWNGACPSYNNPAEGRATEKRSEAEGMMSNWGWQRPGQTSAVRPQPPGPQPPPLFSVAAASSGFSHFRPQPPNDNATRGYFYPHP

SEQ ID NO: 7 - DNA, 831 bp, Arabidopsis thaliana
  G12,family:AP2
gtgtcggtgaattttttgaaacttcttctcttttgcggtttcgtgttccactcctctcttcttggcccacgtgttcatcaatctctccctccgcatgtaatcgcttcgccgtcaatatcacatctttcttcttctttatctttaaaatctctttagatcgattcttttgtggattcttgaaatctccggagaaaaccactatggagacggcgactgaagtggccacggtggtgtcaactccggcggttacggttgcggcggtggcgacgaggaagagagataagccgtataaagggataaggatgaggaagtgggggaagtgggtggcggagataagagagcctaataaaaggtcaaggatctggcttggctcttactctactcctgaagcggcggcgcgtgcttacgacacggcggtgttttatctccgaggtccttctgctcggcttaacttcccggagcttttagccggagtgacggtgacgggaggaggcggaggaggagtgaacggtggtggagatatgtcggcggcgtatataaggagaaaagcggcggaggttggagcacaagtggatgcgttagaagcggcgggggcgggagggaatcgtcatcatcatcatcatcaacatcaacgtggtaatcatgattacgtagataatcatagtgattatcgtattaatgatgatcttatggagtgtagtagtaaagaagggtttaagaggtgtaatggatcgttggaacgggttgatttaaacaaattacccgatccggaaacttcagatgacgattaggaaagcaaaaaatagaaacaaaaaaaaaaaaaaaaaaaaa

SEQ ID NO: 8 - protein, 196 aa, Arabidopsis thaliana
  G12,AP2 domain coordinates 27-94
METATEVATVVSTPAVTVAAVATRKRDKPYKGIRMRKWGKWVAEIREPNKRSRIWLGSYSTPEAAARAYDTAVFYLRGPSARLNFPELLAGVTVTGGGGGGVNGGGDMSAAYIRRKAAEVGAQVDALEAAGAGGNRHHHHHQHQRGNHDYVDNHSDYRINDDLMECSSKEGFKRCNGSLERVDLNKLPDPETSDDD

SEQ ID NO: 9 - DNA, 1905 bp, Arabidopsis thaliana
  G15,family:AP2
atagaaagaagagaagcagaaaccaaaaaaagaaaccatgaagtctttttgtgataatgatgataataatcatagcaacacgactaatttgttagggttctcattgtcttcaaatatgatgaaaatgggaggtagaggaggtagagaagctatttactcatcttcaacttcttcagctgcaacttcttcttcttctgttccacctcaacttgttgttggtgacaacactagcaactttggtgtttgctatggatctaacccaaatggaggaatctattctcacatgtctgtgatgccactcagatctgatggttctctttgcttaatggaagctctcaacagatcttctcactcgaatcaccatcaagattcatctccaaaggtggaggatttctttgggacccatcacaacaacacaagtcacaaagaagccatggatcttagcttagatagtttattctacaacaccactcatgagcccaacacgactacaaactttcaagagttctttagcttccctcaaaccagaaaccatgaggaagaaactagaaattacgggaatgaccctagtttgacacatggagggtcttttaatgtaggggtatatggggaatttcaacagtcactgagcttatccatgagccctgggtcacaatctagctgcatcactggctctcaccaccaccaacaaaaccaaaaccaaaaccaccaaagccaaaaccaccagcagatctctgaagctcttgtggagacaagcgttgggtttgagacgacgacaatggcggctgcgaagaagaagaggggacaagaggatgttgtagttgttggtcagaaacagattgttcatagaaaatctatcgatacttttggacaacgaacttctcaataccgaggcgttacaagacatagatggactggtagatatgaagctcatctatgggacaatagtttcaagaaggaaggtcacagtagaaaaggaagacaagtttatctgggaggttatgatatggaggagaaagctgctcgagcatatgatcttgctgcactcaagtactggggtccctctactcacaccaatttctctgcggagaattatcagaaagagattgaagacatgaagaacatgactagacaagaatatgttgcacatttgagaaggaagagcagtggtttctctaggggtgcttccatctatagaggagtcacaagacatcaccagcatggaaggtggcaagcacggattggtagagtcgctggaaacaaagatctctaccttggaacttttggaacccaagaagaagctgcagaagcttacgatgtagcagcaattaagttccgtggcacaaatgctgtgactaactttgatatcacgaggtacgatgttgatcgtatcatgtctagtaacacactcttgtctggagagttagcgcgaaggaacaacaacagcattgtcgtcaggaatactgaagaccaaaccgctctaaatgctgttgtggaaggtggttccaacaaagaagtcagtactcccgagagactcttgagttttccggcgattttcgcgttgcctcaagttaatcaaaagatgttcggatcaaatatgggcggaaatatgagtccttggacatcaaaccctaatgctgagcttaagaccgtcgctcttactttgcctcagatgccggttttcgctgcttgggctgattcttgatcaacttcaatgactaactctggttttcttggtttagttgctaagtgttttggtttatctccggttttatccggtttgaactacaattcggtttagtttcgtcggtataaatagtatttgcttaggagcggtatatgtttcttttgagtagtattcatgtgaaacagaatgaatctctctataacatattattttaatgg

SEQ ID NO: 10 - protein, 555 aa, Arabidopsis thaliana
  G15,AP2 domain coordinates 281-357,383-451
MKSFCDNDDNNHSNTTNLLGFSLSSNMMKMGGRGGREAIYSSSTSSAATSSSSVPPQLVVGDNTSNFGVCYGSNPNGGIYSHMSVMPLRSDGSLCLMEALNRSSHSNHHQDSSPKVEDFFGTHHNNTSHKEAMDLSLDSLFYNTTHEPNTTTNFQEFFSFPQTRNHEEETRNYGNDPSLTHGGSFNVGVYGEFQQSLSLSMSPGSQSSCITGSHHHQQNQNQNHQSQNHQQISEALVETSVGFETTTMAAAKKKRGQEDVVVVGQKQIVHRKSIDTFGQRTSQYRGVTRHRWTGRYEAHLWDNSFKKEGHSRKGRQVYLGGYDMEEKAARAYDLAALKYWGPSTHTNFSAENYQKEIEDMKNMTRQEYVAHLRRKSSGFSRGASIYRGVTRHHQHGRWQARIGRVAGNKDLYLGTFGTQEEAAEAYDVAAIKFRGTNAVTNFDITRYDVDRIMSSNTLLSGELARRNNNSIVVRNTEDQTALNAVVEGGSNKEVSTPERLLSFPAIFALPQVNQKMFGSNMGGNMSPWTSNPNAELKTVALTLPQMPVFAAWADS

SEQ ID NO: 11 - DNA, 933 bp, Arabidopsis thaliana
  G33,family:AP2
attctcccccaaccaaaatatgaccacagaaaaagagaatgtcactacggccgtggccgtgaaagacggcggagaaaagagtaaggaagtgagtgacaagggcgtaaagaagagaaagaatgtaactaaggccctggccgtgaatgacggcggagaaaagagtaaggaagtgcgttacaggggtgtaaggaggagaccatgggggagatatgctgcggagatccgtgatccggtaaagaaaaaacgggtctggctcgggtccttcaacacgggggaggaagccgccagagcctacgactccgctgccataaggtttcgaggatcgaaagctactactaacttccctctaatcggatactatgggatttcttcggcgacgccggtgaacaacaacctttccgagacggtgagtgatggaaatgccaacctccctctcgttggagacgatgggaatgctttggcttctccggtgaacaacaccctttccgaaacggcgcgtgatggaacacttccatcggattgtcacgacatgttatctccgggggtggctgaagcggttgctggatttttcttagatctgcctgaagttattgcgttgaaagaggagcttgatcgagtttgtcctgaccagtttgagtccattgatatggggttgactattggtcctcaaaccgccgtggaagagcctgagacttcctccgccgtggattgtaagctgcgaatggaaccggatcttgacctcaacgcaagtccctaaagattgatctgatgttgttgtccttgaataagtttgttatcttgtcgctcttctgattgtctgtacttctattggttgattcgtgcttttggaggacaaaacaaacatttttttatgtattaaaaaaaggtaattgaactattatcgaaaaaaaaaaaaaaaaaaaaaaaaaaaaa

SEQ ID NO: 12 - protein, 245 aa, Arabidopsis thaliana
  G33,AP2 domain coordinates 50-117
MTTEKENVTTAVAVKDGGEKSKEVSDKGVKKRKNVTKALAVNDGGEKSKEVRYRGVRRRPWGRYAAEIRDPVKKKRVWLGSFNTGEEAARAYDSAAIRFRGSKATTNFPLIGYYGISSATPVNNNLSETVSDGNANLPLVGDDGNALASPVNNTLSETARDGTLPSDCHDMLSPGVAEAVAGFFLDLPEVIALKEELDRVCPDQFESIDMGLTIGPQTAVEEPETSSAVDCKLRMEPDLDLNASP

SEQ ID NO: 13 - DNA, 800 bp, Arabidopsis thaliana
  G35,family:AP2
ggattctaaaagataagagaaacagtaagtcggttaattttggattaagtaacgcacaagccaaagccttctcctgatcgaatcataaaccaaacaaatctttcttttaaaagaagcggacacaaaccctaaccaccaaccctctccgtcgtcaaatttcccggcgaaagatgaaacgaattgttcgaatttcattcacagacatggaagcaaccgattcttcaagcagcgaagacgagtcaccaccgtcatcacgccgtcgaggtaagaagctagtcaaggaaatcgtaatcgatcattctgatcccccggaggtcggaaaaactcggttcaaaatcaggattccggcgagtttacttgctgcgaggaatacgacggcgaataagaagaagttccgtggcgtgaggcagagaccatgggggaagtgggcggctgagattagatgtggtagagttaaaggaagacctgaacgaatttggcttggaacttttgaaacagctgaagaagctgctcttgcttatgataacgctgcgattcagttgattggacctgatgcgccgactaattttggccgtcctgatgttgattctgcggtggtgaaaaagcaagattctgatgctagtggtggtgcttctgaagaagttgtttgattttcttgtttataactaactttgcaaggttacttttgtttatcatcatcttttgtaaatttgatcatcttgctctttgctttttaacttctcttgtacatgtttgaattataaaagttctaatttttcaatcaaaaaaaaaaaaaaaaa

SEQ ID NO: 14 - protein, 159 aa, Arabidopsis thaliana
  G35,AP2 domain coordinates NA
MKRIVRISFTDMEATDSSSSEDESPPSSRRRGKKLVKEIVIDHSDPPEVGKTRFKIRIPASLLAARNTTANKKKFRGVRQRPWGKWAAEIRCGRVKGRPERIWLGTFETAEEAALAYDNAAIQLIGPDAPTNFGRPDVDSAVVKKQDSDASGGASEEVV

SEQ ID NO: 15 - DNA, 785 bp, Arabidopsis thaliana
  G47,family:AP2
cttcttcttcacatcgatcatcatacaacaacaaaaaatggattacagagaatccaccggtgaaagtcagtcaaagtacaaaggaatccgtcgtcggaaatggggcaaatgggtatcagagattagagttccgggaactcgtgaccgtctctggttaggttcattctcaacagcagaaggtgccgccgtagcacacgacgttgctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggagatacgacgacgtattacgagaatggagctgatcaagtggagccgttgaatatttcagtgtatgattatctgggcggccacgatcacgtttgatttatctcgacggtcatgatcacgtttgatcttcttttgagtaagattttgtaccataatcaaaacaggtgtggtgctaaaatcttactcaaaacaagattaggtaccacagagaaacaatcaaatggttgtgaatatacattataaggttttgattaatgtttgtttcactgatttagtgaagtttggtccattgtatacaaatctattcaagaaacctagcgcgagatcatgtttcgtgattgaagattgagatttttaagtattcgtaatatttttgtaaaatacaaataaaaaaaaaaaaaaaaaaaaa

SEQ ID NO: 16 - protein, 144 aa, Arabidopsis thaliana
  G47,AP2 domain coordinates 10-75
MDYRESTGESQSKYKGIRRRKWGKWVSEIRVPGTRDRLWLGSFSTAEGAAVAHDVAFFCLHQPDSLESLNFPHLLNPSLVSRTSPRSIQQAASNAGMAIDAGIVHSTSVNSGCGDTTTYYENGADQVEPLNISVYDYLGGHDHV

SEQ ID NO: 17 - DNA, 1292 bp, Arabidopsis thaliana
  G201,family:MYB-(R1)R2R3
atgtcaagaaagccatgttgtgtgggagaaggactgaagaaaggagcatggactgccgaagaagacaagaaactcatctcttacattcatgaacacggtggaggaggctggcgtgacattccccaaaaagctggactaaaacgatgtggaaagagttgtagattgcgatgggctaactatttgaaacctgacatcaagagaggagagtttagctatgaggaggaacagattatcatcatgctacacgcttctcgcggcaacaagtggtcagtcatagcgagacatttgcccaaaagaacagataacgagattaagaactactggaacacgcatctcaaaaagctcctgatcgataagggaatcgatcccgtgacccacaagccacttgcctatgactcaaacccggatgagcaatcgcaatcgggttccatctctccaaagtctcttcctccttcaagctccaaaaatgtaccggagataaccagcagtgacgagacaccgaaatatgatgcttccttgagctccaagaaacgttgttttaagagatcgagttctacatcaaaactgttaaacaaagttgcagctagggcttcttccatgggaactatactaggcgcctccatcgaaggaaccttgatcagctctacaccgttgtcttcatgtctaaatgatgacttttctgaaacaagtcaatttcagatggaagaatttgatccattctatcagtcatctgaacacataattgatcatatgaaagaagatatcagcatcaacaattccgaatacaatttctcgcagtttctcgagcagtttagtaacaacgaaggggaagaagctgacaatactggaggaggatataaccaagatcttcttatgtctgatgtctcatcaacaagcgttgatgaagacgagatgatgcaaaacataactggttggtcaaattatctccttgaccattccgatttcaattatgacacgagccaagattatgacgacaagaacttcatatgatccgttgattgcttaccggactagagttgaccggttaatgtcatatggttctcttagatatttgtcaagttatagtaaaggtccactatagggtcactatatattaatattcagtaatggattctcttagttagagaaccttgtgatgccgtggatcaattagtatttgatttgcgggagacacgagttttttttccttctattgttgtttgtggatttacgtactataaataataaataaaacacccatttgattgcaaaaaaaaaaaaaaaaaaaaaaa

SEQ ID NO: 18 - protein, 336 aa, Arabidopsis thaliana
  G201,MYB-(R1)R2R3 domain coordinates 14-114
MSRKPCCVGEGLKKGAWTAEEDKKLISYIHEHGGGGWRDIPQKAGLKRCGKSCRLRWANYLKPDIKRGEFSYEEEQIIIMLHASRGNKWSVIARHLPKRTDNEIKNYWNTHLKKLLIDKGIDPVTHKPLAYDSNPDEQSQSGSISPKSLPPSSSKNVPEITSSDETPKYDASLSSKKRCFKRSSSTSKLLNKVAARASSMGTILGASIEGTLISSTPLSSCLNDDFSETSQFQMEEFDPFYQSSEHIIDHMKEDISINNSEYNFSQFLEQFSNNEGEEADNTGGGYNQDLLMSDVSSTSVDEDEMMQNITGWSNYLLDHSDFNYDTSQDYDDKNFI

SEQ ID NO: 19 - DNA, 1101 bp, Arabidopsis thaliana
  G202,family:MYB-(R1)R2R3
atgtcaagaaagccatgttgcgtcggagaaggcttgaagaaaggagcatggaccaccgaggaggacaagaaactcatctcttacatccacgaccacggcgagggaggctggcgcgacattccccaaaaagctgggttgaaacggtgtggaaagagttgtagactgcgatggaccaactaccttaaacctgagatcaaaagaggcgagtttagttcagaggaagagcagattatcatcatgcttcatgcttctcgtggcaacaagtggtcggtcatagcgagacatttacctagaagaacagacaacgagatcaagaactactggaacacgcatctcaaaaaacgtttgatggaacagggtattgatcccgtgactcacaagccactggcttctagttccaaccctacggtcgatgagaatttgaattccccaaatgcctctagttccgacaagcaatactcccgatcgagctcaatgccttttctgtctcgtcctcctccatccagttgcaacatggtttccaaggtctccgagcttagcagcaatgatgggacaccgattcaaggcagttccttgagttgcaagaaacgtttcaagaaatcaagttctacatcaaggctcttgaacaaagttgcggctaaggccacttccatcaaagatatattgtcggcttccatggaaggtagcttgagtgctactacaatatcacatgcaagcttttttaatggcttcactgagcagattcgcaatgaagaggatagttctaacacatccctgacaaatactcttgctgaatttgatcccttctccccatcatcgttgtaccccgaacatgagatcaatgctacttctgatctcaacatggaccaagattacgatttttcacaatttttcgaaaaattcggaggagataaccacaatgaggagaacagtatgaatgatctccttatgtccgatgtttcccaagaagtctcatcaactagcgttgatgatcaagacaatatggtaggaaacttcgagggatggtcaaattatcttcttgaccataccaattttatgtatgacaccgactcagactcgcttgaaaagcatttcatatga

SEQ ID NO: 20 - protein, 366 aa, Arabidopsis thaliana
  G202,MYB-(R1)R2R3 domain coordinates 13-116
MSRKPCCVGEGLKKGAWTTEEDKKLISYIHDHGEGGWRDIPQKAGLKRCGKSCRLRWTNYLKPEIKRGEFSSEEEQIIIMLHASRGNKWSVIARHLPRRTDNEIKNYWNTHLKKRLMEQGIDPVTHKPLASSSNPTVDENLNSPNASSSDKQYSRSSSMPFLSRPPPSSCNMVSKVSELSSNDGTPIQGSSLSCKKRFKKSSSTSRLLNKVAAKATSIKDILSASMEGSLSATTISHASFFNGFTEQIRNEEDSSNTSLTNTLAEFDPFSPSSLYPEHEINATSDLNMDQDYDFSQFFEKFGGDNHNEENSMNDLLMSDVSQEVSSTSVDDQDNMVGNFEGWSNYLLDHTNFMYDTDSDSLEKHFI

SEQ ID NO: 21 - DNA, 2240 bp, Arabidopsis thaliana
  G214,family:MYB-related
tgagatttctccatttccgtagcttctggtctcttttctttgtttcattgatcaaaagcaaatcacttcttcttcttcttcttctcgatttcttactgttttcttatccaacgaaatctggaattaaaaatggaatctttatcgaatccaagctgattttgtttctttcattgaatcatctctctaaagtggaattttgtaaagagaagatctgaagttgtgtagaggagcttagtgatggagacaaattcgtctggagaagatctggttattaagactcggaagccatatacgataacaaagcaacgtgaaaggtggactgaggaagaacataatagattcattgaagctttgaggctttatggtagagcatggcagaagattgaagaacatgtagcaacaaaaactgctgtccagataagaagtcacgctcagaaatttttctccaaggtagagaaagaggctgaagctaaaggtgtagctatgggtcaagcgctagacatagctattcctcctccacggcctaagcgtaaaccaaacaatccttatcctcgaaagacgggaagtggaacgatccttatgtcaaaaacgggtgtgaatgatggaaaagagtcccttggatcagaaaaagtgtcgcatcctgagatggccaatgaagatcgacaacaatcaaagcctgaagagaaaactctgcaggaagacaactgttcagattgtttcactcatcagtatctctctgctgcatcctccatgaataaaagttgtatagagacatcaaacgcaagcactttccgcgagttcttgccttcacgggaagagggaagtcagaataacagggtaagaaaggagtcaaactcagatttgaatgcaaaatctctggaaaacggtaatgagcaaggacctcagacttatccgatgcatatccctgtgctagtgccattggggagctcaataacaagttctctatcacatcctccttcagagccagatagtcatccccacacagttgcaggagattatcagtcgtttcctaatcatataatgtcaacccttttacaaacaccggctctttatactgccgcaactttcgcctcatcattttggcctcccgattctagtggtggctcacctgttccagggaactcacctccgaatctggctgccatggccgcagccactgttgcagctgctagtgcttggtgggctgccaatggattattacctttatgtgctcctcttagttcaggtggtttcactagtcatcctccatctacttttggaccatcatgtgatgtagagtacacaaaagcaagcactttacaacatggttctgtgcagagccgagagcaagaacactccgaggcatcaaaggctcgatcttcactggactcagaggatgttgaaaataagagtaaaccagtttgtcatgagcagccttctgcaacacctgagagtgatgcaaagggttcagatggagcaggagacagaaaacaagttgaccggtcctcgtgtggctcaaacactccgtcgagtagtgatgatgttgaggcggatgcatcagaaaggcaagaggatggcaccaatggtgaggtgaaagaaacgaatgaagacactaataaacctcaaacttcagagtccaatgcacgccgcagtagaatcagctccaatataaccgatccatggaagtctgtgtctgacgagggtcgaattgccttccaagctctcttctccagagaggtattgccgcaaagttttacatatcgagaagaacacagagaggaagaacaacaacaacaagaacaaagatatccaatggcacttgatcttaacttcacagctcagttaacaccagttgatgatcaagaggagaagagaaacacaggatttcttggaatcggattagatgcttcaaagctaatgagtagaggaagaacaggttttaaaccatacaaaagatgttccatggaagccaaagaaagtagaatcctcaacaacaatcctatcattcatgtggaacagaaagatcccaaacggatgcggttggaaactcaagcttccacatgagactctattttcatctgatctgttgtttgtactctgtttttaagttttcaagaccactgctacattttctttttcttttgaggcctttgtatttgtttccttgtccatagtcttcctgtaacatttgactctgtattattcaacaaatcataaactgtttaatctttttttttcca

SEQ ID NO: 22 - protein, 608 aa, Arabidopsis thaliana
  G214,MYB-related domain coordinates 25-71
METNSSGEDLVIKTRKPYTITKQRERWTEEEHNRFIEALRLYGRAWQKIEEHVATKTAVQIRSHAQKFFSKVEKEAEAKGVAMGQALDIAIPPPRPKRKPNNPYPRKTGSGTILMSKTGVNDGKESLGSEKVSHPEMANEDRQQSKPEEKTLQEDNCSDCFTHQYLSAASSMNKSCIETSNASTFREFLPSREEGSQNNRVRKESNSDLNAKSLENGNEQGPQTYPMHIPVLVPLGSSITSSLSHPPSEPDSHPHTVAGDYQSFPNHIMSTLLQTPALYTAATFASSFWPPDSSGGSPVPGNSPPNLAAMAAATVAAASAWWAANGLLPLCAPLSSGGFTSHPPSTFGPSCDVEYTKASTLQHGSVQSREQEHSEASKARSSLDSEDVENKSKPVCHEQPSATPESDAKGSDGAGDRKQVDRSSCGSNTPSSSDDVEADASERQEDGTNGEVKETNEDTNKPQTSESNARRSRISSNITDPWKSVSDEGRIAFQALFSREVLPQSFTYREEHREEEQQQQEQRYPMALDLNFTAQLTPVDDQEEKRNTGFLGIGLDASKLMSRGRTGFKPYKRCSMEAKESRILNNNPIIHVEQKDPKRMRLETQAST

SEQ ID NO: 23 - DNA, 1904 bp, Arabidopsis thaliana
  G261,family:HS
gctgcttgaaattctcttgtctgattaaaatatatatacccaagtccagaagctgtttaggttcgagaagcagagagggttcgagaagctaataagggtttcttctttttgattttaatgctaaaagggttctagattcgttgaattttacaagggttttaggggttcttagaagcttttgcttgattgtcttttatttagaaacagtggtgagtttttagtctttcactttgttcaagttcgaagctttttttggagggaattttgggcttctgattttgatcgaaacttactgatagtaagttctttgagtcctccttaactgtagtttctgtgtactgaagttattgaattgaaagtttttatcttttttggttattgaaactttcatagtttgatcaaaagagtctcttgctctgtttttggctctgtttttgtgagtgtgattgtaagctttgttgtgagtagattgaatcaaggagtgtgagagttgttaaaagtgttttcagagatggatgagaataatcatggagtttcatcaagctcacttccacctttcctcaccaaaacatatgagatggttgatgattcttcatccgattctatcgtctcttggagtcagagcaataagagtttcatcgtttggaatccgccggagttttctagagatcttcttccgagattcttcaagcacaataacttctctagctttatccgccagcttaacacatatggttttagaaaagctgatcctgagcaatgggaatttgcgaatgatgattttgtgagaggtcaacctcatcttatgaagaacattcatagacgcaaaccagttcatagccactctttaccgaatcttcaagctcagttaaacccgttgacggattcagaacgagtgagaatgaataatcagattgagagattgacaaaagagaaagaaggattgcttgaagagttacataaacaagacgaggaacgagaagtgtttgagatgcaagtgaaagaacttaaagaacgattacaacacatggagaagcgtcagaaaacaatggtttcgtttgtttctcaagtattggaaaagccagggcttgctttgaacctatcgccgtgtgttcccgaaacaaacgagaggaaaagaaggttccctaggatcgagttctttcccgatgaaccgatgttggaagagaacaaaacttgtgttgttgtgagagaggaaggttctacaagcccttcttcacacacaagagagcatcaagtggaacagttagagtcatcgatagcgatttgggagaatcttgtatcggattcttgtgagagtatgttacaatcaagaagtatgatgacacttgatgtggatgaatcatctacttttccagagagccctcctctttcttgcatacagttaagtgtcgattcacgtctcaaatctcctccttctccaaggatcatcgatatgaactgtgagcccgatggttcgaaagaacagaacactgttgctgctcctcctcctcctccagtagcaggagcgaatgatggcttctggcagcagtttttctcagagaatcctggctcaaccgagcaacgggaagttcaattagagaggaaagacgataaagataaagccggagtacgtactgagaaatgttggtggaattcgagaaatgttaatgcaattacagaacagcttggacatctgacttcttcagagagaagttgatatgtcaaagattaaatttctagtctgttttagttacttgtaaaatagggtttctcagttttattgttttcgattacagtacttaggtatggttcagctgtttatttatcacttgtatgatctttcacagttcattgtagcagacttcaatggtaatgataagctagagcttatggatagtattcat

SEQ ID NO: 24 - protein, 401 aa, Arabidopsis thaliana
  G261,HS domain coordinates 15-106
MDENNHGVSSSSLPPFLTKTYEMVDDSSSDSIVSWSQSNKSFIVWNPPEFSRDLLPRFFKHNNFSSFIRQLNTYGFRKADPEQWEFANDDFVRGQPHLMKNIHRRKPVHSHSLPNLQAQLNPLTDSERVRMNNQIERLTKEKEGLLEELHKQDEEREVFEMQVKELKERLQHMEKRQKTMVSFVSQVLEKPGLALNLSPCVPETNERKRRFPRIEFFPDEPMLEENKTCVVVREEGSTSPSSHTREHQVEQLESSIAIWENLVSDSCESMLQSRSMMTLDVDESSTFPESPPLSCIQLSVDSRLKSPPSPRIIDMNCEPDGSKEQNTVAAPPPPPVAGANDGFWQQFFSENPGSTEQREVQLERKDDKDKAGVRTEKCWWNSRNVNAITEQLGHLTSSERS

SEQ ID NO: 25 - DNA, 983 bp, Arabidopsis thaliana
  G280,family:AT-hook
aagttaatatgagaataatgagaaaaccactttcccaaattgctttttaaaatccctcctcacacagattccttccttcatcacctcacacactctctacgcttgacatggccttcgatctccaccatggctcagcttcagatacgcattcatcagaacttccgtcgttttctctcccaccttatcctcagatgataatggaagcgattgagtccttgaacgataagaacggctgcaacaaaacgacgattgctaagcacatcgagtcgactcaacaaactctaccgccgtcacacatgacgctgctcagctaccatctcaaccagatgaagaaaaccggtcagctaatcatggtgaagaacaattatatgaaaccagatccagatgctcctcctaagcgtggtcgtggccgtcctccgaagcagaagactcaggccgaatctgacgccgctgctgctgctgttgttgctgccaccgtcgtctctacagatccgcctagatctcgtggccgtccaccgaagccgaaagatccatcggagcctccccaggagaaggtcattaccggatctggaaggccacgaggacgaccaccgaagagaccgagaacagattcggagacggttgctgcgccggaaccggcagctcaggcgacaggtgagcgtaggggacgtgggagacctccgaaggtgaagccgacggtggttgctccggttgggtgctgaattaatcggtacttatgcaatttcggaatctttagttactgaaaaatggaatctcttagagagtaagagagtgctttaatttagcttaattagatttatttggatttctttcagtatttggattgtaaactttagaatttgtgtgtgtgttgttgcttagtcctgagataagatataacattagcgactgtgtattattattattactgcattgtgttatgtgaaactttgttctcttgttgaaaaaaaaaaaaaaaaaaa

SEQ ID NO: 26 - protein, 204 aa, Arabidopsis thaliana
  G280,AT-hook domain coordinates 97-104,130-137-155-162,185-192
MAFDLHHGSASDTHSSELPSFSLPPYPQMIMEAIESLNDKNGCNKTTIAKHIESTQQTLPPSHMTLLSYHLNQMKKTGQLIMVKNNYMKPDPDAPPKRGRGRPPKQKTQAESDAAAAAVVAATVVSTDPPRSRGRPPKPKDPSEPPQEKVITGSGRPRGRPPKRPRTDSETVAAPEPAAQATGERRGRGRPPKVKPTVVAPVGC

SEQ ID NO: 27 - DNA, 1099 bp, Arabidopsis thaliana
  G350,family:Z-C2H2
acagttgtacaaaaaagcaggcgtggtaccggaccggtaattcccggggatatcgtcgtacccacgcgtccgctcgacacgcaacttccttcctcttcagactcctctgactttactatatataacacacacactttcatttcttgtttcttcaaatcaaatcttttcatttacaattatctttcttctcaatttagaacttagtagctagtcttcaagataatggcacttgaaactcttacttctccaagattatcttctccgatgccgactctgtttcaagattcagcactagggtttcatggaagcaaaggcaaacgatctaagcgatcaagatctgaattcgaccgtcagagtctcacggaggatgaatatatcgctttatgtctcatgcttcttgctcgcgacggagatagaaaccgtgaccttgacctgccttcttcttcgtcttcacctcctctgcttcctcctcttcctactccgatctacaagtgtagcgtctgtgacaaggcgttttcgtcttaccaggctcttggtggacacaaggcaagtcaccggaaaagcttttcgcttactcaatctgccggaggagatgagctgtcgacatcgtcggcgataaccacgtctggtatatccggtggcgggggaggaagtgtgaagtcgcacgtttgctctatctgtcataaatcgttcgccaccggtcaagctctcggcggccacaaacggtgccactacgaaggaaagaacggaggcggtgtgagtagtagcgtgtcgaattctgaagatgtggggtctacaagccacgtcagcagtggccaccgtgggtttgacctcaacataccgccgataccggaattctcgatggtcaacggagacgaagaggtgatgagtcctatgccggcgaagaaactccggtttgacttcccggagaaaccctaaacataaacctaggaaaaactttacagaattcattttataggaaattgttttactgtatatacaaatatcgattttgattgatgttcttcttcactgaaaaattatgattctttgttgtatacttgatgtttctgaaaaagatataactttttattaaaaa

SEQ ID NO: 28 - protein, 238 aa, Arabidopsis thaliana
  G350,Z-C2H2 domain coordinates 91-113,150-170
MALETLTSPRLSSPMPTLFQDSALGFHGSKGKRSKRSRSEFDRQSLTEDEYIALCLMLLARDGDRNRDLDLPSSSSSPPLLPPLPTPIYKCSVCDKAFSSYQALGGHKASHRKSFSLTQSAGGDELSTSSAITTSGISGGGGGSVKSHVCSICHKSFATGQALGGHKRCHYEGKNGGGVSSSVSNSEDVGSTSHVSSGHRGFDLNIPPIPEFSMVNGDEEVMSPMPAKKLRFDFPEKP

SEQ ID NO: 29 - DNA, 925 bp, Arabidopsis thaliana
  G365,family:Z-C2H2
caattcttttactttcattctctttatatattctctctacgctataatatatattacacagaatatacatggaaccgtccatcaaaggagatcaagaaatgttaaaaatcaagaaacaaggtcatcaagatcttgagttggggttgacccttttgtcacgtggaaccgcgacctcatcagagctcaatctcatcgattctttcaaaaccagctcatcatcgacttctcatcatcagcaccagcaagaacaattggcagatccgagagtgttctcgtgtaattattgtcaaagaaagttctatagttcacaagcgctaggcggtcaccaaaacgctcataaacgtgagcgcaccttagccaaacgtggacagtattacaagatgactctctcctccttgccttcttcagcgtttgcgtttggccacggttcagtcagcagattcgcaagcatggcatcgttaccattacatggctcggtgaataacaggtcaacgttagggattcaagctcattcaacgatccataagcccagcttcttaggaagacaaacgacgagtttaagtcatgttttcaaacagagcattcaccagaaaccgaccataggaaagatgttgccggagaaatttcaccttgaagtcgccggaaataataacagtaacatggttgctgctaagttggagagaattggacatttcaagagcaaccaagaagatcataatcagtttaagaaaattgacttgactcttaagctatgagctctgccatcttctttttagtcttcattataactttttttattctcatctttgtttgatataatgattgacggcagggtgtgttagagtttcactaatgatcaagttgtactttttatatatttcattgataccttgttgatgtaattcaatattttaggtctgttttt

SEQ ID NO: 30 - protein, 228 aa, Arabidopsis thaliana
  G365,Z-C2H2 domain coordinates 70-90
MEPSIKGDQEMLKIKKQGHQDLELGLTLLSRGTATSSELNLIDSFKTSSSSTSHHQHQQEQLADPRVFSCNYCQRKFYSSQALGGHQNAHKRERTLAKRGQYYKMTLSSLPSSAFAFGHGSVSRFASMASLPLHGSVNNRSTLGIQAHSTIHKPSFLGRQTTSLSHVFKQSIHQKPTIGKMLPEKFHLEVAGNNNSNMVAAKLERIGHFKSNQEDHNQFKKIDLTLKL

SEQ ID NO: 31 - DNA, 708 bp, Arabidopsis thaliana
  G367,family:Z-C2H2
atggacgcttcaatagtttcctcatccactgcttttccatatcaagattctctaaaccagagcatcgaagacgaagaaagagacgttcataattctagtcacgaactcaatctcatcgactgcatagacgacacaacgagtatcgttaacgaatctacaacatccacagaacaaaagcttttctcatgcaactattgtcaaagaactttctatagctcacaagcacttggtggtcaccaaaacgcacacaagagagagagaacgttggcgaagagaggacaacgtatggcagcgtcagcctcagcttttggacatccttacggtttctctccacttcctttccacggacagtacaacaaccataggtctttagggatccaagcgcattcgataagccacaagctaagttcttataacgggtttggtggtcactatggtcagatcaactggtcaagacttccatttgatcaacaaccagccataggtaaatttccctcaatggataattttcatcatcatcatcatcagatgatgatgatggctccttcagtaaattcacggtccaataacatcgatagcccaagcaacacaggacgggttctagaagggtcaccgactcttgaacaatggcacggagacaaaggattgttgttaagtacaagtcatcatgaagagcagcagaaacttgacttgtccctcaagctttga

SEQ ID NO: 32 - protein, 235 aa, Arabidopsis thaliana
  G367,Z-C2H2 domain coordinates 63-84
MDASIVSSSTAFPYQDSLNQSIEDEERDVHNSSHELNLIDCIDDTTSIVNESTTSTEQKLFSCNYCQRTFYSSQALGGHQNAHKRERTLAKRGQRMAASASAFGHPYGFSPLPFHGQYNNHRSLGIQAHSISHKLSSYNGFGGHYGQINWSRLPFDQQPAIGKFPSMDNFHHHHHQMMMMAPSVNSRSNNIDSPSNTGRVLEGSPTLEQWHGDKGLLLSTSHHEEQQKLDLSLKL

SEQ ID NO: 33 - DNA, 1032 bp, Arabidopsis thaliana
  G368,family:Z-C2H2
gttgcgtttccacatttgtttaaacataactctctctctctctctctctctctctctctctcagtacctcttattcttatgctcttcttcaccaatcctatctcttctatctgtctttattttctctacatgtgaattgacccatttctggtaaacacatagagtaccacttttcttatttagattcttcttcctcttcatagcttccaagtcaactacttcagcttctgtcggctgtctcttcccagatctcgttaagaccaaaacttggaataaatgacggaatctgatgatgcctcacgagaaacaccagccagcagaggaggagaagcctcgtcaaatcaagatctgtccaaaccagaatcaaaccatgtttcactcgatctcaagctcaacgatactttcaacgatgacacaaagagcacaaagtgtgaagcaaacccaagagtcttctcttgcaactactgcagacgcaagttctatagctctcaagctcttggaggtcaccagaacgcacacaagcgagaaagaacaatggccaaacgagcaatgcacatgggaagaatgtttggtcaccatcacaggccttacacatacacttcttcttcccttgggatgcaagctcactccggtttacttcatcacaccttatctcagcctcagcctcttgtttctaggtttcatcatcaagggtattttggtaacaccgtgccgttgttctttgactatgacgatggtggtagcgacttcttctggcccggcagcttccgtcaggtggttgaggaagctgaggctccggtggttgtggtggctagtactgagtcaggccttgatttgaactcggttgcggcaaatggaggtgtagataataatagctcaaagcctgatcttaccttaagactctaaaaggattaaggagattatatctttattgttatttttctattgttagacattcagaagataagttggagacagttgatagaaattgatgaaaaactttgttgttatattaaatgaggttgttcatta

SEQ ID NO: 34 - protein, 209 aa, Arabidopsis thaliana
  G368,Z-C2H2 domain coordinates NA
MTESDDASRETPASRGGEASSNQDLSKPESNHVSLDLKLNDTFNDDTKSTKCEANPRVFSCNYCRRKFYSSQALGGHQNAHKRERTMAKRAMHMGRMFGHHHRPYTYTSSSLGMQAHSGLLHHTLSQPQPLVSRFHHQGYFGNTVPLFFDYDDGGSDFFWPGSFRQVVEEAEAPVVVVASTESGLDLNSVAANGGVDNNSSKPDLTLRL

SEQ ID NO: 35 - DNA, 694 bp, Arabidopsis thaliana
  G369,family:Z-C2H2
ctctcggtcttcagctcaaggtatagctacattcatacgcatttcattttagggttggctttccaagttgtttgtgcacttattggaagttaatataatccttagtcacttttttgtatgtgtatagataacatagaatggaagatcattaccatcaagtagaagtggagggagaagaagagatcaagccaagcaaagaagccaacaagacagacgaaaacacatcatcattaagaatattcccctgcctcttttgttctagaaagttccatagctcccaagccctaggaggccaccagaacgcccacaagaaggagcgaaccgctgctagaagagccaaaagggcttatgattttgtcaacaacaatgacttccttcacacgttacctgttttcttatcctctccctctcaacatcacttgaccatcttaggctaccctgcttctgcctccgttgcctgttttccgacggttcatcccgaccatccgattttcaaatccagtggttctcatgtcgtgttggctacatcccaccaaggtagagattgcaaaggagggtactgttgtcaacaacgtgtagacattttggatcatcattataacgtggtcaatagtgacaagggtaaagatcagtgtcttgatctctccctacatttgtgattttagcattatcatttgttagttatggtcttgcc

SEQ ID NO: 36 - protein, 173 aa, Arabidopsis thaliana
  G369,Z-C2H2 domain coordinates 37-57
MEDHYHQVEVEGEEEIKPSKEANKTDENTSSLRIFPCLFCSRKFHSSQALGGHQNAHKKERTAARRAKRAYDFVNNNDFLHTLPVFLSSPSQHHLTILGYPASASVACFPTVHPDHPIFKSSGSHVVLATSHQGRDCKGGYCCQQRVDILDHHYNVVNSDKGKDQCLDLSLHL

SEQ ID NO: 37 - DNA, 1854 bp, Arabidopsis thaliana
  G373,family:RING/C3HC4
atggcgattgaaactcagcttccttgcgacggtgacggtgtgtgtatgcggtgtcaggtgaatcctccgtcagaagagactctcacttgtggcacgtgcgtcactccatggcacgtgccgtgtctcctccccgaatcactcgcttcttccactggagagtgggagtgtcccgattgctccggcgttgtcgttccctccgccgctccgggtaccggaaacgctcgacctgaatcttccggttcagttctcgttgctgcgatccgtgcgattcaggctgatgagactttaaccgaagctgagaaagccaaaaaaaggcagaaactgatgagtgggggtggtgacgatggtgtcgatgaagaagagaagaagaagttagaaatcttttgttctatttgcattcaattgccagaaagacctatcacgacaccgtgtgggcacaatttctgtttgaaatgtttcgagaaatgggcagtaggtcaagggaagctaacttgtatgatatgccgaagcaaaattccgagacatgtggcaaaaaatcctcgcatcaacttagctctagtttctgctattcgtttagcaaatgttaccaaatgttctgttgaggcaactgcagccaaggttcatcatattatccgcaaccaagaccgtcctgagaaagcatttactaccgagcgggcagtaaaaactgggaaagctaatgctgctagcggtaagttttttgtgacaatacctcgtgatcattttggtcccataccagctgagaatgatgtcactagaaagcaaggtgttttggttggagaatcttgggaggacaggcaagagtgtaggcagtggggagctcatttcccgcatattgctggcattgccgggcaatcagcggttggagctcagtctgtggccctctctggaggttatgacgatgatgaggatcatggtgaatggtttctctacacaggaagtggtggaagggatctcagtggaaacaaaagaattaacaagaaacagtcgtctgaccaggcgtttaaaaacatgaatgaatctctaagacttagttgcaaaatgggctatcctgtccgagttgtcaggtcttggaaggagaagcgttctgcatatgcccctgctgaaggtgtgagatatgatggggtctatcgaattgagaagtgctggagtaatgttggagtacagggttcttttaaggtctgtcgttacctgtttgttagatgtgacaatgagccagctccatggaccagtgatgagcatggcgatcgtccaagaccgttgcctaatgttccggagcttgagactgctgctgacctgtttgtgagaaaggagagtccatcatgggatttcgatgaagctgagggtcgttggaaatggatgaagtctcctcctgttagcagaatggctttggatcctgaggagaggaagaagaataagagagcaaaaaatactatgaaggccagacttctgaaagaatttagttgccaaatctgtcgggaagtgctgagtcttccagtgacgacgccttgtgcacacaacttctgcaaagcatgcttagaagcgaagtttgctgggataactcaactgagagagagaagcaatggcggacgtaaactacgtgcaaagaagaacatcatgacctgcccttgctgcacgacggatctctccgagtttctccaaaacccgcaggtgaacagagagatgatggagataatagagaattttaagaagagtgaggaagaggctgatgcatccatttctgaagaagaagaagaagaatccgaacctccaactaagaagattaagatggataacaactctgttggtggtagtggtacaagtctctcagcttaa

SEQ ID NO: 38 - protein, 617 aa, Arabidopsis thaliana
  G373,RING/C3HC4 domain coordinates 129-168
MAIETQLPCDGDGVCMRCQVNPPSEETLTCGTCVTPWHVPCLLPESLASSTGEWECPDCSGVVVPSAAPGTGNARPESSGSVLVAAIRAIQADETLTEAEKAKKRQKLMSGGGDDGVDEEEKKKLEIFCSICIQLPERPITTPCGHNFCLKCFEKWAVGQGKLTCMICRSKIPRHVAKNPRINLALVSAIRLANVTKCSVEATAAKVHHIIRNQDRPEKAFTTERAVKTGKANAASGKFFVTIPRDHFGPIPAENDVTRKQGVLVGESWEDRQECRQWGAHFPHIAGIAGQSAVGAQSVALSGGYDDDEDHGEWFLYTGSGGRDLSGNKRINKKQSSDQAFKNMNESLRLSCKMGYPVRVVRSWKEKRSAYAPAEGVRYDGVYRIEKCWSNVGVQGSFKVCRYLFVRCDNEPAPWTSDEHGDRPRPLPNVPELETAADLFVRKESPSWDFDEAEGRWKWMKSPPVSRMALDPEERKKNKRAKNTMKARLLKEFSCQICREVLSLPVTTPCAHNFCKACLEAKFAGITQLRERSNGGRKLRAKKNIMTCPCCTTDLSEFLQNPQVNREMMEIIENFKKSEEEADASISEEEEEESEPPTKKIKMDNNSVGGSGTSLSA

SEQ ID NO: 39 - DNA, 1201 bp, Arabidopsis thaliana
  G398,family:HB
agaaggtttctcttgtcctccatacacttagcacaactgataaatcttttgaggtaaaatcagctttagatcaaggtttttctagtcatctctactcataaagatcaaagcttttgctattctcattttctaccaagagacaatatcatgatgatgggtaaagaggatttgggtttaagtcttagcttgggatttgcacaaaaccatcctctccagctaaatcttaaacccacttcttcaccaatgtccaatctccagatgtttccatggaaccaaacccttgtttcttcctcagatcaacaaaagcaacagtttcttaggaaaatcgacgtgaacagcttgccaacaacggtggatttggaagaggagacaggagtttcgtctccaaacagtacgatctcgagcacagtgagtggaaagaggaggagtactgaaagagaaggtacctccggtggtggttgcggagatgaccttgacatcactctagatagatcttcctcacgtggaacctccgatgaagaggaagattacggaggtgagacttgtaggaagaagcttagactatccaaagatcaatccgcagttctcgaagacactttcaaagagcacaatactctcaatcccaaacagaagctggctttggctaagaagctaggtttaacagcaagacaagtggaagtgtggttccaaaacagaagagcaaggacaaagttaaagcagaccgaagtggattgcgagtatttgaaaagatgtgttgagaaattaacggaagagaatcggcggctcgagaaagaggcagcggaactaagagcattaaagctttcaccgcggttgtatggtcagatgagtccaccgaccacacttttgatgtgtccatcgtgtgaacgtgtggccggaccatcctcatctaaccacaaccagcgatctgtctcattgagtccatggctccaaatggcccatgggtcaacctttgatgtgatgcgtcctaggtcttaactttaatgctgcttctatgggttgtgtgtgggtcattgtactttttagattattgactctcagctaatgtatccttaaaagcctttttctacttttaaatttactttaatctaattaaattagttgtccatgtcttcttgataacaaaaaaatttataattataaaaaaaaaaaacaggataaaaaaaaaaaaaaaaaaaaaaaa

SEQ ID NO: 40 - protein, 282 aa, Arabidopsis thaliana
  G398,HB domain coordinates 128-191
MMMGKEDLGLSLSLGFAQNHPLQLNLKPTSSPMSNLQMFPWNQTLVSSSDQQKQQFLRKIDVNSLPTTVDLEEETGVSSPNSTISSTVSGKRRSTEREGTSGGGCGDDLDITLDRSSSRGTSDEEEDYGGETCRKKLRLSKDQSAVLEDTFKEHNTLNPKQKLALAKKLGLTARQVEVWFQNRRARTKLKQTEVDCEYLKRCVEKLTEENRRLEKEAAELRALKLSPRLYGQMSPPTTLLMCPSCERVAGPSSSNHNQRSVSLSPWLQMAHGSTFDVMRPRS

SEQ ID NO: 41 - DNA, 971 bp, Arabidopsis thaliana
  G448,family:IAA
tttccatcttcctcatcaccttcccaagaagaagaacaccaaagaagaagaaaggttaataatgatgggcagtgtcgagctgaatctgagggagactgagctgtgtcttggtcttcccggtggagatacagtggctccggtaaccggaaacaagagagggttctcagagacggttgatctgaagctaaatctgaataatgagcctgcaaacaaggaaggatctacgactcatgacgtcgtgacttttgattccaaggagaagagtgcttgtcctaaagatccagccaaacctccggccaaggcacaagttgtgggatggccaccggtgagatcataccggaagaacgtgatggtttcctgccaaaaatcaagcggtggcccggaggcggcggcgttcgtgaaggtatcaatggacggagcaccgtacttgaggaaaatcgatttgaggatgtataaaagctacgatgagctttctaatgctttgtccaacatgttcagctcttttaccatgggcaaacatggaggagaagaaggaatgatagacttcatgaatgagaggaaattgatggatttggtgaatagctgggactatgttccctcttatgaagacaaagacggtgattggatgctcgtcggcgacgttccttggccaatgttcgtcgatacatgcaagcgtttacgtctcatgaaaggatcggatgccattggtctcgctccgagggcgatggagaagtgcaagagcagagcttgaagtcaaattaaaaggataagtggtatcgattatatatttgattaacacattgattggtgttaattgctctttttttttcttacgatgaaatacattgttcagtttcttttgattgtctgtgttttgatctggatttggtatgtagatatagtttgtatgctattatgtgtaatgaacttaagttaaatatttgagacatttgtaatggaaaatgtgtaat

SEQ ID NO: 42 - protein, 229 aa, Arabidopsis thaliana
  G448,IAA domain coordinates 11-20,83-95,111-128,180-214
MMGSVELNLRETELCLGLPGGDTVAPVTGNKRGFSETVDLKLNLNNEPANKEGSTTHDVVTFDSKEKSACPKDPAKPPAKAQVVGWPPVRSYRKNVMVSCQKSSGGPEAAAFVKVSMDGAPYLRKIDLRMYKSYDELSNALSNMFSSFTMGKHGGEEGMIDFMNERKLMDLVNSWDYVPSYEDKDGDWMLVGDVPWPMFVDTCKRLRLMKGSDAIGLAPRAMEKCKSRA

SEQ ID NO: 43 - DNA, 590 bp, Arabidopsis thaliana
  G459,family:IAA
aaacatcaaagatggcgaatgagagtaataatcttggactcgaaatcaccgaactacggctaggtcttcccggagatatcgtcgtctccggtgagtccatctccgggaagaagagggcttctccggaagtagagattgatttgaaatgtgaaccggcgaaaaagagtcaagttgtgggttggccaccggtttgttcgtaccggagaaagaacagtctcgaacggaccaaaagttcgtacgtgaaagtgagtgtagatggagctgcatttttaaggaagattgatttggaaatgtacaaatgttaccaagatcttgcttccgctctgcaaattctgttcggatgctatatcaattttgatgatacgttgaaggaaagtgaatgtgtaccaatatatgaagacaaagatggagattggatgcttgctggagatgttccttgggaaatgttccttggatcgtgcaagaggttaaggattatgaagagatcatgtaacagaggatgaatgatatttatagtcacatgtgaatgtgagtgagccttacagatatctaaatatacatttttgcagttaataaaaaaaaaaaaaaaa

SEQ ID NO: 44 - protein, 163 aa, Arabidopsis thaliana
  G459,IAA domain coordinates 12-21,53-65,76-92,128-161
MANESNNLGLEITELRLGLPGDIVVSGESISGKKRASPEVEIDLKCEPAKKSQVVGWPPVCSYRRKNSLERTKSSYVKVSVDGAAFLRKIDLEMYKCYQDLASALQILFGCYINFDDTLKESECVPIYEDKDGDWMLAGDVPWEMFLGSCKRLRIMKRSCNRG

SEQ ID NO: 45 - DNA, 832 bp, Arabidopsis thaliana
  G481,family:CAAT
gagcgtttcgtagaaaaattcgatttctctaaagccctaaaactaaaacgactatccccaattccaagttctagggtttccatcttccccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaataccaaatccttaaattaa

SEQ ID NO: 46 - protein, 141 aa, Arabidopsis thaliana
  G481,CAAT domain coordinates 20-109
MADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYRELEGDNKGSGKSGDGSNRDAGGGVSGEEMPSW

SEQ ID NO: 47 - DNA, 476 bp, Arabidopsis thaliana
  G486,family:CAAT
gcgagagctgatagattcactgaaacaaaagagaaaaatgacagacgaagatagattgttgccaatagccaatgtagggagacttatgaagcaaatcctaccatcaaatgcaaagatctcaaaagaagcaaaacaaacagttcaagaatgtgcaacagagttcataagctttgttacatgcgaagcatcagagaagtgccacagggagaatcggaagacggtgaatggagacgacatctggtgggctctcagcactctcggcctcgataactatgctgacgccgtgggtaggcatcttcacaagtaccgtgaagccgagagagaaagaactgagcacaacaaaggtagcaatgatagtgggaatgagaaagaaaccaacactagaagtgatgtacagaaccaatcgacaaaatttattagagttgttgagaagggaagcagctcctcggcccgttgaactagacatctaagttctg

SEQ ID NO: 48 - protein, 139 aa, Arabidopsis thaliana
  G486,CAAT domain coordinates 3-66
MTDEDRLLPIANVGRLMKQILPSNAKISKEAKQTVQECATEFISFVTCEASEKCHRENRKTVNGDDIWWALSTLGLDNYADAVGRHLHKYREAERERTEHNKGSNDSGNEKETNTRSDVQNQSTKFIRVVEKGSSSSAR

SEQ ID NO: 49 - DNA, 1207 bp, Arabidopsis thaliana
  G501,family:NAC
aaaaaatccagatccagctgaaattgaattttcaaccaacgaagaagagatttttccaagagcaacagacaagaagaagagaatgaagtcggagctaaatttaccagctgggttccgattccatccaacggacgaggagcttgtgaaattctacttgtgccggaaatgtgcttccgagcagatctcggctccggttatcgccgagattgatctctacaagttcaatccttgggagcttccagagatgtctctgtacggagagaaagagtggtacttcttctcacctagagatcggaaatacccaaacggttcgcgtcctaaccgggcagcaggaaccggttattggaaagctaccggagcagataaaccgattggtaaaccgaagacgttgggtatcaagaaagcactcgtcttctacgcagggaaagctccaaaagggattaagaccaattggataatgcatgagtatcgtctcgctaatgttgatagatcagcttctgttaacaaaaagaacaacctacgacttgatgattgggttttatgtcgaatatacaacaagaaaggaaccatggagaagtatttccccgcggatgagaagccgaggaccacgacaatggctgaacagtcatcatcaccttttgatacatcagactcgacttacccgacattgcaagaggatgattccagcagctcaggtggtcacggtcacgtggtgtcaccggatgttttggaggttcagagcgagcctaaatggggagagcttgaggatgctttggaagcttttgatacttcaatgtttggtagttccatggagttgttgcagcctgacgcttttgtccctcagttcttgtatcagtctgattatttcacttccttccaggatccgcctgagcagaaaccattcttgaattggagttttgctccacaggggtaaaaacggaagagaccaaaaaaggtgtttgctagtagtactgtgatgtgccagagagaagagtctcatctcaactcatccctggctcttagtagtaaaagaagattgtagaatgttaatagcttttagcatcaatgtctcattagcaggcacattcttgttctttcatgagaagtttatatgaaaactaaaaatttatattcaaattcttcaagatgttgcacttatgtagatactgatattaaataacaacctaacctttatgagaaaaaaaaa

SEQ ID NO: 50 - protein, 283 aa, Arabidopsis thaliana
  G501,NAC domain coordinates 10-131
MKSELNLPAGFRFHPTDEELVKFYLCRKCASEQISAPVIAEIDLYKFNPWELPEMSLYGEKEWYFFSPRDRKYPNGSRPNRAAGTGYWKATGADKPIGKPKTLGIKKALVFYAGKAPKGIKTNWIMHEYRLANVDRSASVNKKNNLRLDDWVLCRIYNKKGTMEKYFPADEKPRTTTMAEQSSSPFDTSDSTYPTLQEDDSSSSGGHGHVVSPDVLEVQSEPKWGELEDALEAFDTSMFGSSMELLQPDAFVPQFLYQSDYFTSFQDPPEQKPFLNWSFAPQG

SEQ ID NO: 51 - DNA, 1125 bp, Arabidopsis thaliana
  G504,family:NAC
cgtcgacctcttgacgatcatgagactgatttcgtgaaaatatcgtcattatatcaaattagaagttgatggaaaacatgggggattcgagcatagggccgggccatccgcatctccctcccgggtttcggtttcacccgactgatgaggaactagtagttcattacctcaagaagaaagcagattctgttccacttccagtctcaatcatcgcagagattgatctttacaagtttgatccttgggagcttccaagcaaggcgagttttggagagcacgagtggtacttctttagtcctcgggatcggaagtatccaaatggggttaggccaaaccgggcagcaacttccggttattggaaagcaacgggaaccgataaaccgatatttacgtgcaatagtcacaaggttggtgtcaagaaagcgcttgttttttacggtggaaagcctcctaaagggataaaaacagattggatcatgcatgaatatcgcctcactgatggtaaccttagcactgcggctaagccgcctgacttaaccacgacaaggaaaaactcactacggctagacgattgggttctatgtaggatctataagaagaatagttcacaaagaccaacaatggagagagtattacttagagaggatctaatggaaggcatgctctcaaaatcatctgctaattcttcttctacatcagtactagacaacaacgacaacaataataacaataacgaagaacactttttcgacggtatggtcgtttcttcagacaaacgttccttgtgtggtcaataccgaatgggccacgaggcctcaggatcatcttcattcggatctttcttatcgagcaagaggtttcatcatacaggtgatctcaacaatgataactacaatgtctcttttgtttcgatgcttagtgagattcctcagagttcggggtttcatgcaaatggtgttatggatacgacgtcgtctctagctgatcatggggttttaagacaggcgtttcagcttcctaacatgaactggcactcataatctatatagatatatatgtgtgtatcatatatgtatctatgcaggcctaatatagtttacacataaatcatctggggcggccgct

SEQ ID NO: 52 - protein, 323 aa, Arabidopsis thaliana
  G504,NAC domain coordinates 16-178
MENMGDSSIGPGHPHLPPGFRFHPTDEELVVHYLKKKADSVPLPVSIIAEIDLYKFDPWELPSKASFGEHEWYFFSPRDRKYPNGVRPNRAATSGYWKATGTDKPIFTCNSHKVGVKKALVFYGGKPPKGIKTDWIMHEYRLTDGNLSTAAKPPDLTTTRKNSLRLDDWVLCRIYKKNSSQRPTMERVLLREDLMEGMLSKSSANSSSTSVLDNNDNNNNNNEEHFFDGMVVSSDKRSLCGQYRMGHEASGSSSFGSFLSSKRFHHTGDLNNDNYNVSFVSMLSEIPQSSGFHANGVMDTTSSLADHGVLRQAFQLPNMNWHS

SEQ ID NO: 53 - DNA, 1812 bp, Arabidopsis thaliana
  G513,family:NAC
atcgtgtcaaattttagggttttttcttttcgtacttcatcaaattctggaatctggttttttcttagttttcttctatatacctttgaatcgcatctttgatccaaattcattttagatatcaccttgaagtcgaatttgtgattttttcttttcctctcgaattctcaaagtctcacgcaactatgaaagaagacatggaagtactatcgctcgcttcactaccggttgggttcagatttagtccaacggacgaagagttagtccggtactatctccggctcaagatcaacggtcacgataacgacgttagagtaattcgtgagatcgatatctgcaaatgggagccttgggatttgcctgatttttctgtggtgaagacaacagactcagagtggctcttcttttgtcctttggaccggaaatatccgagtggaagtcgaatgaatagagctactgtggctggatactggaaggcgacgggaaaagaccgtaagatcaaatcaggaaagactaagattataggtgttaagaggactctagtgttttatacaggtcgtgctcctaaagggacacgaacttgttggattatgcatgagtatcgtgctactgagaaggatcttgatggaacaaagtctggccagaatccgtttgttgtttgtaagttgtttaagaagcaagatattgtgaacggagctgctgaaccagaagagtcaaagtcatgtgaagttgaaccagcggtatcgtctccaactgttgtggacgaggttgaaatgtctgaggtatctcctgttttccctaaaacagaagagactaatccttgtgacgtcgcagagtcttctcttgtaatccccagcgaatgtcgtagtggatactctgtccctgaggttacaaccaccgggcttgacgatatcgattggctctcgtttatggagtttgattccccgaagctgttctctccgttgcactctcaggtgcaatctgagctcggttcctctttcaatggcttacaatctgagtctagtgaattgttcaaaaaccacaatgaggattacattcagactcagtacggtacaaatgatgcggatgaatatatgtccaagttcttggattcttttcttgacattccctatgagccagaacagatcccatatgagccacagaatcttagctcatgcaacaagatcaatgatgaatctaagagaggaattaagattagagctcgacgagcacaagccccgggttgtgctgagcagtttgtaatgcagggcgatgcctcaagaaggctgcgtcttcaggttaaccttaacagccacaagtcagaaactgacagtacacaacttcaatttatcaagaaagaggttaaggacacaacaacggaaactatgacgaaaggatgtggaaatttcacaagatcaaagagcaggactagtttcatattcaagaaaattgcagccatgggatgttcatacagagggcttttcagagtcggtgtggtagcggttgtgtgtgtgatgtcggtctgcagtctagtcgcataaatccgctgaatgtgatgtttgttccgatcaattcatatagtaagaataaagaaagtggtttttacgggtggagagagcgcggatttgtgtgtataacaggggttttggcctggttctgcatctgttgttattgttgttgtttttgtcggcttaagcttaaccatggtcggtttaggagtgtagtagacttgtagttaacatgtacgacgactcataatattcagatggtaatgtttggaaatttttttattcctaaaaaaaaaaaaaaaaa

SEQ ID NO: 54 - protein, 451 aa, Arabidopsis thaliana
  G513,NAC domain coordinates 16-161
MKEDMEVLSLASLPVGFRFSPTDEELVRYYLRLKINGHDNDVRVIREIDICKWEPWDLPDFSVVKTTDSEWLFFCPLDRKYPSGSRMNRATVAGYWKATGKDRKIKSGKTKIIGVKRTLVFYTGRAPKGTRTCWIMHEYRATEKDLDGTKSGQNPFVVCKLFKKQDIVNGAAEPEESKSCEVEPAVSSPTVVDEVEMSEVSPVFPKTEETNPCDVAESSLVIPSECRSGYSVPEVTTTGLDDIDWLSFMEFDSPKLFSPLHSQVQSELGSSFNGLQSESSELFKNHNEDYIQTQYGTNDADEYMSKFLDSFLDIPYEPEQIPYEPQNLSSCNKINDESKRGIKIRARRAQAPGCAEQFVMQGDASRRLRLQVNLNSHKSETDSTQLQFIKKEVKDTTTETMTKGCGNFTRSKSRTSFIFKKIAAMGCSYRGLFRVGVVAVVCVMSVCSLVA

SEQ ID NO: 55 - DNA, 1080 bp, Arabidopsis thaliana
  G517,family:NAC
atgatgaatccggtgggtttcagattccgtccaaacgacgaggagatcgtcgaccattacctccggccaaaaaatctcgatagtgacactagccatgtcgatgaagtcattagcacagtcgatatctgtagcttcgagccttgggatttaccttccaagtcgatgatcaaatcgagagatggggtttggtatttctttagtgttaaggagatgaagtataacagaggtgatcaacagagaagaagaacaaactctgggttttggaagaaaactggaaaaacaatgactgtcatgcgcaaaagaggaaatcgtgagaagatcggtgagaaaagggttttggtttttaagaatcgagatggttcaaagaccgactgggttatgcacgagtatcacgctacgtccttgtttcctaatcagatgatgacgtatacagtctgcaaagttgagtttaagggtgaagagacagagatctcttcttcttctactggtagtgaaattgaacagattcactctttaatccctcttgtgaacagttctggaggatctgagggttcgtcgtttcacagccaagaattacagaattcaagtcagtctggtgtctttgctaatgtgcagggagaatctcaaatcgatgatgcaactacaccgattgaggaggaatggaaaacatggttgaataatgatggtgatgagcagaggaatatcatgtttatgcaagatcatcgcagcgattacacacctctaaagtcgttaactggtgtcttcagtgatgatagcagtgatgataatgattctgatttgatatctcctaaaacaaattctattggaacttcgagcacttgtgctagttttgctagctcaaatcatcagatagaccaaactcaacattctcctgactcaacagtccagctagtgtcattaactcaagaggtgagccaaggtccgggtcaagtgactgtgattcgagagcataaattgggtgaagagtctgtcaagaagaaaagagctagtttcgtttacaggatgatacacagattagtcaagaaaattcaccaatgttattctatctcaagaacatga

SEQ ID NO: 56 - protein, 359 aa, Arabidopsis thaliana
  G517,NAC domain coordinates 6-153
MMNPVGFRFRPNDEEIVDHYLRPKNLDSDTSHVDEVISTVDICSFEPWDLPSKSMIKSRDGVWYFFSVKEMKYNRGDQQRRRTNSGFWKKTGKTMTVMRKRGNREKIGEKRVLVFKNRDGSKTDWVMHEYHATSLFPNQMMTYTVCKVEFKGEETEISSSSTGSEIEQIHSLIPLVNSSGGSEGSSFHSQELQNSSQSGVFANVQGESQIDDATTPIEEEWKTWLNNDGDEQRNIMFMQDHRSDYTPLKSLTGVFSDDSSDDNDSDLISPKTNSIGTSSTCASFASSNHQIDQTQHSPDSTVQLVSLTQEVSQGPGQVTVIREHKLGEESVKKKRASFVYRMIHRLVKKIHQCYSISRT

SEQ ID NO: 57 - DNA, 1407 bp, Arabidopsis thaliana
  G559,family:bZIP
aaagttgctagctttaatttgccaacttactattcttatgtgtaataatcgtttgcagggtcgttgatttggtgataagtcagtagaaatggataaggagaaatctccagcacctccttgtggaggtcttcctcctccatctccatcaggtcgatgctctgcattctcagaagctggtcccattggtcatggttcagatgctaatcgaatgagtcatgatattagccgtatgcttgataacccacctaagaagattggacatcggcgagctcattctgaaatacttactctccctgatgatttgagctttgatagtgatcttggtgtggttggtaatgctgctgatggagcttctttctctgatgagactgaagaagatttgctctctatgtatcttgatatggataagtttaattcttctgctacatcttctgcccaagttggtgagccatcaggaactgcttggaaaaatgagacaatgatgcagacaggcacaggctcaacttccaatcctcagaatacggttaatagtcttggcgaaaggccaagaatcaggcatcaacatagccaatctatggatggttcaatgaatatcaatgagatgcttatgtcgggaaatgaagatgattctgctattgatgctaagaagtctatgtctgctactaaacttgctgagcttgctctcattgatcctaaacgtgctaagaggatatgggcaaacaggcagtccgcagcacgatcaaaagaaaggaagacgagatacatatttgagcttgagagaaaagtacagactttgcaaacagaggctacaactctctcagcccagttgaccctcttacagagagacacaaatggcttgactgttgaaaacaatgagctgaagctgcggttacaaacaatggagcagcaggttcacttgcaggatgaactaaacgaagcactaaaggaggaaatccagcatctgaaggtgttgactggccaagttgctccatcagcgttgaactatgggtcgtttggatcaaaccagcagcaattctattccaacaatcagtcaatgcaaacaatcttagctgcaaaacagttccagcaacttcagattcattcacagaagcagcaacaacaacaacaacaacaacaacagcaacaccaacagcagcagcagcaacagcaacagtatcagtttcaacagcaacagatgcaacagcttatgcagcagcggcttcaacagcaagaacaacaaaatggagtaagactcaagccttcacaagcccagaaagagaactgaggaatatgaatatgtcccacgtaagtgagaggttctccttctgaacaattcctttctcattcataaattgttgttcatccatcacttgcagtctcttggattttagggttttagctaacaca

SEQ ID NO: 58 - protein, 398 aa, Arabidopsis thaliana
  G559,bZIP domain coordinates 203-264
MDKEKSPAPPCGGLPPPSPSGRCSAFSEAGPIGHGSDANRMSHDISRMLDNPPKKIGHRRAHSEILTLPDDLSFDSDLGVVGNAADGASFSDETEEDLLSMYLDMDKFNSSATSSAQVGEPSGTAWKNETMMQTGTGSTSNPQNTVNSLGERPRIRHQHSQSMDGSMNINEMLMSGNEDDSAIDAKKSMSATKLAELALIDPKRAKRIWANRQSAARSKERKTRYIFELERKVQTLQTEATTLSAQLTLLQRDTNGLTVENNELKLRLQTMEQQVHLQDELNEALKEEIQHLKVLTGQVAPSALNYGSFGSNQQQFYSNNQSMQTILAAKQFQQLQIHSQKQQQQQQQQQQQHQQQQQQQQQYQFQQQQMQQLMQQRLQQQEQQNGVRLKPSQAQKEN

SEQ ID NO: 59 - DNA, 1479 bp, Arabidopsis thaliana
  G567,family:bZIP
aaaaagaagaatcagaaagtgaaaaagagagcgagcgatgaacagtatcttctccattgacgatttctccgatcctttctgggaaactcctccgattcctctcaatcccgactcttctaagcctgttacggcggatgaagttagccagagtcaaccggaatggactttcgagatgtttctcgaagagatttcttcgtcggcggtgagctctgagccacttggtaacaacaacaacgcgatcgtcggtgtttcttcggcgcaatctcttccttctgtttccggacagaatgatttcgaggatgatagtcgatttcgtgatcgcgattcgggaaatttggattgtgctgctcccatgacgacgaagacggtgaatgttgattccgatgattatcgtcgtgttcttaagaacaagcttgaggctgagtgcgcgactggtgtttctcttcgggttgggtctgtgaagcctgaagattcgactagttctccagaaactcaacttcaaccagttcaatccagtcctcttactcaaggagaacttggtgttacttcttccttaccagctgaggtgaaaaaaactggtgtatcaatgaagcaggttactagtggatcgtcgagagaatattctgatgacgaggaccttgatgaagagaatgaaaccaccggttccttgaagccagaggacgttaaaaaatctagaaggatgctgtcaaatcgtgagtcagctaggcgatctagaaggagaaagcaggagcaaacaagtgacctcgaaacacaggttaatgatctaaaaggtgagcattcatcacttcttaaacaactgagcaacatgaatcacaagtatgacgaggctgctgttggcaatagaatactaaaggctgacattgagacattaagagctaaggtgaaaatggcggaagaaaccgtgaagagagtaacaggaatgaatccgatgcttctcggaagatcaagtggacataacaacaacaacagaatgccaataactggtaacaacaggatggattcttctagcattattccagcttatcaaccacactcaaacctaaaccatatgtcaaaccaaaacatcgggatcccaaccattctacctccaagactcggaaacaatttcgctgctcctccatcccaaaccagctctcccttgcagagaattagaaatgggcaaaatcaccatgttactccaagcgccaacccgtatggctggaataccgaacctcagaacgattcagcatggccgaaaaaatgcgtggactgatcaaacaagaagcgggtttcgcactatattaatgtctatgcatctgtaatttgtaagtgttattaagttacgaatcatgagaaaacatcttgtgaaaatacagtctcatggcttatatatatatataagctctgtcttataacattacaagattcttatttgagaatcgtctttctatttatagctaataaaaaaaaaaaaaaaaa

SEQ ID NO: 60 - protein, 411 aa, Arabidopsis thaliana
  G567,bZIP domain coordinates 210-270
MNSIFSIDDFSDPFWETPPIPLNPDSSKPVTADEVSQSQPEWTFEMFLEEISSSAVSSEPLGNNNNAIVGVSSAQSLPSVSGQNDFEDDSRFRDRDSGNLDCAAPMTTKTVNVDSDDYRRVLKNKLEAECATGVSLRVGSVKPEDSTSSPETQLQPVQSSPLTQGELGVTSSLPAEVKKTGVSMKQVTSGSSREYSDDEDLDEENETTGSLKPEDVKKSRRMLSNRESARRSRRRKQEQTSDLETQVNDLKGEHSSLLKQLSNMNHKYDEAAVGNRILKADIETLRAKVKMAEETVKRVTGMNPMLLGRSSGHNNNNRMPITGNNRMDSSSIIPAYQPHSNLNHMSNQNIGIPTILPPRLGNNFAAPPSQTSSPLQRIRNGQNHHVTPSANPYGWNTEPQNDSAWPKKCVD

SEQ ID NO: 61 - DNA, 1292 bp, Arabidopsis thaliana
  G594,family:HLH/MYC
agaaaagataagagccttttaaagttttttttttaccttctcttcatggacttgtctgtacttgataggcttaagtggctgcaacagcaacaaatggtttcacctgagtttcttcagatacttggctcagatgggagagaagagctcaaaagagttgagagttacttgggaaacaacaatgatgagctgcagagtttcagacattttcccgaattcggaccggattatgatactactgatggctgcatttctaggacaagtagcttccatatggagccagtgaagaataatggacacagcagagccattaccttgcagaacaagagaaaaccagagggtaagacagaaaagagagagaagaagaagatcaaagcagaggatgaaacagagccaagcatgaaagggaaatcaaacatgagtaacacagagacatcttcagaaattcagaaaccagattacattcatgttagggctagacgaggtgaagccaccgacagacatagcttagcagagagggcaagaagagaaaagataagcaagaagatgaaatgtctacaagatattgttcctggatgcaacaaagttactggaaaagctggtatgcttgatgagatcatcaactatgtccaatctctgcaacaacaagtcgagttcttgtcgatgaaactctctgtcataaatccagaacttgagtgtcatatcgatgatttatccgcaaaacagtttcaggcttacttcacaggtcctccagaaggtgactcgaagcagtcaatcatggcggattttcggtcttttccattacatcagcaaggatctttagattactcagtcataaactcagaccacaccacatctctcggcgctaaagatcatacatcatcaagctgggaaactcactcacagtgtctttacaacagcttgagaaccgattctgtttccaatttcttcagcctcaagtaaaaaaattagggatagcctcattaaaaaaatcgcggttttttgttgttgtcttatccatttatctatcttatctgaaatttgaaccagaaagacagaggaaaccaatccaaagatctttctcaatctattatcttcatacaaatatagtgatttacatatattccaggggatatgtatatgtgtagaagaaagagaaaaaactcttgtggtcatagcaattcctttttttgtacattgtagaatcaaactcttgtggtcgtaacaattatttccttcacaaattacaactacacttgtattaatggagatgccttttggccctgggatcaaca

SEQ ID NO: 62 - protein, 304 aa, Arabidopsis thaliana
  G594,HLH/MYC domain coordinates 144-202
MDLSVLDRLKWLQQQQMVSPEFLQILGSDGREELKRVESYLGNNNDELQSFRHFPEFGPDYDTTDGCISRTSSFHMEPVKNNGHSRAITLQNKRKPEGKTEKREKKKIKAEDETEPSMKGKSNMSNTETSSEIQKPDYIHVRARRGEATDRHSLAERARREKISKKMKCLQDIVPGCNKVTGKAGMLDEIINYVQSLQQQVEFLSMKLSVINPELECHIDDLSAKQFQAYFTGPPEGDSKQSIMADFRSFPLHQQGSLDYSVINSDHTTSLGAKDHTSSSWETHSQCLYNSLRTDSVSNFFSLK

SEQ ID NO: 63 - DNA, 3001 bp, Arabidopsis thaliana
  G619,family:ARF
atttttttccaatctgcaaattttagtctatgtctgttccttgtgctccctcttctcagtacctgcaaatggaggaagaagaatccttctctgaaacccttgttctcatttgattcctccttcctctctcttcttctctctctgtctctgattcgttattccacacttatgactcatctttcccgtcaatagctaagtttgcctcttctttgtgaaatttagctgaaaaaggagaggaattccgaattctgtcacttcaaagctcgaattttgcaaactttcctttgatgggttttacttgttttgttgtaatctgattaaaaatagaaactttttgttttcttcttgtctccttttgctcttaaaagagaagctttttcaatggaatttgacttgaatactgagattgcggaggtggaagaggaggagaatgatgatgtaggagtaggagtaggaggaggaacaagaattgacaagggtaggcttggaatttcaccatcttcttcttcttcatgctcttccggatcatcatcgtcatcatcttctacaggctctgcatcttccatttactctgagctttggcatgcttgtgctggtcctctcacttgtcttcccaagaaaggcaatgtagttgtctatttccctcaaggtcatttggagcaagatgctatggtttcatattcgtctcctcttgaaatccccaaatttgaccttaatccccaaatcgtctgcagggtggttaatgtccagttgcttgctaataaggacaccgatgaggtctacactcaagtcactctgcttccacttcaagagttttcgatgctaaatggggaggggaaagaggtcaaggagttaggaggggaggaagagaggaacggaagctcatccgtcaagcggacacctcatatgttctgtaaaaccttaacagcgtctgacacaagcacacatggaggcttctctgtacctagaagagccgctgaagattgttttgctcctcttgactacaaacaacagaggccatctcaagagctcattgcaaaggacctccatggagtagagtggaagtttcgccatatctatagaggtcaaccaaggaggcatctactcaccactggttggagtatctttgtcagtcaaaagaatctcgtctctggtgatgcggttctctttctgagagacgaaggaggagagctgagattaggaatcagaagagcagcacggccaagaaatggacttcctgactcaatcattgagaagaattcatgttcaaacattctgtctcttgtggctaatgctgtatctacaaaaagcatgtttcatgtgttctacagtccacgagcgacgcatgcagagtttgtgattccttatgagaagtatatcacaagcatcaggagtcctgtttgcataggcacaagatttagaatgcgatttgaaatggacgattctcctgagagaagatgcgctggtgtagtgactggagtctgtgacttggacccgtataggtggccaaactctaaatggaggtgcttgttggtgcgatgggatgagtcttttgtgagtgatcatcaagaaagagtttcaccttgggagattgatccctcggtttctctcccacacttgagcattcagtcatctccaaggcctaaaaggccatgggcaggtttactggatactaccccacccggaaaccccataacaaaaaggggtggttttttggactttgaggagtcggttagaccctctaaggtcttgcaaggtcaagaaaatataggttctgcatcaccctcacaggggtttgatgttatgaaccgccggatactggattttgcgatgcagtctcatgcaaatccagtccttgtgtcgagtagagtcaaggatcgatttggtgagtttgtagatgctactggcgtgaacccagcttgttcaggtgttatggacctggataggtttccaagggtcttgcaaggtcaagaaatttgctcgcttaaatcattcccgcaatttgctggtttcagtccagctgctgctcctaatccctttgcttaccaagccaacaagtcaagttactatccgctagctttgcatgggattaggagcactcatgttccgtatcagaatccatacaatgcgggaaaccaatcctcgggtcccccttcacgtgcaataaactttggtgaagagactagaaagtttgatgcacaaaatgaaggtggcctaccaaataatgttacagctgatttgccattcaagattgatatgatgggaaaacagaaaggcagtgagttgaatatgaatgcttcatcaggatgtaaacttttcggattctccttaccagtggagacacctgcatctaagccgcaaagctcgagcaaaagaatctgtacaaaggttcacaagcaaggaagccaagtggggagagctattgatttgtcgcgacttaacgggtatgatgatctccttatggagcttgaacggctgttcaacatggaagggcttctcagggatcctgaaaaaggatggaggatcttatatactgatagtgagaacgatatgatggtcgttggcgatgatccatggcatgatttctgcaatgtggtgtggaagatacacttatacacgaaagaggaagtggagaatgcgaatgacgataacaagagttgtttagagcaagctgctctcatgatggaagcatcaaagtcatcttctgtgagccagcctgattcttctcctacaatcactagggtttgatacccataaagaagcttatttcctatgttttaaagtgtgttttgctcacaaaagaacttcaactttatctttgtctttgaatccatttatgtgtttgtttgtgtttcttctggtctccatggatgtctcatgtgtaccgttttactcgagagatatgtgagtttatgggatgtgtaaagcatgccattggattttaaggttttcaaaattacaatatatatattagttttgaagttaaaaaaaaaaaaaaaaa

SEQ ID NO: 64 - protein, 788 aa, Arabidopsis thaliana
  G619,ARF domain coordinates 64-406
MEFDLNTEIAEVEEEENDDVGVGVGGGTRIDKGRLGISPSSSSSCSSGSSSSSSSTGSASSIYSELWHACAGPLTCLPKKGNVVVYFPQGHLEQDAMVSYSSPLEIPKFDLNPQIVCRVVNVQLLANKDTDEVYTQVTLLPLQEFSMLNGEGKEVKELGGEEERNGSSSVKRTPHMFCKTLTASDTSTHGGFSVPRRAAEDCFAPLDYKQQRPSQELIAKDLHGVEWKFRHIYRGQPRRHLLTTGWSIFVSQKNLVSGDAVLFLRDEGGELRLGIRRAARPRNGLPDSIIEKNSCSNILSLVANAVSTKSMFHVFYSPRATHAEFVIPYEKYITSIRSPVCIGTRFRMRFEMDDSPERRCAGVVTGVCDLDPYRWPNSKWRCLLVRWDESFVSDHQERVSPWEIDPSVSLPHLSIQSSPRPKRPWAGLLDTTPPGNPITKRGGFLDFEESVRPSKVLQGQENIGSASPSQGFDVMNRRILDFAMQSHANPVLVSSRVKDRFGEFVDATGVNPACSGVMDLDRFPRVLQGQEICSLKSFPQFAGFSPAAAPNPFAYQANKSSYYPLALHGIRSTHVPYQNPYNAGNQSSGPPSRAINFGEETRKFDAQNEGGLPNNVTADLPFKIDMMGKQKGSELNMNASSGCKLFGFSLPVETPASKPQSSSKRICTKVHKQGSQVGRAIDLSRLNGYDDLLMELERLFNMEGLLRDPEKGWRILYTDSENDMMVVGDDPWHDFCNVVWKIHLYTKEEVENANDDNKSCLEQAALMMEASKSSSVSQPDSSPTITRV

SEQ ID NO: 65 - DNA, 1033 bp, Arabidopsis thaliana
  G663,family:MYB-(R1)R2R3
gtcgacccacgcgtccgtgggaagccacaataaccccctattcctcggccttttttaaaaaagttttagaataatccgataaaatacttttatattaatttttctttggtccatggagggttcgtccaaagggttgaggaaaggtgcatggactgctgaagaagatagtctcttgaggctatgtattgataagtatggagaaggcaaatggcatcaagttcctttgagagctgggctaaatcgatgcagaaagagttgtagactaagatggttgaactatttgaagccaagtatcaagagaggaagacttagcaatgatgaagttgatcttcttcttcgccttcataagcttctaggaaataggtggtccttgattgctggtcgattgcctggtcggaccgctaatgatgtcaaaaattactggaacacccatctgagtaaaaaacatgagtcttcgtgttgtaagtctaaaatgaaaaagaaaaacattatttcccctcctacaacaccggtccaaaaaatcggtgtttttaagcctcgacctcgatccttctctgttaacaatggttgcagccatctcaatggtctgccagaagttgatttaattccttcatgccttggactcaagaaaaataatgtttgtgaaaatagtatcacatgtaacaaagatgatgagaaagatgattttgtgaataatctaatgaatggagataatatgtggttggagaatttactgggggaaaaccaagaagctgatgcgattgttcctgaagcgacgacagctgaacatggggccactttggcgtttgacgttgagcaactttggagtctgtttgatggagagactgttgaacttgattagtgtttctcaccgtttgtttaagattgtgggtggcttttctttcgtattttagtaatgtatttttctgtatgaagtaaagaatttcagcattttaagaaaaatggttatgtttctacgtaataaaaaaaaacgttatttataaaaaaaaaaaaaaaaaaaaaaaaaaaaaaa

SEQ ID NO: 66 - protein, 249 aa, Arabidopsis thaliana
  G663,MYB-(R1)R2R3 domain coordinates 9-111
MEGSSKGLRKGAWTAEEDSLLRLCIDKYGEGKWHQVPLRAGLNRCRKSCRLRWLNYLKPSIKRGRLSNDEVDLLLRLHKLLGNRWSLIAGRLPGRTANDVKNYWNTHLSKKHESSCCKSKMKKKNIISPPTTPVQKIGVFKPRPRSFSVNNGCSHLNGLPEVDLIPSCLGLKKNNVCENSITCNKDDEKDDFVNNLMNGDNMWLENLLGENQEADAIVPEATTAEHGATLAFDVEQLWSLFDGETVELD

SEQ ID NO: 67 - DNA, 1056 bp, Arabidopsis thaliana
  G668,family:MYB-(R1)R2R3
atgggaagaccaccttgctgtgaaaagattggagtgaagaaagggccatggacaccagaggaagacatcatcttggtttcttacatccaagaacatggtcctggaaactggagatctgtcccaacacacacaggtttaagatgtagcaagagctgcagattgagatggactaattatcttcgacccggtattaagcgtggaaattttactgagcatgaagagaagacaattgttcatcttcaagcccttttaggcaacagatgggcagccatagcatcataccttccagaaaggacagacaatgatataaagaactattggaacactcacttgaagaagaagctcaaaaagattaatgaatctggtgaagaagataatgatggtgtctcttcatcaaacactagttcacaaaagaaccatcaaagcactaacaaaggtcaatgggaaagaagacttcagacagacattaacatggcaaaacaagctctttgtgaggccttgtctttagacaaaccatcatccactctttcatcatcttcatcattaccgacaccagtaatcacacaacaaaacatccgtaacttctcatcagctttgcttgaccgttgttatgatccatcctcttcttcttcatctaccacaaccaccactacaagcaacactactaatccatacccatcaggggtatatgcgtcaagtgctgagaacatcgcccggttgcttcaagatttcatgaaagacacacccaaggctttaactttatcatcttcatctccggtttcagagactggaccactcactgctgcagtctcggaagaaggtggagaagggtttgaacaatctttcttcagcttcaattcaatggacgaaactcaaaacttgactcaggagacaagcttcttccatgatcaagtgatcaaaccggaaataacaatggaccaagatcatggtctaatatcacaagggtctctgtctttgtttgagaaatggttatttgatgagcaaagccacgagatggttggtatggcactagcaggacaagaagggatgttctag

SEQ ID NO: 68 - protein, 351 aa, Arabidopsis thaliana
  G668,MYB-(R1)R2R3 domain coordinates 14-115
MGRPPCCEKIGVKKGPWTPEEDIILVSYIQEHGPGNWRSVPTHTGLRCSKSCRLRWTNYLRPGIKRGNFTEHEEKTIVHLQALLGNRWAAIASYLPERTDNDIKNYWNTHLKKKLKKINESGEEDNDGVSSSNTSSQKNHQSTNKGQWERRLQTDINMAKQALCEALSLDKPSSTLSSSSSLPTPVITQQNIRNFSSALLDRCYDPSSSSSSTTTTTTSNTTNPYPSGVYASSAENIARLLQDFMKDTPKALTLSSSSPVSETGPLTAAVSEEGGEGFEQSFFSFNSMDETQNLTQETSFFHDQVIKPEITMDQDHGLISQGSLSLFEKWLFDEQSHEMVGMALAGQEGMF

SEQ ID NO: 69 - DNA, 786 bp, Arabidopsis thaliana
  G674,family:MYB-(R1)R2R3
atggtgtttaaatcagaaaaatcaaaccgggaaatgaaatcaaaggagaagcaaaggaagggattatggtcacccgaggaagatgagaagcttaggagtcatgtcctcaaatatggccatggatgctggagtactattcctcttcaagctggattgcagaggaatgggaagagttgtagattaaggtgggttaattatttaagacctggacttaagaagtctttattcactaaacaagaggaaactatacttctttcacttcattccatgttgggtaacaaatggtctcagatatcgaaattcttaccaggaagaaccgacaacgagatcaaaaactattggcattctaatctaaagaagggtgtaactttgaaacaacatgaaaccacaaaaaaacatcaaacacctttaatcacaaactcacttgaggccttgcagagttcaactgaaagatcttcttcatctatcaatgtcggagaaacgtctaatgctcaaacctcaagcttttcgccaaatctcgtgttctcggaatggttagatcatagtttgcttatggatcagtcacctcaaaagtctagctatgttcaaaatcttgttttaccggaagagagaggattcattggaccatgtggccctcgttatttgggaaacgactctttgcctgatttcgtgccaaattcagaatttttgttggatgatgagatatcatctgagatcgagttctgtacttcattttcagacaactttttgttcgatggtctcatcaacgagctacgaccaatgtaa

SEQ ID NO: 70 - protein, 261 aa, Arabidopsis thaliana
  G674,MYB-(R1)R2R3 domain coordinates 20-120
MVFKSEKSNREMKSKEKQRKGLWSPEEDEKLRSHVLKYGHGCWSTIPLQAGLQRNGKSCRLRWVNYLRPGLKKSLFTKQEETILLSLHSMLGNKWSQISKFLPGRTDNEIKNYWHSNLKKGVTLKQHETTKKHQTPLITNSLEALQSSTERSSSSINVGETSNAQTSSFSPNLVFSEWLDHSLLMDQSPQKSSYVQNLVLPEERGFIGPCGPRYLGNDSLPDFVPNSEFLLDDEISSEIEFCTSFSDNFLFDGLINELRPM

SEQ ID NO: 71 - DNA, 2526 bp, Arabidopsis thaliana
  G680,family:MYB-related
cagttatcttcttccttcttctctctgttttttaaatttatttttagagaattttttttgttttgcttccgatttgattatttccgggaacgatgacttctccggggagttcccggtgagatgataagtcagattgcatacttgtctcctccatggctactctcaagggttttggctgcggtggattcgtttggtttctctagaatctaaagaggttatcacaacggctttgcaatttgaaaactttcatgtttggggagatcaaagatggtttcttttttatactttacttgttagagaggatttgaagcagcgaatagctgcaaccggtcctgttatggatactaatacatctggagaagaattattagctaaggcaagaaagccatatacaataacaaagcagcgagagcgatggactgaggatgagcatgagaggtttctagaagccttgaggctttatggaagagcttggcaacgaattgaagaacatattgggacaaagactgctgttcagatcagaagtcatgcacaaaagttcttcacaaagttggagaaagaggctgaagttaaaggcatccctgtttgccaagctttggacatagaaattccgcctcctcgtcctaaacgaaaacccaatactccttatcctcgaaaacctgggaacaacggtacatcttcctctcaagtatcatcagcaaaagatgcaaaacttgtttcatcggcctcttcttcacagttgaatcaggcgttcttggatttggaaaaaatgccgttctctgagaaaacatcaactggaaaagaaaatcaagatgagaattgctcgggtgtttctactgtgaacaagtatcccttaccaacgaaacaggtaagtggcgacattgaaacaagtaagacctcaactgtggacaacgcggttcaagatgttcccaagaagaacaaagacaaagatggtaacgatggtactactgtgcacagcatgcaaaactacccttggcatttccacgcagatattgtgaacgggaatatagcaaaatgccctcaaaatcatccctcaggtatggtatctcaagacttcatgtttcatcctatgagagaagaaactcacgggcacgcaaatcttcaagctacaacagcatctgctactactacagcttctcatcaagcgtttccagcttgtcattcacaggatgattaccgttcgtttctccagatatcatctactttctccaatcttattatgtcaactctcctacagaatcctgcagctcatgctgcagctacattcgctgcttcggtctggccttatgcgagtgtcgggaattctggtgattcatcaaccccaatgagctcttctcctccaagtataactgccattgccgctgctacagtagctgctgcaactgcttggtgggcttctcatggacttcttcctgtatgcgctccagctccaataacatgtgttccattctcaactgttgcagttccaactccagcaatgactgaaatggataccgttgaaaatactcaaccgtttgagaaacaaaacacagctctgcaagatcaaaccttggcttcgaaatctccagcttcatcatctgatgattcagatgagactggagtaaccaagctaaatgccgactcaaaaaccaatgatgataaaattgaggaggttgttgttactgccgctgtgcatgactcaaacactgcccagaagaaaaatcttgtggaccgctcatcgtgtggctcaaatacaccttcagggagtgacgcagaaactgatgcattagataaaatggagaaagataaagaggatgtgaaggagacagatgagaatcagccagatgttattgagttaaataaccgtaagattaaaatgagagacaacaacagcaacaacaatgcaactactgattcgtggaaggaagtctccgaagagggtcgtatagcgtttcaggctctctttgcaagagaaagattgcctcaaagcttttcgcctcctcaagtggcagagaatgtgaatagaaaacaaagtgacacgtcaatgccattggctcctaatttcaaaagccaggattcttgtgctgcagaccaagaaggagtagtaatgatcggtgttggaacatgcaagagtcttaaaacgagacagacaggatttaagccatacaagagatgttcaatggaagtgaaagagagccaagttgggaacataaacaatcaaagtgatgaaaaagtctgcaaaaggcttcgattggaaggagaagcttctacatgacagacttggaggtaaaaaaaaaacatccacatttttatcaatatctttaaatctagtgttagtagtttgcttctccaatctttatgaaagagacttttaattttccttccgaacatttctttggtcatgtcaggttctgtaccatattaccccatgtcttgtctcttgtctctgtttgtgtatgctacttgtggtctatatgtcatctgctactactgttaattaaccattaagcaatggatttgtcttta

SEQ ID NO: 72 - protein, 645 aa, Arabidopsis thaliana
  G680,MYB-related domain coordinates 25-71
MDTNTSGEELLAKARKPYTITKQRERWTEDEHERFLEALRLYGRAWQRIEEHIGTKTAVQIRSHAQKFFTKLEKEAEVKGIPVCQALDIEIPPPRPKRKPNTPYPRKPGNNGTSSSQVSSAKDAKLVSSASSSQLNQAFLDLEKMPFSEKTSTGKENQDENCSGVSTVNKYPLPTKQVSGDIETSKTSTVDNAVQDVPKKNKDKDGNDGTTVHSMQNYPWHFHADIVNGNIAKCPQNHPSGMVSQDFMFHPMREETHGHANLQATTASATTTASHQAFPACHSQDDYRSFLQISSTFSNLIMSTLLQNPAAHAAATFAASVWPYASVGNSGDSSTPMSSSPPSITAIAAATVAAATAWWASHGLLPVCAPAPITCVPFSTVAVPTPAMTEMDTVENTQPFEKQNTALQDQTLASKSPASSSDDSDETGVTKLNADSKTNDDKIEEVVVTAAVHDSNTAQKKNLVDRSSCGSNTPSGSDAETDALDKMEKDKEDVKETDENQPDVIELNNRKIKMRDNNSNNNATTDSWKEVSEEGRIAFQALFARERLPQSFSPPQVAENVNRKQSDTSMPLAPNFKSQDSCAADQEGVVMIGVGTCKSLKTRQTGFKPYKRCSMEVKESQVGNINNQSDEKVCKRLRLEGEAST

SEQ ID NO: 73 - DNA, 1760 bp, Arabidopsis thaliana
  G729,family:GARP
aaaaaaaacaaaagaatagtcatcatcatcatcaccatcatcatccttatcatcatcaacaacttcagtggcagcaatagcaagagaaaggtttctttaattatgtctatggaaggtgtttttctagagaaaaccaaaacaaacacaacaactactctccctgatctatctctccacatcagtctcccagatattcatcaataccatcacaatgaatcttctaaagaatcttcaagaagatcctcccaactcgaaaacaacaaccgatcgtccaactttgaactctctttatctcatcataaccatccaacagcaagaatcttccattgtcctgatcgaagaacccttaatcttcctcatcagcagcattacaacaaccctatcatcaatggtgttcatcaaagggtcgatgaatccgagattagtaatctccaccgtccaattagaggcatcccggtctatcacaaccgttcattccctttccaccaacaaaactcttcattaccttctcttggaggaggagacatggatcaaatctcaatcttaaactcatcttccggctacaacaacgcttaccgatcattacaatcttccccgaggcttaaaggtgttcctttgcatcatcatcatcatcataatcagtatggagtcgttggatcttcagattcgtcttctcctcatcaccataaccatcatcatcatgggatgatcagatcaagattcttgcctaagatgccgacaaagcgaagcatgagagctccaaggatgcgttggactagtagcctccacgcgcggtttgttcacgctgttgagcttctaggcggccatgaaagagcaactccaaagtcggttcttgagctcatggatgtaaaagacttaactttagcacatgtgaagagccatttgcagatgtatcgaactgttaagaccactaacaagcctgctgcttcatcagatgggtcaggagaagaagaaatgggcataaatggaaacgaagttcatcatcaatcatcgacggatcaaagggcacaatctgatgatacttctcttcatcaagaaactgacatttcttccacacaacctcgttggagtaactcttcacgagagacatggccattaagtaataactgctcaagcgacatagatacaatgatcagaacttcatcaacatcaatgatctctcattatcaaagatccagcattcaaaatcaggagcaaaggtcgaatgatcaagcaaagaggtgtggaaatcttagttgtgaaaatccaagtttggagtttacattaggcagaccagattggcacgagaaatgactttcttgatcaatttggatttttatatatattggattttttatttttttgtttcatctttctctctctatatatactcagaaacatgtatgcagtatatatctttgtgacgatgaaattctcagcgtaaaagaaggagaacacgtagagagccaagctgctcaagagtgttgatttttgcacagagagagagaatatcactaccaaaatgaagaaatttggaggttcctcttctcaagttccattgatgatttgattataaagtggatgatcaatgtatgagtttttgtttttgggttttcgggtttttagttttttgaggttgatctggtggtgtgatcataagttatataattggaagatcatcaaaatgtggtgaaagtttggatatttttttgaaagcctcttggttggctagagggtttcaagttttttttttttttttt

SEQ ID NO: 74 - protein, 403 aa, Arabidopsis thaliana
  G729,GARP domain coordinates 224-272
MSMEGVFLEKTKTNTTTTLPDLSLHISLPDIHQYHHNESSKESSRRSSQLENNNRSSNFELSLSHHNHPTARIFHCPDRRTLNLPHQQHYNNPIINGVHQRVDESEISNLHRPIRGIPVYHNRSFPFHQQNSSLPSLGGGDMDQISILNSSSGYNNAYRSLQSSPRLKGVPLHHHHHHNQYGVVGSSDSSSPHHHNHHHHGMIRSRFLPKMPTKRSMRAPRMRWTSSLHARFVHAVELLGGHERATPKSVLELMDVKDLTLAHVKSHLQMYRTVKTTNKPAASSDGSGEEEMGINGNEVHHQSSTDQRAQSDDTSLHQETDISSTQPRWSNSSRETWPLSNNCSSDIDTMIRTSSTSMISHYQRSSIQNQEQRSNDQAKRCGNLSCENPSLEFTLGRPDWHEK

SEQ ID NO: 75 - DNA, 766 bp, Arabidopsis thaliana
  G779,family:HLH/MYC
gacatgcatgtaagcattcggttaattaatcgagtcaaagatatatatcagtaaatacatatgtgtatatttctggaaaaagaatatatatattgagaaataagaaaagatgaaaatggaaaatggtatgtataaaaagaaaggagtgtgcgactcttgtgtctcgtccaaaagcagatccaaccacagccccaaaagaagcatgatggagcctcagcctcaccatctcctcatggattggaacaaagctaatgatcttctcacacaagaacacgcagcttttctcaatgatcctcaccatctcatgttagatccacctcccgaaaccctaattcacttggacgaagacgaagagtacgatgaagacatggatgcgatgaaggagatgcagtacatgatcgccgtcatgcagcccgtagacatcgaccctgccacggtccctaagccgaaccgccgtaacgtaaggataagcgacgatcctcagacggtggttgctcgtcggcgtcgggaaaggatcagcgagaagatccgaattctcaagaggatcgtgcctggtggtgcgaagatggacacagcttccatgctcgacgaagccatacgttacaccaagttcttgaaacggcaggtgaggattcttcagcctcactctcagattggagctcctatggctaacccctcttacctttgttattaccacaactcccaaccctgatgaactacacagaagctcgctagctagacatttggtgtcatcctctcaaccttt

SEQ ID NO: 76 - protein, 200 aa, Arabidopsis thaliana
  G779,HLH/MYC domain coordinates 117-174
MKMENGMYKKKGVCDSCVSSKSRSNHSPKRSMMEPQPHHLLMDWNKANDLLTQEHAAFLNDPHHLMLDPPPETLIHLDEDEEYDEDMDAMKEMQYMIAVMQPVDIDPATVPKPNRRNVRISDDPQTVVARRRRERISEKIRILKRIVPGGAKMDTASMLDEAIRYTKFLKRQVRILQPHSQIGAPMANPSYLCYYHNSQP

SEQ ID NO: 77 - DNA, 1515 bp, Arabidopsis thaliana
  G786,family:HLH/MYC
tttcattgctaattaccaatccgttcaagtttgccaggctgaatatttcagacagttgcttaagcctgtaacgtagtctagcgtctggagttttcggaaattggggttttgagcggctatctacttttgatttcgaaaaaatttactgtgagttgttaaagagtctggtattctgaagagctgtctgtgggggagcttctggtttggggggtaagggctctggtggaaactcgtgatatctttagtatgatggccataacttgatatagcatttggttccgtgtgtcaacttagtgtagtagtaactgagcagctggaagcttacaaaggcgacaaatcggtagtagaaaatattcaagcagcttgcagtttgaggtgtacaacttgtttttctctttgcgtttccttttttacgtttgcacgggttttctgatgcagaacaatcagtttcctcacttctcagatgaagtgggtgacagaaatatgcacaacccgtatgcatcagggtcatcctatgatgctttgttcccaccatgtgcaaagttgccataccatggtgttgaacttcaaccgtctgcggtctgtccaaagaactttgtcatcttcgatcaaacatatgaccgcagccaagtgatgtaccatcctgagctgactcataagctcatgaataccccttcgttgaacaatttagcttcgacgtttcagaacgagtatgttgggggaagttatggtaactatggtaactatgagcaagaagtatcctcttcttatcaagaagatccaaatgagatcgatgctctcttgagcgcagatgaagattatgaagagaatgatgataatgaaggtgaagaggatggtggtgattcagaagaagtcagcactgctcgtacttcttccagggattatggaaacaccacagcagaatcttgttgttccagttatggttacaacaacaacaacaacaacaactcaaggaagcagagtttatcgggcagtgctagtagtagtaacaatgatgggaaaggacgtaaaaagatgaagaagatgatgggagtattgaggagaattgtccctggaggagaacagatgaatacagcttgcgttcttgatgaagctgttcagtatctcaagtcacttaaaatcgaagctcagaaacttggcgttggacatttctcaaaccaatcttgaatgctaccgatatttggttcttccatcactattgtttctcgggaggtaaatcatcggtctagcgctatctggacctttctctttattttcctccctctatactcacttccttttgttggcaggatggtatctattttatgtttgaatctctctatgtattttgctttttgtgtgttactgcttcgatgaagaagcaaggtttgaacaagtacttgtggatttgatttgagattttaatttgtatggttttactttcactgtaatcatttgactatgaactacaattatcattatgtatttgcttctacatagttttaaaaaaaaaaa

SEQ ID NO: 78 - protein, 251 aa, Arabidopsis thaliana
  G786,HLH/MYC domain coordinates 183-240
MQNNQFPHFSDEVGDRNMHNPYASGSSYDALFPPCAKLPYHGVELQPSAVCPKNFVIFDQTYDRSQVMYHPELTHKLMNTPSLNNLASTFQNEYVGGSYGNYGNYEQEVSSSYQEDPNEIDALLSADEDYEENDDNEGEEDGGDSEEVSTARTSSRDYGNTTAESCCSSYGYNNNNNNNSRKQSLSGSASSSNNDGKGRKKMKKMMGVLRRIVPGGEQMNTACVLDEAVQYLKSLKIEAQKLGVGHFSNQS

SEQ ID NO: 79 - DNA, 952 bp, Arabidopsis thaliana
  G812,family:HS
tcgaaatcatcaagaatcttgtctttaatttccaattgggtttttcaaaacccgttacctcaggatgatgaacccgtttctcccggaaggctgcgatccaccaccaccaccacaaccaatggagggtttacacgaaaatgctccacctccatttctgaccaagacatttgagatggtggatgatccaaacactgaccacatcgtatcttggaacagaggaggaacaagttttgtcgtctgggatttgcattctttctccacgattctccttcctcgtcatttcaaacacagcaatttctcaagtttcatcagacaactcaatacttatggtttcagaaagatagaagcagagagatgggaatttgcaaacgaagagtttttgttaggacaaagacagttgttgaagaacatcaagaggagaaacccttttactccatcatcttcaccaagccatgacgcttgcaacgagcttcgcagagagaagcaagtgctaatgatggagatagtgagtctaagacagcagcaacaaacaacgaaaagctacatcaaagctatggaacagaggatagaaggaacagagaggaaacagagacaaatgatgtcgtttctggctagagcaatgcagagtccttcgtttttgcatcagttgttgaaacaaagagataaaaaaattaaggagcttgaggataatgagtcagcaaagaggaaaagaggttcttcttcgatgtcggaattggaagttttggctttggagatgcaagggcatggaaaacagaggaatatgttggaagaagaggatcatcaactggtggtagagagagagttggatgatggtttctgggaagagttgcttagtgatgagagtttggcttccacctcctaactagatggatttctttttggttttgtttttagtttcttctactttcaagctcattttcttctgtcacaa

SEQ ID NO: 80 - protein, 272 aa, Arabidopsis thaliana
  G812,HS domain coordinates 29-120
MMNPFLPEGCDPPPPPQPMEGLHENAPPPFLTKTFEMVDDPNTDHIVSWNRGGTSFVVWDLHSFSTILLPRHFKHSNFSSFIRQLNTYGFRKIEAERWEFANEEFLLGQRQLLKNIKRRNPFTPSSSPSHDACNELRREKQVLMMEIVSLRQQQQTTKSYIKAMEQRIEGTERKQRQMMSFLARAMQSPSFLHQLLKQRDKKIKELEDNESAKRKRGSSSMSELEVLALEMQGHGKQRNMLEEEDHQLVVERELDDGFWEELLSDESLASTS

SEQ ID NO: 81 - DNA, 1210 bp, Arabidopsis thaliana
  misc_feature (1194)..(1196): n is a, c, g, or t
  G860,family:MADS
acaaaaccacatctctgaactgaaccaatttctcttctcccccttccggttatcggattaccagatctcgtttcccgcgatctagtttattctttgaaaaagtgatagaagcagaaatgggaaggggcaagatcgcgattaagaggatcaataactctacgagccgtcaggttacgttctcgaagcgaaggaatggattgttgaagaaagctaaggagcttgcgattctctgcgatgctgaggttggtgtcatcatcttctccagcaccggtaggctctacgatttctccagctccagcatgaaatcggtcatagagagatacagcgatgccaaaggagaaaccagttcagaaaatgatcccgcttcagaaattcagttctggcaaaaggaggctgcgattctaaagcgtcagctacataacttgcaagaaaaccaccggcaaatgatgggggaggagctctctggactaagtgtagaagctttacagaatttggaaaatcagcttgaattgagccttcgtggcgttcgaatgaaaaaggatcaaatgttaatcgaagaaatacaagtacttaaccgagaggggaatctcgttcaccaagagaatttagacctccacaagaaagtaaacctaatgcaccaacagaacatggaactacatgaaaaggtttcagaggtcgagggtgtgaaaatcgcaaacaagaattctcttctcacaaatggtctagacatgagagatacctcgaacgaacatgtccatcttcagctcagccaaccgcagcatgatcatgagacgcattcaaaagctatccaactcaactatttttccttcattgcataatataattcggtgtgccaacacacttatgttgacctcgtcggaatcatatcacaattcactgtgtcagcttgcctctgcataagcgaaaataaaaacataaacatgatcagtttgcattccatatctatcaaacaccagctttgtaacttttaaaactttttctccgtgcaaagacctttggtttggcgcttaagcatgtagtttgatgatcaaaggaaatgggtgttttagcataaagttgtcacccttccgttgcattttagcttcccatccaaatcaatttgtaaaatgtgagttagtttgcagcatgaaagctgattaaatatcagtcccgttatcacaagaggtaaaaaannnaaaaaaaaaaaaaa

SEQ ID NO: 82 - protein, 240 aa, Arabidopsis thaliana
  G860,MADS domain coordinates 2-57
MGRGKIAIKRINNSTSRQVTFSKRRNGLLKKAKELAILCDAEVGVIIFSSTGRLYDFSSSSMKSVIERYSDAKGETSSENDPASEIQFWQKEAAILKRQLHNLQENHRQMMGEELSGLSVEALQNLENQLELSLRGVRMKKDQMLIEEIQVLNREGNLVHQENLDLHKKVNLMHQQNMELHEKVSEVEGVKIANKNSLLTNGLDMRDTSNEHVHLQLSQPQHDHETHSKAIQLNYFSFIA

SEQ ID NO: 83 - DNA, 1005 bp, Arabidopsis thaliana
  G904,family:RING/C3H2C3
atggaatctctcatcaatcccagccatggcggaggaaactacgattctcactcttcttctctcgatagtctcaaaccaagcgtactagtcatcattctcattctcctcatgactcttctcatctccgtttccatttgcttcctcctccgctgtctcaatcgctgtagccaccgctccgttctccctctttcatcttcctcttccgtcgcaaccgtaacttccgattcccgacgattctctggacatcgagtctctcccgaaacagaacggtcctccgtgcttgattcgcttccgattttcaaattctcctccgtcactcgccgatctagctccatgaattccggagattgcgccgtttgtttgtcgaaattcgaaccggaggatcagctccgtcttcttcctctctgttgtcacgcttttcacgccgattgtatcgatatctggctagtctctaaccagacttgtcctctctgtcgctctcctctcttcgcttcagaatctgatctcatgaagtctctcgccgtcgtcggctcaaacaacggcggaggagaaaacagcttccgtctcgaaatcggatccatcagccgtcgtcgtcaaacaccgattccagaatccgttgagcagcatcgaacttactcaatcggttcgttcgattacatagtagacgacgtagattcagaaatctcagagtcaaatttcaaccgtggaaaacaggaagacgcgactacaacaactgccacagcaacggcggttacgactaatccgacgtcgtttgaagctagtttagcggcggatataggtaacgatggttctagaagctggctcaaggattacgttgacagactctcacgaggtatatcgtcgcgtgcaatgtcgtttagaagctctggtagattttttactgggagtagtcgtcggagtgaggaattgacggtgatggatttagaagcgaatcatgccggagaagagataagtgagcttttccggtggctctcaggggtgtga

SEQ ID NO: 84 - protein, 334 aa, Arabidopsis thaliana
  G904,RING/C3H2C3 domain coordinates 117-158
MESLINPSHGGGNYDSHSSSLDSLKPSVLVIILILLMTLLISVSICFLLRCLNRCSHRSVLPLSSSSSVATVTSDSRRFSGHRVSPETERSSVLDSLPIFKFSSVTRRSSSMNSGDCAVCLSKFEPEDQLRLLPLCCHAFHADCIDIWLVSNQTCPLCRSPLFASESDLMKSLAVVGSNNGGGENSFRLEIGSISRRRQTPIPESVEQHRTYSIGSFDYIVDDVDSEISESNFNRGKQEDATTTTATATAVTTNPTSFEASLAADIGNDGSRSWLKDYVDRLSRGISSRAMSFRSSGRFFTGSSRRSEELTVMDLEANHAGEEISELFRWLSGV

SEQ ID NO: 85 - DNA, 890 bp, Arabidopsis thaliana
  G913,family:AP2
cattcaaaaacatcatatatatacacaaacacactttgatacaacaaaaaaaaacagaacacaaacaaaaacacattgtaacattagtttaagcattaagcttctttatgtcgaataataataattctccgaccaccgtgaatcaagaaacgacgacgtctcgtgaagtctcaatcacattgcctactgatcaatctcctcaaacctcaccaggatcatcttcttctccttcaccgagaccttccggtggatcaccggcgagaagaacggcgactggattatccggcaagcactctattttcagggggattcgactacgtaacggaaaatgggtatcggagattagagagccacgtaaaacgacaagaatttggctcgggacttatccggtaccggagatggctgccgccgcttacgacgtggctgcgttagctttaaaaggacccgacgccgttttgaattttcctggtttagctttgacttacgtggctccggtttcaaactctgctgcggatataagagcggctgctagtagagcagcggagatgaagcaaccggatcagggtggggatgagaaggtattggaaccggttcaacccggcaaagaggaagaattagaagaagtgtcgtgtaactcgtgttcgttggagtttatggatgaggaagcgatgttgaatatgccgactttgttgacggagatggctgaagggatgttgatgagtccaccgagaatgatgatacatccgacgatggaagatgattcgccggagaatcatgaaggagataatctttggagttataaatgaatccattgaagctgctctcttttttattgttttccggtcgaatgagattttccccctttttttttttctttttgggtcgctgtt

SEQ ID NO: 86 - protein, 232 aa, Arabidopsis thaliana
  G913,AP2 domain coordinates 62-128
MSNNNNSPTTVNQETTTSREVSITLPTDQSPQTSPGSSSSPSPRPSGGSPARRTATGLSGKHSIFRGIRLRNGKWVSEIREPRKTTRIWLGTYPVPEMAAAAYDVAALALKGPDAVLNFPGLALTYVAPVSNSAADIRAAASRAAEMKQPDQGGDEKVLEPVQPGKEEELEEVSCNSCSLEFMDEEAMLNMPTLLTEMAEGMLMSPPRMMIHPTMEDDSPENHEGDNLWSYK

SEQ ID NO: 87 - DNA, 1250 bp, Arabidopsis thaliana
  G936,family:GARP
aagtgtatcttgatctagggttcacagacaaaatctccatgctttgaactaagcagaattcatctggtcttttatctctttcatatcaaaccaaaggattgatctatccatatcgtccaaaacctatatctagctaagcctagaacttctctatcgtttaccactttctttctatatttcttctgaatttgtaacatcagaagtaataatgattccaagtatggagggaggcgggaagactaacagagaagaagaggaggaggaagaggaagaagaagaagaaggtgaagagagtaaggtttcaagcaatagtacagtggaagagagcgacaagaagactaaggttaggccttatgtgagatctaaagtccctcgactccggtggactcctgatcttcatcttcgctttgtccgcgccgttgagaggcttggaggtcaagaaagagcaactccaaagttggttcgtcagatgatgaacatcaaagggcttagtattgctcatgtcaagagccatctacagatgtacagaagcaagaagatagatgatcaaggtcaagctatagctggtcacaaacatctcttcgagacttccacagatcgaaatatttataaactaagtcagctaccgatgttccgaggctataatcataaccatgattctccattcagatatggaagtaaaatttcaaatgcttctttgtggaactctagctctcaaggaacagaaaggagtttgatagaccaaattaggcccggtttaatccgcaacgcgtcggttagcaataacatccgtggtagtgattattggactaacaacaagtctttccaaaacatctactcttcttcaatttctaatcactttccgaaactacgacacgatcatcacgaacggaccaattcagtcacattcaacagcattcaaggacactcaagaacttttcaaaagttccataacggtgttgaggagaacactaatcattcttattgtagcaagacaaatggcaaaagagacgcaagtaggagcattgatcttgatctatctcttaagctaagacaaccggagaagacaattttggaagagacagaaacagcagcaacaacaacggatcaaacgttgtccttgtcgctatgtccagggtcgtcttcgtggaaaaagagccgactgatgaaagatgaagaggatcggacggttaagattggtcaggagagtactctggatctgactctatgaattatatttaagaatgaga

SEQ ID NO: 88 - protein, 340 aa, Arabidopsis thaliana
  G936,GARP domain coordinates 59-107
MIPSMEGGGKTNREEEEEEEEEEEEGEESKVSSNSTVEESDKKTKVRPYVRSKVPRLRWTPDLHLRFVRAVERLGGQERATPKLVRQMMNIKGLSIAHVKSHLQMYRSKKIDDQGQAIAGHKHLFETSTDRNIYKLSQLPMFRGYNHNHDSPFRYGSKISNASLWNSSSQGTERSLIDQIRPGLIRNASVSNNIRGSDYWTNNKSFQNIYSSSISNHFPKLRHDHHERTNSVTFNSIQGHSRTFQKFHNGVEENTNHSYCSKTNGKRDASRSIDLDLSLKLRQPEKTILEETETAATTTDQTLSLSLCPGSSSWKKSRLMKDEEDRTVKIGQESTLDLTL

SEQ ID NO: 89 - DNA, 2057 bp, Arabidopsis thaliana
  G940,family:EIL
ttcccctgagaacgacaggagaaagaataaaaaccctaaatttctttaatttcggcgcttcagattatcgttgttaaaggtttttgattgattttgtttaaatgggcgatcttgctatgtccgtagcagacatcaggatggagaatgagcctgatgatttagctagtgataatgttgctgagattgatgtgagtgatgaagagattgatgctgacgaccttgagagacggatgtggaaagatcgtgtcaggcttaaaagaatcaaagagcgacaaaaagctggctctcaaggagctcaaacgaaggagacacctaagaaaatctctgatcaagctcagaggaagaaaatgtctagagctcaagatggtatccttaagtacatgttgaagcttatggaagtctgcaaagttcgcgggtttgtctatggtataataccggaaaagggcaagcctgtgagtggttcctctgacaatataagagcttggtggaaagagaaagtgaagtttgataagaacggtcctgctgctattgctaaatacgaagaggagtgtttagcgtttgggaaatctgatgggaataggaattcacagtttgttctccaggatttgcaagatgctactttagggtctttgttatcttctttgatgcaacattgtgatcctcctcaaaggaagtatccgttggagaaagggacgcctccgccttggtggccaacggggaatgaagaatggtgggtgaaactcggtctgcctaaaagccagagtcctccttaccgaaaacctcatgatctcaagaagatgtggaaggttggagttttaacggcagtgatcaatcatatgttacctgatattgcaaagattaagaggcatgttcgtcagtcgaaatgtttacaggacaagatgacagctaaagagagtgcgatttggttggcggttttgaaccaagaggaatctttgattcagcagcctagcagtgacaatggaaactccaatgtgactgagacacatcgtaggggtaataacgctgacaggaggaaacctgtggtcaacagtgacagtgactatgatgttgatgggacagaggaagcttcaggttcagtttcatctaaagacagtagaagaaatcagattcaaaaagaacaaccaacagccatctcacattcagtaagagatcaagataaagcagagaaacatcgcagaaggaaaagacctcgaattagatccggaactgtcaatcgacaagaggaagaacaacctgaagctcaacaaagaaacatcttacctgatatgaatcatgttgatgcccctctgctagaatataacatcaacggtactcatcaagaggacgatgttgtcgacccaaatattgccttaggaccagaggataatggtctggaactagtggttcctgagttcaataacaactatacttatcttccacttgttaatgaacaaactatgatgcctgtagacgaaaggccaatgctttatggaccaaaccctaaccaagagcttcaatttgggtcagggtacaacttctacaatccctctgcagtgtttgtacataaccaggaagacgacattctccatacacagatagaaatgaatacacaagcaccacctcacaacagtgggttcgaggaggccccaggaggagtacttcaaccccttggtttactcggaaatgaagacggtgtaacagggagtgagttgcctcagtatcagagtggcattctgtctccattgactgacttggactttgactatggtggttttggtgatgatttctcatggtttggagcttagtgtcttgccattttttttgggagattacatagttcaaaaggacatggcaatagtctggctagtacagttactttctcttcttcatttcttctgatcttatattcttcctctttttttcttataatattttcttagatttgttaagagaaacaattttccttttgaataagttgccagaagaactgctttgcccgttgtaatggtctctagggaaagcagttagcgtatcatcatttgtaaatttactgtgag

SEQ ID NO: 90 - protein, 567 aa, Arabidopsis thaliana
  G940,EIL domain coordinates 86-96
MGDLAMSVADIRMENEPDDLASDNVAEIDVSDEEIDADDLERRMWKDRVRLKRIKERQKAGSQGAQTKETPKKISDQAQRKKMSRAQDGILKYMLKLMEVCKVRGFVYGIIPEKGKPVSGSSDNIRAWWKEKVKFDKNGPAAIAKYEEECLAFGKSDGNRNSQFVLQDLQDATLGSLLSSLMQHCDPPQRKYPLEKGTPPPWWPTGNEEWWVKLGLPKSQSPPYRKPHDLKKMWKVGVLTAVINHMLPDIAKIKRHVRQSKCLQDKMTAKESAIWLAVLNQEESLIQQPSSDNGNSNVTETHRRGNNADRRKPVVNSDSDYDVDGTEEASGSVSSKDSRRNQIQKEQPTAISHSVRDQDKAEKHRRRKRPRIRSGTVNRQEEEQPEAQQRNILPDMNHVDAPLLEYNINGTHQEDDVVDPNIALGPEDNGLELVVPEFNNNYTYLPLVNEQTMMPVDERPMLYGPNPNQELQFGSGYNFYNPSAVFVHNQEDDILHTQIEMNTQAPPHNSGFEEAPGGVLQPLGLLGNEDGVTGSELPQYQSGILSPLTDLDFDYGGFGDDFSWFGA

SEQ ID NO: 91 - DNA, 768 bp, Arabidopsis thaliana
  G975,family:AP2
attactcatcatcaagttcctactttctctctgacaaacatcacagagtaagtaagaatggtacagacgaagaagttcagaggtgtcaggcaacgccattggggttcttgggtcgctgagattcgtcatcctctcttgaaacggaggatttggctagggacgttcgagaccgcagaggaggcagcaagagcatacgacgaggccgccgttttaatgagcggccgcaacgccaaaaccaactttcccctcaacaacaacaacaccggagaaacttccgagggcaaaaccgatatttcagcttcgtccacaatgtcatcctcaacatcatcttcatcgctctcttccatcctcagcgccaaactgaggaaatgctgcaagtctccttccccatccctcacctgcctccgtcttgacacagccagctcccatatcggcgtctggcagaaacgggccggttcaaagtctgactccagctgggtcatgacggtggagctaggtcccgcaagctcctcccaagagactactagtaaagcttcacaagacgctattcttgctccgaccactgaagttgaaattggtggcagcagagaagaagtattggatgaggaagaaaaggttgctttgcaaatgatagaggagcttctcaatacaaactaaatcttatttgcttatatatatgtacctattttcattgctgatttacagccaaaataatcaattataccgtgtattttatagatgttttatattaaaaggttgttagatata

SEQ ID NO: 92 - protein, 199 aa, Arabidopsis thaliana
  G975,AP2 domain coordinates 4-71
MVQTKKFRGVRQRHWGSWVAEIRHPLLKRRIWLGTFETAEEAARAYDEAAVLMSGRNAKTNFPLNNNNTGETSEGKTDISASSTMSSSTSSSSLSSILSAKLRKCCKSPSPSLTCLRLDTASSHIGVWQKRAGSKSDSSWVMTVELGPASSSQETTSKASQDAILAPTTEVEIGGSREEVLDEEEKVALQMIEELLNTN

SEQ ID NO: 93 - DNA, 833 bp, Arabidopsis thaliana
  misc_feature (810)..(810): n is a, c, g, or t
  G977,family:AP2
caccaaactcacctgaaaccctatttccatttaccattcacactaatggcacgaccacaacaacgctttcgaggcgttagacagaggcattggggctcttgggtctccgaaattcgtcaccctctcttgaaaacaagaatctggctagggacgtttgagacagcggaggatgcagcaagggcctacgacgaggcggctaggctaatgtgtggcccgagagctcgtactaatttcccatacaaccctaatgccattcctacttcctcttccaagcttctatcagcaactcttaccgctaaactccacaaatgctacatggcttctcttcaaatgaccaagcaaacgcaaacacaaacgcaaacgcagaccgcaagatcacaatccgcggacagtgacggtgtgacggctaacgaaagtcatttgaacagaggagtaacggagacgacagagatcaagtgggaagatggaaatgcgaatatgcaacagaattttaggccattggaggaagatcatatcgagcaaatgattgaggagctgcttcactacggttccattgagctttgctctgttttaccaactcagacgctgtgagaaatggccttgtcgttttagcgtattcttttcatttttatttttgtttccacaaaaacggcgtcgtaagtgatgagagtagtagtgagagaaggctaatttcaagacattttgatctgaattggcctcttttgaaacactgattctagtttctataagagcaatcgatcatatgctatgttatgtatagtattataaaaaaatgttattttctgattnaaaaaaaaaaaaaaaaaaaaaaa

SEQ ID NO: 94 - protein, 181 aa, Arabidopsis thaliana
  G977,AP2 domain coordinates 5-72
MARPQQRFRGVRQRHWGSWVSEIRHPLLKTRIWLGTFETAEDAARAYDEAARLMCGPRARTNFPYNPNAIPTSSSKLLSATLTAKLHKCYMASLQMTKQTQTQTQTQTARSQSADSDGVTANESHLNRGVTETTEIKWEDGNANMQQNFRPLEEDHIEQMIEELLHYGSIELCSVLPTQTL

SEQ ID NO: 95 - DNA, 1059 bp, Arabidopsis thaliana
  G1004,family:AP2
atggcgactcctaacgaagtatctgcactttggttcatcgagaaacatctactcgacgaggcttctcctgtggctacagatccatggatgaagcacgaatcatcatcagcaacagaatctagctctgactcttcttctatcatcttcggatcatcgtcctcttctttcgccccaattgatttctctgaatccgtatgcaaacctgaaatcatcgatctcgatactcccagatctatggaatttctatcgattccatttgaatttgactcagaagtttctgtttctgatttcgattttaaaccttctaatcaaaatcaaaatcagtttgaaccggagcttaaatctcaaattcgtaaaccgccattgaagatttcgcttccagctaaaacagagtggattcaattcgcagctgaaaacaccaaaccggaagttactaaaccggtttcggaagaagagaagaagcattacagaggagtaagacaaagaccgtgggggaaattcgcggcggagattcgtgacccgaataaacgcggatctcgcgtttggcttgggacgtttgatacagcgattgaagcggctagagcttatgacgaagcagcgtttagactacgaggatcgaaagcgattttgaatttccctcttgaagttgggaagtggaaaccacgcgccgatgaaggtgagaagaaacggaagagagacgatgatgagaaagtgactgtggttgagaaagtgttgaagacggaacagagcgttgacgttaacggtggagagacgtttccgtttgtaacgtcgaatttaacggaattatgtgactgggatttaacggggtttcttaactttccgcttctgtcgccgttatctcctcatccaccgtttggttattcccagttgaccgttgtttgattagttttttttgagtttttgaacgatgtgtatgctgacgtggacgtacacgtaggtgcatgcgatgaaaaaaacatctatttgttcatatttttgcgtttttctatttgttcattctttttcacaattcacaatacattatttcagttaatgatc

SEQ ID NO: 96 - protein, 300 aa, Arabidopsis thaliana
  G1004,AP2 domain coordinates 153-221
MATPNEVSALWFIEKHLLDEASPVATDPWMKHESSSATESSSDSSSIIFGSSSSSFAPIDFSESVCKPEIIDLDTPRSMEFLSIPFEFDSEVSVSDFDFKPSNQNQNQFEPELKSQIRKPPLKISLPAKTEWIQFAAENTKPEVTKPVSEEEKKHYRGVRQRPWGKFAAEIRDPNKRGSRVWLGTFDTAIEAARAYDEAAFRLRGSKAILNFPLEVGKWKPRADEGEKKRKRDDDEKVTVVEKVLKTEQSVDVNGGETFPFVTSNLTELCDWDLTGFLNFPLLSPLSPHPPFGYSQLTVV

SEQ ID NO: 97 - DNA, 813 bp, Arabidopsis thaliana
  G1020,family:AP2
ctgttcacaagaaagctccccaaaaggagcgttgctttactctcctataaaaagaagctcttctacttcttctcgttaccacaaaactctttcaccgatcttctcgttccattcttcttcctaattacaccatgcccaacatcaccatgggtttgaaacccgacccggttgctccaacgaacccgactcatcatgagagtaatgctgccaaagagattcgttacagaggcgttaggaaacgtccatggggaagatacgccgctgagatccgagatccggttaagaaaactcgagtctggctcggtacgttcgacaccgctcagcaggcggcgcgtgcttacgacgcagccgcgcgtgactttcgtggtgttaaggctaagaccaatttcggtgttatcgttggtagtagtcctactcagagtagcaccgtcgtcgactctcccacggcggcacggtttataacacctccgcacctcgagctcagcttaggcggcggcggcgcgtgtcgtcgtaagatcccgcttgtgcatccggtttactactataacatggcgacgtatccaaagatgacgacgtgtggtgtccagagcgagtctgaaacgtcgtcggtcgttgatttcgaaggtggagctgggaagatatctccgccgttagatctggatcttaacttagctcctccggcggaataggccgtgagttttttttttcttatgtcgtttctttagacaaaaaaaaataacgtttcctttttttttctgcctaagaaaaaaatattatccgttttttagaagaaaaaaaaaaaaaaaaaaaaaa

SEQ ID NO: 98 - protein, 185 aa, Arabidopsis thaliana
  G1020,AP2 domain coordinates 28-95
MPNITMGLKPDPVAPTNPTHHESNAAKEIRYRGVRKRPWGRYAAEIRDPVKKTRVWLGTFDTAQQAARAYDAAARDFRGVKAKTNFGVIVGSSPTQSSTVVDSPTAARFITPPHLELSLGGGGACRRKIPLVHPVYYYNMATYPKMTTCGVQSESETSSVVDFEGGAGKISPPLDLDLNLAPPAE

SEQ ID NO: 99 - DNA, 2031 bp, Arabidopsis thaliana
  G1038,family:GARP
gctcgttttcaaattaaaaacagggagaaatttggaaattccagtacgacgggagataaaacctaacatacgccatggtgaccgttatctaaactacgccaaaatatttgaagtgtcgtcgtttcataataaaacgcaaacaaaaacccactcccactttctcctttccaaaaaaagaactctcgccactttctctgctcttttctttctctctctctttcttgttttcgccggcgatcatggagaaaagcggcttctctcccgtcggtctaagggttcttgtcgtagacgatgatccaacttggctcaagattctcgagaaaatgctcaagaagtgttcttacgaagtaacgacctgtggattagctagagaggctttgaggttgctgagggagcgtaaagatggatatgatatcgtgatcagcgatgtgaacatgcctgacatggatggtttcaagcttcttgagcatgttggtcttgaattagacctccctgtaataatgatgtcggtggacggcgaaacaagccgagtgatgaagggagtgcacacgggagcttgtgattacctcttgaagccgataagaatgaaggagttaaagattatatggcaacatgttctgagaaagaagcttcaagaagtgagagatatcgaaggctgtggatacgaaggaggagcggattggatcactcgatacgatgaagcacattttcttggaggtggtgaagatgtttcttttgggaaaaagagaaaagactttgactttgagaagaagcttcttcaagatgagagtgatccatcatcttcttcttccaagaaagctagagttgtttggtcttttgagcttcatcataagtttgtcaacgccgttaaccaaatcggatgcgatcacaaagctggtcccaagaagatattggatctcatgaatgttccatggctcactagagaaaatgttgcaagccaccttcagaaatatagactttacctgagcagattagagaaaggaaaggagctcaagtgttattcaggtggcgtgaagaatgcggattcatctccaaaagatgtcgaagtgaattcaggctaccaaagccctgggaggagcagctatgtattctctggaggaaattctctgatccaaaaagcaacagagattgatccaaagccacttgcttcagcttctttgtctgaccccaacaccgatgtgatcatgcctccgaaaacaaaaaagacgcgtataggatttgatcctcccatttcctcctctgcgtttgactctctgcttccttggaatgatgttccagaggtccttgaatcgaagccggttctgtatgagaatagctttctccagcaacaaccattgccaagtcaaagttcctatgttgcaatttctgcaccatctctcatggaggaggaaatgaagcctccttatgagacaccagcaggaggcagtagtgtgaatgcagatgagtttctcatgccacaagacaagatccctactgtaacccttcaagatttggatccctctgccatgaagctgcaggagttcaacacagaaggcgattctgaagaagcttgaactggggaacttccagaatcacatcattctgtttctttagacactgacttagacttgacttggcttcaaggcgagcgtttcttgcaaacaccgactccagtttcaagatacagtagtagcccatcactcctatctgagctcccagcccaccttaattggtatggaaatgagcggctgcctgaccctgacgagtattccttcatggtagaccaaggtttattcatatcttaaccttgttccaataacttcttttcgtatattggttggtgtaatgcagaaagattttgtgggtatacctgaaaataatcttgctttcccaagaaccttccatgatcggatgcattgtacaataatccacgagtgtcgtaggctaattacaccaaacaggttgatgacagtgataaggccacatgtttcacaccgtcgcttaagatctttactgtcacctggaaggaaa

SEQ ID NO: 100 - protein, 444 aa, Arabidopsis thaliana
  G1038,GARP domain coordinates 198-247
MEKSGFSPVGLRVLVVDDDPTWLKILEKMLKKCSYEVTTCGLAREALRLLRERKDGYDIVISDVNMPDMDGFKLLEHVGLELDLPVIMMSVDGETSRVMKGVHTGACDYLLKPIRMKELKIIWQHVLRKKLQEVRDIEGCGYEGGADWITRYDEAHFLGGGEDVSFGKKRKDFDFEKKLLQDESDPSSSSSKKARVVWSFELHHKFVNAVNQIGCDHKAGPKKILDLMNVPWLTRENVASHLQKYRLYLSRLEKGKELKCYSGGVKNADSSPKDVEVNSGYQSPGRSSYVFSGGNSLIQKATEIDPKPLASASLSDPNTDVIMPPKTKKTRIGFDPPISSSAFDSLLPWNDVPEVLESKPVLYENSFLQQQPLPSQSSYVAISAPSLMEEEMKPPYETPAGGSSVNADEFLMPQDKIPTVTLQDLDPSAMKLQEFNTEGDSEEA

SEQ ID NO: 101 - DNA, 715 bp, Arabidopsis thaliana
  G1047,family:bZIP
caattttaaaccggtcattatgatgtctactgtaccggcctttacctttactgaaccgggtttggttaaccaattatcggatttccagaccggattcactccttgggaattgaactgctccgatctcttctctacaatccatctcgaaccggtcgtaccgagtccttgttctggtgaatccgatgccggttctgtcaaaattaacaccgattttaacggttttgacgaatcgtgtatcggttccatcaaaactaactccggttctgatgattccaaccttttccacggcgtaccgagtcctcaatccgacgaattggactcaaaaaacacgaaaatccgaagtaacgccacgaatcataaccggaacaaattgaaccggtcggttttgcaggtgactgacgaccgtaaacgcaaacggatggaatcaaaccgagaatcagcgaagcggtcgaggatgcgtaaacaaagacacattgataatttaaaagacgaagcaaatcgtctcggtttagaaaaccgggaactcgcaaaccggcttcgaattgttttgtacaacatcgcattaatgtgtacggacaacaatcagcttttgtcggaacaagagattctcagacggagattcttggagatgaggcagattttgattttcagacagcttcagctgaatccatcattgatcatcaatcatcatcatatgatttgaaagaaaaaaaaa

SEQ ID NO: 102 - protein, 227 aa, Arabidopsis thaliana
  G1047,bZIP domain coordinates 129-180
MMSTVPAFTFTEPGLVNQLSDFQTGFTPWELNCSDLFSTIHLEPVVPSPCSGESDAGSVKINTDFNGFDESCIGSIKTNSGSDDSNLFHGVPSPQSDELDSKNTKIRSNATNHNRNKLNRSVLQVTDDRKRKRMESNRESAKRSRMRKQRHIDNLKDEANRLGLENRELANRLRIVLYNIALMCTDNNQLLSEQEILRRRFLEMRQILIFRQLQLNPSLIINHHHMI

SEQ ID NO: 103 - DNA, 1148 bp, Arabidopsis thaliana
  G1063,family:HLH/MYC
gttaaagaagatggatgggccacaagttgctatataaatccttccacttcttgttgtatactattgcttgagttctgattgggcacagtagtaccattgccatttctctcacacataccgtctctttctctcatcatcaatcatcaatcatccaaaagaaaaaaccctaaaatttcacttgtaagcttttcaccagtttctctccatacccattttatcagcttctccatatctttctctatggattctgacataatgaacatgatgatgcatcagatggagaagcttcctgagttttgtaaccctaattcctctttcttctctcccgaccacaacaacacttacccttttctctttaactccactcattaccagtccgatcactcaatgaccaacgaaccaggtttccgctacggttccggtttactcactaacccttcttctatctctcccaacacagcttactcttccgtttttcttgacaaaagaaacaacagtaacaacaacaataatggcacgaacatggcagctatgcgagagatgatcttccgtatcgccgtgatgcaaccgatccatatcgatcccgaggcggttaagccaccgaagaggaggaacgtcaggatctctaaagatcctcaaagcgtggcggctaggcatagaagggagagaataagcgagaggattcggattttgcaacggcttgttcctggtgggacgaagatggatacagcttcgatgctcgatgaagcaattcattatgtgaagtttttaaagaaacaggtgcagtctctggaggagcaggcggtggttactggcggagggggaggaggaggaggaagggttttgatcggtggaggtggaatgacggcggcgagtggtggtggtggcggcgggggagtggttatgaaagggtgtggaacagtggggactcatcagatggtgggcaatgcacagattcttagatgatgatgatttttaattttattattattatattaatgttggagaaaaagagaaaaatgattctggagagggaagccaagtaatttatgtgagagtctttaatttaactttattttcttgtttagataatgtgtaatgatggtttttaaagccaaagactctccatggttgttggagcgagtttg

SEQ ID NO: 104 - protein, 241 aa, Arabidopsis thaliana
  G1063,HLH/MYC domain coordinates 125-182
MDSDIMNMMMHQMEKLPEFCNPNSSFFSPDHNNTYPFLFNSTHYQSDHSMTNEPGFRYGSGLLTNPSSISPNTAYSSVFLDKRNNSNNNNNGTNMAAMREMIFRIAVMQPIHIDPEAVKPPKRRNVRISKDPQSVAARHRRERISERIRILQRLVPGGTKMDTASMLDEAIHYVKFLKKQVQSLEEQAVVTGGGGGGGGRVLIGGGGMTAASGGGGGGGVVMKGCGTVGTHQMVGNAQILR

SEQ ID NO: 105 - DNA, 1295 bp, Arabidopsis thaliana
  G1070,family:AT-hook
tcgaccagcttggatttcgttgttcatcattactactctctttcttcttctagctagctagttttgacagcaaaataagaagcaaaaaaaaggtcaactaaaaaagatctgttcttagatcactctcttcttctttttttgatccaattccaccattgaatcatagatcatggatccagtacaatctcatggatcacaaagctctctacctcctcctttccacgcaagagactttcaattacatcttcaacaacagcaacaagagttcttcctccaccatcaccagcaacaaagaaaccaaaccgatggtgaccaacaaggaggatcaggaggaaaccgacaaatcaagatggatcgtgaagagacaagcgacaacatagacaacatagctaacaacagcggtagtgaaggtaaagacatagatatacacggtggttcaggagaaggaggtggtggctccggaggagatcatcagatgacaagaagaccaagaggaagaccagcgggatccaagaacaaaccaaaaccaccgattatcatcacacgggacagcgcaaacgcgcttagaacccacgtgatggagatcggagatggctgcgacttagtcgaaagcgttgccacttttgcacgaagacgccaacgcggcgtttgcgttatgagcggtactggaaatgttactaacgtcactatacgtcagcctggatctcatccttctcctggctcggtagttagtcttcacggaaggttcgagattctatctctctcaggatcttttctccctcctccggctcctcctacagccaccggattgagtgtttacctcgctggaggacaaggacaggtggttggaggaagcgtagttggtccgttgttatgtgctggtcctgtcgttgtcatggctgcgtcttttagcaatgcggcgtacgaaaggttgcctttagaggaagatgagatgcagacgccggttcatggcggaggaggaggaggatcattggagtcgccgccaatgatgggacaacaactgcaacatcagcaacaagctatgtcaggtcatcaagggttaccacctaatcttcttggttcggttcagttgcagcagcaacatgatcagtcttattggtcaacgggacgaccaccgtattgatcaaatatacacacacactcataatcgttgctagctagctaacgatgaatcatgagtttagtggatatatatatgattaaaagaggttagcttatgaacattaataagagtttggattctatcgagcttcattatgtttgggtcatcgttc

SEQ ID NO: 106 - protein, 324 aa, Arabidopsis thaliana
  G1070,AT-hook domain coordinates 105-113,114-259
MDPVQSHGSQSSLPPPFHARDFQLHLQQQQQEFFLHHHQQQRNQTDGDQQGGSGGNRQIKMDREETSDNIDNIANNSGSEGKDIDIHGGSGEGGGGSGGDHQMTRRPRGRPAGSKNKPKPPIIITRDSANALRTHVMEIGDGCDLVESVATFARRRQRGVCVMSGTGNVTNVTIRQPGSHPSPGSVVSLHGRFEILSLSGSFLPPPAPPTATGLSVYLAGGQGQVVGGSVVGPLLCAGPVVVMAASFSNAAYERLPLEEDEMQTPVHGGGGGGSLESPPMMGQQLQHQQQAMSGHQGLPPNLLGSVQLQQQHDQSYWSTGRPPY

SEQ ID NO: 107 - DNA, 1084 bp, Arabidopsis thaliana
  G1075,family:AT-hook
tttgtgtttggtgctggcatggctggtctcgatctaggcacaacttctcgctacgtccacaacgtcgatggtggcggcggcggacagttcaccaccgacaaccaccacgaagatgacggtggcgctggaggaaaccaccatcatcaccatcataatcataatcaccatcaaggtttagatttaatagcttctaatgataactctggactaggcggcggtggaggaggagggagcggtgacctcgtcatgcgtcggccacgtggccgtccagctggatcgaagaacaaaccgaagccgccggtgattgtcacgcgcgagagcgcaaacactcttagggctcacattcttgaagttggaagtggctgcgacgttttcgaatgtatctccacttacgctcgtcggagacagcgcgggatttgcgttttatccgggacgggaaccgtcactaacgtcagcatccgtcagcctacggcggccggagctgttgtgactctgcggggtacttttgagattctttccctctccggatcttttcttccgccacctgctcctccaggggcgactagcttgacgatattcctcgctggagctcaaggacaggtcgtcggaggtaacgtagttggtgagttaatggcggcggggccggtaatggtcatggcagcgtcttttacaaacgtggcttacgaaaggttgcctttggacgagcatgaggagcacttgcaaagtggcggcggcggaggtggagggaatatgtactcggaagccactggcggtggcggagggttgcctttctttaatttgccgatgagtatgcctcagattggagttgaaagttggcaggggaatcacgccggcgccggtagggctccgttttagcaatttaagaaactttaattgttttttccacttttttgtttttctccgaattttatgaaattatgatttaagaaaaaaaacgatattgttcatgtattgaccctcttactgcatggtttcttctattgggttaattggctagctcataagaattgtttaatttggttattgtcatcaaatttgcccacatataaagcttctagcaaat

SEQ ID NO: 108 - protein, 285 aa, Arabidopsis thaliana
  G1075,AT-hook domain coordinates 78-86,87-229
MAGLDLGTTSRYVHNVDGGGGGQFTTDNHHEDDGGAGGNHHHHHHNHNHHQGLDLIASNDNSGLGGGGGGGSGDLVMRRPRGRPAGSKNKPKPPVIVTRESANTLRAHILEVGSGCDVFECISTYARRRQRGICVLSGTGTVTNVSIRQPTAAGAVVTLRGTFEILSLSGSFLPPPAPPGATSLTIFLAGAQGQVVGGNVVGELMAAGPVMVMAASFTNVAYERLPLDEHEEHLQSGGGGGGGNMYSEATGGGGGLPFFNLPMSMPQIGVESWQGNHAGAGRAPF

SEQ ID NO: 109 - DNA, 2684 bp, Arabidopsis thaliana
  G1082,family:BZIPT2
gggtttggaatcatattattgagtgttatgggttgtacaagttctaagcttgacgatcttccggcggttgctctttgccgtgaacgctgtgctttcttagaagctgctattcatcaacgttacgctttagctgaatcacacgtggcttacactcattcgcttcgagaaatcggtcactctctccatcttttcatcaatcaccaccaccgtttcgtcgcttccggcggcgctaacgtcggtgattctcctcgacttaatcttcctcctcagagaaaaggtgaccttgacgacgaagcaacaaattccccaaaaaaacaaaagcttgcttcttctcaccacaaccacaaccacgctcactcgggttccggttctgattcgggtcatctcgaattcgattcagattccgacgaagatgaagaagacgacgacgacttggatttggattcgttgcatcaccactctcctccccaccaccatctcggcaatttccctattcccgaatcagcaccaatgggcggatacatggaacaacaaccgggttatataaacccgtacccgaatccagatatgatggggcatccttactctggaggaggaagttatatgcacatgaattacatgaagaacaaatccatgcctccttcagttgtctatgagcaaagaccaactagtcctcaacgagtctacataggcgaatcatcatcttcatatccatatcctcctcaaaattcatattttggatactcaaatccagtacccggacccggaccaggatactacggttcttcttctgcttctacaactgctgcagcaacaaaaccgccaccacctccaccgtcgccgcctaggtctaacggttgggattttttgaatccctttgatacttattatcctccgtatactccgagtcgagattcgagagagttaagagaagaagaaggtataccggatttagaagacgatgattcacattacgaagttgttaaagaagtttacggcaaaccaaaattcgccgccggtggtggtcaccaaccaaatcccgccgccgtacacatgatgagggaagagtccccgtctccgccgcttgataaatccggtgctagtactagcggtggaggtgatgtcggagatgcatctgcgtatcagtctagaccaagtgtgtcggtggagaaagaagggatggagtatgaagttcacgttgttgagaagaaggttgttgaagatgaggaacggcggagtaatgccacggcgacacgtggtggtggtggaggaggagggccacgtgcggtgcctgaagttgcgaaagagattgagaatcaattcgtgaaagctgcagagtcaggaagtgagattgctaagttacttgaagttgggaagcatccttatggtcgtaaacatgctgcttcgaagatgttgcacggtgttactccttcgttaccttctacctctggaggaacttcttcgtctgctgctgctgctgttgtgccacctacttatgcagatattgaagaagagcttgcttcgaggtcgaggaatctttcttcgacgttgcacaagctccatctttgggagaagaagctttatcatgaagtcaaggccgaggagaaactgcgtctagctcacgagaaaaagcttaggaagctaaagcgtttggatcaaagaggtgccgaggctatcaaagtagataaaacgcggaaattagtgagagatatgtccacaaaaatacggattgcgattcaggttgtcgacaaaatatccgtgacgattaataagataagagacgaagacctgtggccgcaactgaatgcattgattcaagggcttacaagaatgtggaaaacaatgcttgaatgtcatcaaagtcaatgtcaagctattagggaagcacaaggtttaggcccgataagagcaagcaagaaactaggcgatgaacatctagaagcgacgagtttgcttggacatgaacttattaattggatattgggattctctagctgggttagtgcgcagaagggttatgtaaaagagttgaataaatggctcatgaaatgtcttctgtatgaacctgaggaaacacctgatgggatagttcccttttcacctggtaggattggggctccacctatctttgtcatctgtaaccaatggtctcaagctctggataggatatctgagaaggaagttattgaggcaatgcgtagtttcactacaagtgtgcttcagctttgggaacaagatcggttagatacgatgatgacggggcatggtgattcagagaagaaagtcaggaacatggacagagaagaacagaggatacagagagagattcaagcattggaaaagaaaatgattcttgtggcaccgggtgatggtaacagtctttcgatatccggcaacgttgtttaccaaagcgatactagcagcgatagtttacaaggtagtttgcaacggatttttgaagctatggagagattcactgctgaatcgatgagagcttatgaggatctcttagagcgcaccaatgaagaaactgcaccacgggaacttgaggaagaagaggaggagtaaaaaagcaaaacaggaagaagaggtttgcttgtcaattcaatttgaatcccatgatcgagctgtttgctgatcttgcaatgccagaatactcggttttgcgcgtctgagactcgggc

SEQ ID NO: 110 - protein, 846 aa, Arabidopsis thaliana
  G1082,BZIPT2 domain coordinates 1-53,503-613
MGCTSSKLDDLPAVALCRERCAFLEAAIHQRYALAESHVAYTHSLREIGHSLHLFINHHHRFVASGGANVGDSPRLNLPPQRKGDLDDEATNSPKKQKLASSHHNHNHAHSGSGSDSGHLEFDSDSDEDEEDDDDLDLDSLHHHSPPHHHLGNFPIPESAPMGGYMEQQPGYINPYPNPDMMGHPYSGGGSYMHMNYMKNKSMPPSVVYEQRPTSPQRVYIGESSSSYPYPPQNSYFGYSNPVPGPGPGYYGSSSASTTAAATKPPPPPPSPPRSNGWDFLNPFDTYYPPYTPSRDSRELREEEGIPDLEDDDSHYEVVKEVYGKPKFAAGGGHQPNPAAVHMMREESPSPPLDKSGASTSGGGDVGDASAYQSRPSVSVEKEGMEYEVHVVEKKVVEDEERRSNATATRGGGGGGGPRAVPEVAKEIENQFVKAAESGSEIAKLLEVGKHPYGRKHAASKMLHGVTPSLPSTSGGTSSSAAAAVVPPTYADIEEELASRSRNLSSTLHKLHLWEKKLYHEVKAEEKLRLAHEKKLRKLKRLDQRGAEAIKVDKTRKLVRDMSTKIRIAIQVVDKISVTINKIRDEDLWPQLNALIQGLTRMWKTMLECHQSQCQAIREAQGLGPIRASKKLGDEHLEATSLLGHELINWILGFSSWVSAQKGYVKELNKWLMKCLLYEPEETPDGIVPFSPGRIGAPPIFVICNQWSQALDRISEKEVIEAMRSFTTSVLQLWEQDRLDTMMTGHGDSEKKVRNMDREEQRIQREIQALEKKMILVAPGDGNSLSISGNVVYQSDTSSDSLQGSLQRIFEAMERFTAESMRAYEDLLERTNEETAPRELEEEEEE

SEQ ID NO: 111 - DNA, 2535 bp, Arabidopsis thaliana
  G1084,family:BZIPT2
atgggatgttctcattccaagttagatgatgaagaagcagttcagatctgtaaagacaggaaacgtttcatcaaacaagctattgaacatagaactaagtttgcttctggtcacattgcttatattcactctcttagaaaagtctctgatgctctccatgactttatcctccaaggagacaacaacaatgagtttgttcctactctctgtcaagactcattcgtcactccggtcaagagaatgccacagagacgtcgtcgaagcagccgtagtaatagcggtgagttcatctccatttcgccttcttcgattcctccgaaaatgattcaaggtaggccaagatcgaatgtgaaagcgaattatttgatggctaatagaagtagaccggttagagtcgaacagagatctcctgaaacgtttagagttgagacattttctccacctagtagtagtaaccaatatggtgaatcagatggtttctttggaatgaatatgaatatgaatacttctgcgtctacttcatcttcgttttggaatccgttgagctctcctgagcaaaggttaagtagtcataacattcctcctccttcaccgcagaattcgcagtgggatttcttctggaatccgttttcttcgttggattattatggatacaatagttatgaccgaggaagtgttgatagtaggagtggtatagatgatgagattagaggattgagacgtgttagagaggaagaagggattcctgatttggaagaagatgatgaacctcataaacctgaacctgtcgtcaatgtgcggtttcagaatcataatccgaatccgaaagcaacggaagagaatagaggtaaagttgataagagttgttgcaatgaggaagttaaagttgaagatgttgatgaggatgaagacgaggatggagatgaggatgatgatgagtttacggatagcgggtgtgagactgagaatgagggagacgagaaatgcgttgctcctccaacgcaagaacagcgaaaagctgaggtgtgtagaggaggagaagctacagggaatgttgttggagtaggtaaggttcaagagatgaagaatgttgttggtgttagagatgatgcaaagacgacggggttcacggtatatgtgaaccggagaccaactagcatggctgaagtaatcaaagatcttgaagatcagttcacaacaatttgtgatgcggctaaggaagtctcggggctattggaagctggtagagctcaatacacatcatcctttaatgaccatagtggtgagtttatgaacaatgttgcaatatttctctccaggaaaatgctgaatccagtagcgttgttccgctcgggttcatcaagatcttcctcgtcaagattcttgatcacttcttctggtggttcaagagagagcgggtctgaaagcagaagcgatgtttcagatgaatcttgcatgatttcaggtagccaccaaacaacattggacagacttttcgcgtgggagaagaaactctatgatgaagttagggtaagtaacaagagatataagcaactatctggagaacgtgttcgaagagcatatgaaaagaaatgtatgcagctgaggaatcaggacgtgaaaggagatgatccgcttgcggttgataaaactagggctactatcagagatctagatacacagatcaaggtgtcaatacactccattgaatccatctccaaaagaatcgagactcttcgtgaccaagaactgttgcctcagcttcttgagctcgttgaaggactgacaaatggtaatcatgatcataacagattaacaaggatgtggaaagtaatggcggaaagtcaccagatacagaaacgaacactagacgaagccaaactgttacttgcaggcacaccggtttcaaagcgtcacaagaagagacaacctccaataatgccagaggctattaactctcaaagattagctcaatctgctttgaatcttgaagctcagcttcgaaactggagaacctgttttgaattctggatcacctctcagagatcctacatgaaagcattatctggttggcttctaagatgtttcagatgtgatcctgaccccgaaaaagttagattatcctcatgtcttcacccgatataccgagtctgcattcaatggtcaaggttgcttaacagcttgaatgaaaaaccagttttggacaaacttgagttctttgcctcagggatgggttcaatatatgcaaggcaagttagggaagatccaaactggagtggaagcgggtcaaggagatactccgggtcagaaagcatggagcttgtagtggctgataagggagaagaagatgttgtgatgactgctgagaaacttgcagaggttgctgtgaaggttctctgccatggaatgtctgttgcagttagttcactagctgagttttccatcaactcggccgatgaacactcgaagcttgttagccaaccagcagacgatgcgtcggagcagcagcccccggatgtaaatttcaattcctag

SEQ ID NO: 112 - protein, 844 aa, Arabidopsis thaliana
  G1084,BZIPT2 domain coordinates 1-53,490-619
MGCSHSKLDDEEAVQICKDRKRFIKQAIEHRTKFASGHIAYIHSLRKVSDALHDFILQGDNNNEFVPTLCQDSFVTPVKRMPQRRRRSSRSNSGEFISISPSSIPPKMIQGRPRSNVKANYLMANRSRPVRVEQRSPETFRVETFSPPSSSNQYGESDGFFGMNMNMNTSASTSSSFWNPLSSPEQRLSSHNIPPPSPQNSQWDFFWNPFSSLDYYGYNSYDRGSVDSRSGIDDEIRGLRRVREEEGIPDLEEDDEPHKPEPVVNVRFQNHNPNPKATEENRGKVDKSCCNEEVKVEDVDEDEDEDGDEDDDEFTDSGCETENEGDEKCVAPPTQEQRKAEVCRGGEATGNVVGVGKVQEMKNVVGVRDDAKTTGFTVYVNRRPTSMAEVIKDLEDQFTTICDAAKEVSGLLEAGRAQYTSSFNDHSGEFMNNVAIFLSRKMLNPVALFRSGSSRSSSSRFLITSSGGSRESGSESRSDVSDESCMISGSHQTTLDRLFAWEKKLYDEVRVSNKRYKQLSGERVRRAYEKKCMQLRNQDVKGDDPLAVDKTRATIRDLDTQIKVSIHSIESISKRIETLRDQELLPQLLELVEGLTNGNHDHNRLTRMWKVMAESHQIQKRTLDEAKLLLAGTPVSKRHKKRQPPIMPEAINSQRLAQSALNLEAQLRNWRTCFEFWITSQRSYMKALSGWLLRCFRCDPDPEKVRLSSCLHPIYRVCIQWSRLLNSLNEKPVLDKLEFFASGMGSIYARQVREDPNWSGSGSRRYSGSESMELVVADKGEEDVVMTAEKLAEVAVKVLCHGMSVAVSSLAEFSINSADEHSKLVSQPADDASEQQPPDVNFNS

SEQ ID NO: 113 - DNA, 838 bp, Arabidopsis thaliana
  G1090,family:AP2
aaactaattcgcacagttctatatacactcacaaacacacacacacacaatatagtgctactaaaataaccttgtattaattatggaaaacacttacgttggccaacgagattaccgcttcaacgttaaccagttgtcctacagaggcattcgtcggaggaaatggggcaaatgggtatcggagatccgagaacccggtaagaaaacaaggatttggcttggaagctacgagacggccgagatggctgcagcggcctacgatgctgcggctcttcacctccgaggacgtgggaccaatctcaactttccggaactcgtcgacagttttcctcggccggaaagctctagttcggagcacattcaagcggctgcacaagatgcagcacttatgtttaaaccaggtaggttgagtgaaccagctctcgagtctggtcaaggactttctcgagtaggattgtctccggatcagattcaagcgattaatgagtctccattagactcgccgaggatggggtggatgcaggatttggaagttgctgactacgaagaattatacggacaattttttggtcagcacgatagggatgagttttttgaaatgcagcaatttcagtccatatggaattctaataattgatatacgttcgcttaattgcttaaccatttgattttttttttaataatgtcatatcatcaaccaaggtttttcgattatattcagtaaagtataataaattttcgacccttactgtttttcttgggttcaatttgtaatctcttaacaatgatgatgtcataaataccaatatgattaattcaaattttcaaaaaaaaaaaa

SEQ ID NO: 114 - protein, 184 aa, Arabidopsis thaliana
  G1090,AP2 domain coordinates 17-84
MENTYVGQRDYRFNVNQLSYRGIRRRKWGKWVSEIREPGKKTRIWLGSYETAEMAAAAYDAAALHLRGRGTNLNFPELVDSFPRPESSSSEHIQAAAQDAALMFKPGRLSEPALESGQGLSRVGLSPDQIQAINESPLDSPRMGWMQDLEVADYEELYGQFFGQHDRDEFFEMQQFQSIWNSNN

SEQ ID NO: 115 - DNA, 909 bp, Arabidopsis thaliana
  G1100,family:RING/C3H2C3
atggtgcagcctggaaccgagataaaagcaagcgacctaaccctactagtaatcacgattatactcttcgcaatcttcatcgttggcttggcttcggtttgcttccgctggacctctcgccaattttactcacaagaatccatcaaccctttcactgactccgacgttgaatcccgtacgagtattacggcggtgcgtgggctcgacgaggctatcatcaactcatttccgacgtttctctactcggaggtgaaggagcggagaatcgggataggtggcgtcgagtgtgcagtgtgtatctgtgagttcgaagaccatgaaacgctccgtttgatgcctgaatgctgccacgtgtttcatgctgattgtgtaagtgtctggctctctgatcactccacgtgtccactctgtcgtgtggatctttgcttacaaccgggtgagagaagctacttgaatccggaaccggatcttgtagaatctacaaactcgcatttgtttgatggtgtgacgtggaccaataggaacagaccgtctcggtcatggtcaacgagattgtctcaatgtcgagtctcccagatattaatctcgagatcgcattcgaccggacattctgtggttcaaccgctagataatttagaccggtttacgcttcggttaccagaagaagtccggaggcaactgacgaaaaaaacggtggacaacgtggcattttctcaggctaggagctcacggcgtggttacagaagcagaagtgccggaagcgagaggagtgtcttctcgtaccaacggcggatgcattccttctctgattgtgcatggtccacctcctgtggcggagaagcggtggctccgtcaaaggattcccgccgaatatcagttgaacaatcccagctagatgatcgagtgtag

SEQ ID NO: 116 - protein, 302 aa, Arabidopsis thaliana
  G1100,RING/C3H2C3 domain coordinates 96-137
MVQPGTEIKASDLTLLVITIILFAIFIVGLASVCFRWTSRQFYSQESINPFTDSDVESRTSITAVRGLDEAIINSFPTFLYSEVKERRIGIGGVECAVCICEFEDHETLRLMPECCHVFHADCVSVWLSDHSTCPLCRVDLCLQPGERSYLNPEPDLVESTNSHLFDGVTWTNRNRPSRSWSTRLSQCRVSQILISRSHSTGHSVVQPLDNLDRFTLRLPEEVRRQLTKKTVDNVAFSQARSSRRGYRSRSAGSERSVFSYQRRMHSFSDCAWSTSCGGEAVAPSKDSRRISVEQSQLDDRV

SEQ ID NO: 117 - DNA, 1511 bp, Arabidopsis thaliana
  G1108,family:RING/C3H2C3
gtgtggtatgcgcaaagtggacaatacctagatgggtgtttctcttctgaaacaacaacatcgtattacaaatcaagctgatactttttctagattcatggaaagatcaccagagaataatctaagcagaaatgagcacatcatcattgacattccaagaaatgccgccattgcatcatcatcatcttctcatgatagaatctcaaatgttttggaacctttacaacatgaggaagagagaccttctactgtttctcccatggctgctcctcagccagctacagctacagcttcttcttcttcttctatgcgatcaaatcctagaagtgtccgtcgtagaagaagtcctttgaattctggcttatggatttctattgaactattcctcactgttggtcagatcattgcagctattgtcgttttgtctttgtcaaaacatgagcatcctcgtgctcctttgttcacttggattgttggttatgcgtgtggatgcgttgctacactcccgcttttgtactggagatattatcattcgaatcaggcttctgaacaggattctggtcagcaccgtcctaatcttaatgttgcagcaggaccattcgccttctcgatatccaggacatccgaagcagatggtcgacagaccaataccacctcttctcgtggtagtagatatcctgggtttataagtgctgccagacttaaagttatcgtggaatacttcaaaatggctctggattgcttctttgcggtgtggtttgtggtaggtaatgtatggatatttggagggcattcatctgctgccgaggctcctaacttgtacaggttatgtttagtgtttcttacctttagctgtattggctacgcgatgcccttcatcctctgtacaacaatatgttgctgcttgccttgcataatctcaattctcggatatagagaagatttaacgcaacctcgaggtgccacacctgagtcgattaatgcgttgccgactcataaatttaagttgaagaaaagcagaagtaatggcgatgacaatggttcaagtactagcgaaggtggagttgtggcggctggaacagataacgaacgagctatttcaggagaggacgcagtctgttgcatttgcttagcgaaatatgcgaataacgaggagttaagagagcttccatgctcacatttcttccacaaagagtgcgttgacaaatggctgaagatcaatgcctcttgccctctatgcaagagcgaagttggggagaagaactctgatttgactagccaagggatcttaacctcgctctcttctggggaaaacgataaccatcaacaacagcaacaacaacaacggagtgaacttagagttgagaatggtttggccaataatgttatctagatcttcgagatttgctctatgtccgagaaaacggcaaattagccgtttggcgatgttcctacacaaaatggggtttgcttctcattgctaagaaggtgaagaaagacacggcgaagat

SEQ ID NO: 118 - protein, 453 aa, Arabidopsis thaliana
  G1108,RING/C3H2C3 domain coordinates 363-403
MGVSLLKQQHRITNQADTFSRFMERSPENNLSRNEHIIIDIPRNAAIASSSSSHDRISNVLEPLQHEEERPSTVSPMAAPQPATATASSSSSMRSNPRSVRRRRSPLNSGLWISIELFLTVGQIIAAIVVLSLSKHEHPRAPLFTWIVGYACGCVATLPLLYWRYYHSNQASEQDSGQHRPNLNVAAGPFAFSISRTSEADGRQTNTTSSRGSRYPGFISAARLKVIVEYFKMALDCFFAVWFVVGNVWIFGGHSSAAEAPNLYRLCLVFLTFSCIGYAMPFILCTTICCCLPCIISILGYREDLTQPRGATPESINALPTHKFKLKKSRSNGDDNGSSTSEGGVVAAGTDNERAISGEDAVCCICLAKYANNEELRELPCSHFFHKECVDKWLKINASCPLCKSEVGEKNSDLTSQGILTSLSSGENDNHQQQQQQQRSELRVENGLANNVI

SEQ ID NO: 119 - DNA, 1311 bp, Arabidopsis thaliana
  G1137,family:HLH/MYC
tacttcagacttctactcaaaccagtcacgtagttggttggtgacatttcgctgcatttttcaatctgtgattgtttttcgttcgtctttcttttactattttctcgaaaaggacacaagaagtattgcattcactcagttgagcaacttaacaatcgtgttgtactttttgaagttcccttgagctaaactgctaagagcatgcctctggataagaggcaacgggatttgcctctgggcttaagtcctcaagcttgcttcaaggatatagtaggtcggtctgtccttcctagaattcctctccctgagcttgggaaactatatgcagctaagcttcaggctcgctgtttgcagccaccaccattccagtctttgctgtgcagtcatgataaggagtcttatggaaaaagattctcacggtctgacatgcggtcttggtgcgctgctgctactactactactactccacttggagcattagagtcttctcagaaaagacttttgatattcgatcagtcaggagaccagactcgtctattacaatgtccatttcctctacggtttccatctcatgcggctgcagaaccagtgaaactctctgagttacaaggtatagagaaagctttcaaagaagatggtgaagagtttcacaagagtgatggaacagagtcagaaatgcatgaagacactgaggagatcaatgcattgctatattcagatgatgattatgatgatgattgcgagagtgatgatgaagtaatgagcactggtcactctccttatccaaatgaaggagtttgcaacaaaagggaattagaagaaatcgatggtccttgtaaaaggcagaaactactggataaggtcaacaacatcagcgacttatcatcacttgtgggcactgagagctccacacaactcaatggatcttcctttcttaaggacaaaaagctccctgaatcaaaaaccatatcgaccaaagaggacactggttctggtctgagcaacgagcagtcgaagaaagacaagatccgcacagctctgaaaatactcgagagcgtagtccctggtgcaaaaggaaacgaagcgctcttacttctggacgaagcaattgattacctaaagttgctgaaacgagacttaatctccacagaggttaagaaccaaagctccaccactcacaagtcaccaatcttgttgcttaaagagacaacatggggaacaagaaatctgcagacagataaggcgtgaaagattctgacgagttaaaacgtgtgaagtgggtttttgggtacgtatccttgcaccagcttt

SEQ ID NO: 120 - protein, 348 aa, Arabidopsis thaliana
  G1137,HLH/MYC domain coordinates 257-314
MPLDKRQRDLPLGLSPQACFKDIVGRSVLPRIPLPELGKLYAAKLQARCLQPPPFQSLLCSHDKESYGKRFSRSDMRSWCAAATTTTTPLGALESSQKRLLIFDQSGDQTRLLQCPFPLRFPSHAAAEPVKLSELQGIEKAFKEDGEEFHKSDGTESEMHEDTEEINALLYSDDDYDDDCESDDEVMSTGHSPYPNEGVCNKRELEEIDGPCKRQKLLDKVNNISDLSSLVGTESSTQLNGSSFLKDKKLPESKTISTKEDTGSGLSNEQSKKDKIRTALKILESVVPGAKGNEALLLLDEAIDYLKLLKRDLISTEVKNQSSTTHKSPILLLKETTWGTRNLQTDKA

SEQ ID NO: 121 - DNA, 1357 bp, Arabidopsis thaliana
  G1145,family:bZIP
gtgatttctctctgccatttccttcgatttgatttctgggttctcttcttctcgtctctcttctgcatgtttcgccactctaccttagaaaaaaggttactttcgcctccgatttaggctcgatttgatgaattcgtcgtcgtgtggctatttatcaaattgagcattagggtttctgatttgtgggttcagaattgtttttatctatctgtcttgttgttttttgtccgctacaaaagcctatggattctcagaggggtattgttgaacaagctaaatctcagtccttgaataggcaaagctctctttacagcttaacacttgatgaggttcaaaatcacttggggagttctggtaaagctctgggaagcatgaaccttgatgagcttttgaagagtgtctgttctgttgaagctaatcagccatcgtctatggctgtcaatggtggagcagctgctcaggagggtctttctcgccaggggagtttgactttgcctcgggatctcagcaaaaagactgttgatgaggtttggaaagacattcagcagaataagaatggaggtagtgctcatgagaggagggataagcagcctacacttggggaaatgacgcttgaagacctgttgttgaaagcaggagtggtcactgagactatccctggttcgaaccatgatggtcctgttggtggtggtagtgctggttcaggtgctggtttagggcaaaacattactcaagttggcccatggattcaatatcatcagctcccatcaatgccacagcctcaagcatttatgccctatccggtttcagatatgcaagcaatggtgtctcagtcttctttgatgggtggtttgtcagatacacaaactcctggaaggaagagggtagcttcaggagaagttgtagagaagactgtagagaggaggcagaagagaatgataaagaacagagagtctgctgctcgttcccgagctaggaaacaggcttacactcatgagctagagatcaaagtttcacggttagaagaagaaaacgaaagactcaggaagcaaaaggaggtggaaaaatcctcccaagtgtaccaccgcctgatcccaagcggcagctccgacggacaagctcggctcctttctgatctctaaactctttttgtctttttctttttttctcttctgtgtcggttcacttataaaaaagagaggaaaacagctttgtttctttgtacattccgtagactttcttgacttggagcaattctgttaactttaaaatattctcgagttattgtagtagcagactagcagcagtaatggttttcatgagtccgattgaaattcagagattgaacaggaaaaaa

SEQ ID NO: 122 - protein, 299 aa, Arabidopsis thaliana
  G1145,bZIP domain coordinates 227-270
MDSQRGIVEQAKSQSLNRQSSLYSLTLDEVQNHLGSSGKALGSMNLDELLKSVCSVEANQPSSMAVNGGAAAQEGLSRQGSLTLPRDLSKKTVDEVWKDIQQNKNGGSAHERRDKQPTLGEMTLEDLLLKAGVVTETIPGSNHDGPVGGGSAGSGAGLGQNITQVGPWIQYHQLPSMPQPQAFMPYPVSDMQAMVSQSSLMGGLSDTQTPGRKRVASGEVVEKTVERRQKRMIKNRESAARSRARKQAYTHELEIKVSRLEEENERLRKQKEVEKSSQVYHRLIPSGSSDGQARLLSDL

SEQ ID NO: 123 - DNA, 3323 bp, Arabidopsis thaliana
  G1146,family:PAZ
cttctctagcgtcactcttcttcttcattggtcggtagaataaggccaaggaagggatcagttttaagttttgtttcattctttttgtagtggagaaaaagagtttttgaaaatcaaaacaacaaaaaatgccgattaggcaaatgaaagatagctctgagactcacttagttatcaaaacccaacctttaaagcaccacaatccaaaaaccgttcaaaacggtaaaatccctcctccttctccttctccggtgacggtgactactccggcgacggttactcagagtcaagcttcttcaccttcaccaccgtcaaagaatcgtagccggaggagaaaccgtggtggaagaaaatctgatcaaggagatgtttgtatgagacctagctctcgtcctcgtaaaccgccaccgccaagtcaaaccacttcctccgccgtctccgtcgccaccgccggtgagattgtcgctgtgaatcatcagatgcagatgggtgttcgtaaaaactcaaactttgctccaagacctggatttggaacacttggaactaaatgcattgttaaagctaaccactttctcgctgatttgcctaccaaggatttgaatcagtatgatgttacaattactcctgaagtgtcatcaaagagtgttaacagagctataattgctgagttagttagactttacaaagagtctgatctcgggaggagacttccggcttacgatggccggaaaagtctttacactgctggagaacttccttttacttggaaggagttcagtgttaagattgttgatgaagatgacggtatcatcaatggccctaaaagggagagatcatataaggtggcaatcaagtttgttgcacgggcaaatatgcatcacttaggcgagtttctagctggtaaacgggcagattgtccgcaagaggcggtgcagattcttgatattgtactcagggagttgtcggttaagaggttttgtcccgttggaagatctttcttttcgcctgatattaaaacaccgcagcgactcggtgaagggttagagtcatggtgtgggttttaccagagtattagaccaactcaaatgggtttatcactaaatatcgatatggcttcagctgcattcatcgagcctcttccagtgatagagtttgtagcacagcttcttggaaaggatgtcttgtcgaagccattgtcggattctgatcgcgtcaagattaagaagggtcttagaggagtgaaagtagaggttactcacagagcgaatgtaagaaggaaataccgtgttgcgggtttaacaactcaaccaacaagagagctaatgtttccagtagatgagaactgtactatgaagtcagttattgagtatttccaagagatgtatggattcacgatccagcacacgcatttgccatgtctccaagttggaaaccaaaagaaggcaagctatttgccgatggaggcatgcaaaattgtcgagggacaacggtacacgaaaaggttgaatgagaagcagattactgctctcttgaaagttacatgccaaagggccgagggacagagaaacgatattttgcggactgtccaacacaacgcatatgatcaagatccatatgcaaaggagtttggcatgaacataagcgaaaagttagcttctgttgaagctcgtattcttccagctccatggcttaagtatcacgagaacgggaaagaaaaagattgtctcccgcaagttggtcagtggaatatgatgaacaagaaaatgatcaacgggatgactgtgagcagatgggcctgtgttaacttctcacgcagcgttcaagaaaacgttgctcgtggattttgtaatgaacttggtcagatgtgtgaagtctcaggcatggagtttaatccagaacccgtgataccaatatatagtgcgaggcccgatcaagtcgagaaagctctaaagcatgtttatcacacttcaatgaacaaaaccaaaggcaaagagttagagcttctgctggcaatattacctgataacaacggttcactttatggtgatcttaagagaatctgtgaaaccgagcttggtttgatatctcaatgttgtctcacaaaacatgtgttcaagattagcaaacagtatctggcagatgtatcccttaaaatcaacgtaaagatgggaggaaggaacacagttctagtagacgccataagctgtagaattccactggttagcgatataccgacaatcatttttggcgcagacgtgactcacccagagaacggggaagagtcaagcccttcaatcgctgctgttgttgcttctcaagactggcctgaagtgacaaaatatgcgggtttagtttgtgctcaagctcacaggcaagaacttatacaagatttgtataaaacatggcaagatcctgttcgcggtactgttagtggcggtatgatcagggaccttcttatctcatttagaaaagcaacagggcaaaaaccgcttcgaattatcttttatcgtgatggagtaagcgaagggcaattctatcaagttttactctatgagttggatgcaattcgaaaggcttgtgcatcgcttgaaccgaattatcagccaccggtgacattcatagttgtacagaagcgtcaccacactcgtttgtttgctaataatcaccgagacaaaaacagtactgaccgaagcggaaatatcttaccaggtactgtagttgacactaaaatatgtcatccaactgaattcgacttctacctttgtagccatgcgggtattcagggaacaagcaggcctgcacattaccatgttctttgggacgagaacaatttcacagcagatggtattcaatctctgactaacaatctctgttatacctatgcgcggtgcactcggtcggtctctatagttcctccagcgtattatgctcatcttgcagcatttcgagcacgtttctacctggaacctgagataatgcaagacaacggatcaccgggtaaaaagaacacgaaaacaacaactgtcggagacgtaggtgtgaagcctttaccagccttgaaggagaatgtgaagagagtaatgttctactgctaaaaatccaaacattccttaatcagttttaataagtagtttggttgtttgcttgtagttcggctttagatttaccaatgtttttcttatgtaaattttgtcggtttggtttaagcctttaggaattagtgtattagggtttttctaaagttgtactttagctgatgataacgttgatgcagtgactttgttaaaacctcctcttctacagtagtgtttacgtcgttcctc

SEQ ID NO: 124 - protein, 988 aa, Arabidopsis thaliana
  G1146,PAZ domain coordinates 886-896
MPIRQMKDSSETHLVIKTQPLKHHNPKTVQNGKIPPPSPSPVTVTTPATVTQSQASSPSPPSKNRSRRRNRGGRKSDQGDVCMRPSSRPRKPPPPSQTTSSAVSVATAGEIVAVNHQMQMGVRKNSNFAPRPGFGTLGTKCIVKANHFLADLPTKDLNQYDVTITPEVSSKSVNRAIIAELVRLYKESDLGRRLPAYDGRKSLYTAGELPFTWKEFSVKIVDEDDGIINGPKRERSYKVAIKFVARANMHHLGEFLAGKRADCPQEAVQILDIVLRELSVKRFCPVGRSFFSPDIKTPQRLGEGLESWCGFYQSIRPTQMGLSLNIDMASAAFIEPLPVIEFVAQLLGKDVLSKPLSDSDRVKIKKGLRGVKVEVTHRANVRRKYRVAGLTTQPTRELMFPVDENCTMKSVIEYFQEMYGFTIQHTHLPCLQVGNQKKASYLPMEACKIVEGQRYTKRLNEKQITALLKVTCQRAEGQRNDILRTVQHNAYDQDPYAKEFGMNISEKLASVEARILPAPWLKYHENGKEKDCLPQVGQWNMMNKKMINGMTVSRWACVNFSRSVQENVARGFCNELGQMCEVSGMEFNPEPVIPIYSARPDQVEKALKHVYHTSMNKTKGKELELLLAILPDNNGSLYGDLKRICETELGLISQCCLTKHVFKISKQYLADVSLKINVKMGGRNTVLVDAISCRIPLVSDIPTIIFGADVTHPENGEESSPSIAAVVASQDWPEVTKYAGLVCAQAHRQELIQDLYKTWQDPVRGTVSGGMIRDLLISFRKATGQKPLRIIFYRDGVSEGQFYQVLLYELDAIRKACASLEPNYQPPVTFIVVQKRHHTRLFANNHRDKNSTDRSGNILPGTVVDTKICHPTEFDFYLCSHAGIQGTSRPAHYHVLWDENNFTADGIQSLTNNLCYTYARCTRSVSIVPPAYYAHLAAFRARFYLEPEIMQDNGSPGKKNTKTTTVGDVGVKPLPALKENVKRVMFYC

SEQ ID NO: 125 - DNA, 1071 bp, Arabidopsis thaliana
  G1197,family:GARP
cagccgagaaaataaaagaaacgaagaaaagtttgttcctttgtggggatcaaagaagaatgtactcggcgattcggtcttcgcttcctctagatggcagcttgggagactactctgacggaaccaatcttcccatcgacgcttgtctggtcctaaccactgaccccaagcctcgccttcgttggacctctgagctccatgaaagattcgttgacgccgtcactcagctcggcggacccgacaaagcaacgcctaaaactataatgagaacaatgggagtgaagggtctcactctttaccatctcaaatctcatcttcagaaattccgcttggggaggcaatcttgtaaagaatcaattgacaactctaaggatgtttcttgtgttgcggagagtcaggacactggttcatcttcaacatcatccttaagattggctgctcaagaacagaacgagagttaccaggtcactgaagctttgcgtgcccagatggaagtccaaagaagactacacgagcaactagaggtgcaaaggcgactccagttaaggatcgaggcacaagggaagtacctgcaatcaattctagagaaagcttgcaaggctatagaggagcaagctgttgcatttgctgggttagaggcagctagagaagagctttcagagctagccataaaggcctccatcaccaatgggtgccaaggaacaacaagcaccttcgacacaaccaaaatgatgattccatccttatccgagcttgcagtagcaatagagcacaagaacaactgttcagcagagagctctctgacttccagcactgtaggaagtccggtatcagctgcgttgatgaagaagagacaacgaggagtgtttggaaatggagatagtgtggttgttggtcatgatgctggatgggttatgcctagtagtagcattggatgaagttagcaagagagagagagagagcgagaccagattttagcttatttaattttgctatgttgtatttaactctaaactctgtcatcaaacttgtcttagcgtctatgtatatatttgttgaatctaaaaaaaa

SEQ ID NO: 126 - protein, 292 aa, Arabidopsis thaliana
  G1197,GARP domain coordinates NA
MYSAIRSSLPLDGSLGDYSDGTNLPIDACLVLTTDPKPRLRWTSELHERFVDAVTQLGGPDKATPKTIMRTMGVKGLTLYHLKSHLQKFRLGRQSCKESIDNSKDVSCVAESQDTGSSSTSSLRLAAQEQNESYQVTEALRAQMEVQRRLHEQLEVQRRLQLRIEAQGKYLQSILEKACKAIEEQAVAFAGLEAAREELSELAIKASITNGCQGTTSTFDTTKMMIPSLSELAVAIEHKNNCSAESSLTSSTVGSPVSAALMKKRQRGVFGNGDSVVVGHDAGWVMPSSSIG

SEQ ID NO: 127 - DNA, 1780 bp, Arabidopsis thaliana
  G1198,family:bZIP
tcttttcaaattccaatcatttgatcaactaatcaagaattaattataagactttgcaatctctctccctctccctctccctagctagttctctcttgtgtttcttaactcgagcttctctcaatagtgattatcatctttttcatcatttcaagatttaatgtgttttgcagaaaagagactaatcaagaagagatatcatcaattgaagctgttttcttgagtagagatggcgaaccatagaatgagcgaagctacaaaccataaccacaatcatcatcttccttattcacttattcatggtctcaacaacaatcatccatcttctggtttcattaaccaagatggatcgtccagtttcgattttggagagctagaagaagcaattgttctgcaaggtgtcaagtataggaacgaggaagccaagccacctttattaggaggaggaggaggagctacgactctggagatgttcccttcgtggccaatcagaactcaccaaactcttcctactgagagttccaagtcaggaggagagagcagcgattcaggatcggctaatttctccggcaaagctgaaagtcaacaaccggagtctcctatgagtagcaaacatcatctcatgcttcaacctcatcataataacatggcaaactcaagttcaacatctggacttccttccacttctcgaactttagctcctcctaaaccttcggaagataagaggaaggctacaacttcaggcaaacagcttgatgctaagacgttgagacgtttggcccaaaatagagaagctgctcgcaaaagccgtcttaggaaaaaggcgtatgtgcaacagctagaatcaagtaggataaagctttcccaattggagcaagaacttcagcgagctcgttctcaggggctgttcatgggtggttgtggaccaccaggacctaacatcacttccggagctgcaatatttgacatggaatatgggagatggctagaggatgataaccggcatatgtcggagattcgaaccggtcttcaggctcatttatctgacaatgatttaaggttgatcgttgacggttacattgctcattttgatgagatattccgattaaaagccgtggcagcgaaagccgatgtttttcacctcatcattgggacatggatgtccccagccgaacgttgttttatttggatggctggtttccgtccatccgacctaatcaagatattggtgtcgcaaatggatctattgacggagcaacaactgatgggaatatatagcctacaacactcgtcgcaacaagcagaggaggctctctcgcaaggcctcgaacaacttcagcaatctctcatcgatactctcgccgcatctccagtcattgacggaatgcaacaaatggctgtcgctctcggaaagatctctaatctcgaaggctttatccgccaggctgataacttgaggcagcagaccgttcaccagctgaggcggatcttgaccgtccgacaagctgcacggtgtttcctagtcatcggagagtactatggacggctcagagctcttagctccctttggttgtcacgcccacgagagacactgatgagtgatgaaacctcttgtcaaacgacgacggatttgcagattgttcagtcatctcggaaccacttctccaatttctgaatggaatgaaactttgtataactaaaaggccaagtttcattgtctgtcgtaatttcacctatttcctttaaagttgtactagagaaaagataggatcttccttcg

SEQ ID NO: 128 - protein, 481 aa, Arabidopsis thaliana
  G1198,bZIP domain coordinates 173-223
MANHRMSEATNHNHNHHLPYSLIHGLNNNHPSSGFINQDGSSSFDFGELEEAIVLQGVKYRNEEAKPPLLGGGGGATTLEMFPSWPIRTHQTLPTESSKSGGESSDSGSANFSGKAESQQPESPMSSKHHLMLQPHHNNMANSSSTSGLPSTSRTLAPPKPSEDKRKATTSGKQLDAKTLRRLAQNREAARKSRLRKKAYVQQLESSRIKLSQLEQELQRARSQGLFMGGCGPPGPNITSGAAIFDMEYGRWLEDDNRHMSEIRTGLQAHLSDNDLRLIVDGYIAHFDEIFRLKAVAAKADVFHLIIGTWMSPAERCFIWMAGFRPSDLIKILVSQMDLLTEQQLMGIYSLQHSSQQAEEALSQGLEQLQQSLIDTLAASPVIDGMQQMAVALGKISNLEGFIRQADNLRQQTVHQLRRILTVRQAARCFLVIGEYYGRLRALSSLWLSRPRETLMSDETSCQTTTDLQIVQSSRNHFSNF

SEQ ID NO: 129 - DNA, 1196 bp, Arabidopsis thaliana
  G1228,family:HLH/MYC
gcatttataattactcactcatcttcttttcattacattacataccaaacaagagctctcaaatggaaaggtttcaaggacacatcaacccctgtttcttcgatcgaaaaccggatgtgagaagcctcgaggttcaaggatttgcagaggctcaaagctttgctttcaaagaaaaagaggaagaaagcttacaagatacagttccatttctacagatgctgcaaagtgaagacccctcatcgtttttttcaatcaaagagccaaactttctgacgctactgtctcttcaaaccctcaaggagccttgggaactcgaaagatatctttcacttgaggattcacaatttcattcaccggtccaatctgagaccaaccgcttcatggaaggagccaatcaagctgtgtcaagccaagaaattccctttagccaagcaaacatgacactcccttcttctacctcatcaccactcagtgcacattcaagacgaaagcgcaaaatcaaccacttgctgcctcaagaaatgactagagaaaagagaaagaggaggaaaacaaaaccaagtaaaaacaatgaagagattgagaatcaaagaataaaccacattgctgttgaacgaaacagaagacgtcaaatgaacgaacatatcaactctctccgggcccttctcccaccttcctacatccaacgaggagaccaagcttccatagtaggaggagcaataaactacgtgaaggtcctcgagcaaatcatacaatctctcgaatcgcaaaagagaacgcaacaacaaagtaacagtgaggtagtagaaaacgcacttaatcatctctcaggcatttcgtcgaacgacctgtggacaactcttgaagatcaaacttgtatccccaaaatcgaagctacagtgatacaaaaccatgtcagccttaaagttcaatgtgagaagaaacaaggacaacttctcaaaggaatcatatcacttgaaaagcttaaactcactgttcttcatctcaatatcactacttcgtctcattcctctgtttcttattccttcaacctcaagatggaagatgagtgcgacttagagtcagccgacgagattacggcggctgttcatcggattttcgatattccgacaatttgattaaacacatataattccaaaaatattaacagctgacaaaatggtatctttgcggcc

SEQ ID NO: 130 - protein, 358 aa, Arabidopsis thaliana
  G1228,HLH/MYC domain coordinates 172-231
MERFQGHINPCFFDRKPDVRSLEVQGFAEAQSFAFKEKEEESLQDTVPFLQMLQSEDPSSFFSIKEPNFLTLLSLQTLKEPWELERYLSLEDSQFHSPVQSETNRFMEGANQAVSSQEIPFSQANMTLPSSTSSPLSAHSRRKRKINHLLPQEMTREKRKRRKTKPSKNNEEIENQRINHIAVERNRRRQMNEHINSLRALLPPSYIQRGDQASIVGGAINYVKVLEQIIQSLESQKRTQQQSNSEVVENALNHLSGISSNDLWTTLEDQTCIPKIEATVIQNHVSLKVQCEKKQGQLLKGIISLEKLKLTVLHLNITTSSHSSVSYSFNLKMEDECDLESADEITAAVHRIFDIPTI

SEQ ID NO: 131 - DNA, 1284 bp, Arabidopsis thaliana
  G1245,family:MYB-(R1)R2R3
atggggaaagttcgtcaagattcaggatcagacgatgacaattcaataaagaaatcttttactaaaggtccttggacacaagcagaagacaatcttttgatagcttacgttgataaacatggtgatggaaactggaacgctgttcaaaacaactcgggcctttctcgttgtggtaaaagttgtcgccttcgttgggtaaatcatctgagaccagatttgaaaaaaggcgcttttacagagaaagaagagaaacgtgtcatcgaacttcatgctttgttagggaacaaatgggcacgaatggctgaagaactaccgggacgaacagataatgagatcaagaacttctggaatacaagacttaagagactgcaacgacttggtttacctgtttaccccgatgaagttcgagagcatgcgatgaatgcagcgacacattccggtctaaacactgattcattggatggtcatcatagtcaagaatatatggaggcagatactgttgagattcctgaagtggatttcgagcatttaccactcaatcgatcttcttcatactaccagtcaatgcttcgacatgttcctcccactaacgtctttgtgagacaaaaaccgtgtttctttcagccgcctaatgtgtataacttgataccaccatctccttacatgtctaccggaaaacgtcctagagaaccagaaaccgcgtttccttgcccgggtggatataccatgaacgagcaaagccctcggctctggaactatccttttgttgagaacgtttcagaacagttaccggatagtcatttgcttggtaatgctgcttattcttctcctcctggacctcttgttcacggggttgagaatttcgagttcccttcattccaatatcatgaagagcctggcggttggggagcagatcaacctaacccaatgccggaacatgagtcagataacactttggttcaatctcctctgacagctcaaacaccatcagattgtccatcatcatcactctatgatggactgttggaatcagttgtctatggatcatcaggggagaaaccggcaaccgataccgattcagaatcttcactgtttcagtcatttacaccagccaatgaaaacataaccggtaaaacttgttttcttactctttatgcattacatgcacttcattgtttgtgtaatcaattcaagaagtctcctcttctccatctgcatgacaaacttaattggtgtaacaaatttaggttcaactccttcaaatcagggacacacatcctttga

SEQ ID NO: 132 - protein, 427 aa, Arabidopsis thaliana
  G1245,MYB-(R1)R2R3 domain coordinates 22-122
MGKVRQDSGSDDDNSIKKSFTKGPWTQAEDNLLIAYVDKHGDGNWNAVQNNSGLSRCGKSCRLRWVNHLRPDLKKGAFTEKEEKRVIELHALLGNKWARMAEELPGRTDNEIKNFWNTRLKRLQRLGLPVYPDEVREHAMNAATHSGLNTDSLDGHHSQEYMEADTVEIPEVDFEHLPLNRSSSYYQSMLRHVPPTNVFVRQKPCFFQPPNVYNLIPPSPYMSTGKRPREPETAFPCPGGYTMNEQSPRLWNYPFVENVSEQLPDSHLLGNAAYSSPPGPLVHGVENFEFPSFQYHEEPGGWGADQPNPMPEHESDNTLVQSPLTAQTPSDCPSSSLYDGLLESVVYGSSGEKPATDTDSESSLFQSFTPANENITGKTCFLTLYALHALHCLCNQFKKSPLLHLHDKLNWCNKFRFNSFKSGTHIL

SEQ ID NO: 133 - DNA, 748 bp, Arabidopsis thaliana
  G1275,family:WRKY
ccaagaaaagggaagatcacgcattcttataggcgtaattcgtaaatagtggtgagtatgaatgatgcagacacaaacttggggagtagtttcagcgatgatactcactctgtgttcgagtttccggagctagacttgtcagatgaatggatggatgatgatcttgtgtctgcggtttccgggatgaatcagtcttatggttatcagactagtgatgttgctggtgctttattctcaggttcttctagctgtttcagtcatcctgaatctccaagtaccaaaacttatgttgctgctacagccactgcttctgccgacaaccaaaacaagaaagaaaagaaaaaaattaaagggagagttgcgttcaagacacggtccgaggtggaagtgcttgacgacgggttcaagtggagaaagtatgggaagaagatggtgaagaacagcccacatccaagaaactactacaaatgttcagttgatggctgtcccgtgaagaaaagggttgaacgagacagagatgatccgagctttgtgataacaacttacgagggttcccacaatcactcaagcatgaactaagactcgaactaaggctcaaggcgaccatgctatattcagcacatcttattttctatggttacgaacgatacttaaaactgcttctagttctttatatccattgtaaactggttgcaggttcacaaattttgagaggtttatgacattctaaatctgtagtacttatata

SEQ ID NO: 134 - protein, 173 aa, Arabidopsis thaliana
  G1275,WRKY domain coordinates 113-169
MNDADTNLGSSFSDDTHSVFEFPELDLSDEWMDDDLVSAVSGMNQSYGYQTSDVAGALFSGSSSCFSHPESPSTKTYVAATATASADNQNKKEKKKIKGRVAFKTRSEVEVLDDGFKWRKYGKKMVKNSPHPRNYYKCSVDGCPVKKRVERDRDDPSFVITTYEGSHNHSSMN

SEQ ID NO: 135 - DNA, 1540 bp, Arabidopsis thaliana
  G1276,family:AP2
ttttgttgttgttgtgaaagctcagagttttgtttgcttttttgttgacttttttgagattgatgctggatctcaatctcgacgtcgactcgaccgagtctactcagaacgaacgagattcgattactgttaaaggggtttctttgaatcagatggatgaatcggtgacgtcgaactcttctgttgttaatgctgaagcttctagctgtatagatggtgaagatgagttgtgctctacacgaacggtcaagtttcaatttgagatactgaaaggaggaggagaagaagaagaagaagatgatgatgaaagaagtgctgtgatgatgactaaggagttttttcctgttgctaaaggcatgaactttatggattcgagcgctcaaagttcaaggagcaccgttgatatttccttccagagggggaaacaaggtggagactttataggtagcgggagcggtggtggcgatgcttcacgggtgatgcagccaccatcacagccggtgaagaaaagcaggagaggtcctaggtctaagagttctcagtatagaggcgtcactttctatcggaggacaggcagatgggaatcgcatatctgggattgcggtaaacaagtttatttaggtggatttgatactgcccatgctgcagctagggcgtatgatcgagctgctgtcaaattccggggtctggaagctgacatcaatttcgttattggcgattatgaagaggatctcaagcagatggcgaatctttccaaagaggaagttgtgcaagtacttcggcgacagagctctggtttctcaaggaataattctagatatcaaggagttgctttgcaaaagattggcgggtggggagctcaaatggagcagcttcatggaaacatgggttgtgacaaggcagccgtacaatggaagggaagggaagctgcttccttaattgagcctcatgcatcccgaatgattcccgaggcagctaatgttaagctcgacctcaacttgggaatctctctttcactaggagatggtccgaagcaaaaagatagggccctccggcttcaccatgtccctaacaattccgtatgtggaaggaacaccatgatggagaaccacatggctgcagcggcatgtgatacgcctttcaatttcttgaagaggggttcagaccatcttaataaccggcatgcccttccttctgcgttcttttcacccatggaaagaacaccagagaaagggcttatgttacgttctcatcaaagcttcccagccaggacatggcaagggcatgatcagtccagtggtgggaccgccgtagcagctacagcaccgccactgttttcaaatgcagcatcatcaggattctcactctcagctacacgccctccttcatccacagctattcatcatccttctcagcccttcgtcaatctgaatcagcccggtctctatgttatccacccatctgattacatatctcagcaccaacacaatctcatgaaccgcccacaaccaccaccatagcttcctccttcctccgcata

SEQ ID NO: 136 - protein, 485 aa, Arabidopsis thaliana
  G1276,AP2 domain coordinates 158-224,250-305
MLDLNLDVDSTESTQNERDSITVKGVSLNQMDESVTSNSSVVNAEASSCIDGEDELCSTRTVKFQFEILKGGGEEEEEDDDERSAVMMTKEFFPVAKGMNFMDSSAQSSRSTVDISFQRGKQGGDFIGSGSGGGDASRVMQPPSQPVKKSRRGPRSKSSQYRGVTFYRRTGRWESHIWDCGKQVYLGGFDTAHAAARAYDRAAVKFRGLEADINFVIGDYEEDLKQMANLSKEEVVQVLRRQSSGFSRNNSRYQGVALQKIGGWGAQMEQLHGNMGCDKAAVQWKGREAASLIEPHASRMIPEAANVKLDLNLGISLSLGDGPKQKDRALRLHHVPNNSVCGRNTMMENHMAAAACDTPFNFLKRGSDHLNNRHALPSAFFSPMERTPEKGLMLRSHQSFPARTWQGHDQSSGGTAVAATAPPLFSNAASSGFSLSATRPPSSTAIHHPSQPFVNLNQPGLYVIHPSDYISQHQHNLMNRPQPPP

SEQ ID NO: 137 - DNA, 2083 bp, Arabidopsis thaliana
  G1290,family:AKR
aattccactgttattagactcttgactctgttttgtttcccgccgatctcgtgatgatggccaccaccaccaccaccaccaccgctagattctctgattcatacgagttcagcaacacaagcggcaatagcttcttcgccgccgagtcatctcttgattatccgacggaatttctcacgccaccggaggtatcagctcttaaacttctgtctaactgcctcgagtctgttttcgactcgccggagacgttctacagcgatgctaagctagttctcgccggcggccgggaagtttcttttcaccgttgtattctttccgcgagaattcctgtcttcaaaagcgctttagccaccgtgaaggaacaaaaatcctccaccaccgtgaagctccagctgaaagagatcgccagagattacgaagtcggctttgactcggttgtggcggttttggcgtatgtttacagcggcagagtgaggtccccgccgaagggagcttctgcttgcgtagacgacgattgttgccacgtggcttgccggtcaaaggtggatttcatggtggaggttctttatctgtctttcgttttccagattcaagaattagttactctgtatgagaggcagttcttggaaattgtagacaaagttgtagtcgaagacatcttggttatattcaagcttgatactctatgtggtacaacatacaagaagcttttggatagatgcatagaaattatcgtgaagtctgatatagaactagttagtcttgagaagtctttacctcaacacattttcaagcaaatcatagacatccgcgaagcgctctgtctagagccacctaaactagaaaggcatgtcaagaacatatacaaggcgctagactcagatgatgttgagcttgtcaagatgcttttgctagaaggacacaccaatctcgatgaggcgtatgctcttcattttgctatcgctcactgcgctgtgaagaccgcgtatgatctcctcgagcttgagcttgcggatgttaaccttagaaatccgaggggatacactgtgcttcatgttgctgcgatgcggaaggagccgaagttgataatatctttgttaatgaaaggggcaaatattttagacacaacattggatggtagaaccgctttagtgattgtaaaacgactcactaaagcggatgactacaaaactagtacggaggacggtacgccttctctgaaaggcggattatgcatagaggtacttgagcatgaacaaaaactagaatatttgtcgcctatagaggcttcactttctcttccagtaactccagaggagttgaggatgaggttgctctattatgaaaaccgagttgcacttgctcgacttctctttccagtggaaactgaaactgtacagggtattgccaaattggaggaaacatgcgagtttacagcttctagtctcgagcctgatcatcacattggtgaaaagcggacatcactagacctaaatatggcgccgttccaaatccatgagaagcatttgagtagactaagagcactttgtaaaaccgtggaactggggaaacgctacttcaaacgatgttcgcttgatcactttatggatactgaggacttgaatcatcttgctagcgtagaagaagatactcctgagaaacggctacaaaagaagcaaaggtacatggaactacaagagactctgatgaagacctttagtgaggacaaggaggaatgtggaaagtcttccacaccgaaaccaacctctgcggtgaggtctaatagaaaactctctcaccggcgcctaaaagtggacaaacgggattttttgaaacgaccttacgggaacggggattaaggaatgggaaatcatattccatttcactcccacaactaaaaatgatgtatgtcctatatcatgatgtttcgtgagtttcaaataaattgaaacgtacatatatcagtttttcatctacgtgactgcgttgtatagttttcgttcttcacttagcatcatgtgtattctagctccaagtgcgtttcaaacaaatatagttatttttagccaattatatatacggt

SEQ ID NO: 138 - protein, 601 aa, Arabidopsis thaliana
  G1290,AKR domain coordinates 270-366
MMATTTTTTTARFSDSYEFSNTSGNSFFAAESSLDYPTEFLTPPEVSALKLLSNCLESVFDSPETFYSDAKLVLAGGREVSFHRCILSARIPVFKSALATVKEQKSSTTVKLQLKEIARDYEVGFDSVVAVLAYVYSGRVRSPPKGASACVDDDCCHVACRSKVDFMVEVLYLSFVFQIQELVTLYERQFLEIVDKVVVEDILVIFKLDTLCGTTYKKLLDRCIEIIVKSDIELVSLEKSLPQHIFKQIIDIREALCLEPPKLERHVKNIYKALDSDDVELVKMLLLEGHTNLDEAYALHFAIAHCAVKTAYDLLELELADVNLRNPRGYTVLHVAAMRKEPKLIISLLMKGANILDTTLDGRTALVIVKRLTKADDYKTSTEDGTPSLKGGLCIEVLEHEQKLEYLSPIEASLSLPVTPEELRMRLLYYENRVALARLLFPVETETVQGIAKLEETCEFTASSLEPDHHIGEKRTSLDLNMAPFQIHEKHLSRLRALCKTVELGKRYFKRCSLDHFMDTEDLNHLASVEEDTPEKRLQKKQRYMELQETLMKTFSEDKEECGKSSTPKPTSAVRSNRKLSHRRLKVDKRDFLKRPYGNGD

SEQ ID NO: 139 - DNA, 1292 bp, Arabidopsis thaliana
  misc_feature (11)..(11): n is a, c, g, or t
  G1308,family:MYB-(R1)R2R3
ctttgattccnatcttcttctcttaattttcactttgggctttctctgtctctcctattatgagtctaaaagtctactagctgttcaatagttttgtctttctgtgtttctcttcttcaaaaccgaaagaaattcaaaaagagtctttcgctgcttgttagtggggtgaggaacaaatgggaagaacaccttgttgtgacaagattggtttgaagaaaggtccttggacgcctgaagaagatgaggttcttgttgcgcatatcaagaaaaatggacatggaagctggagaacacttcctaaacttgctggtttacttcgctgtgggaagagttgcaggctgagatggacaaactatctgagaccagacataaagagaggtcctttcactgctgatgaagagaaacttgttatccagcttcatgccattctcggcaacaggtgggctgctattgcagcacagcttccaggaagaacagacaacgagatcaagaacttatggaacactcatttgaagaaacgtcttttatctatgggtcttgatcccagaactcatgagccattaccttcatatgggttagctaaacaagctccatcttcaccaacaactcgccacatggctcaatgggaaagtgctagggttgaagctgaggcaaggctttctagagaatcaatgctctttagcccttctttttactctggtgtagtaaaaactgaatgtgatcacttcttacgcatttggaattccgagattggtgaagctttcaggaatctcgctccattagatgaatcaactattactagtcaaagcccttgctcgagggcaacatcgacctcatctgcacttctgaagagctcaacaaattcttggggagggaaagaggttactgtggcgattcatggctcagattattctccatattcaaatgatcttgaagatgattcaacagactctgctcttcaacttctgcttgatttccctataagcgatgatgatatgagcttcttggaagagaacattgacagctactcacaggctcctcctattggtcttgtttccatggtttccaaattctagtcttatgagagcctaatatctaagaaaaagattcaaactttgcttccttttggtttttagtgatgataagtagggatatagtatctatgtaaatcagcattagttagttgaagtacttaatcaaccctttcttttatgatttgatcatgtttgagaaaattgcagaacattaaacaattaaccattcaaaaaaaaaaaaaaaaaaaaaaaaaaaaa

SEQ ID NO: 140 - protein, 299 aa, Arabidopsis thaliana
  G1308,MYB-(R1)R2R3 domain coordinates 1-128
MGRTPCCDKIGLKKGPWTPEEDEVLVAHIKKNGHGSWRTLPKLAGLLRCGKSCRLRWTNYLRPDIKRGPFTADEEKLVIQLHAILGNRWAAIAAQLPGRTDNEIKNLWNTHLKKRLLSMGLDPRTHEPLPSYGLAKQAPSSPTTRHMAQWESARVEAEARLSRESMLFSPSFYSGVVKTECDHFLRIWNSEIGEAFRNLAPLDESTITSQSPCSRATSTSSALLKSSTNSWGGKEVTVAIHGSDYSPYSNDLEDDSTDSALQLLLDFPISDDDMSFLEENIDSYSQAPPIGLVSMVSKF

SEQ ID NO: 141 - DNA, 880 bp, Arabidopsis thaliana
  G1326,family:MYB-(R1)R2R3
cgacggtacggtggagatagagatagcatccatggagatgtctagaggaagcaacagttttgacaataagaagcctagttgccaaagaggtcactggagacctgttgaagatgacaatctccggcaactcgttgaacaatacggtcccaagaactggaattttattgctcaacatctctatggaagatcagggaaaagctgtagattaagatggtacaaccaacttgatccaaacatcaccaagaaacccttcaccgaggaggaagaagagagactgcttaaagctcatcggatccaagggaatcgttgggcctccatagcccgactgttccccgggaggaccgacaacgctgtcaaaaaccattttcatgtcatcatggctagacgcaaacgggaaaacttctcttccacagctacttctacgttcaaccaaacttggcatactgttttgagccctagttctagtcttacaaggctaaatagatcccatttcgggctatggaggtatcgaaaggataagagttgcggtctctggccttactcttttgtttcaccacctacgaatggtcaatttggatcttcatctgtctctaacgtacaccacgaaatttatcttgagaggagaaagtcgaaagagttggtggatcctcagaattacacatttcatgcagccacaccagatcataagatgacttcaaatgaagatggaccatccatgggagatgatggtgagaagaacgatgttactttcattgattttcttggtgttggattagcttcttaggttataacatcacaagtcaaagcttttaagggtttctatcattagggttaggcatcattttcagccttttgcttccttaaactctcatatggatct

SEQ ID NO: 142 - protein, 250 aa, Arabidopsis thaliana
  G1326,MYB-(R1)R2R3 domain coordinates 18-121
MEMSRGSNSFDNKKPSCQRGHWRPVEDDNLRQLVEQYGPKNWNFIAQHLYGRSGKSCRLRWYNQLDPNITKKPFTEEEEERLLKAHRIQGNRWASIARLFPGRTDNAVKNHFHVIMARRKRENFSSTATSTFNQTWHTVLSPSSSLTRLNRSHFGLWRYRKDKSCGLWPYSFVSPPTNGQFGSSSVSNVHHEIYLERRKSKELVDPQNYTFHAATPDHKMTSNEDGPSMGDDGEKNDVTFIDFLGVGLAS

SEQ ID NO: 143 - DNA, 918 bp, Arabidopsis thaliana
  G1361,family:NAC
atgacttggtgcaatgaccgtagcgatgttcagaccgttgaaagaatcattccctccccgggggcggctgagtcccccgtagcctcacttccggtctcttgtcacaaaacttgcccttcttgtggccataacttcaagtttcacgaacaggctgggatccatgacttgccgggacttcctgctggagtaaaatttgatccgacggatcaagaggtcttggagcatcttgaaggcaaggtaagagatgacgcaaaaaagcttcatcctctcattgatgagtttatccgtaccatcgatggtgaaaacggcatttgttatacccatcctgaaaaattgccaggagtgaacaaggacgggacggtgcgtcatttcttccaccgaccgtcgaaggcatacacgacgggaacaagaaagcgacgtaaagtccacactgattctgacgtcggtggagagacacggtggcacaagacaggaaaaacacggccagttcttgctggaggaagagtgagaggctacaagaaaatcctagtgctctacacaaactacggcaaacaaaaaaaacccgagaagactaattgggtaatgcatcaatatcatcttggcactagcgaggaagagaaagaaggtgagctcgtcgtctccaaagtcttttaccagactcaaccacgtcaatgcggtggctccgttgctgctgcagccaccgctaaggaccgaccttacctccacggcctcggtggaggtggtggccgccaccttcattaccatcttcatcataacaacggtaacggtaagagcaacggcagtgggggaaccgccggagccggtgagtattatcacaatattccggctattatctcgttcaatcagaccgggatacagaaccacttggttcatgactctcaaccttttatcccttaa

SEQ ID NO: 144 - protein, 305 aa, Arabidopsis thaliana
  G1361,NAC domain coordinates 59-200
MTWCNDRSDVQTVERIIPSPGAAESPVASLPVSCHKTCPSCGHNFKFHEQAGIHDLPGLPAGVKFDPTDQEVLEHLEGKVRDDAKKLHPLIDEFIRTIDGENGICYTHPEKLPGVNKDGTVRHFFHRPSKAYTTGTRKRRKVHTDSDVGGETRWHKTGKTRPVLAGGRVRGYKKILVLYTNYGKQKKPEKTNWVMHQYHLGTSEEEKEGELVVSKVFYQTQPRQCGGSVAAAATAKDRPYLHGLGGGGGRHLHYHLHHNNGNGKSNGSGGTAGAGEYYHNIPAIISFNQTGIQNHLVHDSQPFIP

SEQ ID NO: 145 - DNA, 1260 bp, Arabidopsis thaliana
  G1421,family:AP2
gaaatttcatccctaaataagaaaaaagcatctccttctttagtgtcctccttcaccaaactcttgattccataagcatatattaaaaaagctctctgctttcttcaactttcccgggaaaatcttcttgttacaaagcatcaatctcttgttttaccaattttctctctttattccttttttgccctttacttttcctaactttggtctttatatataaacacacgacacaaagaagaacacacataagttaaaactattacaacagttttaaagagagagatttaaaaaatggagacagagaagaaagtttctctcccaagaatcttacgaatctctgttactgatccttacgcaacagattcgtcaagcgacgaagaagaagaagttgattttgatgcattatctacaaaacgacgtcgtgttaagaagtacgtgaaggaagtggtgcttgattcggtggtttctgataaagagaagccgatgaagaagaagagaaagaagcgcgttgttactgttccagtggttgttacgacggcgacgaggaagtttcgtggagtgaggcaaagaccgtggggaaaatgggcggcggagattagagatccgagtagacgtgttagggtttggttaggtacttttgacacggcggaggaagctgccattgtttacgataacgcagctattcagctacgtggtcctaacgcagagcttaacttccctcctcctccggtgacggagaatgttgaagaagcttcgacggaggtgaaaggagtttcggattttatcattggcggtggagaatgtcttcgttcgccggtttctgttctcgaatctccgttctccggcgagtctactgcggttaaagaggagtttgtcggtgtatcgacggcggagattgtggttaaaaaggagccgtcttttaacggttcagatttctcggcgccgttgttctcggacgacgacgtttttggtttctcgacgtcgatgagtgaaagtttcggcggcgatttatttggagataatctttttgcggatatgagttttggatccgggtttggattcgggtctgggtctggattctccagctggcacgttgaggaccattttcaagatattggggatttattcgggtcggatcctgtcttaactgtttaagaaataactggccgtttaacggcgtttagtgaagttttgttaccggcgacggcgaggattaaaaaaaaacggcgatttattttttgaatgaagatttgttaaata

SEQ ID NO: 146 - protein, 287 aa, Arabidopsis thaliana
  G1421,AP2 domain coordinates 84-146
METEKKVSLPRILRISVTDPYATDSSSDEEEEVDFDALSTKRRRVKKYVKEVVLDSVVSDKEKPMKKKRKKRVVTVPVVVTTATRKFRGVRQRPWGKWAAEIRDPSRRVRVWLGTFDTAEEAAIVYDNAAIQLRGPNAELNFPPPPVTENVEEASTEVKGVSDFIIGGGECLRSPVSVLESPFSGESTAVKEEFVGVSTAEIVVKKEPSFNGSDFSAPLFSDDDVFGFSTSMSESFGGDLFGDNLFADMSFGSGFGFGSGSGFSSWHVEDHFQDIGDLFGSDPVLTV

SEQ ID NO: 147 - DNA, 1142 bp, Arabidopsis thaliana
  G1463,family:NAC
agtttgagatttgcttcatccggtttttttattttctgcaaaatatgtcactctctcccattttgttcatatataatatgtttgaagtttgatcaacttagtatgcgtttctttttctctctagttcctctgtttcttggtcgatttagtttcgttatggcggacacactgctcaacgcagaagacgaagtaataatctcacgttatctgaagcctatgatcgttaacagagtatcatggcctgatctcttcatcgaagacgcagacgtgttcaacaaggatccatatgtgaagttccatgctgagatccctagcttcgtgatcgttaaaccacgaacaaaggcttgtggtaaaaccgatggatgtgattcgggttgctggaggatcattggtcgtgataagctgataaagtcggaggagactggtaagattctagggttcaagaagatactcaagttctgcctaaagtggaaacctagagaatacaagagaagtttggtaatggaagagtataggcttaccaataacttcaactggaagcaagatcatgtgatttgcaagattcggcttttgtttgaagcagaaattagtttcttgctagccaagcatttctacactacatcagactcacttcctcgaaatgtgctgttgccagcttatggattctgttcaccagataaacaagaggaggacgaattttatccggtgacgataatgatttcagaaggaaaagattggcctagctacgttaccaacaacgtgtattgtctgcatccatcggagcttgtgaatgttcacgatgggaagtttcatgataacggaatctgcatcttcgctaacaggacttgtggtgtaaccgataaatgcaatgaaggttactggaagattaagcaccgtgagaagctgatcatgtcacggtacgggcagaccattggttggaagaaagtttttcagttttatgaaacggagaaagaaagacattttggtaatggagaagaagtgaaggtaacttggactctaaaagagtataggcttaccagaaaaatgaacaagaataaagtggtgtgcgttatcaagtataaggtaaagtgtttaccgaggataactagctagggacttctactcttggtttcatgatcgat

SEQ ID NO: 148 - protein, 336 aa, Arabidopsis thaliana
  G1463,NAC domain coordinates 9-156
MRFFFSLVPLFLGRFSFVMADTLLNAEDEVIISRYLKPMIVNRVSWPDLFIEDADVFNKDPYVKFHAEIPSFVIVKPRTKACGKTDGCDSGCWRIIGRDKLIKSEETGKILGFKKILKFCLKWKPREYKRSLVMEEYRLTNNFNWKQDHVICKIRLLFEAEISFLLAKHFYTTSDSLPRNVLLPAYGFCSPDKQEEDEFYPVTIMISEGKDWPSYVTNNVYCLHPSELVNVHDGKFHDNGICIFANRTCGVTDKCNEGYWKIKHREKLIMSRYGQTIGWKKVFQFYETEKERHFGNGEEVKVTWTLKEYRLTRKMNKNKVVCVIKYKVKCLPRITS

SEQ ID NO: 149 - DNA, 1195 bp, Arabidopsis thaliana
  G1464,family:NAC
ccatgagtctcacttcttcttcgctctccaagaaacaaaacactcgatcttgcgtttgatctttctctctctatagatctttttcttgatcgattttatctcattatggaagataacgacgcagcttatgatcaagtcaaatccgaactgttaaactcagaagacgaagtaataatctcacgttatctgaagcctatggtcgttaacggagattcttggccagatcacttcatcgaagacgcaaacgtgttcaccaagaatccaaatgaggtgttcaattctgagagacctagattcgttatcgttaaaccacgaacagaggcttgtggtaagaccgatggatgtgaatctggttgctggaggaccatgggtcgtgataaactgataaagtcggaggagactgggaagattctagggttcaagaagattctcaagttttgcataaagtggaaacctatagaatacaagagaagttgggtaatggaagagtataggcttaccaataacttgaactggaagcaagatcatgtgatttgcaagattcggcttttgtttgaagcagaaattagtttcttgctagccaagcatttctacactacgtcagaatcacttcttcgacatgagctattgccatcttatggatatttatccaatacacaagaggaggatgaattttatctgaagacgataatgacttcggaaggaaacgattggcctagctacgttaccaacaacgtgtactgtcttcatccattggagcttgtggatcttcaagatgtgatgtttcaaagttacggaacctgcatcttcgctaacgggacttgtggtgaatctgataaatgcgatggtggttactggaagatcctgcacggtgataagctgatcaagtcaaatttcgggatggtcactggtttcaagaaggaagaaacagagaggttaggtcatcaacgttgccaaggcttgttgttgccacaccgtcgtggccatgtacaaaccaagagttgcggtgtcgtcaccgtgaaggagaagaggagtttggtagagcaaccggaggagattgtcgctgcacctgagacaccacgccaaggaaaaagtgagcataatgatccactaaagcgaaagaaagcgattggttgcgtgggagagaaagctgagatgtaggcgagacgtcaccactacgaatggagatgcggcc

SEQ ID NO: 150 - protein, 351 aa, Arabidopsis thaliana
  G1464,NAC domain coordinates 12-160
MEDNDAAYDQVKSELLNSEDEVIISRYLKPMVVNGDSWPDHFIEDANVFTKNPNEVFNSERPRFVIVKPRTEACGKTDGCESGCWRTMGRDKLIKSEETGKILGFKKILKFCIKWKPIEYKRSWVMEEYRLTNNLNWKQDHVICKIRLLFEAEISFLLAKHFYTTSESLLRHELLPSYGYLSNTQEEDEFYLKTIMTSEGNDWPSYVTNNVYCLHPLELVDLQDVMFQSYGTCIFANGTCGESDKCDGGYWKILHGDKLIKSNFGMVTGFKKEETERLGHQRCQGLLLPHRRGHVQTKSCGVVTVKEKRSLVEQPEEIVAAPETPRQGKSEHNDPLKRKKAIGCVGEKAEM

SEQ ID NO: 151 - DNA, 414 bp, Arabidopsis thaliana
  G1476,family:Z-C2H2
atggagtgtgagagatcatcgtcgtccacgtcatcagaaaccggagcagtcaggcaccgtcgtacgtcgtcgtcgtcagtctccaccgtgacgagacgaatgtacgagtgcactttctgcaaaagaggtttcacaaacgcacaagctttaggtggtcatatgaacatccatcgacgtgaccgtctcaacaaggccaaggtgcaaaacgatgctgacgtggcactctcgcaaactcatagatgtttccacgtggcgtctgaccttggaggctacgagcaagtagactccgtcgtgttgaggacgacgacctcgaactacatccaacacttacgaatcggctcgatggctacaaggagagaaaacgtcgtcgttgaaggaaatgaaatcgatttggagctgcgtcttggcttatga

SEQ ID NO: 152 - protein, 137 aa, Arabidopsis thaliana
  G1476,Z-C2H2 domain coordinates 37-57
MECERSSSSTSSETGAVRHRRTSSSSVSTVTRRMYECTFCKRGFTNAQALGGHMNIHRRDRLNKAKVQNDADVALSQTHRCFHVASDLGGYEQVDSVVLRTTTSNYIQHLRIGSMATRRENVVVEGNEIDLELRLGL

SEQ ID NO: 153 - DNA, 1131 bp, Arabidopsis thaliana
  G1482,family:Z-CO-like
cgtcgacaccaccatctctatctctctcttaatcgatcgatgaagatcaggtgcgacgtctgcgataaagaagaagcgtcggtgttttgcacggccgacgaagcatctctctgcggcggctgcgaccaccaagtccaccacgctaacaaactcgcctctaaacatctccgtttctctctcctttatccttcttcttccaacacctcctctcctctctgcgacatctgtcaggataaaaaagctctgttgttctgtcaacaagatagagctattttatgcaaagattgcgattcatcgatccacgctgcgaacgaacacacaaagaaacacgataggtttcttcttacaggggttaagctctctgcaacatcgtctgtttacaaacctacttcgaaatcttcttcttcttcttcaagcaaccaagatttctctgtccctggatcatcaatctctaatcctcctcctctcaagaaacctctctcagctcctcctcagagcaacaagatccaacccttttcgaagatcaacggcggtgatgcgtcggtgaatcagtggggatccacaagcacgatttctgagtatttgatggatacgttacctggttggcacgttgaggatttcctcgattcctctcttcctacttatggtttctctaagagtggtgatgatgatggagtgttaccatatatggaaccagaagatgacaacaacactaagagaaacaacaacaacaacaacaacaacaacaacaatacagtgtcacttccatctaagaatttagggatttgggtccctcagattccacaaactcttccttcttcatacccaaatcaatacttttctcaagacaacaacatacagtttgggatgtacaacaaagaaacatcaccagaagtagtgtcttttgctccaatacaaaacatgaaacaacaaggacagaacaacaagagatggtatgatgatggtggcttcactgtcccacagatcactcctcctcctctttcttctaataaaaagtttagatctttctggtaattttactatcttccctaaatgggggagttttttttttgtttgtttgtttctccttcatttctcccaactttgatctcagaattaggcgcggccgct

SEQ ID NO: 154 - protein, 331 aa, Arabidopsis thaliana
  G1482,Z-CO-like domain coordinates 2-33,60-102
MKIRCDVCDKEEASVFCTADEASLCGGCDHQVHHANKLASKHLRFSLLYPSSSNTSSPLCDICQDKKALLFCQQDRAILCKDCDSSIHAANEHTKKHDRFLLTGVKLSATSSVYKPTSKSSSSSSSNQDFSVPGSSISNPPPLKKPLSAPPQSNKIQPFSKINGGDASVNQWGSTSTISEYLMDTLPGWHVEDFLDSSLPTYGFSKSGDDDGVLPYMEPEDDNNTKRNNNNNNNNNNNTVSLPSKNLGIWVPQIPQTLPSSYPNQYFSQDNNIQFGMYNKETSPEVVSFAPIQNMKQQGQNNKRWYDDGGFTVPQITPPPLSSNKKFRSFW

SEQ ID NO: 155 - DNA, 1069 bp, Arabidopsis thaliana
  G1492,family:GARP
aatcccaacccacacacctctcaaatcctcctctcctcgtttctctttctctcctcttcacagaaccaaaacatatcaaacctttttttctcttgggtttaagtaaaaatcgaatctttgtgtcggtttttagggttcttgaaacgatatgggtaagtctagtggtagaaatggtaacggaagctttaacggcaataaatttcacggagttagaccttacgtacggtctccagttccacggcttagatggacgccggatcttcaccgttgtttcgttcacgccgtcgagattctcggtggtcaacaccgagcaacaccaaaacttgttcttaagatgatggatgtgaagggacttaccatttcacatgtcaaaagccaccttcagatgtatagaggaggttcaaagctcactttggagaaaccagaagaaagctcatcatcttcaataagaagaagacaagacagtgaagaagattattatcttcatgacaacttgtctttacacacaaggaatgattgtcttttgggttttcactcttttcctctttcttcacattcttcatttagaggaggaggaggaggaagaacaaaagagcagcagacttcagagtctggtggttatgatgatgatgctgactttcttcacatcaagaagatgaacgatacgacgacgtttttgtcacatcatttccccaagggaacagaggagtggcgggaacaagaacacgaagaagaagaagaagatttgtcgttgtctctgtcgttaaatcatcatcattggagaagcaatggatcatcggtggtgagcgaaacgagtgaagcagcagtctcgacttgttcagcaccattcgtatccaaagattgctttggttcttcaaagattgatcttaatctgtcaatttctctcctcggtagctaaataagttatgcaagatttaggttcagagaaactattcggatgtgtttttgaaactaggatattgaatgttagtagagaaacctagaaaatgaagtttagataaattatcaacgcagcgttttgatcgcctttgaacggaaaattaacaaa

SEQ ID NO: 156 - protein, 256 aa, Arabidopsis thaliana
  G1492,GARP domain coordinates 34-83
MGKSSGRNGNGSFNGNKFHGVRPYVRSPVPRLRWTPDLHRCFVHAVEILGGQHRATPKLVLKMMDVKGLTISHVKSHLQMYRGGSKLTLEKPEESSSSSIRRRQDSEEDYYLHDNLSLHTRNDCLLGFHSFPLSSHSSFRGGGGGRTKEQQTSESGGYDDDADFLHIKKMNDTTTFLSHHFPKGTEEWREQEHEEEEEDLSLSLSLNHHHWRSNGSSVVSETSEAAVSTCSAPFVSKDCFGSSKIDLNLSISLLGS

SEQ ID NO: 157 - DNA, 783 bp, Arabidopsis thaliana
  G1537,family:HB
atggaaaacgaagtaaacgcaggaacagcaagcagttcaagatggaacccaacgaaagatcagatcacgctactggaaaatctttacaaggaaggaatacgaactccgagcgccgatcagattcagcagatcaccggtaggcttcgtgcgtacggccatatcgaaggtaaaaacgtcttttactggttccagaaccataaggctaggcaacgccaaaagcagaaacaggagcgcatggcttacttcaatcgcctcctccacaaaacctcccgtttcttctacccccctccttgctcaaacgtgggttgtgtcagtccgtactatttacagcaagcaagtgatcatcatatgaatcaacatggaagtgtatacacaaacgatcttcttcacagaaacaatgtgatgattccaagtggtggctacgagaaacggacagtcacacaacatcagaaacaactttcagacataagaacaacagcagccacaagaatgccaatttctccgagttcactcagatttgacagatttgccctccgtgataactgttatgccggtgaggacattaacgtcaattccagtggacggaaaacactccctctttttcctcttcagcctttgaatgcaagtaatgctgatggtatgggaagttccagttttgcccttggtagtgattctccggtggattgttctagcgatggagccggccgagagcagccgtttattgatttcttttctggtggttctacttctactcgtttcgatagtaatggtaatgggttgtaa

SEQ ID NO: 158 - protein, 260 aa, Arabidopsis thaliana
  G1537,HB domain coordinates 14-74
MENEVNAGTASSSRWNPTKDQITLLENLYKEGIRTPSADQIQQITGRLRAYGHIEGKNVFYWFQNHKARQRQKQKQERMAYFNRLLHKTSRFFYPPPCSNVGCVSPYYLQQASDHHMNQHGSVYTNDLLHRNNVMIPSGGYEKRTVTQHQKQLSDIRTTAATRMPISPSSLRFDRFALRDNCYAGEDINVNSSGRKTLPLFPLQPLNASNADGMGSSSFALGSDSPVDCSSDGAGREQPFIDFFSGGSTSTRFDSNGNGL

SEQ ID NO: 159 - DNA, 1291 bp, Arabidopsis thaliana
  G1539,family:HB
tttttctccaaacccataagccaaaatagccaaaactactttctaccatttgtctattactccttcaaccatatcattcacatctcctcagtttcgataaaacaaacaaagccctaatatttttacttgctatatcgctgtctctctcccttctcctctataaacatacatataaattaagtacacaccaaaatgtggacgatgggttacaacgaaggaggcgcagattccttcaacggaggaagaaagcttcgtcctctcatcccacgtctcacttcttgccccaccgccgccgtaaacaccaactccgaccaccgctttaatatggcagtggtgacgatgacggcggagcagaacaagagggagctgatgatgctaaactcagaacctcaacatccaccggtaatggtgagctcacggtggaatccgacaccagatcagttaagggttcttgaagagctttaccgacaaggaactagaactccttctgccgaccacatccaacaaatcaccgcacagctacgacggtacgggaagatagaaggcaaaaacgttttctattggttccaaaaccacaaagcccgagaacgccagaaacgacggcgacaaatggaaactggccacgaagaaacggtcctttcaacagcaagtcttgtctcaaaccacggattcgacaagaaagatcctccaggttacaaggttgaacaggtcaagaactggatatgttcggtcggatgcgacacgcaaccagagaaaccttcccgtgattatcatctggaggagccagcgaatatacgggtggagcacaatgctcgttgtggaggagacgagagacgaagctttttagggataaacaccacgtggcagatgatgcagttgccacctagtttctactcttcttcacatcatcatcatcaacgtaacctcattctcaattcacctactgtttcctccaacatgtccaacagcaacaatgctgtctctgcttctaaagatacggtcacggtttcacctgtatttctacgtacgagagaagcaacgaacacagagacttgtcatcgaaatggtgatgataataaagatcaagaacaacatgaagattgctccaacggtgaattggatcatcaagaacagacacttgagctgtttccactgagaaaagaagggttttgtagcgatggtgagaaagacaagaacattagtggcattcactgtttctatgagtttctgccattgaagaactaaacctaattgaagtctttcaagaaaaaaaaaaaaaaaaaaaaaaaaa

SEQ ID NO: 160 - protein, 350 aa, Arabidopsis thaliana
  G1539,HB domain coordinates 76-136
MWTMGYNEGGADSFNGGRKLRPLIPRLTSCPTAAVNTNSDHRFNMAVVTMTAEQNKRELMMLNSEPQHPPVMVSSRWNPTPDQLRVLEELYRQGTRTPSADHIQQITAQLRRYGKIEGKNVFYWFQNHKARERQKRRRQMETGHEETVLSTASLVSNHGFDKKDPPGYKVEQVKNWICSVGCDTQPEKPSRDYHLEEPANIRVEHNARCGGDERRSFLGINTTWQMMQLPPSFYSSSHHHHQRNLILNSPTVSSNMSNSNNAVSASKDTVTVSPVFLRTREATNTETCHRNGDDNKDQEQHEDCSNGELDHQEQTLELFPLRKEGFCSDGEKDKNISGIHCFYEFLPLKN

SEQ ID NO: 161 - DNA, 828 bp, Arabidopsis thaliana
  G1543,family:HB
atgataaaactactatttacgtacatatgcacatacacatataaactatatgctctatatcatatggattacgcatgcgtgtgtatgtataaatataaaggcatcgtcacgcttcaagtttgtctcttttatattaaactgagagttttcctctcaaactttaccttttcttcttcgatcctagctcttaagaaccctaataattcattgatcaaaataatggcgattttgccggaaaactcttcaaacttggatcttactatctccgttccaggcttctcttcatcccctctctccgatgaaggaagtggcggaggaagagaccagctaaggctagacatgaatcggttaccgtcgtctgaagacggagacgatgaagaattcagtcacgatgatggctctgctcctccgcgaaagaaactccgtctaaccagagaacagtcacgtcttcttgaagatagtttcagacagaatcatacccttaatcccaaacaaaaggaagtacttgccaagcatttgatgctacggccaagacaaattgaagtttggtttcaaaaccgtagagcaaggagcaaattgaagcaaaccgagatggaatgcgagtatctcaaaaggtggtttggttcattaacggaagaaaaccacaggctccatagagaagtagaagagcttagagccataaaggttggcccaacaacggtgaactctgcctcgagccttactatgtgtcctcgctgcgagcgagttacccctgccgcgagcccttcgagggcggtggtgccggttccggctaagaaaacgtttccgccgcaagagcgtgatcgttga

SEQ ID NO: 162 - protein, 275 aa, Arabidopsis thaliana
  G1543,HB domain coordinates 135-195
MIKLLFTYICTYTYKLYALYHMDYACVCMYKYKGIVTLQVCLFYIKLRVFLSNFTFSSSILALKNPNNSLIKIMAILPENSSNLDLTISVPGFSSSPLSDEGSGGGRDQLRLDMNRLPSSEDGDDEEFSHDDGSAPPRKKLRLTREQSRLLEDSFRQNHTLNPKQKEVLAKHLMLRPRQIEVWFQNRRARSKLKQTEMECEYLKRWFGSLTEENHRLHREVEELRAIKVGPTTVNSASSLTMCPRCERVTPAASPSRAVVPVPAKKTFPPQERDR

SEQ ID NO: 163 - DNA, 1056 bp, Arabidopsis thaliana
  G1555,family:GARP
gaagttatttgattcattcttccgactgagtttcccgccattattttgtttgatcggaaaattaaatggaaagagtgaatctcggaggtttaggttacgataatggcggagttatgatgactagagatcccaaacctaggctcagatggacagccgatcttcatgatcgcttcgtcgacgccgtcgctaagctcggtggcgctgacaaagcaactcctaaatcggttctgaagctgatgggattaaaaggtttaacactgtaccatctcaagagccatttacagaagtatagacttggtcaacaacaaggcaaaaaacaaaatagaacagaacaaaacaaagaaaatgctggaagttcatatgtgcatttcgacaattgttctcaaggaggaatctccaatgattcaagatttgataaccatcaaagacaaagcgggaatgtaccttttgctgaggcaatgagacatcaggtcgatgcgcaacaacggtttcaagaacaactcgaggtgcagaaaaaactgcagatgagaatggaggcacaaggaaaatatttgttgacattactagagaaagcacagaagagcttaccttgtggtaatgcaggggaaacagacaagggtcaattctcggatttcaatctcgcactttcgggacttgtaggaagtgatcgtaagaacgagaaggcgggtttggttactgatatctcacaccttaatggtggtgattcctctcaagagtttcggttatgtggagaacaagagaaaatagaaaccggagatgcatgtgttaaaccagaatccgggtttgtgcattttgatttgaactccaaaagtgggtatgatctcttgaattgtgggaaatatgggattgaagtgaagccaaatgtgattggagatagacttcaataggttaaagagacactttctttaattttttattttattttattatttctttacatttcttatagaatgttacaaatttggcttcatggtttctcagtcaaatatcaagaacatatttgaagtccaaagtagttgatatcagctaaatacg

SEQ ID NO: 164 - protein, 280 aa, Arabidopsis thaliana
  G1555,GARP domain coordinates 28-177
MERVNLGGLGYDNGGVMMTRDPKPRLRWTADLHDRFVDAVAKLGGADKATPKSVLKLMGLKGLTLYHLKSHLQKYRLGQQQGKKQNRTEQNKENAGSSYVHFDNCSQGGISNDSRFDNHQRQSGNVPFAEAMRHQVDAQQRFQEQLEVQKKLQMRMEAQGKYLLTLLEKAQKSLPCGNAGETDKGQFSDFNLALSGLVGSDRKNEKAGLVTDISHLNGGDSSQEFRLCGEQEKIETGDACVKPESGFVHFDLNSKSGYDLLNCGKYGIEVKPNVIGDRLQ

SEQ ID NO: 165 - DNA, 1440 bp, Arabidopsis thaliana
  G1560,family:HS
atcctttcaatttccactcctctctaatataattcacattttcccactattgctgattcatttttttttgtgaattatttcaaacccacataaaaaaatctttgtttaaatttaaaaccatggatccttcatttaggttcattaaagaggagtttcctgctggattcagtgattctccatcaccaccatcttcttcttcatacctttattcatcttccatggctgaagcagccataaatgatccaacaacattgagctatccacaaccattagaaggtctccatgaatcagggccacctccatttttgacaaagacatatgacttggtggaagattcaagaaccaatcatgtcgtgtcttggagcaaatccaataacagcttcattgtctgggatccacaggccttttctgtaactctccttcccagattcttcaagcacaataacttctccagttttgtccgccagctcaacacatatggtttcagaaaggtgaatccggatcggtgggagtttgcaaacgaagggtttcttagagggcaaaagcatctcctcaagaacataaggagaagaaaaacaagtaataatagtaatcaaatgcaacaacctcaaagttctgaacaacaatctctagacaatttttgcatagaagtgggtaggtacggtctagatggagagatggacagcctaaggcgagacaagcaagtgttgatgatggagctagtgagactaagacagcaacaacaaagcaccaaaatgtatctcacattgattgaagagaagctcaagaagaccgagtcaaaacaaaaacaaatgatgagcttccttgcccgcgcaatgcagaatccagattttattcagcagctagtagagcagaaggaaaagaggaaagagatcgaagaggcgatcagcaagaagagacaaagaccgatcgatcaaggaaaaagaaatgtggaagattatggtgatgaaagtggttatgggaatgatgttgcagcctcatcctcagcattgattggtatgagtcaggaatatacatatggaaacatgtctgaattcgagatgtcggagttggacaaacttgctatgcacattcaaggacttggagataattccagtgctagggaagaagtcttgaatgtggaaaaaggaaatgatgaggaagaagtagaagatcaacaacaagggtaccataaggagaacaatgagatttatggtgaaggtttttgggaagatttgttaaatgaaggtcaaaattttgattttgaaggagatcaagaaaatgttgatgtgttaattcagcaacttggttatttgggttctagttcacacactaattaagaagaaattgaaatgatgactactttaagcatttgaatcaacttgtttcctattagtaatttggctttgtttcaatcaagtgagtcgtggactaacttgc

SEQ ID NO: 166 - protein, 406 aa, Arabidopsis thaliana
  G1560,HS domain coordinates 61-152
MDPSFRFIKEEFPAGFSDSPSPPSSSSYLYSSSMAEAAINDPTTLSYPQPLEGLHESGPPPFLTKTYDLVEDSRTNHVVSWSKSNNSFIVWDPQAFSVTLLPRFFKHNNFSSFVRQLNTYGFRKVNPDRWEFANEGFLRGQKHLLKNIRRRKTSNNSNQMQQPQSSEQQSLDNFCIEVGRYGLDGEMDSLRRDKQVLMMELVRLRQQQQSTKMYLTLIEEKLKKTESKQKQMMSFLARAMQNPDFIQQLVEQKEKRKEIEEAISKKRQRPIDQGKRNVEDYGDESGYGNDVAASSSALIGMSQEYTYGNMSEFEMSELDKLAMHIQGLGDNSSAREEVLNVEKGNDEEEVEDQQQGYHKENNEIYGEGFWEDLLNEGQNFDFEGDQENVDVLIQQLGYLGSSSHTN

SEQ ID NO: 167 - DNA, 1502 bp, Arabidopsis thaliana
  G1584,family:HB
attcacatttttatttatctttccatttagccattctgttccctgtctcttcctcctctctttttgacacatcacatcatcatcacatcatcattcaacatcaatcatcatcatatgcatacacatacatctgtgttctgcggatcgagttaattagttatggcttcttcgaatagacactggccaagcatgttcaagtccaaacctcatccccatcaatggcaacatgacatcaactctcctctcttgccttctgcttctcaccgatcttctcctttctcttcaggatgtgaagtggagaggagtccagagccaaaaccaagatggaatccaaagccagagcagattcggatacttgaagcaatctttaactccgggatggtgaatcctccaagagaggagatcaggcttcaagaatacggccaagtcggtgatgctaacgtcttctactggttccaaaaccgtaagtcccgtagtaaacacaaactccgcctcctccacaaccactccaaacactctctccctcaaacgcaaccgcagccgcagccgcaaccttcggcttcctcttcctcttcctcctcctcttcctcctccaaatccaccaaaccccgaaaaagcaagaacaagaacaacactaatctctctttgggtggtagtcaaatgatggggatgtttccaccggaaccggcgtttctcttcccggtctccactgtcggagggtttgaaggtatcaccgtctcatcccaattagggtttctctccggtgatatgattgagcaacaaaaaccggctccaacgtgtaccggactcctgctgagtgagatcatgaacggtagtgtgagttatggaactcatcatcaacaacacttgagtgagaaagaagttgaagaaatgaggatgaagatgttgcaacagccacagactcagatttgttacgctaccactaatcatcaaatagcttcttacaacaacaacaacaacaacaataacatcatgcttcatattcctcccactacttctactgccaccactattactacttcgcattctctcgctactgtcccatcaacttcggaccagcttcaagttcaagcggacgcacgaataagagttttcatcaatgaaatggagcttgaagtgagctcaggaccgttcaatgtgagggatgcatttggggaagaggttgttctgattaattccgcgggtcagcccattgtcaccgatgaatatggcgtcgctcttcaccctcttcaacacggagcctcgtactatctgatctagtcgtgtgggagatttgagtttgaagaagaaattaagacctgtctctttctttcaccatctctcgtacgtaggcttaaatgttaagattttataaagtattggtttcagttacctgttgtgacggtgtttatgtatgagtttcggacaacattcacaaaactctctcgttaaattgttgaccaataatatatgatgtgtgtttcattattatctaaaaaaaa

SEQ ID NO: 168 - protein, 373 aa, Arabidopsis thaliana
  G1584,HB domain coordinates 49-109
MASSNRHWPSMFKSKPHPHQWQHDINSPLLPSASHRSSPFSSGCEVERSPEPKPRWNPKPEQIRILEAIFNSGMVNPPREEIRLQEYGQVGDANVFYWFQNRKSRSKHKLRLLHNHSKHSLPQTQPQPQPQPSASSSSSSSSSSSKSTKPRKSKNKNNTNLSLGGSQMMGMFPPEPAFLFPVSTVGGFEGITVSSQLGFLSGDMIEQQKPAPTCTGLLLSEIMNGSVSYGTHHQQHLSEKEVEEMRMKMLQQPQTQICYATTNHQIASYNNNNNNNNIMLHIPPTTSTATTITTSHSLATVPSTSDQLQVQADARIRVFINEMELEVSSGPFNVRDAFGEEVVLINSAGQPIVTDEYGVALHPLQHGASYYLI

SEQ ID NO: 169 - DNA, 984 bp, Arabidopsis thaliana
  G1594,family:HB
atggatggaatgtacaatttccattcggccggtgattattcagataagtcggttctgatgatgtcaccggagagtctcatgtttccttccgattaccaagctttgctatgttcctccgccggtgaaaatcgtgtctctgatgttttcggatccgacgagctactctcagtagccgtctccgctttgtcgtcggaggcggcttcgatcgctccggagatccgaagaaatgatgataacgtttctctaactgtcatcaaagctaaaatcgcttgtcatccttcgtatcctcgcttacttcaagcttacatcgattgccaaaaggtcggagcaccaccggagatagcgtgtttactagaggagattcaacgggagagtgatgtttataagcaagaggttgttccttcttcttgctttggagctgatcctgagcttgatgaatttatggaaacgtactgcgatatattagtgaaatacaaatcggatctagcaagaccgtttgacgaggcaacgtgtttcttgaacaagattgagatgcagctacggaacctatgtactggtgtcgagtctgccaggggagtttctgaggatggtgtaatatcatctgacgaggaactgagtggaggtgatcatgaggtagcagaggatgggagacaaagatgtgaagaccgggacctcaaagataggttgctacgcaaatttggaagccgtattagtactttaaagcttgagttctcaaagaagaagaagaaaggaaagttaccaagagaagcaagacaagctcttcttgattggtggaatctccattataagtggccttaccctactgaaggagataagatagcattagctgatgcaacggggttagaccaaaaacaaatcaacaattggtttataaaccaaaggaaacgtcattggaagccatcagagaatatgcctttcgctatgatggatgattctagtggatcattctttaccgaggaatga

SEQ ID NO: 170 - protein, 327 aa, Arabidopsis thaliana
  G1594,HB domain coordinates 308-343
MDGMYNFHSAGDYSDKSVLMMSPESLMFPSDYQALLCSSAGENRVSDVFGSDELLSVAVSALSSEAASIAPEIRRNDDNVSLTVIKAKIACHPSYPRLLQAYIDCQKVGAPPEIACLLEEIQRESDVYKQEVVPSSCFGADPELDEFMETYCDILVKYKSDLARPFDEATCFLNKIEMQLRNLCTGVESARGVSEDGVISSDEELSGGDHEVAEDGRQRCEDRDLKDRLLRKFGSRISTLKLEFSKKKKKGKLPREARQALLDWWNLHYKWPYPTEGDKIALADATGLDQKQINNWFINQRKRHWKPSENMPFAMMDDSSGSFFTEE

SEQ ID NO: 171 - DNA, 1164 bp, Arabidopsis thaliana
  G1635,family:MYB-related
atggcgtcgtctccgttgactgcaaatgttcagggtaccaacgcttctttgaggaatagagatgaagaaactgcagacaagcagatacaattcaatgaccaaagttttgggggaaatgactatgcacccaaggtacggaagccatacacgataacaaaagagagagagagatggacagatgaagagcacaagaagtttgttgaagccttgaaattatacgggcgagcttggagacgaatagaagaacatgtgggctcaaagaccgcagttcagattcgaagccatgctcagaagtttttctctaaggttgctcgagaagcaactggaggtgatgggagctcagtagagccgattgtaatacctcctcctcgtcccaagagaaagccagcgcatccgtaccctcgtaagtttgggaacgaggcagatcaaacaagtagatcggtttctccctcagaacgtgatactcaatctccaacctctgtgttgtccactgttggatcagaagcattgtgttcccttgattcgagttcacccaatcgaagcttgtccccagtttcttctgcatcaccaccagctgctcttacaaccactgcaaatgcacctgaagagcttgagactctgaagctggagttgtttcctagtgagagactcttaaacagggagagctcgatcaaggaaccaacgaagcaaagtcttaaactctttgggaagacagttttggtatctgattcaggcatgtcctcttctctaacaacttcaacatattgtaaatccccaattcagccattaccacggaaactctcatcatccaagacactacccataataagaaactcacaagaagaactcttgagctgctggatacaagtccctcttaagcaagaagatgtggaaaatagatgtttggattcaggaaaggctgtccaaaacgaaggatcatcgactggatcaaacactggttcggtggatgatacgggacacacggaaaagaccacagaacccgaaacaatgctatgtcaatgggagtttaaaccaagtgagaggtctgcattttctgagctcagaagaacaaactccgagtcaaattcaagaggatttggtccatacaagaagagaaagatggtaacagaagaagaagagcatgagattcatctccacttataa

SEQ ID NO: 172 - protein, 387 aa, Arabidopsis thaliana
  G1635,MYB-related domain coordinates 56-102
MASSPLTANVQGTNASLRNRDEETADKQIQFNDQSFGGNDYAPKVRKPYTITKERERWTDEEHKKFVEALKLYGRAWRRIEEHVGSKTAVQIRSHAQKFFSKVAREATGGDGSSVEPIVIPPPRPKRKPAHPYPRKFGNEADQTSRSVSPSERDTQSPTSVLSTVGSEALCSLDSSSPNRSLSPVSSASPPAALTTTANAPEELETLKLELFPSERLLNRESSIKEPTKQSLKLFGKTVLVSDSGMSSSLTTSTYCKSPIQPLPRKLSSSKTLPIIRNSQEELLSCWIQVPLKQEDVENRCLDSGKAVQNEGSSTGSNTGSVDDTGHTEKTTEPETMLCQWEFKPSERSAFSELRRTNSESNSRGFGPYKKRKMVTEEEEHEIHLHL

SEQ ID NO: 173 - DNA, 871 bp, Arabidopsis thaliana
  G1655,family:HLH/MYC
tttctaactagtcacattgagagagagagagagagaaagagagactctcagaatctgaagaagaagaagagattgttgtttttgccttttatcatcggtttctttgaatctctggttttaaatcggatttaatggtggagtctctgttcccgagcatcgaaaacacaggtgaatcgtctcgaagaaagaagccgaggatatcagagacggcggaggcggagatagaggcacgacgtgtcaacgaagaaagcttgaagagatggaaaacgaatcgtgtgcaacagatctacgcttgtaagctcgtcgaagctttacgccgagttcgtcagagatcttccaccaccagcaacaacgagaccgataaactcgtctccggcgcggcgagggagatacgtgatacggcggatcgagttctagctgcgtccgctcgtggtacgactcggtggagcagagcgattttagcgagtcgcgtccgagcgaagctgaagaaacatagaaaggcgaaaaagtcaacgggaaattgtaaatcgagaaaaggtctcacggagacgaatcggattaagttaccggcggttgagagaaaactgaagattcttggccgtttggttcctggttgccggaaagtctctgtaccgaatcttttagatgaagcgaccgattacatcgcagcgttagagatgcaggttcgagccatggaggctctcgccgaacttttaaccgcagccgcaccacggacgacgttgaccggaacttaacggcggcagttagtttgtcagttgttaattagcttttcttttacctttttacccctttattttggcttcaagtgttttttttttctcgtcgacgcgattttaatttattaaattca

SEQ ID NO: 174 - protein, 207 aa, Arabidopsis thaliana
  G1655,HLH/MYC domain coordinates 129-186
MVESLFPSIENTGESSRRKKPRISETAEAEIEARRVNEESLKRWKTNRVQQIYACKLVEALRRVRQRSSTTSNNETDKLVSGAAREIRDTADRVLAASARGTTRWSRAILASRVRAKLKKHRKAKKSTGNCKSRKGLTETNRIKLPAVERKLKILGRLVPGCRKVSVPNLLDEATDYIAALEMQVRAMEALAELLTAAAPRTTLTGT

SEQ ID NO: 175 - DNA, 1946 bp, Arabidopsis thaliana
  G1662,family:DBP
atcatccttttcatcttcaaaagctttttccttttaaaatcattttcttaaacaagtggtatcaacgcagagtacgagttcatttttttcaagttttaattctgaaactcagagctggttctctgttttgatcacatggttttgttcagaacataactcttgttccaccaggacaataaataccatcttctgatcacacgtcatctttccatattcaagaaaacttcattttccatcggaagattcgtttaggagagaaaatggaaagtggcttttattcagattggaaagatacttcttcttcttcgttctttggatcagagaatatggaggaagagttggaagatggagttcttagagctgaagagcttttctcatcgattcctcaacctcagacacctaaagagccaatggagtttctgtctagatcctggagtctctctacttctgaaatctccaaagcacttgctctcaaacatagacaacaacaagatcagttttgtgttggccagaacagtcctcctgttttgttccctgatgctgctgcagatccactcgtggctgggaagatcatgaactctgttggcacacgtagagcagggacattgtctaaatggtttcaccacaacaaggaacacagcaccagcagtactactaccaatctcaagaagaaagataaagtgcgtgtggagaacgcccacgtgcattctgccgtctctatagcggctctggctgcaggtttagcctctgtgacatctgctagcaattgcaaagggtcaggctccaagatggcactggctttagcctcagccactgaactgttggcctcacactgtgttgagatggctgagcgagccggtgctgaccatgcacgtgttacttccacggttagatcttctgtggatatccacagccccggtgatctcatgactctaacagccgctgctgcaactgctttgagaggagaagcggctctgaaggcgaggcagccaaaggaagcaaggaaaaatgcagctattaccccttttgagagaagtttctctgattctcattggcatgcaaattttcagtatagattggaagaaccaaatcttccatttgaaggcgaactgatgcaatgtgcacgaaatggagtgcagcgaactaagcgtgtctgtgtctatatcaacaagaagtctcaggtaatgatcaaactcaaaagcaaacatgttggaggggcattctctaagaaaatcaaatgcgttgtctatggagtctgcgatgagaaatcagcttggccttacaggaaagagagggaaaattcagaagaagtctacttcggtctgaaaaccggacaaggtcttttggagttcaagtgcaagagcaagattcacaagcagagatgggttgatggggttcagtctcttctccgccaagtaaattgctttgaggctgccaaatgctcgctgggatctctgaatctcactggtcacacgtgatgcaggatcctgtatatatttgattatattcatatatataatatccaaatttttgctgttgtgaggtatttgcaaaacctggcaatgtaacctcagaagacttttggataaaacaaagcaggttgttcaaatgatcacaacaagtgttaggaacattgctatgtacagaaagacatcagaagaatgatgaatctcaattgaactttttatttccaatgattcagtttctatgaagagtcaaaaaattgtagagaagtggtatgtatatttttgtttgagtgagaagttcatatgaagaatcacgtgagagacatgtcagagatattcatatagaccgtattagaatacgacagtcctttgtgtcccataaggcaatactcgcagttcgcagtaagattttatagctttcatgagacactttttctcaaggtcctctgatttctggacaaagctcctcaaattgtctcg

SEQ ID NO: 176 - protein, 405 aa, Arabidopsis thaliana
  G1662,DBP domain coordinates 44-69,295-330
MESGFYSDWKDTSSSSFFGSENMEEELEDGVLRAEELFSSIPQPQTPKEPMEFLSRSWSLSTSEISKALALKHRQQQDQFCVGQNSPPVLFPDAAADPLVAGKIMNSVGTRRAGTLSKWFHHNKEHSTSSTTTNLKKKDKVRVENAHVHSAVSIAALAAGLASVTSASNCKGSGSKMALALASATELLASHCVEMAERAGADHARVTSTVRSSVDIHSPGDLMTLTAAAATALRGEAALKARQPKEARKNAAITPFERSFSDSHWHANFQYRLEEPNLPFEGELMQCARNGVQRTKRVCVYINKKSQVMIKLKSKHVGGAFSKKIKCVVYGVCDEKSAWPYRKERENSEEVYFGLKTGQGLLEFKCKSKIHKQRWVDGVQSLLRQVNCFEAAKCSLGSLNLTGHT

SEQ ID NO: 177 - DNA, 712 bp, Arabidopsis thaliana
  G1671,family:NAC
cctctctatataatcttcttctacacacacacacacacgcaaccatatacgtacatgtgaagtagtgagatcaatatcgttagcaatgaatctaccaccgggatttaggttttttccgaccgatgaagagctcgtcgttcacttcctccaccggaaagcttccctcttgccttgtcaccctgatgtcatccccgaccttgatctttaccattacgatccttgggaccttcccgggaaagctttgggagaagggaggcaatggtacttctatagtagaaagacacaagagagagtgacaagcaatgggtattggggatcaatgggaatggacgagccaatctacacaagctccacacacaagaaagtgggaatcaaaaagtatctaactttctatctcggagattctcagactaattggatcatgcaagaatattccctcccggattcctcttcttcatctagtcgatcttctaagagatcaagccgtgcttctagttctagtcacaaacccgattatagcaagtgggtgatatgcagagtgtatgagcaaaattgcagtgaggaggaagacgatgatgggacagaactctcatgtttggatgaagtgtttttgtctttagatgatcttgacgaagtaagcttaccgtaataaagacagaagcacccaagaagagaaaaaaaaaaaaagggtttagtgggcaattatttctaa

SEQ ID NO: 178 - protein, 187 aa, Arabidopsis thaliana
  G1671,NAC domain coordinates 1-158
MNLPPGFRFFPTDEELVVHFLHRKASLLPCHPDVIPDLDLYHYDPWDLPGKALGEGRQWYFYSRKTQERVTSNGYWGSMGMDEPIYTSSTHKKVGIKKYLTFYLGDSQTNWIMQEYSLPDSSSSSSRSSKRSSRASSSSHKPDYSKWVICRVYEQNCSEEEDDDGTELSCLDEVFLSLDDLDEVSLP

SEQ ID NO: 179 - DNA, 777 bp, Arabidopsis thaliana
  G1747,family:MYB-(R1)R2R3
atgaaaatgatgcaagaggagggaaaccgaaaaggtccatggacagaacaggaagacatacttctggtaaattttgttcacttatttggagatcgacgatgggattttatagcaaaagtatcaggtttgaacagaacaggaaagagttgcaggctaagatgggttaattacctacatcctggtctcaaacgtggcaagatgacgcctcaagaagagcgcctcgtccttgagcttcacgctaagtggggaaacaggtggtcgaaaatagcccgaaaattgccgggacgaacggataacgagataaagaactactggaggactcatatgaggaagaaagctcaagaaaagaagcgtcctgtttccccaacttcctcattttccaactgcagctcgtcatctgtgaccactaccaccaccaatactcaagatacatcgtgccactcgcgtaaatcttcaggggaagtgagcttttacgacactggaggttcccgatccactagagagatgaatcaagaaaacgaagacgtgtactcgttggatgatatatggagagagattgatcactcagcagtaaacataataaaaccggttaaagacatctactcagaacaaagccattgcttaagttacccaaatctagcttcaccatcatgggaaagctcattggattctatatggaacatggatgcagataaaagtaagatatcgtcttactttgcaaatgatcagtttcctttctgtttccaacacagtagatcaccatggtcgtcaggttaa

SEQ ID NO: 180 - protein, 258 aa, Arabidopsis thaliana
  G1747,MYB-(R1)R2R3 domain coordinates 11-114
MKMMQEEGNRKGPWTEQEDILLVNFVHLFGDRRWDFIAKVSGLNRTGKSCRLRWVNYLHPGLKRGKMTPQEERLVLELHAKWGNRWSKIARKLPGRTDNEIKNYWRTHMRKKAQEKKRPVSPTSSFSNCSSSSVTTTTTNTQDTSCHSRKSSGEVSFYDTGGSRSTREMNQENEDVYSLDDIWREIDHSAVNIIKPVKDIYSEQSHCLSYPNLASPSWESSLDSIWNMDADKSKISSYFANDQFPFCFQHSRSPWSSG

SEQ ID NO: 181 - DNA, 1089 bp, Arabidopsis thaliana
  G1753,family:AP2
acccaaaaaaacgcgatatccaacaagaggagcaattaaaaagctgtctttacagctttagcttcatcatctctaagctgtgatcaattcctcccaaaccattttctaactggtttgcactttcttcactctcttctcttcactcttcactacgtacttcactctccaactaacttaactgcaccataaaatggcttcgatctcttcctctccttcctcaaactcatcactcttctctactcaaaaccctaatactcattatcaatatgcaaggaacctccaaagacaatggcggccgccaccctttgtacaggggagtaaggcagcgaaagaactcaaacaaatgggtttctgagatccgtgagccgagaaaacctaaccgtatctggttaggaacattctctacccccgagatggcggcaatagcctatgacgtggcagctctagccctcaaaggcagtcaagctgagctcaacttcccaaactcagtttcctctttgcctgccccaacctccatgtctccagcagacatccaagcagcagccgcttcggccgctgctgcttttggtgctgctagggatgcgattgttatggcaaataataacagccaaacaagtggtgtggcttgcatgaatagtagttatgataatacaaatatgaatggattcatggacgaggatttggtattcgacatgcctaatgtgctcatgaatatggctgaaggaatgcttcttagcccccctcgtcctactgtctttgatgctgcttacgacgctgatggttttcctggaggagacgattacttgtggaattttccatgatagttaaacaaaccaaccatataaatatgtgattttgtgtgtttctatatatgtatgtatgaaataaataaatatggtgtctagtgatgcattgtatgcatggttaggcccgttaagaccgtaatataaggtcgtactgtattaagtttttgtctttaaattattctcaatttacaatcttatctagtctgatgtaatgccaaatgtaatgaatagtcaatgccttgactgatactcatttgtttattttacagatggatacaatttt

SEQ ID NO: 182 - protein, 184 aa, Arabidopsis thaliana
  G1753,AP2 domain coordinates 12-80
MQGTSKDNGGRHPLYRGVRQRKNSNKWVSEIREPRKPNRIWLGTFSTPEMAAIAYDVAALALKGSQAELNFPNSVSSLPAPTSMSPADIQAAAASAAAAFGAARDAIVMANNNSQTSGVACMNSSYDNTNMNGFMDEDLVFDMPNVLMNMAEGMLLSPPRPTVFDAAYDADGFPGGDDYLWNFP

SEQ ID NO: 183 - DNA, 773 bp, Arabidopsis thaliana
  G1755,family:AP2
acctttttttttctctgctaacgaaaaaagccatcttctttgctactactaatctactattacactgaatcgtttgggttcttcttcttcttcagctgctactttgttcgagtgattgctgacatgccgtcagcgtcggagattgttgacaggaaacggaagtctcgtggaacacgagatgtagctgagattctaaggaaatggagagagtacaatgagcagaccgaggcagattcttgcatcgatggtggtggttcaaaaccaatccgaaaggctcctccaaaacgttcgaggaagggttgtatgaaaggtaaaggtggacctgaaaatgggatttgtgactatacaggagttagacagaggacatggggtaaatgggttgctgagatccgtgagccaggccgaggtgctaagttatggctcggtactttctctagttcatatgaagctgcattggcttatgatgaggcttccaaagctatttacggtcagtctgcccgactcaatcttccactgctgccactgtgtcaggctcggttactgcattttctgatgaatctgaagtttgtgcacgtgaggatacaaatgcaagatctggttttggtcaggtcagactagaggattgtattgatgaatatgttctcctagatagttctagtgtattgttaatcgtagttgactattgtgaggtcttaagttgtagattgaaaatgagatagctcatatggagctttattgaaatgcaagaaagtaaacaaaaaaaaaaaaaaaaa

SEQ ID NO: 184 - protein, 164 aa, Arabidopsis thaliana
  G1755,AP2 domain coordinates 71-133
MPSASEIVDRKRKSRGTRDVAEILRKWREYNEQTEADSCIDGGGSKPIRKAPPKRSRKGCMKGKGGPENGICDYTGVRQRTWGKWVAEIREPGRGAKLWLGTFSSSYEAALAYDEASKAIYGQSARLNLPLLPLCQARLLHFLMNLKFVHVRIQMQDLVLVRSD

SEQ ID NO: 185 - DNA, 1031 bp, Arabidopsis thaliana
  G1756,family:WRKY
atatgtacttgtacaccaacccaccaaaagagataaaagaggaaacaaaaactcgaaaagagagagatatatgggtgaggtggcttatatggacgaaggagacctagaagcaatagtcagaggctactccggctccggagacgcgttttccggcgaaagttccggtacgttttcaccttcgttttgcctaccgatggagacgtctagtttctacgaaccggagatggagacaagtggcttagatgagctcggtgaactttacaaacccttttaccctttctccacacaaacgatcctcacaagctcggtctctctccctgaagattcaaaacctttccgagatgacaagaaacaacgatcacatggttgtcttttatccaacggatcaagagctgatcatatccgaatttcagaatccaaatcaaagaaaagcaagaagaatcaacagaagagagttgttgagcaagtgaaagaagagaatctgttgtcggacgcatgggcgtggcgtaaatacgggcagaaacccatcaaaggatctccatacccaaggagttattacagatgcagtagctcaaaagggtgtttggcaagaaaacaagtcgaaagaaatcctcaaaacccggagaaattcaccataacatacactaatgagcacaatcatgaactaccaacccggagaaactcattagccggttcgactcgagcaaaaacttcccaacccaaaccaaccttaaccaaaaaatccgaaaaagaagttgtttcttcccctacaagtaatcctatgatcccatccgctgatgaatcttctgttgcggttcaagaaatgagcgttgcggaaacgagtacgcaccaagcggctggagcaatcgagggccgccgcttgagtaacggtttaccatcggatttgatgtccgggagcggaacttttccaagttttaccggtgacttcgatgaactattgaatagccaagagttcttcagtgggtatttatggaattactagagagcattaggtgtatgtatatatatat

SEQ ID NO: 186 - protein, 310 aa, Arabidopsis thaliana
  G1756,WRKY domain coordinates 138-200
MGEVAYMDEGDLEAIVRGYSGSGDAFSGESSGTFSPSFCLPMETSSFYEPEMETSGLDELGELYKPFYPFSTQTILTSSVSLPEDSKPFRDDKKQRSHGCLLSNGSRADHIRISESKSKKSKKNQQKRVVEQVKEENLLSDAWAWRKYGQKPIKGSPYPRSYYRCSSSKGCLARKQVERNPQNPEKFTITYTNEHNHELPTRRNSLAGSTRAKTSQPKPTLTKKSEKEVVSSPTSNPMIPSADESSVAVQEMSVAETSTHQAAGAIEGRRLSNGLPSDLMSGSGTFPSFTGDFDELLNSQEFFSGYLWNY

SEQ ID NO: 187 - DNA, 1432 bp, Arabidopsis thaliana
  misc_feature (1419)..(1419): n is a, c, g, or t
  G1757,family:WRKY
atcaccaatcctataacactctcattctcatcatatcattcttcaatctatataacccattcttaattatactcaacacacattatatttttctgatcatatcattctttcagtccatctatataaccaattcttgatttatacttaaaacacacattatacatctttctcatcatagtttgtatcaatttcctagagtaaactacctaaaggaaaaaaaaaatctattttgggaatcatatactaaaaatggaaggaagagatatgttaagttgggagcaaaagacattgctaagcgagcttatcaatggatttgatgcggccaaaaagcttcaggcacgacttagagaagctccgtcgccgtcgtcatcattttcatcaccggcgacggctgttgctgagactaacgagattctggtgaagcagatagtttcttcctacgagagatctcttcttctgctaaactggtcatcctcaccgagcgtacaacttattccgacgccggttactgtagtcccggtggcaaatcccggcagtgttccagaatctccggcatcgataaacggaagtccgagaagtgaagagtttgccgatggaggaggttctagcgagagtcatcatcgccaagattacattttcaattcaaagaaaagaaagatgttaccaaagtggtcagaaaaagtgagaataagcccagagagaggcttagaaggacctcaagatgatgtctttagctggagaaaatatggtcaaaaagacattttaggcgccaaattcccaaggagttattacagatgcacacatcgtagcacacaaaactgttgggcaacgaaacaagtccagagatcagacggggatgctacggttttcgaagtgacgtacagaggaacacacacttgttcgcaggcgatcacaagaacaccaccattagcctcgccggagaagcgacaagacaccagagtcaaaccagccattacccaaaagccaaaggatattctcgagagtcttaaatccaacttaaccgttcgaaccgatgggcttgatgatggtaaagacgttttctcgttccctgatacgccgccgttttacaattacggaactatcaacggcgagttcggccacgtggagagttctccgatcttcgacgttgttgactggttcaatccaacggtcgagattgacacaactttccccgcgtttttacacgagtcgatttattattaattaaaatttgtaacagagaaatagatagtaactagtaagtaatgatcagcgagagttaaaacataaaagtacttagagtaatctaacgatgcataataaggaatgttcaacaggacttgaacatgatttcaatactaagagagatttatctagctactggtagtagccgcagacttcttgttgtagcttcacttnctttttgttgctt

SEQ ID NO: 188 - protein, 324 aa, Arabidopsis thaliana
  G1757,WRKY domain coordinates 158-218
MEGRDMLSWEQKTLLSELINGFDAAKKLQARLREAPSPSSSFSSPATAVAETNEILVKQIVSSYERSLLLLNWSSSPSVQLIPTPVTVVPVANPGSVPESPASINGSPRSEEFADGGGSSESHHRQDYIFNSKKRKMLPKWSEKVRISPERGLEGPQDDVFSWRKYGQKDILGAKFPRSYYRCTHRSTQNCWATKQVQRSDGDATVFEVTYRGTHTCSQAITRTPPLASPEKRQDTRVKPAITQKPKDILESLKSNLTVRTDGLDDGKDVFSFPDTPPFYNYGTINGEFGHVESSPIFDVVDWFNPTVEIDTTFPAFLHESIYY

SEQ ID NO: 189 - DNA, 1038 bp, Arabidopsis thaliana
  G1760,family:MADS
ccctaaaaaagagaagaaccagaggagattcaattagaggataaaattgatgggaagagggaagattgtgatccaaaggatcgatgattcaacgagtagacaagtcactttctccaaacgaagaaagggccttatcaagaaagccaaagagctagctattctctgtgatgccgaggtcggtctcatcatcttctctagcaccggaaagctctatgactttgcaagctccagcatgaagtcggttattgatagatacaacaagagcaagatcgagcaacaacaactattgaaccccgcatcagaagtcaagttttggcagagagaagctgctgttctaagacaagaactgcatgctttgcaagaaaatcatcggcaaatgatgggagaacagctaaatggtttaagtgttaacgagctaaacagtcttgagaatcaaattgagataagtttgcgtggaattcgtatgagaaaggaacaactgttgactcaagaaatccaagaactaagccaaaagaggaatcttattcatcaggaaaacctcgatttatctaggaaagtacaacggattcatcaagaaaatgtggagctctacaagaaggcttatatggcaaacacaaacgggtttacacaccgtgaagtagctgttgcggatgatgaatcacacactcagattcggctgcaactaagccagcctgaacattccgattatgacactccaccaagagcaaacgaataacagagagattgaagttggaagataccatgatgttgaagaacactccaaaggccttggtttgaataaggttcttgaactggaaacctctatacaccaagccacgtacgataagcagcatggttcttctaacatagtcatattttcaatcctaaatataattaaagcatatataattaaaatccggtgttgttatactcatcttgagtattaatattgtacttgtttataaccatagattcgtcaattaatagagaaaaatcatatgaattattatccaaaaaaaaaaaaaaaaaaaaaaaaaa

SEQ ID NO: 190 - protein, 228 aa, Arabidopsis thaliana
  G1760,MADS domain coordinates 2-57
MGRGKIVIQRIDDSTSRQVTFSKRRKGLIKKAKELAILCDAEVGLIIFSSTGKLYDFASSSMKSVIDRYNKSKIEQQQLLNPASEVKFWQREAAVLRQELHALQENHRQMMGEQLNGLSVNELNSLENQIEISLRGIRMRKEQLLTQEIQELSQKRNLIHQENLDLSRKVQRIHQENVELYKKAYMANTNGFTHREVAVADDESHTQIRLQLSQPEHSDYDTPPRANE

SEQ ID NO: 191 - DNA, 450 bp, Arabidopsis thaliana
  G1795,family:AP2
acaaacacgcaaaaagtcattaatatatggatcaaggaggtcgaggtgtcggtgccgagcatggaaagtaccggggagttcggagacgaccttggggaaaatatgcagcagagatacgagattcgaggaagcacggtgaacgtgtgtggcttggaacgttcgatacggcagaggaagcggctagagcctatgaccaagctgcttactccatgagaggccaagcagcaatccttaacttccctcatgagtataacatggggagtggtgtctcttcttccaccgccatggctggatcttcctccgcctccgcctccgcttcttcttcttctaggcaagtttttgaatttgagtacttggatgatagtgttttggaggagctccttgaggaaggagagaaacctaacaagggcaagaagaaatgagcgagatataattcatgattatttctaa

SEQ ID NO: 192 - protein, 131 aa, Arabidopsis thaliana
  G1795,AP2 domain coordinates 11-75
MDQGGRGVGAEHGKYRGVRRRPWGKYAAEIRDSRKHGERVWLGTFDTAEEAARAYDQAAYSMRGQAAILNFPHEYNMGSGVSSSTAMAGSSSASASASSSSRQVFEFEYLDDSVLEELLEEGEKPNKGKKK

SEQ ID NO: 193 - DNA, 833 bp, Arabidopsis thaliana
  G1798,family:MADS
atggtgagagggaagatcgagatcaagaagattgagaacgtgacgagcagacaagtcacgttctcgaagcgaagaagcggtctatttaagaaggctcatgagctttcggttctatgcgatgctcaagtagccgccattgtcttttctcagagcggaagattacacgaatactctagctcccagatggagaagattatagatagatatggcaagtttagtaatgccttctatgtggcagagaggcctcaagtagaacgatacttgcaggagctgaagatggaaattgatagaatggtgaaaaagattgatctccttgaagttcatcaccgtaagctgttggggcaaggtttggattcgtgttcagtgacagaacttcaagagattgacactcaaattgagaaaagccttcgtattgtcaggtcaagaaaggctgagttatatgcagatcaactgaaaaagctaaaagaaaaggagagggagctcttgaacgagagaaaaaggctgcttgaagagcaaaatagagaaaggttgatgcgaccggtggtgccagcaactttacaaatatgtgataagggtaatactgaaggtggtcacagaaccaaacattcatcagaggttgaaaccgacctatttatcggattgcccgtgactcggctataacatattactttggttccatgtttgtacactataatgcttccatacagtttatagttttctgagtgctcatgcatgaccatctcttcatatatatatgtgtataaactgaaaataatttgacatgtattatttgtcactttagtttttcttttgaatgaatgtgacattttgtt

SEQ ID NO: 194 - protein, 219 aa, Arabidopsis thaliana
  G1798,MADS domain coordinates 1-57
MVRGKIEIKKIENVTSRQVTFSKRRSGLFKKAHELSVLCDAQVAAIVFSQSGRLHEYSSSQMEKIIDRYGKFSNAFYVAERPQVERYLQELKMEIDRMVKKIDLLEVHHRKLLGQGLDSCSVTELQEIDTQIEKSLRIVRSRKAELYADQLKKLKEKERELLNERKRLLEEQNRERLMRPVVPATLQICDKGNTEGGHRTKHSSEVETDLFIGLPVTRL

SEQ ID NO: 195 - DNA, 604 bp, Arabidopsis thaliana
  G1809,family:bZIP
ctctctattctcgtctttagcaaaatctcaaaagacaaaaagatattgatgtctctccaacgacccaatgggaactcgagttcgtcttcttcccacaagaagcacaaaactgaggaaagtgatgaggagttgttgatggttcctgacatggaagcagctggatcaacatgtgttctaagcagcagcgccgacgatggagtcaacaatccggagcttgaccagactcaaaatggagtctctacagctaaacgccgccgtggaagaaaccctgttgataaagaatatagaagcctcaagagattattgaggaacagagtatcagcgcaacaagcaagagagaggaagaaagtgtatgtgagtgatttggaatcaagagctaatgagttacagaacaacaatgaccagctcgaagagaagatttctactttgacgaacgagaacacaatgcttcgtaaaatgcttattaacacaaggcctaaaactgatgacaatcactaaatatttaccctttaatccattgttcagtgttgtatgattatctttctttcttttttggttttggtttgtatacactttttgttcgaataacattcactttgagcat

SEQ ID NO: 196 - protein, 149 aa, Arabidopsis thaliana
  G1809,bZIP domain coordinates 23-35,68-147
MSLQRPNGNSSSSSSHKKHKTEESDEELLMVPDMEAAGSTCVLSSSADDGVNNPELDQTQNGVSTAKRRRGRNPVDKEYRSLKRLLRNRVSAQQARERKKVYVSDLESRANELQNNNDQLEEKISTLTNENTMLRKMLINTRPKTDDNH

SEQ ID NO: 197 - DNA, 1563 bp, Arabidopsis thaliana
  G1812,family:PCOMB
aaaggtgagttgtgtgttgtgtcaggtccaaaataaaagtttgtcgtgaggtcaaaatctacggttacagtaattttaataacctgtgaatctgtgtctaatcgaaaattacaaaacaccagttgttgttgcatgagagacttgtgagcttagattagtgtgcgagagtcagacagagagagagatttcgaatatcgaatgtcgaagataaccttagggaacgagtcaatagttgggtctttgactccatcgaataagaaatcgtacaaagtgacgaataggattcaggaagggaagaaacctttgtatgctgttgttttcaacttccttgatgctcgtttcttcgatgtcttcgttaccgctggtggaaatcggattactctgtacaattgtctcggagatggtgccatatcagcattgcaatcctatgctgatgaagataaggaagagtcgttttacacggtaagttgggcgtgtggcgttaatgggaacccatatgttgcggctggaggagtaaaaggtataatccgagtcattgacgtcaacagtgaaacgattcataagagtcttgtgggtcatggagattcagtgaacgaaatcaggacacaacctttaaaacctcaacttgtgattactgctagcaaggatgaatctgttcgtttgtggaatgttgaaactgggatatgtattttgatatttgctggagctggaggtcatcgctatgaagttctaagtgtggattttcatccgtctgatatttaccgctttgctagttgtggtatggacaccactattaaaatatggtcaatgaaagagttttggacgtacgtcgagaagtcattcacatggactgatgatccatcaaaattccccacaaaatttgtccaattccctgtatttacagcttccattcatacaaattatgtagattgtaaccgttggtttggtgattttatcctctcaaagagtgtggacaacgagatcctgttgtgggaaccacaactgaaagagaattctcctggcgagggagcttcagatgttctattaagatacccggttccaatgtgtgatatttggtttatcaagttttcttgtgacctccatttaagttctgttgcgataggtaatcaggaaggaaaggtttatgtctgggatttgaaaagttgccctcctgttttgattacaaagttatcacacaatcaatcaaagtctgtaatcaggcaaacagccatgtctgtcgatggaagcacgattcttgcttgctgcgaggacgggactatatggcgctgggacgtgattaccaagtagcggtctgagtcttgtaggaattgatgaattaggagtgcgaagaaatgagatatccattcttttattgtaattctgatcatgttgctactccctgagaccttgagatgctctttgtagccttgttaacgtccacccttgtaccacagtgtataccctttctggagattttgtcttattctcttagttcaatacacaaggctgtatcctggagctttattgcaggaaccactctctttcataagctttctagtattc

SEQ ID NO: 198 - protein, 369 aa, Arabidopsis thaliana
  G1812,PCOMB domain coordinates 32-365
MSKITLGNESIVGSLTPSNKKSYKVTNRIQEGKKPLYAVVFNFLDARFFDVFVTAGGNRITLYNCLGDGAISALQSYADEDKEESFYTVSWACGVNGNPYVAAGGVKGIIRVIDVNSETIHKSLVGHGDSVNEIRTQPLKPQLVITASKDESVRLWNVETGICILIFAGAGGHRYEVLSVDFHPSDIYRFASCGMDTTIKIWSMKEFWTYVEKSFTWTDDPSKFPTKFVQFPVFTASIHTNYVDCNRWFGDFILSKSVDNEILLWEPQLKENSPGEGASDVLLRYPVPMCDIWFIKFSCDLHLSSVAIGNQEGKVYVWDLKSCPPVLITKLSHNQSKSVIRQTAMSVDGSTILACCEDGTIWRWDVITK

SEQ ID NO: 199 - DNA, 1308 bp, Arabidopsis thaliana
  G1817,family:PMR
atgaaggacgcagagaagcgagaggtgattgcatcatcatcattacaaagaaagagaaacagaggaagaagactaaggaaaagaagaagaagaaacgagaagcgagtactaatggttccatcatcattaccaaacgacgtgctagaggagatctttttaagatttccggttaaagccctaatccgactcaagtctctctcgaaacaatggagatcgacgatcgaatctcgcagttttgaagagagacacttgacgatcgctaagaaagccttcgtggatcatcccaaggtcatgctcgtaggagaagaagatcccataagaggaaccgggattcgtccagacactgacattggttttaggttattctgcttggaatcggcttctcttctatcctttactcgtctcaatttccctcaagggttcttcaactggatctacatatctgaaagctgtgatggccttttctgcatccattccccaaaatcacattccgtatatgtagtgaatccggctacacggtggctccgcctacttcctccggcagggtttcagattttgatccacaagtttaaccccactgaacgtgagtggaatgtagtgatgaaatcaatctttcatctagcattcgtgaaggccaccgattacaaattagtgtggttgtacaattgtgataagtacattgttgatgcgtcgagtccaaacgtgggagtcacaaagtgcgagatttttgactttaggaaaaatgcttggaggtacttggcttgcactccaagtcatcagatattctattaccaaaagccagcatctgcaaacgggtcggtttattggtttacagaaccatataatgaaagaatcgaagtagtggcttttgatattcagaccgaaacattccggttgctgcctaagattaatccggctattgctggttcagatcctcaccatattgacatgtgcactctggataatagtttgtgtatgtcgaaaagggagaaagatactatgatccaagatatttggaggttgaaaccatcagaagacacatgggaaaagatttttagcatagacttggtttcctgtccttcttctcggactgagaagcgtgatcaatttgattggagcaagaaggatagggttgagccagccacacccgtcgcggtttgtaagaataagaagatccttctctcacatcgctattcccgaggtttggtaaagtacgatcccctaacaaaatctatcgattttttttccggacatcctaccgcttacagaaaagttatttattttcaaagtttgatatctcatctataa

SEQ ID NO: 200 - protein, 435 aa, Arabidopsis thaliana
  G1817,PMR domain coordinates 47-331
MKDAEKREVIASSSLQRKRNRGRRLRKRRRRNEKRVLMVPSSLPNDVLEEIFLRFPVKALIRLKSLSKQWRSTIESRSFEERHLTIAKKAFVDHPKVMLVGEEDPIRGTGIRPDTDIGFRLFCLESASLLSFTRLNFPQGFFNWIYISESCDGLFCIHSPKSHSVYVVNPATRWLRLLPPAGFQILIHKFNPTEREWNVVMKSIFHLAFVKATDYKLVWLYNCDKYIVDASSPNVGVTKCEIFDFRKNAWRYLACTPSHQIFYYQKPASANGSVYWFTEPYNERIEVVAFDIQTETFRLLPKINPAIAGSDPHHIDMCTLDNSLCMSKREKDTMIQDIWRLKPSEDTWEKIFSIDLVSCPSSRTEKRDQFDWSKKDRVEPATPVAVCKNKKILLSHRYSRGLVKYDPLTKSIDFFSGHPTAYRKVIYFQSLISHL

SEQ ID NO: 201 - DNA, 1740 bp, Arabidopsis thaliana
  G1818,family:CAAT
taacaaatcaaataattagagaaataaccaaaatttaacttttagagggactacaggatttgtactttgtacattcatatattattgttatatatcgtttcatacattaatttgaaccaatgtaaattaagtaaaattcaatttaacatcatgagcaaattcttattaaaattctcttaaaattttgagcaaattatgctttcacatttaacatttgaaaacatcatttttaacaagatattcaaaactaagttttgtacagcaaaattttaactttcaattttatagagaaaaaggtatttttttttttgtttcatttttataagactattatttggtatataatatacactttaagtaaaaacaaatctctttcttttttcttcttataataccaaccacaagtctgtcagtcacacacatacagttaataacattaaatattcttaacaaactactaaataggttgagattcatatatgtaaagagatcacttcttaatcttatcctaccatatcttatatacgcttaattttcctttatatatgcaaacctccacataaaaatatctcaaacccaaacacttcaaacaaaaaaaaaatggagaacaacaacaacaaccaccaacagccaccgaaagataacgagcaactaaagagtttctggtcaaaggggatggaaggtgacttgaatgtcaagaatcacgagttccccatctctcgtatcaagaggataatgaagtttgatccggatgtgagtatgatcgctgctgaggctccaaatctcttatctaaggcttgtgaaatgtttgtcatggacctcacgatgcgttcatggctccatgctcaagagagcaaccgactcacgatacggaaatctgatgttgatgccgtagtgtctcaaaccgtcatctttgatttcttgcgtgatgatgtccctaaggacgagggagagcccgttgtcgccgctgctgatcctgtggacgatgttgctgatcatgtggctgtgccagatcttaacaatgaagaactgccgccgggaacggtgataggaactccggtttgttacggtttaggaatacacgcgccacacccgcagatgcctggagcttggaccgaggaggatgcgactggggcaaatggaggaaacggtgggaattaatatttggattgggttttgtaaccgctgttgtgagaacttgaatttctttttgagttctgcttatgttttcaatgttatgttttttagttgttgaatgtatttctgttgttttgtccaaaaaaaaaaaagaatgtatttctgttgttgtctttcaaatgaatctaatggtttatgaatattggctttagattaatttatgcatacaaaaacacaaggattacggataaaaaagtcctcagtttacccatggaaacataatcttctagtgattccttatgagagtagaaaagaatcatatattataatctatttcataagagatagggtactgtaaacaaggatgtttattcggctatttcttttttttttaatcacttttacttgtcaagactcttttgtgtttgcagctttttgttagattacattctagaggcaacaagatccagagatctagcaaaaaaaacttattttgaaacctgaatctattttaaaaattttccaactcatttttcgttcttattctttgttttccaacggaatttggcgcacaaacgatttatttgaattttgtctttcaag

SEQ ID NO: 202 - protein, 186 aa, Arabidopsis thaliana
  G1818,CAAT domain coordinates 24-116
MENNNNNHQQPPKDNEQLKSFWSKGMEGDLNVKNHEFPISRIKRIMKFDPDVSMIAAEAPNLLSKACEMFVMDLTMRSWLHAQESNRLTIRKSDVDAVVSQTVIFDFLRDDVPKDEGEPVVAAADPVDDVADHVAVPDLNNEELPPGTVIGTPVCYGLGIHAPHPQMPGAWTEEDATGANGGNGGN

SEQ ID NO: 203 - DNA, 924 bp, Arabidopsis thaliana
  G1825,family:GARP
agtaattgatctcgagagctagctaaagacactctcgccggagagacatggccgggagatcttcgccgggaaaatgctccacgtggcttgacctgaacagagaagaaacagtggagaagaacaatgaagaagagtcatcagtggaagacgaagaccaaatcacgaataacgttagacagtatattcggtccaacatgcctcggcttcgttggacgcctgatcttcatctctccttcgttcgtgctgtccaacgactaggcggtccagacagagcgacgccgaaattggttcttgagatgatgaatctaaaaggattgagtattgcacatgtcaagagtcatttacagatgtatcgaagtaagaagctcgagccgtcttctcgccctggatttggagctttcatgagtggacaaagaagctatttgatggacatgatcgactctcgatgtatccctcatagcgatttaagacatgcctataactctaaaaccgttccttcgagggtactcaatcaagacgcggtcgttacaaatcttggaggtaactttcttatgcgaccttcgagctggtttagcgggttatgcagaaatgaccgagacagcacagagaacaagactctgcctctactcgagattaggaagaagaacaatgagaaaagagtccgagatgaagaagtatcatcagtcaaacgattgaaatcaatgtccggaggtgggatacagttgcctgagtttggaaattgcaggcaaaaaccaacagatgatatcaacacaatgctctcgctctctctgttgtcgacatcatcagaaccgtaaccaacatactagagagatgaagtttaactttaaaagagattcaagagtagagacttttgttttccttagccgtttcatgggatgagtacttagccaggatctggatcag

SEQ ID NO: 204 - protein, 255 aa, Arabidopsis thaliana
  G1825,GARP domain coordinates 55-103
MAGRSSPGKCSTWLDLNREETVEKNNEEESSVEDEDQITNNVRQYIRSNMPRLRWTPDLHLSFVRAVQRLGGPDRATPKLVLEMMNLKGLSIAHVKSHLQMYRSKKLEPSSRPGFGAFMSGQRSYLMDMIDSRCIPHSDLRHAYNSKTVPSRVLNQDAVVTNLGGNFLMRPSSWFSGLCRNDRDSTENKTLPLLEIRKKNNEKRVRDEEVSSVKRLKSMSGGGIQLPEFGNCRQKPTDDINTMLSLSLLSTSSEP

SEQ ID NO: 205 - DNA, 1376 bp, Arabidopsis thaliana
  G1826,family:GARP
tgtttgatctttgtccagagaactccaagatagaccaaaaaggttcaacctcaaaacaaacaacacaaaaacagccaaatagctagagaccaagatgagatcaagcagccaaaattctgaaaactccaagacttgtctatctaacaacatcaaagcaaccaccaagaatgaagaagataaagatgaagaggatgatgaagaaggcgaagaggatgaagaagagagatctggagatcagagcccatctagcaatagctatgaggaagagagtgggagtcaccaccatgatcagaacaagaagaatggaggatccgtgaggccgtacaaccgctcaaagactccgaggctgcgatggacgccggagctccatatttgctttcttcaagctgtggagagattgggtggcccagatagagcaacaccgaagcttgttctccaattgatgaacgtcaaggggctaagtattgcccatgttaagagtcatcttcagatgtacagaagcaagaagaccgatgagcctaatgaaggagatcaaggattttcgtttgaacacggagctggttacacttacaaccttagccaacttccaatgctacaaagttttgatcaaaggccttcttctagtttaggatatggtggtggttcgtggactgaccacagacgacagatctaccgtagcccttggagaggattaacgacacgagaaaatacaagaacaagacaaacaatgtttagctcacagcctggtgagagatatcacggagttagcaatagtattcttaacgataagaacaaaactatttcatttcgaatcaattctcatgaaggggttcatgataacaatggagtagctggagctgttccaagaattcatagaagttttcttgaaggtatgaaaacgtttaacaaatcatggggacagagcctctcttccaatcttaagtcctccaccgcaacaataccacaagatcatattgctacaacgctaaattcttatcaatgggagaatgctggagtggcagaaggatcagagaatgttttgaagaggaagaggttattattttctgatgactgcaataagtcagaccaagatttggatctaagcttgtcccttaaggtacctcggacacacgacaatcttggagaatgcttgttagaagatgaagtaaaagaacatgatgatcatcaagatatcaagagtttgtctctttcgttatcatcttcaggttcatcaaaactcgaccgaaccattaggaaagaagatcaaactgatcacaaaaagagaaagatttcggtcttggcaagtccccttgatctcactctgtgaatatgtataacaacttatatacgtatattctaagtgagatcttgtggta

SEQ ID NO: 206 - protein, 410 aa, Arabidopsis thaliana
  G1826,GARP domain coordinates 87-135
MRSSSQNSENSKTCLSNNIKATTKNEEDKDEEDDEEGEEDEEERSGDQSPSSNSYEEESGSHHHDQNKKNGGSVRPYNRSKTPRLRWTPELHICFLQAVERLGGPDRATPKLVLQLMNVKGLSIAHVKSHLQMYRSKKTDEPNEGDQGFSFEHGAGYTYNLSQLPMLQSFDQRPSSSLGYGGGSWTDHRRQIYRSPWRGLTTRENTRTRQTMFSSQPGERYHGVSNSILNDKNKTISFRINSHEGVHDNNGVAGAVPRIHRSFLEGMKTFNKSWGQSLSSNLKSSTATIPQDHIATTLNSYQWENAGVAEGSENVLKRKRLLFSDDCNKSDQDLDLSLSLKVPRTHDNLGECLLEDEVKEHDDHQDIKSLSLSLSSSGSSKLDRTIRKEDQTDHKKRKISVLASPLDLTL

SEQ ID NO: 207 - DNA, 668 bp, Arabidopsis thaliana
  G1836,family:CAAT
ataacaagcctagaacactagaaacttcaaaaaagaaaaaaatcttatggagaacaacaacggcaacaaccagctgccaccgaaaggtaacgagcaactgaagagtttctggtcaaaagagatggaaggtaacttagatttcaaaaatcacgaccttcctataactcgtatcaagaagattatgaagtatgatccggatgtgactatgatagctagtgaggctccaatcctcctctcgaaagcatgtgagatgtttatcatggatctcacgatgcgttcgtggctccatgctcaggaaagcaaacgagtcacgctacagaaatctaatgtcgatgccgcagtggctcaaactgttatctttgatttcttgcttgatgatgacattgaggtaaagagagagtctgttgccgccgctgctgatcctgtggccatgccacctattgacgatggagagctgcctccaggaatggtaattggaactcctgtttgttgtagtcttggaatccaccaaccacaaccacaaatgcaggcatggcctggagcttggacctcggtgtctggtgaggaggaagaagcgcgtgggaaaaaaggaggtgacgacggaaactaataagtggaatacgttttagggtattttcaagggaatatgtagtaaatagtcatggatc

SEQ ID NO: 208 - protein, 187 aa, Arabidopsis thaliana
  G1836,CAAT domain coordinates 24-110
MENNNGNNQLPPKGNEQLKSFWSKEMEGNLDFKNHDLPITRIKKIMKYDPDVTMIASEAPILLSKACEMFIMDLTMRSWLHAQESKRVTLQKSNVDAAVAQTVIFDFLLDDDIEVKRESVAAAADPVAMPPIDDGELPPGMVIGTPVCCSLGIHQPQPQMQAWPGAWTSVSGEEEEARGKKGGDDGN

SEQ ID NO: 209 - DNA, 834 bp, Arabidopsis thaliana
  G1844,family:MADS
agaaattaggggattagatgtgtcggaagagtgaagccatgggaagaagaagagtagagatcaaacgaattgagaacaaaagcagtagacaagtcactttctgtaagagacgaaatggtctcatggagaaagctcgtcaactctcaattctctgtggatcctccgtcgctcttttcatcgtctcttccaccggcaaactctacaactcctcctccggcgacagcatggccaagatcatcagtcgttttaaaatacaacaagctgatgatcctgaaaccttggatcttgaagacaaaactcaggattatctttcacacaaggagttactagaaatagttcaaagaaagattgaagaagcaaaaggggataatgtaagtatagaatctctaatttccatggaagagcagctcaagagtgctctgtctgtaattagagctaggaagacagagttattgatggagcttgtgaagaaccttcaggataaggagaagttgctgaaagaaaagaacaaggttctagctagcgaggtggggaagctgaagaaaattttggaaacaggggatgaaagagcagtaatgtcaccggaaaatagctctggccacagcccaccggagactctcccgcttctcaagtaaccaccaatcatcaacggctgatttttcatcatcctgattcaaaaaaggtaaaaaaaattcatgtgtaaaaatcataaagaagctacatgttttaaaatcctcttctccccctgcatacggataaatttatagaccaaaaatataatgttttccctcaaataagatatcgacctttgtgttaccttggaagacaggatca

SEQ ID NO: 210 - protein, 198 aa, Arabidopsis thaliana
  G1844,MADS domain coordinates 2-57
MGRRRVEIKRIENKSSRQVTFCKRRNGLMEKARQLSILCGSSVALFIVSSTGKLYNSSSGDSMAKIISRFKIQQADDPETLDLEDKTQDYLSHKELLEIVQRKIEEAKGDNVSIESLISMEEQLKSALSVIRARKTELLMELVKNLQDKEKLLKEKNKVLASEVGKLKKILETGDERAVMSPENSSGHSPPETLPLLK

SEQ ID NO: 211 - DNA, 1110 bp, Arabidopsis thaliana
  G1883,family:Z-Dof
atggacgctacgaagtggacacagggttttcaagaaatgatgaacgttaaaccaatggagcagatcatgattcctaataacaacacacatcaaccaaacaccacatccaatgcaaggccaaacaccattctcacatctaacggcgtctcaactgctggagcaaccgtctccggcgtaagcaacaacaataacaatacggcggttgtggcggagaggaaagcaagaccacaagagaaactaaattgtccaagatgcaactcaaccaacacaaagttttgttactacaacaactatagtctcacacaaccaagatacttctgcaaaggttgtcgaaggtattggaccgaaggtggatctcttaggaatgttcctgtgggaggaagctcaagaaagaacaagagatcatcttcatcttcttcatcaaacatccttcagacaataccatcttcacttccagatctaaacccgccaatactcttctcaaaccaaatccataataaatcgaaagggtcatcacaagatctcaacttgttgtctttcccagtcatgcaagatcaacatcatcatcatgtccatatgtctcagtttcttcagatgcctaagatggagggaaatggtaacataactcatcagcagcagccttcatcatcttcttctgtctatggttcctcgtcgtctcctgtttcagctcttgaacttttaagaaccggagttaatgtttcttcaagatcagggattaactcatcgttcatgccttccggttcaatgatggattcaaacactgtgctttacacttcttcagggtttccaacaatggtggattacaagccaagtaatctctccttctctaccgatcatcaagggcttggacacaatagcaacaataggtctgaagctcttcatagtgatcatcaccaacaaggtagagttttgtttccatttggggatcaaatgaaggagctttcatcaagcataacacaagaagttgatcatgatgataatcaacaacagaagagtcatggaaataataataataataataactcaagccctaataatggatattggagtgggatgttcagtactacaggaggaggatcttcatggtga

SEQ ID NO: 212 - protein, 369 aa, Arabidopsis thaliana
  G1883,Z-Dof domain coordinates 82-124
MDATKWTQGFQEMMNVKPMEQIMIPNNNTHQPNTTSNARPNTILTSNGVSTAGATVSGVSNNNNNTAVVAERKARPQEKLNCPRCNSTNTKFCYYNNYSLTQPRYFCKGCRRYWTEGGSLRNVPVGGSSRKNKRSSSSSSSNILQTIPSSLPDLNPPILFSNQIHNKSKGSSQDLNLLSFPVMQDQHHHHVHMSQFLQMPKMEGNGNITHQQQPSSSSSVYGSSSSPVSALELLRTGVNVSSRSGINSSFMPSGSMMDSNTVLYTSSGFPTMVDYKPSNLSFSTDHQGLGHNSNNRSEALHSDHHQQGRVLFPFGDQMKELSSSITQEVDHDDNQQQKSHGNNNNNNNSSPNNGYWSGMFSTTGGGSSW

SEQ ID NO: 213 - DNA, 1503 bp, Arabidopsis thaliana
  G1895,family:Z-Dof
cgtcgaccacataacacaaatctaatctcatactccatcttcttttctgtcttatgtcttcaaagattggtatgtctcaagttagagatactccggttaaattgtttggctggacaattacaccggtttctcatgatccatactcttcttcgtcccatgttcttcctgattcttcctcgtcttcctcgtcttcttctctatcacttcgaccacacatggtatgtttcatggtcttacctttatttgttaagaaatgctaaagatttaatattttctctagtccttgtatcagtttgaaactagttcatgatgttaatcctaatccaagttccttcaatttttttcagatgaataaccaatctgttactgacaatacaagtcttaagctgtcatctaatcttaacaacgagtcaaaagaaacatctgagaacagtgatgaccaacacagcgagatcacaacaattacatcggaagaagagaaaacaactgaactgaagaaaccagacaagattcttccatgtccgagatgcaacagcgcagacaccaaattctgttactacaacaactacaacgttaaccagccacgtcacttctgtagaaaatgccagaggtattggaccgctggtggatccatgaggatcgtcccggttggctcaggccgtcgcaagaacaagggatgggtttcttcagaccagtacctgcacatcacttccgaggatactgacaattacaatagctcctcaacaaagattctaagcttcgagtcttcggactctttggtaactgagaggcctaagcatcaatcaaacgaagtgaagataaacgctgaacctgtttcacaagaacccaacaacttccaagggttacttcctccccaagcatcccctgtttcgcctccttggccttaccaataccctccaaaccctagtttctaccacatgcccgtctactggggctgcgcgataccggtttggtctaccctcgacacttctacatgtcttgggaaaaggacaagagacgaaacttctcatgaaactgttaaagagagtaaaaatgcttttgagagaacaagcatgcttttggaatctcagagcatcaaaaatgaaacaagtatggctacaaataaccatgtgtggtatccagtaccgatgacccgcgagaagacacaagaattcagctttttcagtaatggagctgaaacaaagagcagcaacaacagattcgtccctgaaacgtatcttaacctgcaagcaaaccctgcagccatggcaagatctatgaacttcagagagagcatataacgttaaaggagaaaagaaactttgtagatacctttttttgtgtgatgaattaacttttaatatctatcttatttatataccacaatccccattttgtagattatccaaacagatggaaatgctgaagtgtaatgtcttttttggtaaatgtggttcgaaaatattgtttactccattatttgtattctgtagtactagtgtc

SEQ ID NO: 214 - protein, 317 aa, Arabidopsis thaliana
  G1895,Z-Dof domain coordinates 58-100
MNNQSVTDNTSLKLSSNLNNESKETSENSDDQHSEITTITSEEEKTTELKKPDKILPCPRCNSADTKFCYYNNYNVNQPRHFCRKCQRYWTAGGSMRIVPVGSGRRKNKGWVSSDQYLHITSEDTDNYNSSSTKILSFESSDSLVTERPKHQSNEVKINAEPVSQEPNNFQGLLPPQASPVSPPWPYQYPPNPSFYHMPVYWGCAIPVWSTLDTSTCLGKRTRDETSHETVKESKNAFERTSMLLESQSIKNETSMATNNHVWYPVPMTREKTQEFSFFSNGAETKSSNNRFVPETYLNLQANPAAMARSMNFRESI

SEQ ID NO: 215 - DNA, 615 bp, Arabidopsis thaliana
  G1902,family:Z-Dof
atgcaggatccagcagcatattaccagacgatgatggcgaagcaacaacaacaacaacaaccacagtttgcagagcaagaacagttaaagtgtcctcgttgtgactcaccaaacactaaattctgttactacaacaactacaatctctcacagcctcgtcacttttgcaaaagctgtcgtcgttactggactaaaggcggcgctctccgtaacgttcccgtcggtggtggttctcgtaagaacgcaaccaaacgatccacttcttcttcttcttctgcttcctctccttccaacagtagccaaaacaagaagacgaaaaacccggatccggatcctgatccacgtaattctcaaaaaccggatttggatccgacccggatgctttacgggtttccgatcggtgaccaagacgtgaagggtatggagattggtggaagctttagctcgttgttggcgaataatatgcagcttggtcttggaggaggagggatcatgcttgacgggtcgggttgggatcatccgggtatgggtttgggtttgaggagaaccgaaccgggtaataataataataacccatggaccgatctggctatgaacagagcggagaaaaactga

SEQ ID NO: 216 - protein, 204 aa, Arabidopsis thaliana
  G1902,Z-Dof domain coordinates 31-59
MQDPAAYYQTMMAKQQQQQQPQFAEQEQLKCPRCDSPNTKFCYYNNYNLSQPRHFCKSCRRYWTKGGALRNVPVGGGSRKNATKRSTSSSSSASSPSNSSQNKKTKNPDPDPDPRNSQKPDLDPTRMLYGFPIGDQDVKGMEIGGSFSSLLANNMQLGLGGGGIMLDGSGWDHPGMGLGLRRTEPGNNNNNPWTDLAMNRAEKN

SEQ ID NO: 217 - DNA, 294 bp, Arabidopsis thaliana
  G1911,family:MYB-related
atggcatcaagctcaatgtcttctcagagctctggctcgtggactgctaagcagaacaaagcctttgagcaggctctagcaacctatgaccaggacactcctaaccgttggcaaaatgttgccaaagtcgtgggtggaaaaacaacagaggaggtaaagagacactacgaactcttagtgcaagacatcaacagcatagagaacggtcatgttccattcccaaactacaggactagtggaggctgcactaatggcaggcttagtcaggaggaaaaaaggtatgtattgtcctaa

SEQ ID NO: 218 - protein, 97 aa, Arabidopsis thaliana
  G1911,MYB-related domain coordinates 12-62
MASSSMSSQSSGSWTAKQNKAFEQALATYDQDTPNRWQNVAKVVGGKTTEEVKRHYELLVQDINSIENGHVPFPNYRTSGGCTNGRLSQEEKRYVLS

SEQ ID NO: 219 - DNA, 1155 bp, Arabidopsis thaliana
  G1930,family:AP2
attcacattactaatctctcaagatttcacaattttcttgtgattttctctcagtttcttatttcgtttcataacatggatgccatgagtagcgtagacgagagctctacaactacagattccattccggcgagaaagtcatcgtctccggcgagtttactatatagaatgggaagcggaacaagcgtggtacttgattcagagaacggtgtcgaagtcgaagtcgaagccgaatcaagaaagcttccttcttcaagattcaaaggtgttgttcctcaaccaaatggaagatggggagctcagatttacgagaaacatcaacgcgtgtggcttggtactttcaacgaggaagacgaagcagctcgtgcttacgacgtcgcggctcaccgtttccgtggccgcgatgccgttactaatttcaaagacacgacgttcgaagaagaggttgagttcttaaacgcgcattcgaaatcagagatcgtagatatgttgagaaaacacacttacaaagaagagttagaccaaaggaaacgtaaccgtgacggtaacggaaaagagacgacggcgtttgctttggcttcgatggtggttatgacggggtttaaaacggcggagttactgtttgagaaaacggtaacgccaagtgacgtcgggaaactaaaccgtttagttataccaaaacaccaagcggagaaacattttccgttaccgttaggtaataataacgtctccgttaaaggtatgctgttgaatttcgaagacgttaacgggaaagtgtggaggttccgttactcttattggaatagtagtcaaagttatgtgttgaccaaaggttggagtagattcgttaaagagaagagactttgtgctggtgatttgatcagttttaaaagatccaacgatcaagatcaaaaattctttatcgggtggaaatcgaaatccgggttggatctagagacgggtcgggttatgagattgtttggggttgatatttctttaaacgccgtcgttgtagtgaaggaaacaacggaggtgttaatgtcgtcgttaaggtgtaagaagcaacgagttttgtaataacaatttaacaacttgggaaagaaaaaaaagctttttgattttaatttctcttcaacgttaatcttgctgagatta

SEQ ID NO: 220 - protein, 333 aa, Arabidopsis thaliana
  G1930,AP2 domain coordinates 59-124,179-273
MDAMSSVDESSTTTDSIPARKSSSPASLLYRMGSGTSVVLDSENGVEVEVEAESRKLPSSRFKGVVPQPNGRWGAQIYEKHQRVWLGTFNEEDEAARAYDVAAHRFRGRDAVTNFKDTTFEEEVEFLNAHSKSEIVDMLRKHTYKEELDQRKRNRDGNGKETTAFALASMVVMTGFKTAELLFEKTVTPSDVGKLNRLVIPKHQAEKHFPLPLGNNNVSVKGMLLNFEDVNGKVWRFRYSYWNSSQSYVLTKGWSRFVKEKRLCAGDLISFKRSNDQDQKFFIGWKSKSGLDLETGRVMRLFGVDISLNAVVVVKETTEVLMSSLRCKKQRVL

SEQ ID NO: 221 - DNA, 997 bp, Arabidopsis thaliana
  G1935,family:MADS
cttaaatatacaattttgcattcgatcaatttctctcgtgccaactaataatagattgtgttttgattattttgcagtgaccatcggatatgggtcgggttaaattggagttaaagcgtatagagaagagcacgaaccgacaaattacgttctcaaaacgtaaaaaaggtttaataaaaaaggcttatgaattgtcaacactttgtgacatcgatcttgccctcctcatgttctctccctctgatcgactatgtctcttttccggtcaaacaaggatcgaggacgttttggcgaggtacatcaatcttcctgatcaagaaagagaaaacgccatagttttccctgatcagagcaagcgccaaggtatccaaaacaaagagtatttgttaaggactttggaaaaactcaaaattgaggatgacatggctctccaaatcaacgaacctcgtccagaagccaccaactccaatgtcgaggaacttgagcaagaagtttgtagattacaacaacagcttcagatatcagaggaagaactcaggaaattcgaaccagatccaatgaggctaacatcaatggaggagattgaagcatgtgaagctaacctcatcaatacgttgacacgtgtcgtccagagaagggaacatttgttgagaaagtcctgcgaagcacaaagtaaccaacaaagcatggacgggatccttctaaatgacatcgtcgaggattggggacctgagcccgagcccaaacaagcccatatgatagctaattcggcccatcattcaaatcagccaagctatgatttactcttacgcaggagtaattcgagttcgaaccaaaatccaaaatgatattaggtgaatcgcaaggcgtcgtcgagccctgatggcaagagaatgcatgttataagacaaaaataaacgagatatctcacaaatgggtatgtacctaagcttctacgacttctctttcaaattatggtttttgtgtacaatgtttt

SEQ ID NO: 222 - protein, 252 aa, Arabidopsis thaliana
  G1935,MADS domain coordinates 1-57
MGRVKLELKRIEKSTNRQITFSKRKKGLIKKAYELSTLCDIDLALLMFSPSDRLCLFSGQTRIEDVLARYINLPDQERENAIVFPDQSKRQGIQNKEYLLRTLEKLKIEDDMALQINEPRPEATNSNVEELEQEVCRLQQQLQISEEELRKFEPDPMRLTSMEEIEACEANLINTLTRVVQRREHLLRKSCEAQSNQQSMDGILLNDIVEDWGPEPEPKQAHMIANSAHHSNQPSYDLLLRRSNSSSNQNPK

SEQ ID NO: 223 - DNA, 1554 bp, Arabidopsis thaliana
  G1942,family:HLH/MYC
cactccaaatggctcttgtgctctcagaacacacacagatataataaactcttaacgaagaagaagactttttcttttcttgagcaagctctgagaaactcacagagagggacagagagagaaatatttcattcgctactctctttaataccgccattgatgcaacctccttcgcgttaactgtcaaaatactccccaactgacaaaaattaaattcctttttttctctctcgattttaaaagctctaaaaggaacgagttgatcaagtcggtcggttctggttatcactgaatttcattcaactcggtttattccggtttaagtgtgattttcccggctaatggatctgacccaaggtttcagagctagatccggcgttgttgggccggtggccggactagaatctctcaatttcagcgacgaatttcggcacttagtgacgacgatgcctccggagactactggcggctccttcacggctttactcgagatgcctgtgactcaggccatggagcttctccatttcccagattcatcgtcttctcaggccagaaccgttaccagtggtgatatttctcctaccactcttcaccctttcggggctttgacttttccttctaactcgcttctcttggaccgcgccgctcgtttctcggtgattgctacagagcaaaacggtaatttttccggcgagactgctaactctttaccttctaatcccggcgcgaatctggacagagtcaaagccgagcctgctgagaccgattcaatggtggagaatcagaaccagagctactcttctggaaaaaggaaagaacgcgagaagaaggtcaaaagctcgacgaagaagaacaagagctccgtggagtcagacaagttgccatatgttcatgtcagagctcgtcgtggtcaagctactgataaccatagcttagcagagagagcaagaagggagaagataaacgcacgaatgaagctgctacaggaactggtcccaggctgtgataagattcagggcactgcattggttctggatgaaatcattaaccatgtgcaaactttacagcgtcaagtggagatgctatctatgagacttgctgcagtaaaccccagaatcgacttcaatctagacagcatactggcttcagagaacggctctcttatggatggtagcttcaatgcagagtcttatcatcagctgcaacaatggcctttcgacggctaccaccagccggaatggggaagagaagaagatcatcatcaagccaatttctcaatgggttcagctactttacacccaaatcaggtgaaaatggagctctaagttggaaacagtttgacatgcttatgtgtatatataagagttatatatatctactaaagtttcgattgttgaattagaggtagaaaatggttatgattgtttcaggtctttgttcatggcctttctatatttactagattcctcaatgtagaattcagaatgtctaaattgcgtttcccttgagagaagtatatgaagatttgatatgttactgaacaaaaaaaaaaaa

SEQ ID NO: 224 - protein, 327 aa, Arabidopsis thaliana
  G1942,HLH/MYC domain coordinates 188-246
MDLTQGFRARSGVVGPVAGLESLNFSDEFRHLVTTMPPETTGGSFTALLEMPVTQAMELLHFPDSSSSQARTVTSGDISPTTLHPFGALTFPSNSLLLDRAARFSVIATEQNGNFSGETANSLPSNPGANLDRVKAEPAETDSMVENQNQSYSSGKRKEREKKVKSSTKKNKSSVESDKLPYVHVRARRGQATDNHSLAERARREKINARMKLLQELVPGCDKIQGTALVLDEIINHVQTLQRQVEMLSMRLAAVNPRIDFNLDSILASENGSLMDGSFNAESYHQLQQWPFDGYHQPEWGREEDHHQANFSMGSATLHPNQVKMEL

SEQ ID NO: 225 - DNA, 1445 bp, Arabidopsis thaliana
  G1944,family:AT-hook
tcgaccttcctaatttccaacctctgttcttagcaatatattttttctccaaaaataattctcagtttgattttcttcttctagctcttaagtatatttctttgttgttatttatcttttaatcctttaatctcatctttgtttatctttaatcaaaacccaaaatttacatgggttcttgaaaatctagaagaaataaaggaaacataacaaaaatagaaagaaaaagaagctaatggtcttaaatatggagtctaccggagaagctgttagatcaaccaccggtaacgacggtggtattacggtggttagatccgacgcgccgtcagatttccacgtagctcaaagatcagaaagctcaaaccaatctcccacctctgtcactcctcctccaccacagccatcgtctcatcacacagctcctccgccgctgcaaatttcgacggtgacgactacgactacgacggccgcgatggaaggtatctccggtggactgatgaagaagaagcgtggacggccaaggaagtatggaccggacgggactgttgtagcgttatctcctaaaccgatttcatcagcgccggcgccgtcgcatcttccgccgccgagttcacacgtcatcgatttctccgcttctgagaaacgtagcaaagtgaaaccaacgaactcgtttaacagaacaaagtatcatcaccaagttgagaatttgggtgaatgggctccttgctccgtcggtggtaatttcacacctcatataatcacagtcaacaccggcgaggatgtaacaatgaagataatctcgttttcgcaacaaggacctcgctctatttgtgttctgtcagcaaacggtgttatttcaagcgttacacttcgtcagccagattcctctggcggcacattgacatacgaaggtcggtttgagatattatcattatccgggtcattcatgcctaatgattcaggcggaacacgaagtagaacgggaggaatgagtgtatcgttagcaagtcccgatggacgtgtagtaggcggtggcctcgccggtttactagtagccgcgagtccggttcaggtggttgtaggaagttttttagcgggcactgaccatcaagatcagaaaccgaaaaagaacaaacatgatttcatgttgtcgagtcctaccgctgcaattcctatctctagtgcagctgatcaccggacaatccattcggtctcgtctcttccggtcaataataatacatggcagacttctttagcttccgatccaagaaacaagcataccgatattaatgtcaatgtaacttgaaatccaatctttctctgtattttctgttaacaagtttgatttggttgtttatctacattaggattttactaaaatggtagtattatttatagggttttagggtctttattttggttccactgttgtcacttgtaggata

SEQ ID NO: 226 - protein, 356 aa, Arabidopsis thaliana
  G1944,AT-hook domain coordinates 87-100
MVLNMESTGEAVRSTTGNDGGITVVRSDAPSDFHVAQRSESSNQSPTSVTPPPPQPSSHHTAPPPLQISTVTTTTTTAAMEGISGGLMKKKRGRPRKYGPDGTVVALSPKPISSAPAPSHLPPPSSHVIDFSASEKRSKVKPTNSFNRTKYHHQVENLGEWAPCSVGGNFTPHIITVNTGEDVTMKIISFSQQGPRSICVLSANGVISSVTLRQPDSSGGTLTYEGRFEILSLSGSFMPNDSGGTRSRTGGMSVSLASPDGRVVGGGLAGLLVAASPVQVVVGSFLAGTDHQDQKPKKNKHDFMLSSPTAAIPISSAADHRTIHSVSSLPVNNNTWQTSLASDPRNKHTDINVNVT

SEQ ID NO: 227 - DNA, 609 bp, Arabidopsis thaliana
  G1985,family:Z-C2H2
ctcctttattctacggaagaaatctatatattctatatatggaaaacatcaaaaaccctaaaaacgcagatgattgttccgatagcatatcaaaaaacagtcatcaaggcgttgatgattccctgaaccagtcaagatcttacgtatgcagtttctgcataaggggcttctcgaatgctcaagcactaggagggcatatgaacatccacagaagagacagggctaaactcagacaaaagcttatggaagataataaggatgatgtcgtcgccgagagtgatgcatccgaagttgtgtctctagaccttaatgaacaacaacaacaacaaggagaagctttgacatgtgatgatcacgatcaatatgttgataacgatataagtcctaaacagaaattagagttttgggttcaagaaagcaagcttgatactaatgatcatggaaaggtcacggaggctagcatagatggttcgagttcgagtcatcatcgtgatattgaagtattggatctcgagcttcggttaggccaaagcgtcgtaaagaagaagacaacatagtctctgaacgatgaatcatatattgattgcattgtatcaatgggaaaatccc

SEQ ID NO: 228 - protein, 172 aa, Arabidopsis thaliana
  G1985,Z-C2H2 domain coordinates 37-57
MENIKNPKNADDCSDSISKNSHQGVDDSLNQSRSYVCSFCIRGFSNAQALGGHMNIHRRDRAKLRQKLMEDNKDDVVAESDASEVVSLDLNEQQQQQGEALTCDDHDQYVDNDISPKQKLEFWVQESKLDTNDHGKVTEASIDGSSSSHHRDIEVLDLELRLGQSVVKKKTT

SEQ ID NO: 229 - DNA, 879 bp, Arabidopsis thaliana
  G2052,family:NAC
atgggaagttcatgtttacctccagggttccggtttcatcctacggatgaagaactcatcgaatattacttgaaaagaaaagtcgaaggtctcgagattgagcttgaagtcattcccgtcatcgatctttatagtttcgatccttgggagttaccagacaagtcgtttctcccaaaccgggacatggaatggtacttcttctgctcaagggacaaaaaatatcctaatggttttcgtacaaatcgaggaacaaaggctggttattggaaagcaaccggaaaagatcgaaaaattacttctcgttcatcttctataattggttatagaaaaactctagttttctacaaaggccgtgccccgttaggcgatagaagcaattggatcatgcatgaatatcgactatgcgatgatgatacatcacaaggatcacaaaatttaaagggagcttttgtgttatgtcgtgttgctatgaagaatgagatcaaaactaatacgaaaatccgaaaaattccaagcgagcaaacaatcggatcaggagaaagctcgggtttatcaagccgagtaacgtctcctagtcgcgatgaaacaatgccgtttcactcatttgccaatcctgtatctactgaaactgattcttccaacatttggatttcacctgaattcatcctcgattcttcaaaggactatcctcaaatccaagatgtcgcatctcagtgcttccaacaagactttgattttccgatcatcggtaaccaaaacatggagtttccagcgagtacaagcttagatcagaacatggatgagtttatgcaaaacggttattggacaaattatggatacgatcaaaccggtttattcggttactcagatttctcctag

SEQ ID NO: 230 - protein, 292 aa, Arabidopsis thaliana
  G2052,NAC domain coordinates 7-158
MGSSCLPPGFRFHPTDEELIEYYLKRKVEGLEIELEVIPVIDLYSFDPWELPDKSFLPNRDMEWYFFCSRDKKYPNGFRTNRGTKAGYWKATGKDRKITSRSSSIIGYRKTLVFYKGRAPLGDRSNWIMHEYRLCDDDTSQGSQNLKGAFVLCRVAMKNEIKTNTKIRKIPSEQTIGSGESSGLSSRVTSPSRDETMPFHSFANPVSTETDSSNIWISPEFILDSSKDYPQIQDVASQCFQQDFDFPIIGNQNMEFPASTSLDQNMDEFMQNGYWTNYGYDQTGLFGYSDFS

SEQ ID NO: 231 - DNA, 1321 bp, Arabidopsis thaliana
  G2128,family:GARP
cgtcgacagtttactctcttggaacttctgagagaagcaaattagatttaaacttacagttgcacagactttatgtattaccaaaaccagcaccaaggaaagaacatcctctcatcttcaagaatgcatataacttctgaaaggcatccattccttagagggaatagtccaggtgattctggacttatcctatcaaccgatgcaaagccacgcctaaaatggactccagatcttcatgagagattcattgaagcagtcaatcaactcggtggagcagataaagctactcctaagacaatcatgaaagtcatggggattccaggccttaccttataccatctcaaaagtcatcttcagaaatacaggctgagcaagaatctcaacggacaagctaacaacagcttcaacaaaataggtataatgaccatgatggaagaaaagactcctgatgcagacgaaattcaaagcgagaatttaagcattggaccacagccaaacaagaattcaccaataggtgaagcactgcaaatgcaaatagaggtccaaagaaggcttcatgagcaacttgagcttaggatagaggctcaagggaagtacctgcaatcggttttggagaaagcacaagagactcttggaagacagaacctcggtgcagctgggatcgaagctgccaaagttcaactctcggaactagtatctaaagtatcagcagagtacccaaactctagtttcctagaaccaaaagaacttcaaaacctatgctcacaacagatgcaaacaaactatccacctgattgctctcttgaaagttgcctgacctcaagcgagggaacgcagaaaaactcgaaaatgctagagaacaacagattaggactaagaacgtatattggtgattcaacatcggagcagaaagagattatggaagaaccattgttccaaagaatggagctcacatggacagaaggtctaagagggaatccatatctttcaacaatggtgagtgaagcagaacaaagaatctcatattcagaaagaagtccaggtagattatcaataggagtaggattgcacggacacaaaagccaacatcaacaaggcaacaatgaggatcataagcttgaaacacgaaaccggaaaggcatggattcaacaacagagctagatctcaacacacatgttgaaaactattgtacaacgcgtacgaaacagttcgacttgaatggtttcagctggaactgagaatagattaaccaaaaagttaaaagagagtttcaatcatttctgagttcacacaggagaagaacccctattagcggccgct

SEQ ID NO: 232 - protein, 388 aa, Arabidopsis thaliana
  G2128,GARP domain coordinates 49-100
MYYQNQHQGKNILSSSRMHITSERHPFLRGNSPGDSGLILSTDAKPRLKWTPDLHERFIEAVNQLGGADKATPKTIMKVMGIPGLTLYHLKSHLQKYRLSKNLNGQANNSFNKIGIMTMMEEKTPDADEIQSENLSIGPQPNKNSPIGEALQMQIEVQRRLHEQLELRIEAQGKYLQSVLEKAQETLGRQNLGAAGIEAAKVQLSELVSKVSAEYPNSSFLEPKELQNLCSQQMQTNYPPDCSLESCLTSSEGTQKNSKMLENNRLGLRTYIGDSTSEQKEIMEEPLFQRMELTWTEGLRGNPYLSTMVSEAEQRISYSERSPGRLSIGVGLHGHKSQHQQGNNEDHKLETRNRKGMDSTTELDLNTHVENYCTTRTKQFDLNGFSWN

SEQ ID NO: 233 - DNA, 1523 bp, Arabidopsis thaliana
  G2141,family:HLH/MYC
cttctgattagtgagtggtgttcatcaagtattagaagaagatggatttaagtgcgaaagatgagttttcagcagagaagaggaatcctgataactatgattctgttaataatccgtctggagattggcgagttgattcatatccttcagagaatctgatttcagctggtcctgcgtcttgttctccttctcagatgatggattcatttgggcaaactctttggtatgatcccacgagtgttcaggctgttggttatgccggttttaatggtggtaatgcttcgtcttcttcgtttaggggtagtattgatagatctcttgaaatgggttggaatctgcctaatttgttgcctcctaaaggcaatggtcttttcttaccgaatgcgagtagtttccttcctccgagtatggctcagttcccggctgattcaggttttatagagcgtgcagcgaggttttcgctctttagcggtgggaattttagtgatatggtgaatcaaccacttgggaattctgaggctattggtttgtttcttcaaggtggtggaacaatgcaagggcagtgtcaaagtaatgaacttaatgttggtgaacctcacaatgatgtatctgtagcagtgaaagaatcaactgttagatctagtgaacaagctaaaccgaatgttcctggatcgggcaatgtatccgaggatactcagtctagtggtggtaatggtcagaaaggcagagaaacctcttccaacacaaagaagaggaaaagaaatgggcagaagaactctgaagcagctcaatcacacagatcccagcagtctgaggaagaaccagacaacaatggtgatgaaaagcgcaatgatgagcaaagtccaaattcacctggaaagaagtcaaacagtgggaaacaacagggcaaacaaagttctgatcctccaaaagatggatatattcatgtacgggcacgaagaggccaggccacaaatagccatagtcttgcagaaagagttaggagagaaaaaattagtgaaaggatgaagtttcttcaagatctagtaccgggttgcaacaaggtgactgggaaggcagttatgcttgacgaaatcataaactacgtacaatcactacaacgccaagttgagtttttatcgatgaaacttgcaactgtgaacccacaaatggactttaaccttgaaggtcttcttgcaaaagatgcacttcaactacgagctggttcttcatctacaacaccattcccaccaaatatgtcaatggcttatcctcctctacctcatggattcatgcaacaaactctttccagcattggaaggaccattacctctccattgtctcctatgaatggtggattcaagcgacaggaaacaaatggatgggagggtgatttgcaaaatgtgatccacattaactatggagctggtgatgtcacacctgaccctcaagcagcagctacagcatctcttccagctgcaaatatgaaggttgagccatgatatttcgtcctgttagatagc

SEQ ID NO: 234 - protein, 486 aa, Arabidopsis thaliana
  G2141,HLH/MYC domain coordinates 306-364
MDLSAKDEFSAEKRNPDNYDSVNNPSGDWRVDSYPSENLISAGPASCSPSQMMDSFGQTLWYDPTSVQAVGYAGFNGGNASSSSFRGSIDRSLEMGWNLPNLLPPKGNGLFLPNASSFLPPSMAQFPADSGFIERAARFSLFSGGNFSDMVNQPLGNSEAIGLFLQGGGTMQGQCQSNELNVGEPHNDVSVAVKESTVRSSEQAKPNVPGSGNVSEDTQSSGGNGQKGRETSSNTKKRKRNGQKNSEAAQSHRSQQSEEEPDNNGDEKRNDEQSPNSPGKKSNSGKQQGKQSSDPPKDGYIHVRARRGQATNSHSLAERVRREKISERMKFLQDLVPGCNKVTGKAVMLDEIINYVQSLQRQVEFLSMKLATVNPQMDFNLEGLLAKDALQLRAGSSSTTPFPPNMSMAYPPLPHGFMQQTLSSIGRTITSPLSPMNGGFKRQETNGWEGDLQNVIHINYGAGDVTPDPQAAATASLPAANMKVEP

SEQ ID NO: 235 - DNA, 958 bp, Arabidopsis thaliana
  G2146,family:HLH/MYC
attagatatcccctccaattactcaaaattattatcaaaataagaaagagctcaacattgttctctgactctataaataactgttcttggaaattttccaagagaacaagaaacaaaaacaaaacgttgtttaagtgtggttctatagatttcttgtgaatgtcttctgaacaaggaaatggatcgaatccttccacgtcaccggaggtagaagggactaaaacaatcccctttcgccggagattgcaaagaggacaaagagttttcgctccaaagctgatggaggctctacgtcgatcaagggtaagctctgaagaagctccggtaaggcatcttagtcgtagatggagagccacaacggcgcagaaggtatattccctaaagctctacgacgctcttcaacgatcgcggcggagcgcaacagtccgggacacggccgacaaagtccttgcgacgaccgctcgtggtgcaactcggtggagccgagccattttggttagtcgattcggaacgagtctgaggcggcgtaggaataccaaaccggcgtcggcattagctgcggcgatcaggggaagtggtggaagtgggaggaggaggaagttatcggcggtgggaaatcgggtccgggttttgggtgggttggtgccgggttgccggagaacggcgttaccggagcttttggacgagacagcagattacatagcggctttggaaatgcaagtccgagccatgacagctctatcaaagattctgtcggagcttcagccgtctactaatctcggctcggctttatagccgagtgtataagccgatgaatttgtttcaattaattcttttacgattttatcgtgggaatgtcttattgtttttaatgatttgtttgccctggaaaaaaaaaattgtcaaaatcatcacgagttggacgaaaatactatgtttttctaaaaaccttataata

SEQ ID NO: 236 - protein, 211 aa, Arabidopsis thaliana
  G2146,HLH/MYC domain coordinates 132-189
MSSEQGNGSNPSTSPEVEGTKTIPFRRRLQRGQRVFAPKLMEALRRSRVSSEEAPVRHLSRRWRATTAQKVYSLKLYDALQRSRRSATVRDTADKVLATTARGATRWSRAILVSRFGTSLRRRRNTKPASALAAAIRGSGGSGRRRKLSAVGNRVRVLGGLVPGCRRTALPELLDETADYIAALEMQVRAMTALSKILSELQPSTNLGSAL

SEQ ID NO: 237 - DNA, 929 bp, Arabidopsis thaliana
  G2148,family:HLH/MYC
gtctctaatataagcttgaacgttgctatatataaatgtaaaggcgaacgcataagaaaagaaaaatggagaatgaagcttttgtagatggtgaattggagtctcttttggggatgttcaactttgatcaatgttcatctaacgaatcgagcttttgcaatgctccaaatgagactgatgttttctcttctgatgatttcttcccatttggtacaattctgcaaagtaactatgcggccgttcttgatggttccaaccaccaaacgaaccgaaatgtcgactcaagacaagatctgttgaaaccaaggaagaagcaaaagttaagctcggaaagcaatttggttaccgagcctaagactgcttggagagatggtcaaagcctaagcagttataatagttcagatgatgaaaaggctttaggtttagtgtctaatacatcaaaaagcctaaaacgcaaagcgaaagccaacagagggatagcttccgatcctcagagcctatacgctaggaaacgaagagaaaggataaacgataggctaaagacattgcagagcctagttcctaatgggacaaaggtcgatataagcacaatgctggaagatgctgtccattacgtgaagttcctgcagcttcaaatcaagctcttgagttcagaagatctatggatgtatgcacctcttgctcacaatggtctgaatatgggactacatcacaatcttttgtctcggcttatttaagacaaaatcattggaataacataacttacagtacttgttttttttctcgttctatattcatgattatggttattttttgtttgagttgttcaatttttctgtctattgcgttctatgaacttgacactctttttgtaattattatatgctaaagacaatttggactaacagcattttaataaaaaaaaaaaa

SEQ ID NO: 238 - protein, 223 aa, Arabidopsis thaliana
  G2148,HLH/MYC domain coordinates 135-192
MENEAFVDGELESLLGMFNFDQCSSNESSFCNAPNETDVFSSDDFFPFGTILQSNYAAVLDGSNHQTNRNVDSRQDLLKPRKKQKLSSESNLVTEPKTAWRDGQSLSSYNSSDDEKALGLVSNTSKSLKRKAKANRGIASDPQSLYARKRRERINDRLKTLQSLVPNGTKVDISTMLEDAVHYVKFLQLQIKLLSSEDLWMYAPLAHNGLNMGLHHNLLSRLI

SEQ ID NO: 239 - DNA, 1466 bp, Arabidopsis thaliana
  G2150,family:HLH/MYC
gttttgtttttgaagaaacacacataaagtttgtctttttacttctcaaatttggttgttttcactcaatttcaatcttgctttctgattcagattctgggttttcttcagaattcccagagaagttgttggaattgaatttttcacttttttgttcataaaagttctagtctttttagatgaacatggacaaggaaacagagcaaaccctaaattacttacctttgggtcagagcgatccctttggcaatggcaatgaaggaacaattggagatttccttggaagatactgcaacaaccctcaggagatttcaccgttaactctacaatccttctctctgaattctcagatctccgagaatttcccaatctctggtggaatcagattccctccatatccaggtcaatttggatccgatcgtgaatttgggtcacaaccaacaacgcaggagagtaacaagagctctttgttggatccagattcagtttcggatcgagttcacaccacgaaatctaactctagaaagaggaagtcgattcctagtggtaatggcaaggagtctccagcttcatcgtctcttacagcttccaattcaaaggtttcaggagagaatggtggatctaaaggtgggaagagaagcaagcaagatgtagctgggagtagtaaaaacggagtagagaagtgcgatagtaaaggcgacaataaggacgatgctaagcctcctgaggcgcctaaagattatattcatgtcagagctagaaggggtcaagcaactgatagccatagtcttgctgaaagagcaagaagagaaaagattagtgagagaatgacgttgcttcaggatctggttcctggttgcaaccggattacagggaaagcagtcatgcttgatgaaattataaattatgtgcagtccttgcagagacaagttgagttcttgtccatgaagctggctaccgtaaatccaaggatggagtttaatgctaatgcttctttatccacagagatgattcaaccgggggagtcgttaacgcagtctctttacgcaatggcttgctcagagcaaagacttccatcagcatactattcacttggcaagaacatgccaagattctcagacacacaattcccctcaaacgatggatttgttcacactgagacaccaggattctgggaaaataatgacctgcaaagcattgttcagatgggttttggagatatcctccagcaacagagcaacaacaacaacaacaactgttctgagccaacgcttcagatgaagcttgaaccatagtccatagctatgattattatctctgttgtacatacagaaaaccaagtagtgatgagtaacggagtgaatcatattggaattttaatgtttacaatcgttgcttctttgcttgtgtctctgttgatttcttctcaaccttaaacaaaaaaaaaacaagaaaacttcagatta

SEQ ID NO: 240 - protein, 371 aa, Arabidopsis thaliana
  G2150,HLH/MYC domain coordinates 194-252
MNMDKETEQTLNYLPLGQSDPFGNGNEGTIGDFLGRYCNNPQEISPLTLQSFSLNSQISENFPISGGIRFPPYPGQFGSDREFGSQPTTQESNKSSLLDPDSVSDRVHTTKSNSRKRKSIPSGNGKESPASSSLTASNSKVSGENGGSKGGKRSKQDVAGSSKNGVEKCDSKGDNKDDAKPPEAPKDYIHVRARRGQATDSHSLAERARREKISERMTLLQDLVPGCNRITGKAVMLDEIINYVQSLQRQVEFLSMKLATVNPRMEFNANASLSTEMIQPGESLTQSLYAMACSEQRLPSAYYSLGKNMPRFSDTQFPSNDGFVHTETPGFWENNDLQSIVQMGFGDILQQQSNNNNNNCSEPTLQMKLEP

SEQ ID NO: 241 - DNA, 548 bp, Arabidopsis thaliana
  G2226,family:RING/C3H2C3
agacaacatcatttctaccgacaaagatttgatatcgaatccaacaagtgaaagatgggtctatcaagtcttcctggtccatcagaaggaatgttatgtgtgatattagttaatacagcattatcgatctccattgtcaaaggcattgtaagatcattccttggcatagtaggaatcagtctctcgccgtcttcatcctcgccttcttcggtgacggtatcttcagagaattcatcaacttcagagtcatttgatttccgggtctgccaaccagagagttaccttgaggagttcaggaaccggactccgacactgaggtttgagagcttgtgcaggtgcaagaaacaggcagacaatgagtgttctgtgtgtttgtcgaaattccaaggggattcagagatcaacaagctcaagtgcggccatttgtttcacaaaacatgcttggagaaatggatagactattggaacatcacttgcccattgtgtaggactcctcttgttgttgtgccagaagaccatcagctttcttctaatgtttggtgactgct

SEQ ID NO: 242 - protein, 162 aa, Arabidopsis thaliana
  G2226,RING/C3H2C3 domain coordinates 103-144
MGLSSLPGPSEGMLCVILVNTALSISIVKGIVRSFLGIVGISLSPSSSSPSSVTVSSENSSTSESFDFRVCQPESYLEEFRNRTPTLRFESLCRCKKQADNECSVCLSKFQGDSEINKLKCGHLFHKTCLEKWIDYWNITCPLCRTPLVVVPEDHQLSSNVW

SEQ ID NO: 243 - DNA, 682 bp, Arabidopsis thaliana
  G2251,family:RING/C3H2C3
ctcacccattctccaccttatcatcacaatccaaaactctctctctctctctctctctgtctcttgtcttatcatttatctctctaacggcgaggcaatgggttttccggtgggatattctgagctacttctcccaaaaatctttttctacttgttatctttcttaggtttgatacgtaaactcatctccacaatgttcaagatcattggtctaccagatttcttagaacctgaaccggtttcaacctcatggcccgacccaccacccacgttgaccaaacctgactcagcagcaatactagccggagagatgttaccggttgttcgattctcggatataaaccgaccggaatccgagtgttgcgcagtgtgtctctacgatttcgagaacgacgacgagatccgacggctgacgaattgtcgacatatatttcatcggggatgtttggaccgttggatgatgggttataatcagatgacgtgtccactttgtcgtacacagtttatacctgatcatcttcaactggagtttaatcaaaggctctggtctcaatcttctgctgtttcttctcaacttcttgatgaatcatcatcttaggacgtattaaatctttgtccaaacaaaaaaaaaagacatattaaatcctttttttttggtactttcattgggaattgggtttgg

SEQ ID NO: 244 - protein, 166 aa, Arabidopsis thaliana
  G2251,RING/C3H2C3 domain coordinates 89-132
MGFPVGYSELLLPKIFFYLLSFLGLIRKLISTMFKIIGLPDFLEPEPVSTSWPDPPPTLTKPDSAAILAGEMLPVVRFSDINRPESECCAVCLYDFENDDEIRRLTNCRHIFHRGCLDRWMMGYNQMTCPLCRTQFIPDHLQLEFNQRLWSQSSAVSSQLLDESSS

SEQ ID NO: 245 - DNA, 827 bp, Arabidopsis thaliana
  G2291,family:AP2
gctttctcacctttataaaatagaaaatggaaaacagctacaccgttgatggtcaccgtcttcaatattccgttccgttaagctccatgcatgaaaccagtcaaaactccgaaacttacggattatccaaagagtcgccgttggtctgcatgcccttgttcgaaaccaacactacttcattcgatatctcttctcttttctcgtttaacccaaaaccagaacccgaaaacacgcatcgtgtcatggacgattccatcgccgccgtcgtgggcgaaaacgttcttttcggtgataaaaacaaagtctctgatcacttgaccaaagaaggtggtgtgaagcgggggcggaagatgccgcagaagaccggaggattcatgggagtgagaaaacggccgtgggggagatggtcggcggagataagagacaggatagggcggtgcagacactggttaggaacgttcgacacggcggaagaggcagcgcgtgcgtatgacgcggcggcgaggaggcttagagggaccaaagccaagaccaatttcgtgattcctccgctttttcccaaggaaatagctcaggctcaggaggataataggatgaggcagaagcagaagaagaagaagaagaaaaaagtgagtgtgaggaagtgtgttaaagtcacatcggttgcacagttgttcgatgatgccaattttataaattcttctagtattaaaggaaatgtgattagttctattgataatcttgaaaaaatgggtctagagcttgatttgagtttagggttgttgtctaggaagtgataaagcactcgtagttaagtagttgtagtt

SEQ ID NO: 246 - protein, 256 aa, Arabidopsis thaliana
  G2291,AP2 domain coordinates 113-180
MENSYTVDGHRLQYSVPLSSMHETSQNSETYGLSKESPLVCMPLFETNTTSFDISSLFSFNPKPEPENTHRVMDDSIAAVVGENVLFGDKNKVSDHLTKEGGVKRGRKMPQKTGGFMGVRKRPWGRWSAEIRDRIGRCRHWLGTFDTAEEAARAYDAAARRLRGTKAKTNFVIPPLFPKEIAQAQEDNRMRQKQKKKKKKKVSVRKCVKVTSVAQLFDDANFINSSSIKGNVISSIDNLEKMGLELDLSLGLLSRK

SEQ ID NO: 247 - DNA, 1011 bp, Arabidopsis thaliana
  G2346,family:SBP
atggagttgttaatgtgttcgggtcaggccgagtcaggtggttcttcttccaccgagtcttcttcactcagtggtggactcaggtttggtcagaagatctacttcgaggatggatccggatccagaagcaagaaccgggtcaataccgttcgtaagtcgtctaccacggcgaggtgccaagtggaaggttgtagaatggatctaagcaatgttaaagcttattactcgagacacaaagtttgttgcattcactctaaatcatctaaagtcattgtctctggtcttcatcaaaggttttgtcaacaatgtagcaggtttcaccagctttctgagtttgacttggagaaaagaagttgtcgcagaagactcgcttgtcataacgaacgacgaagaaaaccacaacccacaacggctcttttcacttctcattactctcgaatcgctccatctctttacggaaaccccaatgctgcaatgattaaaagcgttttgggagatcctactgcgtggtcaaccgcaagatcagtgatgcagcggcctggaccgtggcagattaatccagttagggaaacccatccacacatgaatgttttatcacatggaagctcaagctttactacatgtccagagatgataaacaacaatagcacagattcaagctgtgctctctctcttctgtcaaactcatacccaattcatcagcagcaacttcagacaccaacaaatacatggcgaccatcttctggtttcgactcgatgatctcattctccgataaggttacaatggctcagccaccgcccatttcaacccatcagccgcccatctcaacacatcagcagtacctcagccaaacttgggaagtcatcgcgggcgaaaagagcaattcacattatatgtctcctgtgagtcaaatctcggagccagcagatttccagataagcaatggcagtgtgtcgccctattctcctccgtccttactatctcttgtgtgctacttgcggccgctatag

SEQ ID NO: 248 - protein, 336 aa, Arabidopsis thaliana
  G2346,SBP domain coordinates 59-135
MELLMCSGQAESGGSSSTESSSLSGGLRFGQKIYFEDGSGSRSKNRVNTVRKSSTTARCQVEGCRMDLSNVKAYYSRHKVCCIHSKSSKVIVSGLHQRFCQQCSRFHQLSEFDLEKRSCRRRLACHNERRRKPQPTTALFTSHYSRIAPSLYGNPNAAMIKSVLGDPTAWSTARSVMQRPGPWQINPVRETHPHMNVLSHGSSSFTTCPEMINNNSTDSSCALSLLSNSYPIHQQQLQTPTNTWRPSSGFDSMISFSDKVTMAQPPPISTHQPPISTHQQYLSQTWEVIAGEKSNSHYMSPVSQISEPADFQISNGSVSPYSPPSLLSLVCYLRPL

SEQ ID NO: 249 - DNA, 816 bp, Arabidopsis thaliana
  G2425,family:MYB-(R1)R2R3
atggggaggacgacgtggttcgacgttgacgggttgaggaaaggagagtggacggcggaggaagaccggaagctcgtggtttacatcaacgaacacggtctaggcgagtggggttcactgcctaagagagccggtctacaaagatgtggaaagagttgtagattaagatggctgaattatttgaggcctgggattaaaagaggcaagttcactcctcaggaagaagaagaaatcatcaaataccatgctcttcttggaaacaggtgggcagcaatagctaagcaaatgccaaacagaacagataatgacataaagaaccattggaactcatgccttaagaaaagacttgctaaaaaaggaatcgatccaatgacccatgagccaacaacaacaacaagcctcaccgtcgatgtcacctcctcatcaactacgtcgtctcctacaccgagccctacttcttcttctttttcctcctgttcctctactggctctgcacgtttccttaacaagctcgctgctggaatctcgtcaagaaaacacggactagagagtatcaagacagtgatattggcagaacaaccaagagaagccgttgatgaagagaagatgatgacaattaacatgaaagagaaggaattgattagttgttacatggagattgatgagacgatgagtattgatgaactaccttgtgatgactcgacgtctggcttcgtggcttttgacgactactcattaatcgacccatacagagacggtgtgtacgtatctgatttctacgatgagactgaacaccttgacctgttccttctttga

SEQ ID NO: 250 - protein, 271 aa, Arabidopsis thaliana
  G2425,MYB-(R1)R2R3 domain coordinates 12-119
MGRTTWFDVDGLRKGEWTAEEDRKLVVYINEHGLGEWGSLPKRAGLQRCGKSCRLRWLNYLRPGIKRGKFTPQEEEEIIKYHALLGNRWAAIAKQMPNRTDNDIKNHWNSCLKKRLAKKGIDPMTHEPTTTTSLTVDVTSSSTTSSPTPSPTSSSFSSCSSTGSARFLNKLAAGISSRKHGLESIKTVILAEQPREAVDEEKMMTINMKEKELISCYMEIDETMSIDELPCDDSTSGFVAFDDYSLIDPYRDGVYVSDFYDETEHLDLFLL

SEQ ID NO: 251 - DNA, 690 bp, Arabidopsis thaliana
  G2454,family:YABBY
atgtctatgtcgtctatgtcctccccttcctcagctgtttgttcaccggaccacttctctccttccgaccatctctgctatgtccaatgcaacttttgccaaaccatccttgcggttaatgttccttacacaagcttgttcaagaccgtaactgtccgatgtggttgctgtaccaatctcctttcggtgaacatgagatcatatgtcctcccagcttctaaccagctccagctccagctcggtcctcactcttacttcaatccccaggatattctggaggagctgagagatgcaccgtctaacatgaatatgatgatgatgaatcaacatcctactatgaatgacataccatctttcatggatcttcatcaacaacatgagattcctaaagcaccacccgttaaccgccctccagagaaaagacagagagtcccatccgcatataaccgattcatcaaggaggagatccaacgtatcaaagctggtaatcctgatataagccacagagaagcctttagtgctgctgccaagaattgggcccacttcccccacatacacttcgggctcgtgccagacaatcaacccgtgaagaaaaccaacatgccccaacaggagggagaggataacatggtgatgaaagaagggttctacgctcctgcagctgctaacgttggtgtgactccttattaa

SEQ ID NO: 252 - protein, 229 aa, Arabidopsis thaliana
  G2454,YABBY domain coordinates 25-64,136-183
MSMSSMSSPSSAVCSPDHFSPSDHLCYVQCNFCQTILAVNVPYTSLFKTVTVRCGCCTNLLSVNMRSYVLPASNQLQLQLGPHSYFNPQDILEELRDAPSNMNMMMMNQHPTMNDIPSFMDLHQQHEIPKAPPVNRPPEKRQRVPSAYNRFIKEEIQRIKAGNPDISHREAFSAAAKNWAHFPHIHFGLVPDNQPVKKTNMPQQEGEDNMVMKEGFYAPAAANVGVTPY

SEQ ID NO: 253 - DNA, 1409 bp, Arabidopsis thaliana
  G2484,family:Z-C4HC3
tatagggctagagcgccgcccgggcaggtgttttagggtttgtagctcctttctctttttttcttttctcaatttcccccaaattaaaaaaaaactctctctttcagagatttacaaatttcatttctccaaatccgaaaccccaaagtgaatatttttccttctgggtttcttttgtttgcctggaaacatttgtctcagattttgattttgaccggagtactcatattctccggcgatttctccggcgacatcgtttgtgaaatggagggaattactcatccaatacctcgtactgttgaagaggtctttagcgacttcagaggtcgacgagctggtcttattaaagctctcactaatgatatggtgaagttttaccaaacgtgtgatcctgagaaggagaatttgtgtctctatggacttccaaatgagacatgggaggttaatctacccgttgaggaagttcctcctgagcttcctgaaccagctttaggcatcaatttcgctagagacggaatgcaagaaaaggactgggtatctttggtcgcagttcacagtgattcatggctgctttctgttgcattttactttggtgcacgtttcggatttggcaagaatgagaggaagaggctgttccagatgattaatgagctgccaaccattttcgaagttgtgagcggcaatgcaaagcagtccaaggatctatctgttaacaacaataatagcaaaagcaaacctagtggcgtcaagtctcgccaatccgaatctctctcaaaggttgcaaagatgtcatctccaccgccaaaagaagaagaagaagaagaagatgagagtgaagatgagagtgaagacgatgaacaaggtgcggtttgtggtgcttgtggagacaactacggtacagatgagttctggatttgctgcgacgcgtgtgagaaatggttccatggaaaatgtgtgaagataacacctgcaaaagcagaacacatcaagcattacaaatgcccaacttgcagtaacaagagagctagaccttgaagttaaataaccaaattatgaaaaggtaaagcgagttaggagaaaattatgaaagaagaaggtgaagtttccagtttataagaaatgccagtaaaagggacttagaagatgtaagcaggtaaaaaaaaaaattgtattgcttagtctttattgttggattgagactatctacagttggtgatgtcttttcttttctttttttggatttttgttgttgttaatgttaattctactactaatttgtttggtctgtttaagatattttagttctgattagtaattttttttttttttttttttctgattagtaatttgctaaaattgtaaaaactattatgtcgttatgtagtctttttattcatctttttaaaaaa

SEQ ID NO: 254 - protein, 256 aa, Arabidopsis thaliana
  G2484,Z-C4HC3 domain coordinates 202-250
MEGITHPIPRTVEEVFSDFRGRRAGLIKALTNDMVKFYQTCDPEKENLCLYGLPNETWEVNLPVEEVPPELPEPALGINFARDGMQEKDWVSLVAVHSDSWLLSVAFYFGARFGFGKNERKRLFQMINELPTIFEVVSGNAKQSKDLSVNNNNSKSKPSGVKSRQSESLSKVAKMSSPPPKEEEEEEDESEDESEDDEQGAVCGACGDNYGTDEFWICCDACEKWFHGKCVKITPAKAEHIKHYKCPTCSNKRARP

SEQ ID NO: 255 - DNA, 690 bp, Arabidopsis thaliana
  G2514,family:AP2
aaaacttcttcatcttctttaattagtttgccacctcgcacgtgtgacaaatccttcttcgccacgtgtgaaaacccttctccggcttgctactaatatacgactaatagtatgaatagttcaatggcttctgccggcttaggtagccggagaaaggatccggtgtacagaggaatccggtgccgaagtgggaaatgggtctccgagattcgtgagccgaggaaaaccacgagaatctggcttggaacttaccccatggcagagatggcagcagccgcctatgatgtggctgctatggctcttaaaggaagagaagctgtcttgaacttccctggatccgtcgggtcatacccggttcctgaatcaacatccgcagcagatatacgagccgctgcggcagccgcagcagcaatgaagggatgtgaggaaggggaggaggagaaaaaggcaaaggagaagaagagtagtagttcgaagtcgagagcgcgtgagtgccacgtagataatgatgttggatcttcgtcgtggtgtgggacagagttcatggacgaagaagaagtcttgaatatgcctaatctgctggctaatatggcagaagggatgatggttgcgccgccgtcgtggatgggttctcggccgtcggatgactctccggagaattcaaatgatgaggacttgtggggctattga

SEQ ID NO: 256 - protein, 192 aa, Arabidopsis thaliana
  G2514,AP2 domain coordinates 16-82
MNSSMASAGLGSRRKDPVYRGIRCRSGKWVSEIREPRKTTRIWLGTYPMAEMAAAAYDVAAMALKGREAVLNFPGSVGSYPVPESTSAADIRAAAAAAAAMKGCEEGEEEKKAKEKKSSSSKSRARECHVDNDVGSSSWCGTEFMDEEEVLNMPNLLANMAEGMMVAPPSWMGSRPSDDSPENSNDEDLWGY

SEQ ID NO: 257 - DNA, 1197 bp, Arabidopsis thaliana
  G2520,family:HLH/MYC
aaggagttttgcatactcaccaagccacaatcatttctctcttctctatctctctggttttgaatcggcgacgactgagtcaactcggtgttgttactggtttcgtcgtatgtgttgtaactgattaagttgatggatccgagtgggatgatgaacgaaggaggaccgtttaatctagcggagatctggcagtttccgttgaacggagtttcaaccgccggagattcttctagaagaagcttcgttggaccgaatcagttcggtgatgctgatctaaccacagctgctaacggtgatccagcgcgtatgagtcacgcgttgtctcaggcggttattgaaggtatctccggcgcttggaaacggagggaagatgagtctaagtcggcgaagatcgtctccaccattggcgctagtgaaggtgagaacaaaagacagaagatagatgaagtgtgtgatgggaaagcagaagcagaatcgctaggaacagagacggaacaaaagaagcaacagatggaaccaacgaaagattatattcatgttcgagctagaagaggtcaagctactgatagtcacagtttagctgaaagagcgagaagagagaaaataagtgagcggatgaaaatcttgcaagatcttgttccgggatgtaacaaggttattggaaaagcacttgttctagatgagataattaactatatacaatcattgcaacgtcaagttgagttcttatcgatgaagcttgaagcagtcaactcaagaatgaaccctggtatcgaggtttttccacccaaagaggtgatgattctcatgatcatcaactcaatcttctccatttttttcacaaaacaatacatgtttctatcgaggtattctcggggtaggagtctcgatgtttatgcggttcggtcatttaagcattgcaataaacggagtgacctctgtttttgctcctgctccccaaaaacagaacttaagacaactatattttcacaaaacatgacatgtttctgtcgatattctcgagtaggagtcgctattagttcatctaagcattgcaatgaaccgtttggtcagcaagcgtttgagaatccggagatacagttcgggtcgcagtctacgagggaatacagtagaggagcatcaccagagtggttgcacatgcagataggatcaggtggtttcgaaagaacgtcttga

SEQ ID NO: 258 - protein, 354 aa, Arabidopsis thaliana
  G2520,HLH/MYC domain coordinates 139-197
MDPSGMMNEGGPFNLAEIWQFPLNGVSTAGDSSRRSFVGPNQFGDADLTTAANGDPARMSHALSQAVIEGISGAWKRREDESKSAKIVSTIGASEGENKRQKIDEVCDGKAEAESLGTETEQKKQQMEPTKDYIHVRARRGQATDSHSLAERARREKISERMKILQDLVPGCNKVIGKALVLDEIINYIQSLQRQVEFLSMKLEAVNSRMNPGIEVFPPKEVMILMIINSIFSIFFTKQYMFLSRYSRGRSLDVYAVRSFKHCNKRSDLCFCSCSPKTELKTTIFSQNMTCFCRYSRVGVAISSSKHCNEPFGQQAFENPEIQFGSQSTREYSRGASPEWLHMQIGSGGFERTS

SEQ ID NO: 259 - DNA, 1012 bp, Arabidopsis thaliana
  G2573,family:AP2
ccagatttaatttgagactctcaaagaaacaccatggaagaagagcaacctccggccaagaaacgaaacatggggagatctagaaaaggttgcatgaaaggtaaaggcggtccagagaacgccacgtgtactttccgtggagttaggcaacggacttggggtaaatgggtggctgagatccgtgagcctaaccgtgggactcgtctctggctcggcacgtttaatacctcggtcgaggccgccatggcttacgatgaagccgctaagaaactctatggacacgaggctaaactcaacttggtgcacccacaacaacaacaacaagtagtagtgaacagaaacttgtctttttctggccacgggtcgggttcttgggcttataataagaagctcgatatggttcatgggttggaccttggtctcggccaggcaagttgttcacgaggttcttgctcagagagatcgagttttctacaagaagatgatgatcatagtcataatcgatgttcgtcttcaagtggttcgaatctttgttggttattacctaaacaaagtgattcacaagatcaagagaccgttaatgctacgactagttatggcggtgaaggcggtggtggctctacgttaacgttttcgaccaatttgaaaccaaagaatttgatgagtcagaattatggattatacaatggagcttggtctaggtttcttgtggggcaagaaaagaagacggaacatgacgtgtcatcgtcgtgtggatcgtcggacaacaaggagagtatgttggttcctagttgcggcggagagaggatgcataggccggagttggaagagcgaacaggatatttggaaatggatgatcttttggagattgatgatttaggtttgttgattggcaaaaatggagatttcaagaattggtgttgtgaagagtttcaacatccatggaattggttctgagagtttttatttattactattatttatcatacatatttcttatatttgacttagg

SEQ ID NO: 260 - protein, 307 aa, Arabidopsis thaliana
  G2573,AP2 domain coordinates 31-98
MEEEQPPAKKRNMGRSRKGCMKGKGGPENATCTFRGVRQRTWGKWVAEIREPNRGTRLWLGTFNTSVEAAMAYDEAAKKLYGHEAKLNLVHPQQQQQVVVNRNLSFSGHGSGSWAYNKKLDMVHGLDLGLGQASCSRGSCSERSSFLQEDDDHSHNRCSSSSGSNLCWLLPKQSDSQDQETVNATTSYGGEGGGGSTLTFSTNLKPKNLMSQNYGLYNGAWSRFLVGQEKKTEHDVSSSCGSSDNKESMLVPSCGGERMHRPELEERTGYLEMDDLLEIDDLGLLIGKNGDFKNWCCEEFQHPWNWF

SEQ ID NO: 261 - DNA, 1647 bp, Arabidopsis thaliana
  G2574,family:WRKY
atggaggttcttttgaaattaccctcttcagagtctcctcttaaggataaatttggatctgttcaaatccatgaagctaataagggtgatggtgatcatcaagaacttgaatctgccaaggcagagatgagcgaggtgaaggaagagaacgagaagcttaaaggaatgctcgaacgaattgaaagtgattacaaatctctcaagctcagattcttcgacataattcaacaagaaccttcaaacaccgcaactaaaaatcaaaacatggttgatcatcccaagccaacgacgacggatttgagttcttttgaccaagaacgcgagcttgtatcgctttcactagggagaagaagttcttccccaagtgatagcgtccccaaaaaggaagagaaaacggacgcaatcagcgcagaagtcaacgctgacgaagagttgactaaggccggcttgaccttagggatcaataatggcaacggaggtgaaccgaaagagggtttatctatggagaatcgtgcaaattctggctcggaagaagcttgggcgccaggtaaagttacggggaagagaagctctccagcaccagcctccggtggcgatgctgacggtgaggccggtcaacaaaaccatgttaagagagctagagtttgtgttagagcaagatgtgacacaccaacgatgaatgatggttgtcaatggagaaaatatggacaaaagattgcgaaaggaaatccatgtccacgagcatattatcgctgcacggttgcacctggatgtcccgttagaaaacaggtccaaagatgtgcagatgacatgtctatactaatcacaacctatgaaggaacacacagccactctcttccactctcagccaccaccatggcttccaccacatcagccgctgcctccatgctcctctctggctcctcctcctcaccagccgctgaaatgatcggaaataacctctacgacaattcaagattcaacaacaacaacaaatccttctattcacccacccttcactccccattacatcccaccgtcactctagacctcactgctccacaacactcttcctcgtcttcttcttcattgctttctttaaatttcaacaaattctcgaactctttccaaagattcccatctacaagcctaaatttctcttctacttcatcaacatcatcaaacccgtctactctcaacctacccgcgatttggggtaatgggtattcttcttatactccatatccttacaacaacgtccaatttgggacgtccaacctaggaaaaacagtccaaaatagccagtccttaaccgaaaccctaacaaaagcgcttacttccgacccaagtttccactcggtgatcgctgctgccatctcaactatggtcggatcaaatggagaacaacagattgtcggtccacggcattcgattagcaataacattcaacaaaccaacacgacgaataataacaaaggatgtggaggctattttagcagcttattgatgtctaacattatggcgagtaatcaaacgggtgcttctttggatcaaccatcgtcgcaacttcctcccttctctatgttcaagaattcttcttcttcgtcttctacgactaatttcgtgaacaaggaagagaaaagctag

SEQ ID NO: 262 - protein, 548 aa, Arabidopsis thaliana [sequence omitted]

SEQ ID NO: 263 - DNA, 1746 bp, Arabidopsis thaliana
  G2577,family:AP2
atgaactcgatgaataactggttaggcttctctctctctcctcatgatcaaaatcatcaccgtacggatgttgactcctccaccaccagaaccgccgtagatgttgccggagggtactgttttgatctggccgctccctccgatgaatcttctgccgttcaaacatcttttctttctcctttcggtgtcaccctcgaagctttcaccagagacaataatagtcactcccgagattgggacatcaatggtggtgcatgcaataacattaacaataacgaacaaaatggaccaaagcttgagaatttcctcggccgcaccaccacgatttacaataccaacgagaccgttgtagatggaaatggcgattgtggaggaggagacggtggtggtggcggctcactaggcctttcgatgataaaaacatggctgagtaatcattcggttgctaatgctaatcatcaagacaatggtaacggtgcacgaggcttgtccctctctatgaattcatctactagtgatagcaacaactacaacaacaatgatgatgtcgtccaagagaagactattgttgatgtcgtagaaactacaccgaagaaaactattgagagttttggacaaaggacgtctatataccgcggtgttacaaggcatcggtggacaggtagatacgaggcacatttatgggacaatagttgcaaaagagaaggccagactcgcaaaggaagacaaggaggttatgacaaagaagaaaaagcagctagggcttacgatttagccgcactaaagtattggggaaccaccactactactaacttccccttgagtgaatatgagaaagaggtagaagagatgaagcacatgacgaggcaagagtatgttgcctctctgcgcaggaaaagtagtggtttctctcgtggtgcatcgatttatcgaggagtaacaaggcatcaccaacatggaaggtggcaagctaggatcggaagagtcgccggtaacaaagacctctacttgggaactttcggcacacaggaagaggctgctgaggcttatgacattgcagccattaaattcagaggattaagcgcagtgactaacttcgacatgaacagatacaatgttaaagcaatcctcgagagcccgagtctacctattggtagttctgcgaaacgtctcaaggacgttaataatccggttccagctatgatgattagtaataacgtttcagagagtgcaaataatgttagcggttggcaaaacactgcgtttcagcatcatcagggaatggatttgagcttattgcagcaacagcaggagaggtacgttggttattacaatggaggaaacttgtctaccgagagtactagggtttgtttcaaacaagaggaggaacaacaacacttcttgagaaactcgccgagtcacatgactaatgttgatcatcatagctcgacctctgatgattctgttaccgtttgtggaaatgttgttagttatggtggttatcaaggattcgcaatccctgttggaacatcggttaattacgatccctttactgctgctgagattgcttacaacgcaagaaatcattattactatgctcagcatcagcaacaacagcagattcagcagtcgccgggaggagattttccggtggcgatttcgaataaccatagctctaacatgtactttcacggggaaggtggtggagaaggggctccaacgttttcagtttggaacgacacttag

SEQ ID NO: 264 - protein, 581 aa, Arabidopsis thaliana
  G2577,AP2 domain coordinates 208-281,307-375
MNSMNNWLGFSLSPHDQNHHRTDVDSSTTRTAVDVAGGYCFDLAAPSDESSAVQTSFLSPFGVTLEAFTRDNNSHSRDWDINGGACNNINNNEQNGPKLENFLGRTTTIYNTNETVVDGNGDCGGGDGGGGGSLGLSMIKTWLSNHSVANANHQDNGNGARGLSLSMNSSTSDSNNYNNNDDVVQEKTIVDVVETTPKKTIESFGQRTSIYRGVTRHRWTGRYEAHLWDNSCKREGQTRKGRQGGYDKEEKAARAYDLAALKYWGTTTTTNFPLSEYEKEVEEMKHMTRQEYVASLRRKSSGFSRGASIYRGVTRHHQHGRWQARIGRVAGNKDLYLGTFGTQEEAAEAYDIAAIKFRGLSAVTNFDMNRYNVKAILESPSLPIGSSAKRLKDVNNPVPAMMISNNVSESANNVSGWQNTAFQHHQGMDLSLLQQQQERYVGYYNGGNLSTESTRVCFKQEEEQQHFLRNSPSHMTNVDHHSSTSDDSVTVCGNVVSYGGYQGFAIPVGTSVNYDPFTAAEIAYNARNHYYYAQHQQQQQIQQSPGGDFPVAISNNHSSNMYFHGEGGGEGAPTFSVWNDT

SEQ ID NO: 265 - DNA, 653 bp, Arabidopsis thaliana
  G2583,family:AP2
caaatcagaaaatatagagtttgaaggaaactaaaagatggtacattcgaggaagttccgaggtgtccgccagcgacaatggggttcttgggtctctgagattcgccatcctctattgaagagaagagtgtggcttggaactttcgaaacggcagaagcggctgcaagagcatacgaccaagcggctcttctaatgaacggccaaaacgctaagaccaatttccctgtcgtaaaatcagaggaaggctccgatcacgttaaagatgttaactctccgttgatgtcaccaaagtcattatctgagcttttgaacgctaagctaaggaagagctgcaaagacctaacgccttctttgacgtgtctccgtcttgatactgacagttcccacattggagtttggcagaaacgggccgggtcgaaaacaagtccgacttgggtcatgcgcctcgaacttgggaacgtagtcaacgaaagtgcggttgacttagggttgactacgatgaacaaacaaaacgttgagaaagaagaagaagaagaagaagctattattagtgatgaggatcagttagctatggagatgatcgaggagttgctgaattggagttgacttttgactttaacttgttgcaagtccacaaggggtaagggttttc

SEQ ID NO: 266 - protein, 189 aa, Arabidopsis thaliana
  G2583,AP2 domain coordinates 4-71
MVHSRKFRGVRQRQWGSWVSEIRHPLLKRRVWLGTFETAEAAARAYDQAALLMNGQNAKTNFPVVKSEEGSDHVKDVNSPLMSPKSLSELLNAKLRKSCKDLTPSLTCLRLDTDSSHIGVWQKRAGSKTSPTWVMRLELGNVVNESAVDLGLTTMNKQNVEKEEEEEEAIISDEDQLAMEMIEELLNWS

SEQ ID NO: 267 - DNA, 1099 bp, Arabidopsis thaliana
  G2590,family:MADS
cacacaccaaagaaaagaaaaacaaagataatgaggtcgaaaattaagttatcactcatagctaataagacctcaaggagaaccacattcaggaagaggaagggagggataacgaacaaactccatgagctaacaactctctgcggcgtcaaagcatgtgcggtaatctccagtccgtacgagaatccagtggtgtggccgtcaaccgaaggtgttcaagaggcggtttccatgtttatggagaggccggcgacagaacaatccaagctgatgatgagtcatgagacctacttgcaggacaaaattaccaaagaaacaaagaaactggagagtctacgtcgtgaaaaccgagaatctcagcttaggcaatttatgtttgattgtgttgaaggtaagatgagtgagcatcagtatggtgcaagggaccttcaagatttaagtctttatattgatcactatatcaatcagcttaattcaagtgtcatgctccttacaaacaatggtgcgtcttcttcttcctttcctcctccgcttcatacttcagttgcgggtgcgggtgcgggtgcgggtgctgctcctcttgttgttgcgggtgcgggtgcggctcctcttgctgttgcgggggcgggtgcgagtcctcttgctgttgcgggtgtgggtgcggctcctcttgctgttgcgggtgccggtcctcctatggctcagaatcagtatgagccgattcagccctatatccctactgcttttagtgataatattcaataccaagctcctgtggattttaatcatcagatccaacatggaatctatgataatctcagtttggatccaaatcatcagtatccgtttcaagatgatccattcatggagatgttgatggaatatccttatgaacaagtgggttatgctgcagagcatgcacacatccctttcatgaacggaaactactacaactaccaccaaccaccaaccgttggtcttactaccaccggtcacatgccttccaacaacgccaccaccaccaccaccaccaacaccaccgttgtgtgatgtgtttcagtagtttgcatttgtgttttgtccatttcaaaagaccaat

SEQ ID NO: 268 - protein, 339 aa, Arabidopsis thaliana
  G2590,MADS domain coordinates 2-57
MRSKIKLSLIANKTSRRTTFRKRKGGITNKLHELTTLCGVKACAVISSPYENPVVWPSTEGVQEAVSMFMERPATEQSKLMMSHETYLQDKITKETKKLESLRRENRESQLRQFMFDCVEGKMSEHQYGARDLQDLSLYIDHYINQLNSSVMLLTNNGASSSSFPPPLHTSVAGAGAGAGAAPLVVAGAGAAPLAVAGAGASPLAVAGVGAAPLAVAGAGPPMAQNQYEPIQPYIPTAFSDNIQYQAPVDFNHQIQHGIYDNLSLDPNHQYPFQDDPFMEMLMEYPYEQVGYAAEHAHIPFMNGNYYNYHQPPTVGLTTTGHMPSNNATTTTTTNTTVV

SEQ ID NO: 269 - DNA, 879 bp, Arabidopsis thaliana
  G2606,family:Z-C2H2
atgacaagtgttcttgaggagagtggagaccacgcgcgtcttgttctcctcatcaagggcaaacgcaccaaacgtcagcgttctgcgtctcctcttatgatgaacgctgctgcagtatccagcgtttgtagcggtgaacgatcatcagtggaggtaagagaagaagaagctgctggtgaagtagaattccaaggagctaccgatgaagacgaagatatggcgaattgtctgatcttgttgtcgcaaggacatcaagcaaagagcagcgacgatcatttgtcgatgcagagaatgggtttctttagcaacaagaaaccggtggcttctctagggttagggctagacggtgtttaccagtgcaaaacgtgtgataaaagcttccattcgttccaagcgctaggagggcacagggctagtcacaagaagccaaaacttggagctagcgttttcaaatgcgtcgagaagaaaacggcgtctgcgtctacggttgaaacagtggaagctggagccgtaggaagctttctttccctacaagtgactagtagtgatggtagcaagaaaccggagaaaacacatgaatgttcaatctgcaaggccgagttttcttcaggacaagccttaggaggacatatgaggagacatagaggtttaacaataaacgcaaacgctacttcagcaatcaaaacagcgatatcatcatcaagtcatcatcaccatgaagaatctatacggccaaagaactttctccagttagatctgaatcttccagcacccgaagatgaacgatgctgcgagaaaccgaaattcgcgtttgcatccaaagatcagattcttctcttcacggccgcgtcaaattctttgattgattgtcatcactaa

SEQ ID NO: 270 - protein, 292 aa, Arabidopsis thaliana
  G2606,Z-C2H2 domain coordinates 120-140,192-214
MTSVLEESGDHARLVLLIKGKRTKRQRSASPLMMNAAAVSSVCSGERSSVEVREEEAAGEVEFQGATDEDEDMANCLILLSQGHQAKSSDDHLSMQRMGFFSNKKPVASLGLGLDGVYQCKTCDKSFHSFQALGGHRASHKKPKLGASVFKCVEKKTASASTVETVEAGAVGSFLSLQVTSSDGSKKPEKTHECSICKAEFSSGQALGGHMRRHRGLTINANATSAIKTAISSSSHHHHEESIRPKNFLQLDLNLPAPEDERCCEKPKFAFASKDQILLFTAASNSLIDCHH

SEQ ID NO: 271 - DNA, 2049 bp, Arabidopsis thaliana
  G2674,family:HB
atgaatggcgatcttgaagttgatatgtctagaggagatttcaatccaagtttttttcttggaaagcttaaagacgatgagtttgagagtagatcattgagtgatgatagctttgatgcaatgtctggtgatgaggataaacaagaacaacgccctaagaagaagaagaggaagacaaagtatcatagacacacttcttaccagattcaagaactcgaatctttcttcaaagagtgtcctcatcctaatgagaagcaaaggttggaacttggcaaaaaacttactttggagagtaagcaaattaagttttggtttcagaacagaagaacacaaatgaagacgcaactagagcggcatgagaatgtgattctcaaacaagagaatgaaaaactgcggctagaaaacagtttccttaaagagtcaatgagaggctctctatgtattgattgtggtggagcagttatacctggtgaggtttcttttgagcagcaccaacttaggattgagaatgctaagcttaaggaagagcttgataggatttgtgctttagcaaatagattcattggtgggtctatttcacttgagcagccttcaaatggtgggattggctcacagcatttgcctataggacattgtgtcagtggtggaacttcactgatgtttatggatcttgccatggaagccatggatgagttgttgaagttagcagaattggaaacttctttatggagttcaaagagtgagaaaggatcgatgaaccatttccctggttcaagagaaactggtttagtacttatcaatagcttggctctagtcgagactcttatggacacgaacaaatgggcagaaatgtttgagtgcatagtcgcggttgcatcaacccttgaagtgatatccaacggtagtgatggatcaagaaacggctctattctattgatgcaagcagagtttcaagtgatgtctccattagttccaatcaaacaaaagaagtttcttagatattgcaagcaacatggagatggtttatgggcggtcgtcgatgtttcttatgatataaacagaggaaatgagaacttgaagtcttatggtggctctaaaatgtttccttcaggatgcattatacaagacataggcaacggctgctccaaggtgacatggatagaacattcagagtacgaagagagtcacacccactcactttaccaaccgttgctcagttcttcggttgggttaggcgcaaccaaatggcttgcgactctgcagaggcaatgcgagagcttcacaatgcttttgtcttctgaagatcacacaggtttgtcacatgctggaacaaagagtatactaaagctagcgcagcgtatgaagctcaacttttactcgggaataactgcttcgtgcattcacaaatgggagaagcttcttgctgagaacgtgggacaggacacaaggatactgacaaggaagagtcttgagccgtctggtattgtcctgagcgctgcgacatctctgtggctaccagtgactcagcagagactctttgagtttctgtgtgatggtaaatgcagaaaccagtgggatattttgtctaatggtgcttcaatggaaaacacacttctcgtcccaaaaggacaacaggaaggaagctgcgtctctcttcttcgtgctgctgggaatgatcaaaatgagagtagtatgctcatcttgcaagagacatggaatgacgtttctggtgcactggtggtttacgcgcctgttgatattccatctatgaatactgtaatgagcggtggagattcagcttatgtggcgcttcttccatcggggttctcgatattgcctgacggatcatcatcatcgtctgatcagttcgataccgatggcggtttggtgaatcaagaaagcaaaggatgtctcctgactgtaggatttcagatcttagtgaacagcctaccgactgcaaaactcaacgtggaatctgttgaaactgttaacaacctcatcgcttgcaccattcacaagatcagagccgctcttcgtatacctgcttag

SEQ ID NO: 272 - protein, 682 aa, Arabidopsis thaliana
  G2674,HB domain coordinates 56-116
MNGDLEVDMSRGDFNPSFFLGKLKDDEFESRSLSDDSFDAMSGDEDKQEQRPKKKKRKTKYHRHTSYQIQELESFFKECPHPNEKQRLELGKKLTLESKQIKFWFQNRRTQMKTQLERHENVILKQENEKLRLENSFLKESMRGSLCIDCGGAVIPGEVSFEQHQLRIENAKLKEELDRICALANRFIGGSISLEQPSNGGIGSQHLPIGHCVSGGTSLMFMDLAMEAMDELLKLAELETSLWSSKSEKGSMNHFPGSRETGLVLINSLALVETLMDTNKWAEMFECIVAVASTLEVISNGSDGSRNGSILLMQAEFQVMSPLVPIKQKKFLRYCKQHGDGLWAVVDVSYDINRGNENLKSYGGSKMFPSGCIIQDIGNGCSKVTWIEHSEYEESHTHSLYQPLLSSSVGLGATKWLATLQRQCESFTMLLSSEDHTGLSHAGTKSILKLAQRMKLNFYSGITASCIHKWEKLLAENVGQDTRILTRKSLEPSGIVLSAATSLWLPVTQQRLFEFLCDGKCRNQWDILSNGASMENTLLVPKGQQEGSCVSLLRAAGNDQNESSMLILQETWNDVSGALVVYAPVDIPSMNTVMSGGDSAYVALLPSGFSILPDGSSSSSDQFDTDGGLVNQESKGCLLTVGFQILVNSLPTAKLNVESVETVNNLIACTIHKIRAALRIPA

SEQ ID NO: 273 - DNA, 726 bp, Arabidopsis thaliana
  G2686,family:WRKY
atgttttcaaacatcgatcacaaggctgtggcagcactccttcatggccagggatgcgctaacatcctcaagacggtcctcgacaactgtaaagttagctctgtttcaacagaacctctcattaacaccattcttgattccttttcactagctctatcttctgtgaattctcctaatcgtcaaccacaccatgagtcttcttctcgagacatggcaggtcttgtgcctcaaagatcatcaaagaagaagatttgcggagtaaaaggtttagagatttacagagatgattcccccaatccccgccttgatgacggcttcacctggaggaaatatggacaaaaaaccatcaaaacctctttgtaccaaaggtgttactatcgttgtgcctatgcaaaagaccaaaactgctatgctacaaagcgggtgcagatgatccaagacagtcctccagtttacagaaccacttatttgggacaacatacatgtaaagcctttggggtgcatgataatacgtatggctctgaaatgataaacttcgaccaagttgtatctgaatcggttatgcgtcaacttgcaacaattggtgaacaagctgttctcatggaggacgaagctaaccatatcatgaaccaagaatatgatattaatgattatttggtggatgatgaagtcttttgggggaatgaatttcctctattttcatcggaagacctgatgttgttttga

SEQ ID NO: 274 - protein, 241 aa, Arabidopsis thaliana
  G2686,WRKY domain coordinates 122-173
MFSNIDHKAVAALLHGQGCANILKTVLDNCKVSSVSTEPLINTILDSFSLALSSVNSPNRQPHHESSSRDMAGLVPQRSSKKKICGVKGLEIYRDDSPNPRLDDGFTWRKYGQKTIKTSLYQRCYYRCAYAKDQNCYATKRVQMIQDSPPVYRTTYLGQHTCKAFGVHDNTYGSEMINFDQVVSESVMRQLATIGEQAVLMEDEANHIMNQEYDINDYLVDDEVFWGNEFPLFSSEDLMLF

SEQ ID NO: 275 - DNA, 1200 bp, Arabidopsis thaliana
  G2719,family:MYB-(R1)R2R3
atggaaggagaaactcatcaatcggagccgttacctttagcatctggagattccgatgaagggatcagtgctgcgattgaggcggagcttgctgagttagctgctggagattcaagcggcggtggtggttgcggcggcggaggaggagggattaggagtaaagtcaaaggaccttggtctacggaggaagacgcggttcttacgaagcttgtgaggaaactaggaccgaggaattggagtttgatcgctcgtggaatccctggtcgttctggtaaatcttgtcgattgcgttggtgtaatcagcttgacccttgtctcaagcgtaaacctttctctgatgaggaagatcgtatgataatttctgctcacgcggttcacggaaacaaatgggcagtgattgcgaaactgttaactggaagaacagataacgctatcaagaaccattggaactcaactcttagacgtaaatacgcagatctatggaataatggtcaatggatggctaattcagttactaccgcttccgtcaaaaacgaaaatgtcgatgaaacaactaatcctccatcctcaaaacaacagttgcctcaaggagatatcaattcctccccgccaaagcctccacaagtgagtgatgttgtaatggaagaggcagctaatgaacctcaagaacctcaagaacaacaagaacaagctccaccggtagtgagtaacgttccaacagaaaataacgtgtttcgccccgtggctcgcgttggtgcattcagtatctataacccaaccagccagaaaaatggttacagagactacaatatagttccatgtgagggaccgttgattcaagcagctaaacccgattcattggctggtaaatttctacaatctctttgtgatgaacctcaaatcccgtcaaaatgtggtcacggctgctctactcttccagctgaaactaagttctcacgtaactcggtgttgggacctgagtttgtggattatgaagagccttctgcggttttcaaccaagaactaatatctatagcaaccgatttgaacaacattgcatggataaagagtggccttgacaatgctgttgtcagagaagcagaacagagtttgaagatggataattacaattataatgatcctcgaatcaagtttactggaatgatgcctagacaagatttcttctgtgcaagaagctga

SEQ ID NO: 276 - protein, 399 aa, Arabidopsis thaliana
  G2719,MYB-(R1)R2R3 domain coordinates 56-154
MEGETHQSEPLPLASGDSDEGISAAIEAELAELAAGDSSGGGGCGGGGGGIRSKVKGPWSTEEDAVLTKLVRKLGPRNWSLIARGIPGRSGKSCRLRWCNQLDPCLKRKPFSDEEDRMIISAHAVHGNKWAVIAKLLTGRTDNAIKNHWNSTLRRKYADLWNNGQWMANSVTTASVKNENVDETTNPPSSKQQLPQGDINSSPPKPPQVSDVVMEEAANEPQEPQEQQEQAPPVVSNVPTENNVFRPVARVGAFSIYNPTSQKNGYRDYNIVPCEGPLIQAAKPDSLAGKFLQSLCDEPQIPSKCGHGCSTLPAETKFSRNSVLGPEFVDYEEPSAVFNQELISIATDLNNIAWIKSGLDNAVVREAEQSLKMDNYNYNDPRIKFTGMMPRQDFFCARS

SEQ ID NO: 277 - DNA, 1456 bp, Arabidopsis thaliana
  G2741,family:GARP
gaaaaaaaaaaaaaaaaaaattgtttgctcatcatcttcacaaaccaaacttctcttcttctccgatctcagatttgaatttttatcgattttgagcttcgaagagctcaatctctaactgaatttcgagaaattagagagtttgaaatgggagaggaagtacaaatgagcgattacgatgtttccggcgacggagatagggtttctgaatgggagatgggattaccaagcgacgaagatctagcatctctttcttactctctgattccaccgaatttggcgatggcgtttagtatcacaccggagagaagccgtacgattcaggatgtgaatcgtgcatcggagacgacgctctcgtcgctacgtggtggatcttcaggtccaaatacctcgtcgtcgaataataacgtggaggaggaagatcgagttggatctagcagtcctggatcggattcgaagaagcaaaagacatcaaacggtgatggagatgacggtggcggtgtggatccggattcggcgatggcggcggaagaaggagattcaggaactgaagatctatctgggaaaacacttaaacgaccgcgtttagtgtggacaccgcagctacacaagagattcgttgacgttgtagctcacttagggatcaaaaacgctgttccgaagacgattatgcagctgatgaacgttgaaggattaactcgtgagaacgttgcgtctcatcttcaaaagtataggctttacctcaaaaggatgcagggattgactaatgaaggtccctctgcttcggataagctcttctcttcaacacctgttcctccacagagcttccaagatatcggtggcggtggcggtagcagcggtaatgttggagtgccgattccgggggcgtatggaacgcaacagatgatgcagatgccagtttatgcacatcatatgggtatgcaaggatatcatcatcaaaatcataatcatgatccttatcatcagaatcatcgtcatcatcatggagctggtggaaatggtgcgtttgagtcaaatccttatatgatgcagcagaataagtttggatccatggcttcttatccttctgttggaggtggaagcgcaaatgagaattaaaaagagtctatagatggattcaatgggggaggaagagataggtgagcttgttattgctcgtggaactgataattattgtcaagtttctgtttttttaagtacagtacagttataattcttactcgatttgatcgaaattttcatcaagtttctgtcttttactataaatggtatacaataaagtcttaataatcacttgtgaggtgagtgccctcagatttatttgtctgcagacttcttaaagtggtaatcaagagagtgaattgtttatttctgtgagagatggcgtcagacacaaactttattttaaaaatttataaaccaatcaaatgtttca

SEQ ID NO: 278 - protein, 323 aa, Arabidopsis thaliana
  G2741,GARP domain coordinates 149-197
MGEEVQMSDYDVSGDGDRVSEWEMGLPSDEDLASLSYSLIPPNLAMAFSITPERSRTIQDVNRASETTLSSLRGGSSGPNTSSSNNNVEEEDRVGSSSPGSDSKKQKTSNGDGDDGGGVDPDSAMAAEEGDSGTEDLSGKTLKRPRLVWTPQLHKRFVDVVAHLGIKNAVPKTIMQLMNVEGLTRENVASHLQKYRLYLKRMQGLTNEGPSASDKLFSSTPVPPQSFQDIGGGGGSSGNVGVPIPGAYGTQQMMQMPVYAHHMGMQGYHHQNHNHDPYHQNHRHHHGAGGNGAFESNPYMMQQNKFGSMASYPSVGGGSANEN

SEQ ID NO: 279 - DNA, 943 bp, Arabidopsis thaliana
  G2742,family:GARP
aaaaaaaaaaacgttttctttttctttcaagaaatcaagatcaaaagaattagggttttcgaatgggtaggtgtggaagaagcaacgacggagtaattggtggagtaagaccatacgtacgatctccggtgcctcgtctgagatggacgccggagcttcaccggagtttcgttcacgccgttgatttgctcggcggtcaatataaagcaactccaaaacttgttctgaagataatggatgtcaagggactaaccatatcacacgtcaagagccatctccagatgtataggggatccagaatcactcttcttggaaaaccagaagagagttcttcaccatcttcaagaagaagaagaagacaagacaatgaagaagatcatcttcatgacaacttgtctgtacacgcaaggaatgattgtcttttgggttttcactcttttaactttagagagcagacttcagcgactgataatgatgacgatgactttcttaacatcatgaacatggagagaacgaagacatttgcaggcaatggcgagtccatcaaatttcagtctcatcactctctcgaggctgagaacacgaagaacatttggaaaaacacatggcgagaaaacgaacacgaagaagaagaagagttatcgctgtctctgtcgttgaatcatcctcataaccatcaacaaagatggaaaagcaatgcttcatcatcactcagtgaaacaagcgaagcagtctcatcttcttctggtccattcatcttcagagattgttttgcttcttcgaagattgatcttaatcttaatctctccttttctctactccatagctgaagctttgttcagctttgttcctttgttctaaattttagcgtagtgaacatttagattgtttttaaaccaccttaaaagttcctaatcttttagttaggcctcttgatttgtga

SEQ ID NO: 280 - protein, 255 aa, Arabidopsis thaliana
  G2742,GARP domain coordinates 28-76
MGRCGRSNDGVIGGVRPYVRSPVPRLRWTPELHRSFVHAVDLLGGQYKATPKLVLKIMDVKGLTISHVKSHLQMYRGSRITLLGKPEESSSPSSRRRRRQDNEEDHLHDNLSVHARNDCLLGFHSFNFREQTSATDNDDDDFLNIMNMERTKTFAGNGESIKFQSHHSLEAENTKNIWKNTWRENEHEEEEELSLSLSLNHPHNHQQRWKSNASSSLSETSEAVSSSSGPFIFRDCFASSKIDLNLNLSFSLLHS

SEQ ID NO: 281 - DNA, 970 bp, Arabidopsis thaliana
  G2747,family:ABI3/VP-1
ggtgaggaagtcaaaatcttgagagatctgagattgtaagaagatgaatcaagaagataaagagaagcctattgaagaagcttcttcatcaatggagagagaacacatgttcgacaaagtagtaacaccaagcgacgttggcaaactaaaccgactcgtgatccctaagcaacacgcagagagatacttcccattagataactccacaacaaacgacagcaacaaaggtttgcttctaaacttcgaagatcgaagtggaaactcatggaggttccgttactcttactggaacagtagtcaaagctatgtcatgactaaaggttggagccgttttgtcaaagacaagaagcttgatgctggagacatcgtttcttttcagagagattcttgtaataaagacaagctttacatcgattggaggagacgacctaagattcccgatcatcatcatcagcaattcgccggagctatgttccctaggttttacacttttcctcatcctcagatgccgacaaattacgaaactcacaacctttatcatcgatttcatcaacgagatctaggaattggatactatgtgaggtcaatggagaggagtcatccaacggctgtgattgaatctgtgccggtgatgatgcaaaggagagcacaagtggcttcaatggcttcgagaggagagaagcggttaaggctgtttggtgtagatatggagtgcggaggaggaggagggagtgtgaatagtacggaggaagagtcgtcgtcttccggtggtagtataccacgtggcagagtttctatggttggtgctggttctctcctccagttgaggttagtgagcagtgatgatgagtctttagtagcaatggaagctgcaagtcttgaggatcatcacttctttacaaagaaaggaaaaccttctttgtcttttgatttggataggtgatgattatgcatgagattaatcactatt

SEQ ID NO: 282 - protein, 299 aa, Arabidopsis thaliana
  G2747,ABI3/VP-1 domain coordinates 19-113
MNQEDKEKPIEEASSSMEREHMFDKVVTPSDVGKLNRLVIPKQHAERYFPLDNSTTNDSNKGLLLNFEDRSGNSWRFRYSYWNSSQSYVMTKGWSRFVKDKKLDAGDIVSFQRDSCNKDKLYIDWRRRPKIPDHHHQQFAGAMFPRFYTFPHPQMPTNYETHNLYHRFHQRDLGIGYYVRSMERSHPTAVIESVPVMMQRRAQVASMASRGEKRLRLFGVDMECGGGGGSVNSTEEESSSSGGSIPRGRVSMVGAGSLLQLRLVSSDDESLVAMEAASLEDHHFFTKKGKPSLSFDLDR

SEQ ID NO: 283 - DNA, 1025 bp, Arabidopsis thaliana
  G2763,family:HLH/MYC
aaaggaagaagaagaagaagaaaggattcgtcttccttcttccacaccctttctgacacctcatctcccctcccaccttctccgtcccgttccgtttctccatcagatcctcgattccgatccaacagttcgaattcagtttccgattctgatctgatcgaaccaatactcactgagatttgatcggcgattatggagtctatatctccggtatcgaatcagcttcttcagccgacgacgacgagctctaattccgatcgctctcgtcgtaagcgtaagaagaaatcatcgccatcatcggttgagaaatctccatctccgtcaatatcgttggagaaatggagatcggagaagcagcaacagatctactcaacgaagctagttcatgctttaagagagctacgaatcagccaacaaccatcttcatcatcatcttcttcgattccacgtggaggtagagccgtacgtgaagtcgccgatagagctttagcagttgcggcgagaggtaaaacgttatggagtcgagcgatactttcaaaagctgtaaaactcaaattcaggaaacacaaacgccagagaatctctaatccgacgacgacgacgttaaccaccgggagtatcaggtcaaagaaacagagagcgacggttttgaggcttaaggctaaaggtttgccagctgtacagaggaaagtgaaagtactgagccggttagttcccggttgccgtaaacaatcattaccggtggttttagaagaaaccactgattatatagctgcgatggagatgcagattcgtactatgactgcgattctctccgccgttagttcttctcctccgccgccaacgccaggtcacgaagggggacaaacacacatgcttggttagttggccaaactgtccttttatttttttccaattttaaaaaccaaaaaaaaaactgtttttttttatcatattattattcttctcactgtattgtttgttgtttgaatattttactattcaactttatttaccatttcgtc

SEQ ID NO: 284 - protein, 230 aa, Arabidopsis thaliana
  G2763,HLH/MYC domain coordinates 141-201
MESISPVSNQLLQPTTTSSNSDRSRRKRKKKSSPSSVEKSPSPSISLEKWRSEKQQQIYSTKLVHALRELRISQQPSSSSSSSIPRGGRAVREVADRALAVAARGKTLWSRAILSKAVKLKFRKHKRQRISNPTTTTLTTGSIRSKKQRATVLRLKAKGLPAVQRKVKVLSRLVPGCRKQSLPVVLEETTDYIAAMEMQIRTMTAILSAVSSSPPPPTPGHEGGQTHMLG

SEQ ID NO: 285 - DNA, 1668 bp, Arabidopsis thaliana
  G2831,family:Z-C2H2
acccttttcaatctcttccaacaaaacttttgtccaagaagaagacatgacaactgaagatcagacaatttcaagtagtggaggatatgtccaaagctcatcaacaactgatcatgttgatcatcatcatcatgatcaacatgaatccctcaatcctcctcttgtcaagaagaagagaaacctccctggaaatcctgatccagaagctgaggtcatagctctatctccaaagacacttatggccacaaatcgtttcctctgcgagatatgtggaaaagggtttcaaagagaccagaatctacagcttcaccgtcgaggacacaacctcccatggaagctaaagcagaggacgagcaaagaagtaaggaaacgagtgtatgtatgtccagaaaagagttgcgtccaccaccatccgacgagggcacttggtgatcttaccggcattaagaaacatttttgtcggaaacatggcgagaaaaagtggaagtgtgagaaatgcgccaagagatatgcagtccaatctgactggaaggctcattccaagacttgtgggactagagaatatagatgcgactgtggtacaattttctccaggagagacagcttcattacacatagagcgttctgtgacgctttagcagaagaaaccgctaggctaaacgcagcctcgcatctcaaaagctttgccgcaaccgctggtagtaatctaaactatcattatctcatggggacacttatcccatcaccatcactaccacaaccaccgtcgtttccgttcggaccaccgcaaccgcaacatcatcaccaccaccaattcccaatcacaaccaacaacttcgatcatcaagacgtcatgaaaccagcgtctacgctctctttatggtcgggaggaaatattaatcatcatcagcaagtgaccatcgaggaccgtatggcgccgcagccgcattcaccgcaagaggattacaattgggttttcggaaacgcgaataatcacggcgagttaataacgacgagcgattcactcattactcatgacaataatattaatatcgtccagagtaaggaaaacgctaacggggcaacttctctttccgtgccttctctttttagcagcgttgaccaaattacccaagacgcaaacgctgcttctgtggctgttgcaaatatgtcggcgactgcgttactccaaaaagctgctcagatgggagcgacttcttctacgtcaccaacgacgacgattactaccgaccaatcagcgtatcttcagagttttgcatcgaagagtaatcagattgtagaagatggtggcagcgacaggttctttgcttcgtttggatcgaacagtgtcgagttaatgagtaataataataacggtcttcacgagatcgggaaccctagaaacggcgttacggtcgtttcggggatgggtgaattacagaattacccttggaagcgtagaagagttgatattgggaatgcgggaggaggagggcaaactcgggattttcttggggttggtgtacaaacaatatgccattcttcctctatcaatggatggatttgaaacactctttaatggatttttctaccttatttatgagtgaacttaattatcaaagctgatttctttaattaattttaaaaatgatttatttcaccagacca

SEQ ID NO: 286 - protein, 506 aa, Arabidopsis thaliana
  G2831,Z-C2H2 domain coordinates 72-92,148-168
MTTEDQTISSSGGYVQSSSTTDHVDHHHHDQHESLNPPLVKKKRNLPGNPDPEAEVIALSPKTLMATNRFLCEICGKGFQRDQNLQLHRRGHNLPWKLKQRTSKEVRKRVYVCPEKSCVHHHPTRALGDLTGIKKHFCRKHGEKKWKCEKCAKRYAVQSDWKAHSKTCGTREYRCDCGTIFSRRDSFITHRAFCDALAEETARLNAASHLKSFAATAGSNLNYHYLMGTLIPSPSLPQPPSFPFGPPQPQHHHHHQFPITTNNFDHQDVMKPASTLSLWSGGNINHHQQVTIEDRMAPQPHSPQEDYNWVFGNANNHGELITTSDSLITHDNNINIVQSKENANGATSLSVPSLFSSVDQITQDANAASVAVANMSATALLQKAAQMGATSSTSPTTTITTDQSAYLQSFASKSNQIVEDGGSDRFFASFGSNSVELMSNNNNGLHEIGNPRNGVTVVSGMGELQNYPWKRRRVDIGNAGGGGQTRDFLGVGVQTICHSSSINGWI

SEQ ID NO: 287 - DNA, 1367 bp, Arabidopsis thaliana
  G2832,family:Z-C2H2
ttttgtcggtttatgcagcactcgtcttcattcatagattttgatttgaggtaaactaaactcatcagatattaaaaatgggttctttacttctttcgatttcgtgtgtaaaggagaaacctttattgattctttcttgcttgtttgctgtttgatcatttgtctaagagaagaaggtcaaattttcaaatggaggaagggaaagagaattcgtttttgtgcaagtactgttacaagacgtttccttctgggaaagcactcggtggtcacattagaattcatacgaacgagaattcagttggttacaatggcaataagaagaagaggttggtggatcagagaaagatgatggctcagaaacataagcaacaacaacaagttggttgcagagaatgtggtagagtgttcgtttctttgaaagctcttagaggtcacatggcttgtcacggtgaggtaaagaagatgttgatggatgataatagccaatctgatactgaaagtgagacttcctcagctcctatgaggaaaagatccaagagggtggtcatgaaacaatcaaattctgaatctttgagtaatgggagctcgtcttttggttctgagattgaccaagaacgtagggatggggcttataatttgatgatgttgtcgagtgattctagtagtttcaagaaaagacgtaacatggtgatgaattctcttggtgagtcatctgacaacaactctgcgattgttgagaataagtcatcttcaggggatgagtttaagatcatgaatgtgaagaatgcagtagatgaccaatggagatctgctgatgatgatggagttagtctctgtgattcagatggctctgattctgattacttcatgaatggtccaagtaagtcggagtcagacatttctgttgacaggaacactggatttggatctggattcaacaactcattgatcaggttcaggaatagtaatgagggaggaacaaagtatgagctgagcaaaagcaagagagccttgttttcttatgaaactgattcatgtgcagacacaaacagcaagattcatcataggttcaaagatagcaaatcctcaatggttaagaaagaaggtggtgagaaggtgaagagcaaaggtcatgagtgcccaatttgcttcaggatgttcaaatcaggccaagctttaggtggtcacaagagatcacattccattgcaaaccacgcagctgaaatgcgtaaccaaatcgatctctatcttcctgtttcggatactgatgaatgaatcagaacctgagaactatagttctctctgatagtatttcatccccactttttgtttgttttctttgctccacattttagaactagatgaaa

SEQ ID NO: 288 - protein, 361 aa, Arabidopsis thaliana
  G2832,Z-C2H2 domain coordinates 11-31,66-86,317-337
MEEGKENSFLCKYCYKTFPSGKALGGHIRIHTNENSVGYNGNKKKRLVDQRKMMAQKHKQQQQVGCRECGRVFVSLKALRGHMACHGEVKKMLMDDNSQSDTESETSSAPMRKRSKRVVMKQSNSESLSNGSSSFGSEIDQERRDGAYNLMMLSSDSSSFKKRRNMVMNSLGESSDNNSAIVENKSSSGDEFKIMNVKNAVDDQWRSADDDGVSLCDSDGSDSDYFMNGPSKSESDISVDRNTGFGSGFNNSLIRFRNSNEGGTKYELSKSKRALFSYETDSCADTNSKIHHRFKDSKSSMVKKEGGEKVKSKGHECPICFRMFKSGQALGGHKRSHSIANHAAEMRNQIDLYLPVSDTDE

SEQ ID NO: 289 - DNA, 943 bp, Arabidopsis thaliana
  G2859,family:HLH/MYC
actttctattttcaccaattttcaaaaaaaaaataaaaattgaaactcagaaatggcgaatctctcttctgattttcagacatttacaatggatgatcccataagacaactagcagaactgagcaacacgcttcatcatttccaaacatttcctcctcctttctcttcttctctcgattctcttttctttcataatcaattccctgatcattttcccggaaaatctctcgagaataattttcatcaagggatattcttcccttctaatatccaaaacaacgaagagtcttcttcacaattcgataccaagaagagaaaatcattaatggaagctgtttctacgtcggagaacagtgtctctgatcaaactctctctacctcttctgctcaagtttccataaatggaaatatttcgacaaaaaataattcttcaaggagagggaagaggtcgaagaatagagaagaagagaaagagagagaagttgttcatgttagagctagaagaggccaagccactgatagccacagcatagcagaacgggttcgacgagggaaaataaacgagagattgaaatgcttgcaagatatagtccccggatgttataagacaatgggaatggctactatgcttgatgagataattaattacgtccagtccttacaaaatcaagtcgagtttttatctatgaagcttacagcagcaagttcgtattatgactttaactcggagactgatgctgtggaatccatgcagaaggcaaaggcacgtgaggcagtggagatgggtcaagggagggatgggagttctgtcttccattcatcatcgtggaccctttgacttttgttttttgctctcctttttttgtctttctaattttcttcctttttttggatttaaaaagatacttttaaagattaatttcaagaaatctcgatgtaaaaa

SEQ ID NO: 290 - protein, 261 aa, Arabidopsis thaliana
  G2859,HLH/MYC domain coordinates 150-208
MANLSSDFQTFTMDDPIRQLAELSNTLHHFQTFPPPFSSSLDSLFFHNQFPDHFPGKSLENNFHQGIFFPSNIQNNEESSSQFDTKKRKSLMEAVSTSENSVSDQTLSTSSAQVSINGNISTKNNSSRRGKRSKNREEEKEREVVHVRARRGQATDSHSIAERVRRGKINERLKCLQDIVPGCYKTMGMATMLDEIINYVQSLQNQVEFLSMKLTAASSYYDFNSETDAVESMQKAKAREAVEMGQGRDGSSVFHSSSWTL

SEQ ID NO: 291 - DNA, 2152 bp, Arabidopsis thaliana
  G2885,family:GARP
agagtacgcgggggtactatattcctttgaagagaggagacttgcaaacgtattgcatcaaatatggagtttggaagcactgaagatggaaggcatgacaagtttcctgtaggaatgagggttcttgctgtggatgacaatccaacctgccttcggaaactcgaagagttgctgcttcgttgcaagtatcatgtgacaaagacaatggagtcgaggaaagctctggaaatgctgagagaaaacagcaacatgtttgatctggtgataagcgatgtagagatgccagacacggatggttttaagttgcttgaaattggtcttgaaatggaccttcctgtcatcactcatagcgactatgacagcgttatgaaaggtattatacatggcgcttgcgattatctggtcaagcctgttggactcaaggagcttcagaatatatggcatcatgttgtgaagaagaacattaaatcttacgcaaaactgctcccaccttctgaatctgattccgtcccaagcgccagcaggaaacggaaagacaaagtcaatgacagtggtgatgaagatgacagtgacagagaagaggatgatggtgaggggagtgaacaggatggtgacgggtcaggtacgcggaagaagccacgtgttgtttggtctcaggagcttcaccagaagtttgtcagtgccgttcagcaattgggcctcgacaaggctgttcccaaaaaaatacttgatctcatgagtatagaaggtctcactagggaaaacgtagccagtcatttgcagaagtacagactgtacttgaaaaagatagacgaaggtcagcagcaaaatatgaccccagatgcatttggaacaagagattcatcttactttcagatggctcaacttgatggacttagagattttactgccgcaagacaaattccaagctcaggactcttatcgcgttcccatctcaccaaactccaaccccctatgtattcatcgataaatctccaaggaatgaactcctccagcttcatccaacaggggcatcaccagaactcaagcaattcagctaatccgtttggaacatatcacagtactctgtcaccaagaatccagaacgtgaatctgtttcagcgaacttcatctccactagaacccctccagtttcctagaagcaagtcatacattggagattttaaaggcttaggggacagagctattggcggtagcttcctagatacttgtatgccatttggtagctctagcacctctttaccaagtgcttccaccaatcctctaatgttgcaagcaaactatacacaacccctgcatatagcctcagatggaattcagccttgcatcgagggaactccgtccaactctgcctccccaaacatcagtttccaaggcttatctagatttcctggtcatagctggcaagggaatttgaacacaaccagattcccaccgagttccttaccactaaatcttgctttcttgccggatcaagtgacatgtgcagggaacaatctgggagattgtacttctttggtttctgcagagaatcctggtggagagatgcagtgtgatcctcaattacttggcggcttcatgcagaacgtgaatccgttaggcggacagaaatgggagcaacagaactgcaccatgctgaacaatccattcggtaacattgagtatcctctacccgcagataacatggttttcagagacaacaattcaaccagaagcaaaggcttggatgagtcactgatgaacccaatagacaacagtcaagagtatgttggaaaagctactacaatgctggatccagagatgaagtcgggaaagccagagaatgacaaccagcatgatgtattcgatgacataatgaatgagatgatgaaacaggaggagaataacggaatggtgccagtggctactagatttggctttgattcatttcctccaccttagctagtcatctctttctctaccagttgcattaagtttctccacttgagaccattttcatgtgatttttttaaatttcttcccacattgtttcctccgactgtcaatagatcatagtacaccaacctgtttcatactctcttttatgaattggaattgaaagcgagcctgttacaaaaaaaaaaaaaaaaaa

SEQ ID NO: 292 - protein, 632 aa, Arabidopsis thaliana
  G2885,GARP domain coordinates 196-243
MEFGSTEDGRHDKFPVGMRVLAVDDNPTCLRKLEELLLRCKYHVTKTMESRKALEMLRENSNMFDLVISDVEMPDTDGFKLLEIGLEMDLPVITHSDYDSVMKGIIHGACDYLVKPVGLKELQNIWHHVVKKNIKSYAKLLPPSESDSVPSASRKRKDKVNDSGDEDDSDREEDDGEGSEQDGDGSGTRKKPRVVWSQELHQKFVSAVQQLGLDKAVPKKILDLMSIEGLTRENVASHLQKYRLYLKKIDEGQQQNMTPDAFGTRDSSYFQMAQLDGLRDFTAARQIPSSGLLSRSHLTKLQPPMYSSINLQGMNSSSFIQQGHHQNSSNSANPFGTYHSTLSPRIQNVNLFQRTSSPLEPLQFPRSKSYIGDFKGLGDRAIGGSFLDTCMPFGSSSTSLPSASTNPLMLQANYTQPLHIASDGIQPCIEGTPSNSASPNISFQGLSRFPGHSWQGNLNTTRFPPSSLPLNLAFLPDQVTCAGNNLGDCTSLVSAENPGGEMQCDPQLLGGFMQNVNPLGGQKWEQQNCTMLNNPFGNIEYPLPADNMVFRDNNSTRSKGLDESLMNPIDNSQEYVGKATTMLDPEMKSGKPENDNQHDVFDDIMNEMMKQEENNGMVPVATRFGFDSFPPP

SEQ ID NO: 293 - DNA, 1107 bp, Arabidopsis thaliana
  G2990,family:ZF-HB
agtcttttttttcttcaaattattggttatattaatgttttaagctatgatggatatgactcctacaataacaacaacaacaacaccaactcctaaatcacccgaacccgaatccgaaactccgacccggatccaaccggcgaaacccatttcctttagcaacggcatcatcaaacgccaccaccaccaccaccatcctctcctctttacttacaaagaatgtctcaaaaaccacgcggcggctttaggtggtcacgctctcgacggttgcggcgaattcatgccgtctccgtcgtcaatctcctccgatccaacttctctcaaatgtgctgcttgtggctgccaccgtaatttccaccgccgtgatccagataacaacaacgactcttcccaaatccctcctcctccttccaccgccgtagagtatcaacctcaccaccgtcatcatccaccaccaccaccacctcctccaccaccacgtagtcctaactcagcttctcctccaccaatctcttcctcttacatgctcttatctctctccggtactaataacaacaacaacaacttagcttctttctccgatcttaacttctccgccggaaacaaccaccaccaccaccaccaacatactcttcacggatctcgtaaaagattccgaacaaaattcagccagtttcagaaagagaagatgcatgaattcgccgaacgtgttggttggaagatgcaaaaacgtgacgaagacgatgttcgtgatttttgccggcagatcggagttgataaaagtgttctcaaagtttggatgcataacaacaaaaacacctttaaccgccgtgatatcgccggaaacgagatccggcaaatcgataacggcggaggaaaccacactccgattctcgccggcgagattaataaccataacaatggacaccacggtgtcggaggaggaggagagcttcaccagagtgttagtagcggcggtggtggcggaggatttgatagtgatagcggcggagctaacggtggtaacgttaacggatcatcgtcgtcgtgaagttaaagatgagagtgtcaggttaataagaagcttagagtaagcttattcggata

SEQ ID NO: 294 - protein, 334 aa, Arabidopsis thaliana
  G2990,ZF-HB domain coordinates 54-109,200-263
MMDMTPTITTTTTPTPKSPEPESETPTRIQPAKPISFSNGIIKRHHHHHHPLLFTYKECLKNHAAALGGHALDGCGEFMPSPSSISSDPTSLKCAACGCHRNFHRRDPDNNNDSSQIPPPPSTAVEYQPHHRHHPPPPPPPPPPRSPNSASPPPISSSYMLLSLSGTNNNNNNLASFSDLNFSAGNNHHHHHQHTLHGSRKRFRTKFSQFQKEKMHEFAERVGWKMQKRDEDDVRDFCRQIGVDKSVLKVWMHNNKNTFNRRDIAGNEIRQIDNGGGNHTPILAGEINNHNNGHHGVGGGGELHQSVSSGGGGGGFDSDSGGANGGNVNGSSSS

SEQ ID NO: 295 - DNA, 1202 bp, Arabidopsis thaliana
  G3032,family:GARP
gtaacaacgcagagtacgcggggaagttgcaagccatgactaatcttgatgagtttcttgaagagctaagttctattgaatcacattctcagaaaatcgtgaagatagatgagcatttaaaaaagttggatgaagagacgaaagaagatgaagatgaagatgcggcgaagataattcaagatcggagtaccgcgagagaagcagaaattgctctacttatggatctccgtcagaactttcttccaccaccatcgatgtcatcctcctctcttcaaccaccgtcatcgtcaactctcgcaccatcgtcatcatcctctcttcaaccacccgcaccgttgatagacttctttcggtcatcagtgtcatactctcatcaaccaccgtcatcttcaactctcgcaacatcatcgtcaccgtctcttcaaccaccgtcgatgtcatcctcctctcttcaaccacccgcatctttgagggaattctttacgtcgtcagtgtcatactctcatcagccatcttcatcttcaactctcgcaacatcttcgttctttccgtcgtcaatgccatactctgttcgacctcccgattcgtctgatcgaccatctttgagggaattctttccgtcgtcaccatcatcctctattcagccacccgaatcatcatcatctaagcgagcacggcttagtaacatctttccgtcacctttatcctcctctccgtcaccgtttgttaacccgtttctccgtccgcaggcccaagaaccaacaataccaaatttcataaacccaataccacagatctctccaggcctacctgctctattcccaaaccctaaccctaatcctaaccctaacccaatcccaaacccaatccgaaacccagacttggtgtggacaaataggcttcaactagtgtttgatgacgcagttgtcagacttgggggattattcagtgcaacacccaaagccataaacgaactaatttctgaagagggtctcactggtgaccagatccgtagccacttacaagtcttgcgggatcgtcaaaaggctattgcagacaaattagccttggagtgaagaaaatattgaagatgagagataggattaaatagaaagagtgatagtatagaacgtttctttttcttttgttgttaatcttgcatattacaaacaattactatatcataatagaatttatgttaa

SEQ ID NO: 296 - protein, 346 aa, Arabidopsis thaliana
  G3032,GARP domain coordinates 285-333
MTNLDEFLEELSSIESHSQKIVKIDEHLKKLDEETKEDEDEDAAKIIQDRSTAREAEIALLMDLRQNFLPPPSMSSSSLQPPSSSTLAPSSSSSLQPPAPLIDFFRSSVSYSHQPPSSSTLATSSSPSLQPPSMSSSSLQPPASLREFFTSSVSYSHQPSSSSTLATSSFFPSSMPYSVRPPDSSDRPSLREFFPSSPSSSIQPPESSSSKRARLSNIFPSPLSSSPSPFVNPFLRPQAQEPTIPNFINPIPQISPGLPALFPNPNPNPNPNPIPNPIRNPDLVWTNRLQLVFDDAVVRLGGLFSATPKAINELISEEGLTGDQIRSHLQVLRDRQKAIADKLALE

SEQ ID NO: 297 - DNA, 1253 bp, Arabidopsis thaliana
  G3034,family:GARP
gcttaaaggtctctttcatggagctgtttcctgctcagcccgatttatccttacaaataagtccaccaaacagtaaaccatcatcgacatggcagagaagaagatcaacaacagatcaagaagatcatgaagaactcgatttagggttttggagaagagctcttgattcaagaacatcttctctcgtctctaattccacctcaaaaacaatcaatcatccattccaagacctctcgctctctaacatctctcatcatcaacaacaacaacaacatcatcatccacaacttctccctaattgcaacagctctaacatcttgacctctttccaatttccgacacagcagcaacaacaacacttacaagggtttcttgctcacgaccttaatactcacttaagaccaataagaggaataccactttaccacaaccctcctccacatcatcatcctcaccgtccgccaccgccatgtttccctttcgacccgtcgtctctaataccctcttcctccacttcctcgccggctctaaccggaaacaacaatagctttaatactagtagcgttagtaaccctaattaccacaatcatcatcaccagactctaaacagagccagattcatgccaagattcccagctaaacgaagcatgagagctcctaggatgcgatggaccaccactcttcatgcccggttcgttcacgccgttgaattactcggtggccatgaaagagcaacacctaaatcagttcttgagctcatggatgtcaaagatctaaccttggctcatgttaagtcccatttacagatgtacagaacagtgaagacaaccgacaaagcagcagcttcgtcaggacaatctgatgtctatgaaaatggatcatcaggagataataactcagacgactggatgttcgatatgaatagaaaatcgagagatagcgaggaattgacgaatcctctagagaaatcaaatggtctatggaccaattcttccggagaagcacgtttgcatgggaagttaatcgataatgttgcagaaattatgctaccttctgagaaggaactagatggaaagtgctcaagttatgagagaatatcatcagaagagatgagctcatcaagcatctcgggaacaagccctttcaagccaaatcttgagtttactctgggtcgatctcactaaatttattgttgtagctaggtagtaattaattagtatcaattaacttatattttggctactgactagttt

SEQ ID NO: 298 - protein, 388 aa, Arabidopsis thaliana
  G3034,GARP domain coordinates 218-266
MELFPAQPDLSLQISPPNSKPSSTWQRRRSTTDQEDHEELDLGFWRRALDSRTSSLVSNSTSKTINHPFQDLSLSNISHHQQQQQHHHPQLLPNCNSSNILTSFQFPTQQQQQHLQGFLAHDLNTHLRPIRGIPLYHNPPPHHHPHRPPPPCFPFDPSSLIPSSSTSSPALTGNNNSFNTSSVSNPNYHNHHHQTLNRARFMPRFPAKRSMRAPRMRWTTTLHARFVHAVELLGGHERATPKSVLELMDVKDLTLAHVKSHLQMYRTVKTTDKAAASSGQSDVYENGSSGDNNSDDWMFDMNRKSRDSEELTNPLEKSNGLWTNSSGEARLHGKLIDNVAEIMLPSEKELDGKCSSYERISSEEMSSSSISGTSPFKPNLEFTLGRSH

SEQ ID NO: 299 - DNA, 1634 bp, Arabidopsis thaliana
  G3044,family:HLH/MYC
attctcaacttttctctgatttgctcgtgtgtttacttcaattcctcagttcttgtgtagaaagttgagtttcatgtgatcaaaattggggctttactacttttaagagaatgagtgacaaagacgagtttgccgcaaagaagaaggatttggtcaatacgccagtggatttgtatcctccggagaatccaatgttgggtccttctccgatgatggattcattcagagaaactctttggcatgatggtggtttcaatgtccacacagatgcagacacttcctttagaggtaataataatattgatatacctcttgaaatgggttggaatatggctcagttccctgcagattcaggattcattgagcgtgctgcaaagttttctttttttggatgtggtgaaatgatgatgaaccaacaacaatcatctcttggagttccagattcaactggcttgtttcttcaagatacacagattcctagtggatccaaactagataatggtcctcttactgatgcatctaagttagtgaaagagagatcgattaataatgtatcagaggattctcaatctagtggaggtaatggtcatgatgatgctaagtgtgggcaaacatcttccaaggggtttagtagtaagaagaggaaaagaattgggaaggattgtgaagaagaagaagataaaaagcaaaaggatgagcaaagtccaacttcaaatgcgaacaagacaaacagtgagaagcaaccttctgattctttaaaggatgggtatattcacatgagggcacgaagaggccaggctactaatagtcacagtcttgctgaaagagtaagaagagaaaaaatcagtgaaaggatgaagttcttgcaagatcttgtgccaggttgcgacaaggtgactggtaaggcagttatgctcgatgaaatcattaactatgtgcaatcacttcaatgccaaatcgagtttttatcgatgaaactttcggctgtgaatcctgtgctcgattttaacctcgaaagcctccttgcaaaagatgctcttcaatcatctgcaccgacatttccccacaacatgtcgatgctttatcctcctgtatcgtatctctctcaaacaggattcatgcaaccgaacatttcctcaatgtcgctattgagtggaggattaaaacggcaggaaacacatggatatgaaagtgatcaccacaatcttgtccacatgaaccatgaaaccggcactgcacctgatcatgaagatacaacagctgacatgaaggtggagccgtagatgtttcttcttcactttgtactcagctttagctgctgatatagtgcgccgcggtcgagaattttattaacttcgaacagaagagtgaaaacgaaacagaggaggaagcagattttgtctttgaaatattgacagctcccggagaaagagtcgagagtaagaatcaacaatgttgtgtaatgaatagctactgtctgcttcttttgtagctattgtctgcttcttttttgtacatataaatccatgcaagggaagaggaatgttaattcaacacatgtgcacaacatgatcatcacatatgtacttcaacttgatcaatcggaattagctctacttgtcaaaaaaaaaaaa

SEQ ID NO: 300 - protein, 390 aa, Arabidopsis thaliana
  G3044,HLH/MYC domain coordinates 226-284
MSDKDEFAAKKKDLVNTPVDLYPPENPMLGPSPMMDSFRETLWHDGGFNVHTDADTSFRGNNNIDIPLEMGWNMAQFPADSGFIERAAKFSFFGCGEMMMNQQQSSLGVPDSTGLFLQDTQIPSGSKLDNGPLTDASKLVKERSINNVSEDSQSSGGNGHDDAKCGQTSSKGFSSKKRKRIGKDCEEEEDKKQKDEQSPTSNANKTNSEKQPSDSLKDGYIHMRARRGQATNSHSLAERVRREKISERMKFLQDLVPGCDKVTGKAVMLDEIINYVQSLQCQIEFLSMKLSAVNPVLDFNLESLLAKDALQSSAPTFPHNMSMLYPPVSYLSQTGFMQPNISSMSLLSGGLKRQETHGYESDHHNLVHMNHETGTAPDHEDTTADMKVEP

SEQ ID NO: 301 - DNA, 1365 bp, Arabidopsis thaliana
  G3061,family:Z-C2H2
atgattccacataatcatgaccgcctctcattctctagctttgtccatgaccaagagcacatcacccctaatccttaccctaactctcagcctgcagcctccactaaaacacccaagaaaaagagaaaccttccaggaaatccagatccaaatgcagaagtcatctctctatctccaaaatccctcatggcgacaaatcggttcttttgtgaaatttgtaacaaggggtttcagagagaacagaaccttcagctccacaaaagaggccacaacctgccatggaagctgaagcagaaaacgaacaagaatcaggtgaagaagaaagtttatatatgccctgagaagagttgcgtccatcatgatccagctcgagccctaggagaccttactggaataaagaagcactttagcaggaaacatggagagaagaagtggaaatgcgataagtgttccaagaagtatgctgtgatatccgattggaaagctcataacaagatttgtggtagcagagagtttagatgtgattgtggtactcttttctccaggaaggacagtttcatctcacatagatccttctgtgatgtcttagctgaagaaagttctaaattcttctcagttccttcaccattagccgccaattcgaccatcgccactgtcactgataccaacaatccaattctcattcaatcacaattggatcaatcttccacaggtacggccgatcttaacgtcaacaacaatcacaccaccctatttggacaaaagttcaccaactccaacccaacccaacaacaacccaatgctttggcgttgtcctcaccaccatcacctcgtagtacatctgattcggttcataatctatggaagttacaagaagaggaatgtgcacaccagtggttactcaatgaatatatgaacaataacaaaaacatattccataagggaatattcaagaatcaagaagatgagataaagaagggaaatatctacagcggctcaaacccaaccgatggaaacatagcatccttgttctcgtataatcaagaagcagtgaatatggcttcattttcggcaacaacattgcttcaaaaggtagctcaaacgggaacaccatcaagctccgaaactagcaccaccatgtttgggcaaatgacttcctccatcttcaacaatacgatgctaaactcctattgtttaacggcgaagaataatgaagaagagttgaccagagactttcttggtgtgggaagtagtgaggaccaacaacgtctacatcgtcatcgcttcccatcaagcgtgccattgacggcgaaccatgatattcccaagttggccgcaaccattgtaggcaggaagcaaccatag

SEQ ID NO: 302 - protein, 454 aa, Arabidopsis thaliana
  G3061,Z-C2H2 domain coordinates 73-90,174-193
MIPHNHDRLSFSSFVHDQEHITPNPYPNSQPAASTKTPKKKRNLPGNPDPNAEVISLSPKSLMATNRFFCEICNKGFQREQNLQLHKRGHNLPWKLKQKTNKNQVKKKVYICPEKSCVHHDPARALGDLTGIKKHFSRKHGEKKWKCDKCSKKYAVISDWKAHNKICGSREFRCDCGTLFSRKDSFISHRSFCDVLAEESSKFFSVPSPLAANSTIATVTDTNNPILIQSQLDQSSTGTADLNVNNNHTTLFGQKFTNSNPTQQQPNALALSSPPSPRSTSDSVHNLWKLQEEECAHQWLLNEYMNNNKNIFHKGIFKNQEDEIKKGNIYSGSNPTDGNIASLFSYNQEAVNMASFSATTLLQKVAQTGTPSSSETSTTMFGQMTSSIFNNTMLNSYCLTAKNNEEELTRDFLGVGSSEDQQRLHRHRFPSSVPLTANHDIPKLAATIVGRKQP

SEQ ID NO: 303 - DNA, 2040 bp, Arabidopsis thaliana
  G3070,family:Z-C2H2
atgcgtggggtttggctttatctcaagaagtctcttagctgctgcaaggcacagaagtcaactgtagcttgtgatccagacaagatccaaattcagaagaaggagaatccatctggatgctcaagaagatcaatgtcgaatctgagagatgtctttgtaactaatggagatgaaggagctatgcagaatgtaagctgctgcagctcacggtctcttgagagctccaggtttgtaaacacagtgaaatttgaggagaatgcaggttattcagacagattcaaaggtttgcttagcggagcatcttcttctgatttacttcccggtcgttgttcagagagatttgatgttgttggctctgacatctgcggtttcggagttcttgcttgtcaaaaatgtcatgagagagtcagagatcttgacgcgtttgaagcacattacctctctaaccactctgtcgttagactcttagcaggagatttctcaagaacaactgtggaactaatctgcaacacaggctattctcacaagctaggcaaaatgaaagggaacaacatttcagcgatctttaaaatccagaacttgcagagagttgttgcagactttgaagattacagagagctcgtgaaaataagagcaaacaagctttcaaagaagcactctcgttgtatggctgatggcaacgagtttcttgggttccacggtacaactctttcttgcactctcggtttcagtaacagctcttcaaacctctgtttctcggatcactgtgaagtttgtcatattctaagacatggtttcagtcctaaaacaagaccagatgggataaaaggagttctcacagcatcaactagctctacagctcttgaatctatcgaaaccgatcaaggaagaaatagaggttcattgatagctgttgtgctatgtagagtgattgcagggagggttcataaacctatgcagacgtttgaaaattctttagggttttctgagtttgattcactagctttgaaagttaaaaatgttgggctttccccaaaattgaaagatggaaaacttgctggacaagtctatgcccagcctctatatttaaagggtgaagaagactgtaacttgttctccctccggaaacctctgtttgtaagatactattctcttctctccccaatcacactttgttctttttttttttttttgatgatagacgccctagtgttgggtgcttgtcatctcgacgctgaaccttgcggattgggtatgggaaaactcatgattgcaattagtagtgataattcgatgtgggttttggagaagaaggcccctgtggagttggtggaaggaggaaagggaattgtaggagcatcccatgggtgggtagctactttgaaagacggagtagtgtgtctccaagatgatctaaacccaagcacatcgaattcagacccgaaacgcatctcattgcctagtctaagagttgagatgttctgcataccttcttctggaggtcacgttactggatcgtgggatctccacaaacacaagttgcagagggtgcgatttcgaaaccttgctaagttgacaaagaaggaatggaagcttttggattcgtgtagcaggagcgaacatttggtggagtcagcagaaaatgaaactttcttggttaagtggtacaggaagaaaagcaaagatttgaagagaatgatgacaacaaaggctgaaatgctaaaaaaaaaaaaaaaaaaaaaaaaaaaaaaaaaagaaggaaatgctgtttacactcgagacattggagatctctgcattttcctctcaaaatctgaatctttctgtgtctctgcaactagtagctacaaatccgttccttccctagtccgtaaccacgtctatgtccaggcttacgacgagtatggattcatggatatcgccaagccttttgacgattcctgggtcattcctgcctcacctgatgcgaacccgaatcctttctatattccacctcaaactatagaatatactttatctacgatgcacccggatctatga

SEQ ID NO: 304 - protein, 679 aa, Arabidopsis thaliana
  G3070,Z-C2H2 domain coordinates 129-150
MRGVWLYLKKSLSCCKAQKSTVACDPDKIQIQKKENPSGCSRRSMSNLRDVFVTNGDEGAMQNVSCCSSRSLESSRFVNTVKFEENAGYSDRFKGLLSGASSSDLLPGRCSERFDVVGSDICGFGVLACQKCHERVRDLDAFEAHYLSNHSVVRLLAGDFSRTTVELICNTGYSHKLGKMKGNNISAIFKIQNLQRVVADFEDYRELVKIRANKLSKKHSRCMADGNEFLGFHGTTLSCTLGFSNSSSNLCFSDHCEVCHILRHGFSPKTRPDGIKGVLTASTSSTALESIETDQGRNRGSLIAVVLCRVIAGRVHKPMQTFENSLGFSEFDSLALKVKNVGLSPKLKDGKLAGQVYAQPLYLKGEEDCNLFSLRKPLFVRYYSLLSPITLCSFFFFLMIDALVLGACHLDAEPCGLGMGKLMIAISSDNSMWVLEKKAPVELVEGGKGIVGASHGWVATLKDGVVCLQDDLNPSTSNSDPKRISLPSLRVEMFCIPSSGGHVTGSWDLHKHKLQRVRFRNLAKLTKKEWKLLDSCSRSEHLVESAENETFLVKWYRKKSKDLKRMMTTKAEMLKKKKKKKKKKKEGNAVYTRDIGDLCIFLSKSESFCVSATSSYKSVPSLVRNHVYVQAYDEYGFMDIAKPFDDSWVIPASPDANPNPFYIPPQTIEYTLSTMHPDL

SEQ ID NO: 305 - DNA, 1046 bp, Arabidopsis thaliana
  G3080,family:bZIP-ZW2
gcattcacgaactaaccaacgaagaaagatggcgactagttcttcgagttatgggattgaacaacttcaaaaaggatgttactatgagtggatgagtgtgcaggctaaacacatagttgatctcaaagaagcactcatgagtcatcgatccaaagaagatcacaagcttgaagaactcgttggtaaaatcgtcaatgacttccaaaaatacaccgaaaaacgatctgagctctctcgccgaagctgctcaagctactttgcaccgtcgtggaactctcctctagagaacggtttactatggatgggaggatgtcgtccatcgtctttcattagagttatttactctctttgtggatcccaagccgaaacgcagctttctcagtatcttctaaagatcgatgaaaatgtcgaagtaaaccatggtggttccatgagtgatctaaacgcgtcgcagcttgcaaaaatcaatgatttgcatataaaggttatagagaaagaggacaagataacaaagaaatcggcgaatttgcaagagaatgttgcggatatgcctatagccatcgcggcttatgccacggacttgatgaatggtgacgtggtggtggaagatgctttagataagtatgaggagggcatggcggttttaatggtggaagctgataaactgaggtttgagacgcttaggaagatcgtggatgttgttacgccggttcaagcggcggagtttttgctcgcagggaaaagattacacatatcattgcacgagtggggaagagttagagaagagcaacgttttgggtgtgtacgtacggatgcagcggctgccacgggaggagcgggaaccgagaagtcaaagaggtcaagcttgttgatgtgagtttaaagttgaatatatataacttgtgttatatttgtctatgtagagataaaatcgtgtttaagtgtctttatgtgtaatatatgtatgagagagtgcggctagtttcgagatgatgcaagcataagcttttgcttttgtcttatataataacaaaagctgaaaacaa

SEQ ID NO: 306 - protein, 282 aa, Arabidopsis thaliana
  G3080,bZIP-ZW2 domain coordinates 76-106,210-237
MATSSSSYGIEQLQKGCYYEWMSVQAKHIVDLKEALMSHRSKEDHKLEELVGKIVNDFQKYTEKRSELSRRSCSSYFAPSWNSPLENGLLWMGGCRPSSFIRVIYSLCGSQAETQLSQYLLKIDENVEVNHGGSMSDLNASQLAKINDLHIKVIEKEDKITKKSANLQENVADMPIAIAAYATDLMNGDVVVEDALDKYEEGMAVLMVEADKLRFETLRKIVDVVTPVQAAEFLLAGKRLHISLHEWGRVREEQRFGCVRTDAAAATGGAGTEKSKRSSLLM

SEQ ID NO: 307 - DNA, 583 bp, Arabidopsis thaliana
  G10,family:AP2
ggtgattcaatacaaacgaaaacaagagtttcctatggtgaaagaaggaatggtcatgaccgagaagccaaagaggaatctcataagctctaatgagaagcgatacaaaggaataaggatgaggaagtggggcaagtgggtggctgagataagagagcctaataaacgatcacggatctggcttggttcatacaaaaccgccgttgccgcggcacgggcctacgataccgctgtgttttacttacgtggtccttcggcgagactcaatttccctgaagaggtctttaaggatggaaacggcggtgaaggcttaggaggagatatgtctccgacgttgatacggaagaaggcggctgaggtgggagctagagtcgacgcagagttgcggttagagaataggatggttgagaacttagacatgaataagttgccggaggcatatggattgtaatttatagtttggtagtttataggttggagattgcccggagacagagtcaaacagaggttctctgactcatatgaggcataatatagttaatatagtaatttttgttttgagcatagtaattatgtcataacc

SEQ ID NO: 308 - protein, 138 aa, Arabidopsis thaliana
  G10,AP2 domain coordinates 21-88
MVKEGMVMTEKPKRNLISSNEKRYKGIRMRKWGKWVAEIREPNKRSRIWLGSYKTAVAAARAYDTAVFYLRGPSARLNFPEEVFKDGNGGEGLGGDMSPTLIRKKAAEVGARVDAELRLENRMVENLDMNKLPEAYGL

SEQ ID NO: 309 - DNA, 1368 bp, Arabidopsis thaliana
  G1010,family:ABI3/VP-1
attcttcttctaaaaaatcttgacaactttttgtttttgttttctttctctgaattttttaaaagagagagagctatgtagctatgaaacagtaagagatatagatatagagagacagagaaagatgatgatcagtgaagttaggctaaacccactttctatttatgtataattaggtcaatcacatcaccaatctcctcctccaattctcctcctctccttccaaattctagggttttgcttgtatctcaccccctttctcaattccctagggaaactgtgaatttcatcaaattccattattttttggtcacacccttaaagagatctgagagttctaaagatgatgacagatttatctctcacgagagatgaagatgaagaagaagcaaagcccttagcagaagaagaaggagcgcgtgaagtagcagacagagagcacatgttcgacaaagttgtgactccaagtgatgtcggaaaactaaaccgacttgtgatcccaaagcaacacgcagagagattcttccctttagattcatcttcaaacgagaaaggtttgcttttaaacttcgaagatctcactggcaaatcttggaggttccgttactcttactggaacagtagtcaaagctatgtcatgactaaaggttggagcagattcgttaaagacaaaaagcttgacgccggagatattgtctctttccaaagatgtgtcggagattcaggaagagatagccgtttgtttattgattggaggagaagacctaaagtccctgaccatcctcatttcgccgccggagctatgttccctaggttttacagctttccttcgaccaattacagtctttataatcatcagcagcaacgtcatcatcacagtggtggtggttataattatcatcaaattccgagagaatttggttatggttacttcgttaggtcagtggatcagaggaacaatcctgcggctgcggtggctgatccgttggtgattgaatctgtgccggtgatgatgcacgggagagctaatcaggaacttgttggaacggccgggaagagactgaggctttttggagttgatatggaatgcggcgagagcggaatgaccaacagtacggaggaggaatcatcatcttccggtggaagtttgccacgtggaggcggtggtggtgcttcatcttcctctttctttcagctgagacttggaagcagcagtgaagatgatcacttcactaagaaaggaaagtcttcattgtcttttgatttggatcaataataatgatgatgatgaaattagttggtattttaagaaaaaaaacatacatatataattctatatatatgacaacataatgcattgatttcctt

SEQ ID NO: 310 - protein, 310 aa, Arabidopsis thaliana
  G1010,ABI3/VP-1 domain coordinates 33-122
MMTDLSLTRDEDEEEAKPLAEEEGAREVADREHMFDKVVTPSDVGKLNRLVIPKQHAERFFPLDSSSNEKGLLLNFEDLTGKSWRFRYSYWNSSQSYVMTKGWSRFVKDKKLDAGDIVSFQRCVGDSGRDSRLFIDWRRRPKVPDHPHFAAGAMFPRFYSFPSTNYSLYNHQQQRHHHSGGGYNYHQIPREFGYGYFVRSVDQRNNPAAAVADPLVIESVPVMMHGRANQELVGTAGKRLRLFGVDMECGESGMTNSTEEESSSSGGSLPRGGGGGASSSSFFQLRLGSSSEDDHFTKKGKSSLSFDLDQ

SEQ ID NO: 311 - DNA, 803 bp, Arabidopsis thaliana
  G1011,family:MADS
cttgtttagggtttcaatctttacagatcttgtggcagaaaaaatcaagtcaaagcaagaaaaatggttagaggaaagatagagatgaagaaaatagaaaacgcaacgagtagacaagtgactttctcaaaaagaagaaatggtttgttgaagaaagcttatgagctctcagtactctgcgatgctcaactctctctcatcatcttctcccagagaggaaggctttatgaattctctagctctgatatgcagaagacgatcgaacgctaccgcaagtacacaaaagatcatgaaaccagcaatcacgactcacaaattcacttgcagcaattgaaacaagaagcaagccacatgataacaaagattgaactccttgagtttcacaagcggaagctattgggacaaggaattgcttcttgttctctagaagagcttcaagaaatcgatagtcaactccaaagaagtctgggaaaggtccgagaaagaaaggctcaattgttcaaggagcagttggagaaactaaaagcaaaggagaaacaattgttagaagagaacgtcaagttacatcaaaagaatgttattaatccatggagaggatcatcgactgatcagcagcaagagaaatacaaagttatagatttgaatttggaagttgaaactgacttattcatcggtttgccaaatagaaactgctagtaacattatataatatgtttatttatttatcatgaaatattcaaaatcattcaataaattgtgaggtaatgatttgggatagtaaaaaaaaaaaaaaaaaaaaaaaa

SEQ ID NO: 312 - protein, 210 aa, Arabidopsis thaliana
  G1011,MADS domain coordinates 2-57
MVRGKIEMKKIENATSRQVTFSKRRNGLLKKAYELSVLCDAQLSLIIFSQRGRLYEFSSSDMQKTIERYRKYTKDHETSNHDSQIHLQQLKQEASHMITKIELLEFHKRKLLGQGIASCSLEELQEIDSQLQRSLGKVRERKAQLFKEQLEKLKAKEKQLLEENVKLHQKNVINPWRGSSTDQQQEKYKVIDLNLEVETDLFIGLPNRNC

SEQ ID NO: 313 - DNA, 1057 bp, Arabidopsis thaliana
  G1040,family:GARP
ctttgatctccactatttaagtagacaagaatcataaagaaaatagtgagatgatgatgttagagtcaagaaacagtatgagagcttcaaactcagtcccagatctgtctcttcagatcagtcttcctaactatcacgccggaaaacctcttcacggcggtgaccggagctccacaagcagtgattctggaagcagcctcagtgacctgagccatgagaacaacttcttcaacaaacctctcttgagcttaggatttgaccatcatcatcaaaggcgctcaaacatgttccaacctcaaatctacggtcgagatttcaagagaagctcatcatcaatggttggtcttaaacgaagcattcgtgctccaagaatgagatggacttctactcttcatgctcacttcgtccatgctgttcaacttcttggcggccatgaaagagcaacgcctaaatcagtgttggagctcatgaatgtgaaggatctaaccctagctcatgtcaagagtcacttgcagatgtatagaacagtgaaatgcactgataaaggatcaccaggagaaggaaaggtagagaaagaggcagagcagaggatagaggacaataataataatgaagaagctgatgaaggaactgacacaaattcgccaaactcatcatctgtgcaaaagacccaaagagcttcatggtcatcgacaaaggaagtatctaggagcatatctacacaagcatattctcacttgggaacaactcatcacactaaggccaatgaagagaaagaggataccaacattcatctcaatttggatttcacattgggcggcctagttgggggatggaatatgcggaaccctccagtgatttaacccttctcaagtgctaattgccttaagctacaacaaataagtcagcttaggttaccagttttaacataattttaacttgttttgatcatatgagcttcggaagaatcatattatcatcatatatgaacttctttccaagaatgttctatgagttttttgatatgtataatcaagagaatcgtttgaagtaaaaa

SEQ ID NO: 314 - protein, 270 aa, Arabidopsis thaliana
  G1040,GARP domain coordinates 109-158
MMMLESRNSMRASNSVPDLSLQISLPNYHAGKPLHGGDRSSTSSDSGSSLSDLSHENNFFNKPLLSLGFDHHHQRRSNMFQPQIYGRDFKRSSSSMVGLKRSIRAPRMRWTSTLHAHFVHAVQLLGGHERATPKSVLELMNVKDLTLAHVKSHLQMYRTVKCTDKGSPGEGKVEKEAEQRIEDNNNNEEADEGTDTNSPNSSSVQKTQRASWSSTKEVSRSISTQAYSHLGTTHHTKANEEKEDTNIHLNLDFTLGGLVGGWNMRNPPVI

SEQ ID NO: 315 - DNA, 923 bp, Arabidopsis thaliana
  G1056,family:bZIP
gctacatatatgggttctattagaggaaacattgaagagcctatatctcagtcattaacgaggcagaactctctctatagcttaaagctccatgaggttcaaacccacttaggaagttctggaaaaccactaggaagcatgaaccttgatgagcttctcaagactgtcttgccaccagctgaggaagggcttgttcgtcagggaagcttgacgttacctcgagatctcagtaaaaagacagttgatgaggtctggagagatatccaacaggacaagaatggaaacggtactagtactactactactcataagcagcctacactcggtgaaataacacttgaggatttgttgttgagagctggtgtagtgactgagacagtagtccctcaagaaaatgttgttaacatagcttcaaatgggcaatgggttgagtatcatcatcagcctcaacaacaacaagggtttatgacatatccggtttgcgagatgcaagatatggtgatgatgggtggattatcggatacaccacaagcgcctgggaggaaaagagtagctggagagattgtggagaagactgttgagaggagacagaagaggatgatcaagaacagagaatctgcagcacgttcacgagctaggaaacaggcttatacacatgaattagagatcaaggtttcaaggttagaagaagaaaacgaaaaacttcggaggctaaaggaggtggagaagatcctaccaagtgaaccaccaccagatcctaagtggaagctccggcgaacaaactctgcttctctctgatcctaaagactcttctttctttcttcttctttgtgttggtttatatcagaccgctttgttctttgtatattgtgtagactttattgactttgaacagcatgtctttataaacatttcttgagtgt

SEQ ID NO: 316 - protein, 262 aa, Arabidopsis thaliana
  G1056,bZIP domain coordinates 183-246
MGSIRGNIEEPISQSLTRQNSLYSLKLHEVQTHLGSSGKPLGSMNLDELLKTVLPPAEEGLVRQGSLTLPRDLSKKTVDEVWRDIQQDKNGNGTSTTTTHKQPTLGEITLEDLLLRAGVVTETVVPQENVVNIASNGQWVEYHHQPQQQQGFMTYPVCEMQDMVMMGGLSDTPQAPGRKRVAGEIVEKTVERRQKRMIKNRESAARSRARKQAYTHELEIKVSRLEEENEKLRRLKEVEKILPSEPPPDPKWKLRRTNSASL

SEQ ID NO: 317 - DNA, 1342 bp, Arabidopsis thaliana
  G1076,family:AT-hook
attttagtcttcctataacttcttctcaatcctctctcatatcttttttcttagtttaaatttcaataaaatagaaaaaaacatatacaaatctacagagaagagaagctttattttaatcttgtgtgtgtgtgtgtgttttatataatttttattttttttcaaattaaaatctcttctttgcttttgatgtgggcatggctggtcttgatctaggcacagcttttcgttacgttaatcaccagctccatcgtcccgatctccaccttcaccacaattcctcctccgatgacgtcactcccggagccgggatgggtcatttcaccgtcgacgacgaagacaacaacaacaaccatcaaggtcttgacttagcctctggtggaggatcaggaagctctggaggaggaggaggtcacggcgggggaggagacgtcgttggtcgtcgtccacgtggcagaccaccgggatccaagaacaaaccgaaacctccggtaattatcacgcgcgagagcgcaaacactctaagagctcacattcttgaagtaacaaacggctgcgatgttttcgactgcgttgcgacttatgctcgtcggagacagcgagggatctgcgttctgagcggtagcggaacggtcacgaacgtcagcatacgtcagccatctgcggctggagcggttgtgacgctacaaggaacgttcgagattctttctctctccggatcgtttcttcctcctccggcacctcccggagcaacgagtttgacaattttcttagccggaggacaaggtcaggtggttggaggaagcgttgtgggtgagcttacggcggctggaccggtgattgtgattgcagcttcgtttactaatgttgcttatgagagacttcctttagaagaagatgagcagcagcaacagcttggaggaggatctaacggcggaggtaatttgtttccggaggtggcagctggaggaggaggaggacttccgttctttaatttaccgatgaatatgcaaccaaatgtgcaacttccggtggaaggttggccggggaattccggtggaagaggtcctttctgatgtgtatatattgataatcattatatatataccggcggagaagcttttccggcgaagaatttgcgagagtgaagaaaggttagaaaagcttttaatggactaatgaatttcaaattatcatcgtgatttcggacattgtcttgttcatcatgttaagcttaggtttattttttgtcgtttgtagaattttatgtttgaatccttttttttttctgtgaaactctattgtgttcgtctgcgaaggaaaaaaaaattctcaaaaaaaa

SEQ ID NO: 318 - protein, 292 aa, Arabidopsis thaliana
  G1076,AT-hook domain coordinates 82-90,91-233
MAGLDLGTAFRYVNHQLHRPDLHLHHNSSSDDVTPGAGMGHFTVDDEDNNNNHQGLDLASGGGSGSSGGGGGHGGGGDVVGRRPRGRPPGSKNKPKPPVIITRESANTLRAHILEVTNGCDVFDCVATYARRRQRGICVLSGSGTVTNVSIRQPSAAGAVVTLQGTFEILSLSGSFLPPPAPPGATSLTIFLAGGQGQVVGGSVVGELTAAGPVIVIAASFTNVAYERLPLEEDEQQQQLGGGSNGGGNLFPEVAAGGGGGLPFFNLPMNMQPNVQLPVEGWPGNSGGRGPF

SEQ ID NO: 319 - DNA, 1322 bp, Arabidopsis thaliana
  G1133,family:HLH/MYC
ttcaagaaagaatcaccaagtgttgcgttccacacatttgagcaacagcttccacaatcgtattgtattcctgtaaagttcccttggcttaaactgcaagagcatgcctcttgataccaaacagcagaaatggttgccattaggcttaaatcctcaagcttgtgtccaggacaaggcgactgagtatttccgtcctggaattccttttccggaactcggtaaagtttatgcagctgagcatcagtttcgctatttgcagccaccgttccaagccttattgtctagatatgatcagcagtcttgtggaaaacaagtttcatgtttgaatgggcgatctagcaacggtgctgctccagagggggcactcaagtcttctcggaaaagatttatagtattcgatcagtcgggagagcagactcgtttgttacaatgtggatttcctctgcggtttccttcttctatggatgcagagcgagggaacattctcggtgccctacacccagagaaagggtttagtaaagatcatgccattcaagaaaagatattgcaacatgaagatcatgaaaatggcgaagaagactcggaaatgcacgaagacactgaggaaatcaacgcgttactgtattctgatgatgacgataatgatgattgggaaagtgatgatgaagtaatgagcactggtcactctccattcacagttgaacaacaagcgtgcaacataacaacagaagagctggatgaaactgaaagcactgttgatggtccacttcttaaaagacagaaactactggaccattcgtacagagactcatcaccatcccttgtgggcaccactaaagtcaaaggcttatcagatgaaaaccttcctgaatcaaacatttcaagcaaacaagaaacgggttctggtttgagcgacgagcagtcaagaaaagacaagattcacaccgctctgagaatcctggagagtgtagttccaggggcaaagggaaaagaagctcttttactactagacgaagccattgattacctcaagttgctgaagcaaagcttaaactcatcaaagggtttgaataaccattggtgaaaaacctacaaccccttttgtcctattgataaggcatgtttggttggttaaagagaagacatgggacaaaagataatcaatgaggtaaaggactgatgaagaagattctctcaaattcattaacgtgggtttgaaacaattagaacacgcctggtgaccctagtgggaccgtatccactgttcatctagctggatcaatagtggtttacttttggatttggcatgctctctcaaaaaa

SEQ ID NO: 320 - protein, 326 aa, Arabidopsis thaliana
  G1133,HLH/MYC domain coordinates 260-317
MPLDTKQQKWLPLGLNPQACVQDKATEYFRPGIPFPELGKVYAAEHQFRYLQPPFQALLSRYDQQSCGKQVSCLNGRSSNGAAPEGALKSSRKRFIVFDQSGEQTRLLQCGFPLRFPSSMDAERGNILGALHPEKGFSKDHAIQEKILQHEDHENGEEDSEMHEDTEEINALLYSDDDDNDDWESDDEVMSTGHSPFTVEQQACNITTEELDETESTVDGPLLKRQKLLDHSYRDSSPSLVGTTKVKGLSDENLPESNISSKQETGSGLSDEQSRKDKIHTALRILESVVPGAKGKEALLLLDEAIDYLKLLKQSLNSSKGLNNHW

SEQ ID NO: 321 - DNA, 2910 bp, Arabidopsis thaliana
  G1149,family:PAZ
atgtcaaatcgtggtggtggtggtcacggcggcgctagtcgtggtcgaggaggtggacgaaggtctgaccagagacaagatcagtcttctggtcaagttgcttggccgggtttacaacaaagctacggtggtcgtggtggttctgtttccgccggtagaggtcgtggaaacgtcggaagaggtgaaaatactggagatctgacggcgacgcaagttccggttgcttctgctgtttctggcgggagaggtcgtggtaacatcggagatccgacgttttctgttgcgtcttcgtctaagacggtgtctgttgcttcttcatctaaagaggaaagtaagaatacggaggtttctgagaccatgtcgaaccttcagattacttcgacggagacgaaacctgaaatgacgtcacttcctccggcgtcatctaaagcggttacgtttccggtacggccaggacgtggtactttggggaagaaagtcatggttcgtgcgaatcatttccttgttcaagttgctgatcgtgatctctaccattacgatgtttcgatcaatcctgaggttatatcaaagacagtgaacagaaacgtgatgaaacttctggttaagaattataaagactctcacttgggagggaagtcaccagcgtatgatggaaggaaaagcctctatactgctggtccattaccttttgactcgaaagagtttgttgtgaatctggcggagaaaagagctgacggttcctctgggaaggacagaccgtttaaagttgctgtaaagaatgtgacaagcactgatctttatcagttgcaacagttccttgatcgtaagcaaagagaggctccatatgatactatccaagtgcttgatgttgttcttagggataagccctctaatgattatgtctctgttgggaggtcttttttccacactagtttgggaaaggacgcaagagatggtaggggtgagcttggagatggtattgagtactggagaggttatttccaaagtctaaggctgactcagatgggtttgtctctgaacattgacgtttcagcaagatcattttatgaaccgattgttgtcactgactttattagcaagtttctgaatataagggacttaaacaggccacttagagactcagatcgacttaaggtgaagaaagttttgaggacactgaaagttaagttgcttcactggaacggcacaaaaagtgccaaaattagtgggatttctagtctacccatcagggagctaaggttcactctggaggacaaatcagagaagacggttgttcaatattttgctgaaaaatataattatagagtgaaataccaggctctacctgctattcaaacagggagtgacacaagacccgtctacctaccaatggagctctgccaaattgacgaagggcaaagatacaccaaaaggctcaatgagaagcaagtgactgcattgctaaaagctacctgccaacgaccccctgatagagagaactcgatcaaaaacttggttgtgaaaaataattacaatgatgatctgagcaaggagtttgggatgtcagtgactacccaactagcctcgattgaagctcgtgtacttcccccaccgatgttgaagtaccatgacagtggtaaagagaaaatggtaaatccaaggctaggacagtggaacatgattgacaagaaaatggttaatggagcaaaagtcacttcttggacttgcgaatttaagcctcaacctgctattccgttcatctcttgtccccctgaacatattgaggaagctcttctcgatatccacaaaagggcacctggtctccaactgttgattgtaatattgcctgatgtgactggatcatatggaaaaataaaaaggatctgtgaaacagaattggggattgtctctcagtgttgccaacctagacaagttaataaactcaacaagcagtacatggaaaatgttgccttgaagatcaatgtcaagactgggggaaggaacactgttcttaatgatgctattagaagaaacatacctcttattactgatcgtccaaccatcatcatgggtgctgatgtgactcacccacagcctggagaggactcaagtccttctattgctgctgttgtggcctctatggactggcctgagataaacaaataccgaggattggtttctgctcaagctcatagggaagaaattattcaggacctgtataagctggttcaggatccacaacgtgggctagtccactctggtttgataagggaacatttcatagcattcaggagagctacaggccagatacctcaaaggatcatcttctatcgtgacggagtaagcgaagggcagtttagtcaggttctgctacatgagatgactgctatccgcaaggcttgtaactctctccaagagaattatgttcctcgtgttactttcgtgattgtccagaaacgtcaccacacacgtttgttccctgagcaacacgggaatcgtgatatgactgataagagtggcaatattcaaccaggtactgtcgtggacactaaaatctgtcaccctaatgaattcgacttctatttgaacagccatgctggtattcagggaacaagcaggccggcacattaccatgtacttctcgatgagaacggtttcaccgctgatcagttgcaaatgctcacaaacaacctctgctacacgtatgcgaggtgtacaaaatctgtgtcaattgtgccaccagcctactacgctcacttggctgcattccgtgcccgctactacatggagagtgagatgtctgatggaggttcgagcaggtccaggagctcaacaacaggtgtgggtcaagtcatttcgcagctcccagcaataaaagataacgtcaaggaggttatgttttattgctaa

SEQ ID NO: 322 - protein, 969 aa, Arabidopsis thaliana
  G1149,PAZ domain coordinates 870-880
MSNRGGGGHGGASRGRGGGRRSDQRQDQSSGQVAWPGLQQSYGGRGGSVSAGRGRGNVGRGENTGDLTATQVPVASAVSGGRGRGNIGDPTFSVASSSKTVSVASSSKEESKNTEVSETMSNLQITSTETKPEMTSLPPASSKAVTFPVRPGRGTLGKKVMVRANHFLVQVADRDLYHYDVSINPEVISKTVNRNVMKLLVKNYKDSHLGGKSPAYDGRKSLYTAGPLPFDSKEFVVNLAEKRADGSSGKDRPFKVAVKNVTSTDLYQLQQFLDRKQREAPYDTIQVLDVVLRDKPSNDYVSVGRSFFHTSLGKDARDGRGELGDGIEYWRGYFQSLRLTQMGLSLNIDVSARSFYEPIVVTDFISKFLNIRDLNRPLRDSDRLKVKKVLRTLKVKLLHWNGTKSAKISGISSLPIRELRFTLEDKSEKTVVQYFAEKYNYRVKYQALPAIQTGSDTRPVYLPMELCQIDEGQRYTKRLNEKQVTALLKATCQRPPDRENSIKNLVVKNNYNDDLSKEFGMSVTTQLASIEARVLPPPMLKYHDSGKEKMVNPRLGQWNMIDKKMVNGAKVTSWTCEFKPQPAIPFISCPPEHIEEALLDIHKRAPGLQLLIVILPDVTGSYGKIKRICETELGIVSQCCQPRQVNKLNKQYMENVALKINVKTGGRNTVLNDAIRRNIPLITDRPTIIMGADVTHPQPGEDSSPSIAAVVASMDWPEINKYRGLVSAQAHREEIIQDLYKLVQDPQRGLVHSGLIREHFIAFRRATGQIPQRIIFYRDGVSEGQFSQVLLHEMTAIRKACNSLQENYVPRVTFVIVQKRHHTRLFPEQHGNRDMTDKSGNIQPGTVVDTKICHPNEFDFYLNSHAGIQGTSRPAHYHVLLDENGFTADQLQMLTNNLCYTYARCTKSVSIVPPAYYAHLAAFRARYYMESEMSDGGSSRSRSSTTGVGQVISQLPAIKDNVKEVMFYC

SEQ ID NO: 323 - DNA, 3147 bp, Arabidopsis thaliana
  G1152,family:PAZ
atggtgagaaagagaagaacggatgctccatctgaaggaggtgaaggctctgggtctcgtgaagctggtccagtctcaggtggtggacgtggttcacagcgaggtggtttccagcagggaggaggacaacaccaaggtggaaggggttatactcctcaacctcaacagggaggtcgtggtggtcgtggatatgggcaaccaccacaacagcaacaacagtatggaggaccacaagagtaccaaggaagaggaagaggaggacctcctcatcaaggaggtcgaggagggtatggcggtggccgtggaggtggaccttcttctggaccaccgcagagacaatcagttcccgagctgcatcaagctacctcacctacttatcaagcggtgtcttctcagcctacactgtctgaggtgagtcctacccaggtaccagaacctactgttctggctcagcaatttgaacaactctctgttgaacaaggagctcccagtcaggcaatccagcctataccttcttctagcaaggctttcaagtttccaatgaggcctggtaaaggacagagtggaaagcgttgcattgtgaaggctaaccatttctttgctgaactgcctgataaggatttgcaccattatgatgttaccattactccggaagttacatcaaggggtgtcaatcgtgctgtgatgaaacaacttgttgataattatcgtgattctcaccttggaagtcgtcttccagcgtatgatggtcgaaaaagtctttacactgctggtccacttccctttaactccaaggagttcagaatcaatcttcttgacgaagaagtaggggctggaggtcaaagacgagaaagggaatttaaagttgtgatcaagctagttgcacgtgctgatctgcatcacctaggaatgtttttggaggggaaacaatcagatgccccacaggaagctctgcaggttcttgacattgttcttcgtgagctgccgacctctaggtatattccggtgggccggtccttttattcccctgatataggaaaaaaacaatcattgggggatggcttggagagctggcgtggattctaccaaagcattcgtcctacacagatgggcttatcactcaatattgatatgtcatcgacagccttcatagaggcaaaccctgtgattcagtttgtctgtgatttgcttaaccgggatatttcttctcgacctttatctgatgctgatcgtgttaagataaaaaaggctcttagaggtgtcaaagttgaagtgactcatcgaggaaacatgcgccggaagtaccgcatttccggtttgactgctgtggccactcgggaattgacattcccagtagatgaaagaaatactcagaaatctgttgtagaatacttccacgaaacatatggttttcgcattcagcacactcaactaccatgcttgcaagttgggaattctaataggcctaattacttaccaatggaggtatgcaagattgttgaaggccagcggtattccaaaagattgaatgagagacagatcactgctttgctgaaggttacctgtcagcgcccgatagatcgagaaaaagatatcttacagacggtgcaactcaatgattatgctaaagataattatgctcaagagtttggcatcaaaataagtacttctctggcttctgttgaggctcgtatactgcctcctccatggcttaagtaccacgagtctggaagggaagggacttgtctgccacaagttggtcaatggaacatgatgaataagaaaatgatcaatggtggaacggtgaataattggatctgcatcaacttttctaggcaagtgcaggacaatctagcgcgtacattttgtcaggaacttgctcaaatgtgttacgtatctggcatggcatttaatccggaaccagtcctcccaccagtcagtgctcgccctgagcaagtagagaaggtcttgaagactagatatcatgatgccacatcaaaactctcccaaggaaaagaaattgatctgcttattgtcattctgcccgataataatggatcattatacggtgatttgaaacgcatatgtgagactgaactcggcatagtctctcaatgttgcctgacaaagcatgtctttaagatgagcaaacaatacatggctaatgttgcgctgaagattaatgtgaaggttggaggaagaaacacagtgcttgttgatgctctatctaggcggattcctctagtcagtgatcgacccaccattatatttggtgctgatgttacccaccctcaccctggagaggattcaagcccatctattgctgctgttgtggcatctcaggattggcctgaaatcactaaatatgctggattagtttgcgctcaagcgcataggcaggagctcattcaggatctgttcaaagagtggaaggatcctcagaaaggtgtggtgactggtggcatgataaaggagttgctcatagccttccgtagatcaactgggcataaaccactaaggatcatcttctacagggatggagtcagtgagggacaattttaccaagttttgctctatgaacttgatgccatccgcaaggcctgtgcttcgctggaagcaggttatcaaccaccagtgacatttgtggtggtgcagaagcgtcatcacacgaggctgtttgctcagaaccacaatgatcgccattcggtggacagaagtgggaatattttacctggcactgttgtggactctaaaatctgccaccctacagagtttgacttttacctctgtagtcatgctggtattcagggcacttctcgacctgctcattaccacgttctttgggatgagaacaactttactgcagatggacttcaatctctgaccaataacttatgttacacgtatgcaagatgcacacgctcagtttcaattgttccccctgcatattatgcacatctagcagcttttagggctcgattctacatggagccagagacatcagacagtggctcaatggctagtgggagcatggcacgtggaggtggaatggctggtagaagcacacgcgggcctaatgtcaatgctgcagtgaggccactcccagctctgaaagagaatgtgaagcgtgtcatgttctactgctga

SEQ ID NO: 324 - protein, 1048 aa, Arabidopsis thaliana
  G1152,PAZ domain coordinates 937-947
MVRKRRTDAPSEGGEGSGSREAGPVSGGGRGSQRGGFQQGGGQHQGGRGYTPQPQQGGRGGRGYGQPPQQQQQYGGPQEYQGRGRGGPPHQGGRGGYGGGRGGGPSSGPPQRQSVPELHQATSPTYQAVSSQPTLSEVSPTQVPEPTVLAQQFEQLSVEQGAPSQAIQPIPSSSKAFKFPMRPGKGQSGKRCIVKANHFFAELPDKDLHHYDVTITPEVTSRGVNRAVMKQLVDNYRDSHLGSRLPAYDGRKSLYTAGPLPFNSKEFRINLLDEEVGAGGQRREREFKVVIKLVARADLHHLGMFLEGKQSDAPQEALQVLDIVLRELPTSRYIPVGRSFYSPDIGKKQSLGDGLESWRGFYQSIRPTQMGLSLNIDMSSTAFIEANPVIQFVCDLLNRDISSRPLSDADRVKIKKALRGVKVEVTHRGNMRRKYRISGLTAVATRELTFPVDERNTQKSVVEYFHETYGFRIQHTQLPCLQVGNSNRPNYLPMEVCKIVEGQRYSKRLNERQITALLKVTCQRPIDREKDILQTVQLNDYAKDNYAQEFGIKISTSLASVEARILPPPWLKYHESGREGTCLPQVGQWNMMNKKMINGGTVNNWICINFSRQVQDNLARTFCQELAQMCYVSGMAFNPEPVLPPVSARPEQVEKVLKTRYHDATSKLSQGKEIDLLIVILPDNNGSLYGDLKRICETELGIVSQCCLTKHVFKMSKQYMANVALKINVKVGGRNTVLVDALSRRIPLVSDRPTIIFGADVTHPHPGEDSSPSIAAVVASQDWPEITKYAGLVCAQAHRQELIQDLFKEWKDPQKGVVTGGMIKELLIAFRRSTGHKPLRIIFYRDGVSEGQFYQVLLYELDAIRKACASLEAGYQPPVTFVVVQKRHHTRLFAQNHNDRHSVDRSGNILPGTVVDSKICHPTEFDFYLCSHAGIQGTSRPAHYHVLWDENNFTADGLQSLTNNLCYTYARCTRSVSIVPPAYYAHLAAFRARFYMEPETSDSGSMASGSMARGGGMAGRSTRGPNVNAAVRPLPALKENVKRVMFYC

SEQ ID NO: 325 - DNA, 1625 bp, Arabidopsis thaliana
  G1227,family:HLH/MYC
tcttccgtgtgttaacagaagtccccacaattgtctgtcttcgctgcgagacaaaactgccacagccaataatgtttctctgagggaccttgcttctgtcagagactcgctctctctctcctcttcttgctctgctcagctctctcaccaactcatcttcagtcctcaaacaaacatctgttctcatctttgttttctttcctttctttctcatatctcattttcaattttcccaatttctcttcaacatcttcatagcaatttaagaccactattccattataaagctaactgctttagaaactcctcacatttatttcttccccatcattgttttagagagggagaaagaaaaagagctcagctttctgatggagaggagtattcaaggacaaaacaagctctgttgtttggaccaaaaagtgaatgtgagaagaagcctacaagttcaagaaactgtagaggatcatcaaagctttgcccttgaagaggaagaacaacaactctcaactccgagcttgctgcaagacacaacaataccatttctacaaatgctgcaacaaagtgaagacccttcaccgtttttgtcattcaaagacccaagctttctagcactactatctctccagacacttgaaaagccttgggaactcgaaaactacctcccacatgaagttccagagtttcattcaccgatccattctgaaaccaaccactactatcataatccatctttggaaggagtcaatgaagccatctcaaaccaagaacttccattcaacccactagagaatgcgcgttcaagacgcaagcggaaaaacaacaacttggcatcattgatgacaagagaaaagcgaaagagaagaagaactaaaccaacaaagaacatagaagagatagagagtcaaagaatgacacacattgcggttgaacgaaaccgcagacgccaaatgaacgttcatctgaactcactccgctccatcattccatcttcatacatccagaggggagaccaagcgtcaatagtaggaggagcaatagacttcgtaaagatcctagagcaacagttgcaatcccttgaagcacaaaagagaagtcaacagagtgatgataacaaagagcaaattccagaagataacagtctcaggaacatttcgtcgaacaagttgcgtgcgagtaataaagaagaacaaagtagcaaactcaaaatcgaagccacagtgatagagagtcacgtcaacctaaaaattcaatgtacgaggaaacaaggacaacttctcagatcaatcatattgctggagaaacttcgattcactgttcttcatctcaacatcacatctccgaccaatacatctgtctcttattccttcaacctcaagatggaagatgaatgtaatttgggatcagcggatgagataacggcggcgattcgtcagattttcgacagctgattgactaatccaagtaaaaagtaaaataaaaaaagaaacgtttactttggtaacttcgttttcatgattaaattctttatttggtcgtatgtgattggagtcttctcggcatggaacttgactttggttttagggtactagtctctacagaagctgtggtccttctttggatgc

SEQ ID NO: 326 - protein, 359 aa, Arabidopsis thaliana
  G1227,HLH/MYC domain coordinates 175-234
MERSIQGQNKLCCLDQKVNVRRSLQVQETVEDHQSFALEEEEQQLSTPSLLQDTTIPFLQMLQQSEDPSPFLSFKDPSFLALLSLQTLEKPWELENYLPHEVPEFHSPIHSETNHYYHNPSLEGVNEAISNQELPFNPLENARSRRKRKNNNLASLMTREKRKRRRTKPTKNIEEIESQRMTHIAVERNRRRQMNVHLNSLRSIIPSSYIQRGDQASIVGGAIDFVKILEQQLQSLEAQKRSQQSDDNKEQIPEDNSLRNISSNKLRASNKEEQSSKLKIEATVIESHVNLKIQCTRKQGQLLRSIILLEKLRFTVLHLNITSPTNTSVSYSFNLKMEDECNLGSADEITAAIRQIFDS

SEQ ID NO: 327 - DNA, 1264 bp, Arabidopsis thaliana
  G1232,family:Z-C4HC3
gctctctcttctcaatttccccaaatgaaataaattcctccgaaagtttatagatttcactctcccccgaactatacaaaattccctcaaaaggaaaaactaaaaagccgatcttggcttttttgtttctgagtgcatctcgatacttggaagcattctttggtgaggctgattcattctcatcttgtgaaagtctttggcttttgaagcaatactatggaaggaattcagcatcctatacctcgcactgtcgaagaggtttttagcgactttcgtggtcgtagagctggtctcatcaaggctctctctactgatgtacagaagttttaccatcagtgtgaccctgagaaggaaaacttgtgtctttatggacttccaaatgagacatgggaggttaatcttcccgttgaggaggtccctcctgagcttcctgaaccagcgttaggcatcaatttcgcaagggacggaatgcaagaaaaagactggatttctttggttgcagttcacagtgattcatggcttatctctgttgcattttactttggtgcacgtttcggatttggcaagaatgagaggaagaggctcttccagatgataaatgatctcccaaccattttcgaggttgtaactggcaatgcaaagcaatccaaggatcaatctgctaaccacaacagtagcagaagcaaatctagtggtggcaagcctcgtcattctgaatctcacactaaggcttcaaagatgtcccctccaccaagaaaagaagatgagagcggagatgaggatgaagatgacgagcaaggtgctgtttgtggtgcgtgtggcgacaactatggaggagatgagttctggatatgttgtgatgcttgcgagaaatggttccatgggaaatgcgtgaagatcacaccagcaaaggctgagcatatcaaacattacaaatgcccaagttgcactaccagcaagaaaatgaaagcctgaaagtgataataacattagagcctgtgaaagaggaaaacgttttcacagtttaagaagacagtacaagagtttagctgtgggaagaagaagaaacaaaaggcttctgattgcgtagttttaatgggattgagacagcttacagttagtaatgtctctttctcttttcttttctttttttttgctgttaatgttaaaatgttatgactaatttgtcttaagtttctgagaaaattctgtcttttaagcactctctagtctatgtcaagtggtttcttcttctcggtaaaaa

SEQ ID NO: 328 - protein, 252 aa, Arabidopsis thaliana
  G1232,Z-C4HC3 domain coordinates 197-245
MEGIQHPIPRTVEEVFSDFRGRRAGLIKALSTDVQKFYHQCDPEKENLCLYGLPNETWEVNLPVEEVPPELPEPALGINFARDGMQEKDWISLVAVHSDSWLISVAFYFGARFGFGKNERKRLFQMINDLPTIFEVVTGNAKQSKDQSANHNSSRSKSSGGKPRHSESHTKASKMSPPPRKEDESGDEDEDDEQGAVCGACGDNYGGDEFWICCDACEKWFHGKCVKITPAKAEHIKHYKCPSCTTSKKMKA

SEQ ID NO: 329 - DNA, 1245 bp, Arabidopsis thaliana
  G1247,family:MYB-(R1)R2R3
atgattcaggatcaagcgaatgatttattagcaatgaagaaaacttttactaagtctaaatggaaaccagaggaagatagaattttgaaagattatgttattcaatatggtgatagaacttggactcatgttccaaaacgcacgggccttcctcataatcctgcaagttgtcgttttcgttggatgaatcatcttaagccaagcttgaaaaaagggccctttaccgatgaggaagagaagcgtgttctccaacttcatgctgttttggggaacaaatggtcacaaatggctagagaagtatgtaactctctttcctttttttttcactctctacattttcatcttcttttactgtttgatttaaacttttgtttctttaagttccctggtcgaacagataacgagataaagaatttttggaacgcaagacgtatgcgattgaaaggaaagggtttaccagtttaccctgatgaagttcgagagcaggcgatacgtacagcagcacaatatggtgtaaaagttgaattattgaatgctcattatagtcaagactcattgatggcaggcaatgtcgagaaacctcaagaactcaataacttggcactcaatcaatgttctccgtattaccagtcaacgcttgccaatgttcagcctagccgcaatcgcgttatggaaccagaaacaacatttcctttcacgggtggatctgccatgaacgagcaaaaccctactctcttgtgtaatccttacgtggagagcactcaagaacagttacctgacagccatttgtttggaaatgttacatattcttctcctcctatgcctctcattcacgaggttgagaacttggagctcccttcattccaaggctttgattttcatgaagagcctagcagttttggagcagaacaatataacccaatgctgaatcttgagccacacaacactttggtccagtctcctctgataggccagacaccaacagatttcccatcatcattctatgatgaattgttggatgaattgttggaatcagttgttaacggttcattaggagaaataccgaaaaccgataccagttcggagtcccaactgtttcagtcctctctacgtagccataccgatgctacaccagacattgcaaacacaactggtaaaccttttttagtctctacgcattacattacaatcacttcattttttgtgtgttcaattcaagaggtttccactaatctttatgcatga

SEQ ID NO: 330 - protein, 414 aa, Arabidopsis thaliana
  G1247,MYB-(R1)R2R3 domain coordinates 18-141
MIQDQANDLLAMKKTFTKSKWKPEEDRILKDYVIQYGDRTWTHVPKRTGLPHNPASCRFRWMNHLKPSLKKGPFTDEEEKRVLQLHAVLGNKWSQMAREVCNSLSFFFHSLHFHLLLLFDLNFCFFKFPGRTDNEIKNFWNARRMRLKGKGLPVYPDEVREQAIRTAAQYGVKVELLNAHYSQDSLMAGNVEKPQELNNLALNQCSPYYQSTLANVQPSRNRVMEPETTFPFTGGSAMNEQNPTLLCNPYVESTQEQLPDSHLFGNVTYSSPPMPLIHEVENLELPSFQGFDFHEEPSSFGAEQYNPMLNLEPHNTLVQSPLIGQTPTDFPSSFYDELLDELLESVVNGSLGEIPKTDTSSESQLFQSSLRSHTDATPDIANTTGKPFLVSTHYITITSFFVCSIQEVSTNLYA

SEQ ID NO: 331 - DNA, 585 bp, Arabidopsis thaliana
  G1274,family:WRKY
atgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggcaagaaatctgtcaaaaacaacattaacaagaggaattactacaaatgctcaagtgaaggttgctcggtgaagaagagggtagagagagatggtgacgatgcagcttatgtaattacaacatatgaaggagtccataaccatgagagtctctctaatgtctattacaatgaaatggttttatcttatgatcatgataactggaaccaacactctcttcttcgatcttaa

SEQ ID NO: 332 - protein, 194 aa, Arabidopsis thaliana
  G1274,WRKY domain coordinates 110-166
MNISQNPSPNFTYFSDENFINPFMDNNDFSNLMFFDIDEGGNNGLIEEEISSPTSIVSSETFTGESGGSGSATTLSKKESTNRGSKESDQTKETGHRVAFRTRSKIDVMDDGFKWRKYGKKSVKNNINKRNYYKCSSEGCSVKKRVERDGDDAAYVITTYEGVHNHESLSNVYYNEMVLSYDHDNWNQHSLLRS

SEQ ID NO: 333 - DNA, 911 bp, Arabidopsis thaliana
  G1277,family:AP2
attctaaagtcctcctctcggaaagtaagagactcaacttccgagccgccatggacgccggagtagcagtaaaagctgacgtggcagtcaaaatgaagagagaaagaccattcaaagggatcagaatgagaaaatgggggaaatgggttgcggagattcgagaacccaacaagcgttcaagactttggctcggctcttactctactcccgaagcggcggcgcgtgcatacgacacggctgtcttttacctcagaggaccaactgctacgctcaacttcccggagcttctgccgtgtacctccgccgaggatatgtcagcggcaacgatcaggaaaaaggcgacggaggtgggagctcaagtagatgcgataggggcgacggtggtgcagaacaacaaacgccgccgcgtttttagtcaaaagcgtgactttggcggcgggttattagagcttgttgacttgaacaagttacctgacccggaaaatctcgatgatgatttggtgggaaaatagactgaaaaataataataaaatatcttacaatggtggctgtagctatcgtacgcggaatgcttgggcttgtgttatatgactacgtggttacggaaagattcctctgtttcgtcattgtattaaaatttaatcccacaagtcaaacatactgtacattattcttaatttagtattttcttattaatatctatcatttgtttggtgaacaccagaatattagactattaatgtaacgagtttttaatatttcgatcataataacaccaagctagttaaaggttaatatcttgttacgaagtcttgagtaagttcaattgtcatatatatgtaacggaagaggttcgttcgggtcccaagtgaagtggatcaaaggtgacttcacataaaaaataaaaaaaa

SEQ ID NO: 334 - protein, 153 aa, Arabidopsis thaliana
  G1277,AP2 domain coordinates 18-85
MDAGVAVKADVAVKMKRERPFKGIRMRKWGKWVAEIREPNKRSRLWLGSYSTPEAAARAYDTAVFYLRGPTATLNFPELLPCTSAEDMSAATIRKKATEVGAQVDAIGATVVQNNKRRRVFSQKRDFGGGLLELVDLNKLPDPENLDDDLVGK

SEQ ID NO: 335 - DNA, 925 bp, Arabidopsis thaliana
  G1329,family:MYB-(R1)R2R3
ccacgcgtccgtaccttttacaatttgtttatatattttacgtatctatctttgttccatggagggttcgtccaaagggctgcgaaaaggtgcttggactactgaagaagatagtctcttgagacagtgcattaataagtatggagaaggcaaatggcaccaagttcctgtaagagctgggctaaaccggtgcaggaaaagttgtagattaagatggttgaactatttgaagccaagtatcaagagaggaaaacttagctctgatgaagtcgatcttcttcttcgccttcataggcttctagggaataggtggtctttaattgctggaagattacctggtcggaccgcaaatgacgtcaagaattactggaacactcatctgagtaagaaacatgaaccgtgttgtaagataaagatgaaaaagagagacattacgcccattcctacaacaccggcactaaaaaacaatgtttataagcctcgacctcgatccttcacagttaacaacgactgcaaccatctcaatgccccaccaaaagttgacgttaatcctccatgccttggacttaacatcaataatgtttgtgacaatagtatcatatacaacaaagataagaagaaagaccaactagtgaataatttgattgatggagataatatgtggttagagaaattcctaaggaaagccaagaggtagatattttggttcctgaagcgacgacaacagaaaagggggacaccttggcttttgacgttgatcaactttggagtcttttcgatggagagactgtgaaatttgattagtgtttcgaacatttgtttgcgtttgtgtataggtttgctttcaccttttaatttgtgtgttttgataaataagctaatagtttttagcattttaatgaaatatttcaagtttccgtgttac

SEQ ID NO: 336 - protein, 212 aa, Arabidopsis thaliana
  G1329,MYB-(R1)R2R3 domain coordinates 7-111
MEGSSKGLRKGAWTTEEDSLLRQCINKYGEGKWHQVPVRAGLNRCRKSCRLRWLNYLKPSIKRGKLSSDEVDLLLRLHRLLGNRWSLIAGRLPGRTANDVKNYWNTHLSKKHEPCCKIKMKKRDITPIPTTPALKNNVYKPRPRSFTVNNDCNHLNAPPKVDVNPPCLGLNINNVCDNSIIYNKDKKKDQLVNNLIDGDNMWLEKFLRKAKR

SEQ ID NO: 337 - DNA, 1837 bp, Arabidopsis thaliana
  G1350,family:Z-C2H2
tgacgaattaaagagtttttctgtatatctctctgtccacctgttttgtcttcttacttagaaactctctctttctctgtctttcaactaaaccaatatcagcatgatgatgccagatgatcatcatcccctctcatttcccagctatgtccttcaccaagaacacatcgctccaaatcctaaccctaaccctaatcctacctcctctaactcagccaagaggaagagaaatctcccgggaaatccagatccagatgcagaagtcatcgctctatcaccaaactccctcatgacaactaatcgattcatctgcgaggtttgcaacaaaggatttaagagagaccagaaccttcagcttcaccggagaggccataaccttccatggaagctaaagcaaaggacaaacaaggagcaagtgaagaaaaaagtgtacatctgtccagagaagacttgcgtacaccatgacccggcccgagcccttggtgacttaactggaattaagaagcatttcagcaggaaacatggtgaaaagaagtggaaatgtgacaagtgttccaagaaatatgctgtcatgtccgattggaaagctcatagcaagatttgtggtactaaagaatacagatgtgactgtggtaccctcttttccaggaaagatagtttcatcacacatagagcattctgtgacgctttagctgaagagagtgctagatttgtctcagttccaccagcacccgcatatttgaacaatgccctggatgtggaagtcaaccatggaaatatcaaccaaaatcatcaacaacgacagcttaatactacttcgtcacaattggaccaacctggttttaataccaatcgcaataacattgcctttttgggacaaaccttaccaaccaacgtttttgcgtcctcatcatctccatcacctcgtagtgcatccgactcccttcaaaatctatggcatttacaaggacaatcatctcaccaatggcttctcaacgaaaacaacaacaacaacaacaacattctccaaaggggaatctccaaaaatcaagaagaacatgagatgaagaatgtgattagtaatggttctttgttctcttcggaagcacgaaacaacactaataattataaccaaaacggtggacaaatagcatcaatgtcagccacggcattgctacaaaaggcagctcaaatgggatcaaagagatcatcatcaagctcaagcaatagcaagacttttggtctaatgacctctatcttcaacaacaaacaagcagagaatatcaaaactaaggaagttgatgaaagaggtttcacgagagactttcttggtgtgggaagtcaacaccgttcttggccgttattgatggtcaaccataatcttccagactcgtctcctccggcctccacggacggcacaccaaccgccgacatgaaccagtaatcttgtattgttcatgtatactataagagacgtgaagtatgagattcaagtgacgagaggatggtttaagcacggcgaagaaaacggtgaaatatgagacttttgactcaggagagaatctctgagtcaactcggtgttgcagatgggtccactcggttgatgaagatgggaagctattcgggtccacttctgcatgcatgacgaaacctctgaccatgcatgcacagcaaaacatacgctatgtcttttcttattcttcttattcttctttttctttttcttgtaattatttcatgttttaattttgaaagaccctaaaagaaactatgaaaagttcgtagtttgttactttttattttttcatcgtagaaaggttaaacttttttttgaaa

SEQ ID NO: 338 - protein, 446 aa, Arabidopsis thaliana
  G1350,Z-C2H2 domain coordinates NA
MMMPDDHHPLSFPSYVLHQEHIAPNPNPNPNPTSSNSAKRKRNLPGNPDPDAEVIALSPNSLMTTNRFICEVCNKGFKRDQNLQLHRRGHNLPWKLKQRTNKEQVKKKVYICPEKTCVHHDPARALGDLTGIKKHFSRKHGEKKWKCDKCSKKYAVMSDWKAHSKICGTKEYRCDCGTLFSRKDSFITHRAFCDALAEESARFVSVPPAPAYLNNALDVEVNHGNINQNHQQRQLNTTSSQLDQPGFNTNRNNIAFLGQTLPTNVFASSSSPSPRSASDSLQNLWHLQGQSSHQWLLNENNNNNNNILQRGISKNQEEHEMKNVISNGSLFSSEARNNTNNYNQNGGQIASMSATALLQKAAQMGSKRSSSSSSNSKTFGLMTSIFNNKQAENIKTKEVDERGFTRDFLGVGSQHRSWPLLMVNHNLPDSSPPASTDGTPTADMNQ

SEQ ID NO: 339 - DNA, 823 bp, Arabidopsis thaliana
  G1364,family:CAAT
ctcttctctcgatctctctccctctctgcctcctctcttcctccaatcaacaaacacctctctgtttcactcccgccctttttcgaattcttctgatggcggagtcgcaggccaagagtcccggaggctgtggaagccatgagagtggtggagatcaaagtcccaggtcgttacatgttcgtgagcaagataggtttcttccgattgctaacataagccgtatcatgaaaagaggtcttcctgctaatgggaaaatcgctaaagatgctaaggagattgtgcaggaatgtgtctctgaattcatcagtttcgtcaccagcgaagcgagtgataaatgtcaaagagagaaaaggaagactattaatggagatgatttgctttgggcaatggctactttaggatttgaagactacatggaacctctcaaggtttacctgatgagatatagagagatggagggtgacacaaagggatcagcaaaaggtggggatccaaatgcaaagaaagatgggcaatcaagccaaaatggccagttctcgcagcttgctcaccaaggtccttatgggaactctcaagctcagcagcatatgatggttccaatgccgggaacagactagtatgagaggagtattcaactttggttatgttccaccaaaagaggttatcttatctgtatattatttgtgttgtaagagttttgctatgcagaacttgtgactataatcatctcattgttttgttttgtttttgtttccttggatttgttctgaatatgtcatcaagtcagtcagtctatttatatatttggtttgttgattatttc

SEQ ID NO: 340 - protein, 173 aa, Arabidopsis thaliana
  G1364,CAAT domain coordinates 29-118
MAESQAKSPGGCGSHESGGDQSPRSLHVREQDRFLPIANISRIMKRGLPANGKIAKDAKEIVQECVSEFISFVTSEASDKCQREKRKTINGDDLLWAMATLGFEDYMEPLKVYLMRYREMEGDTKGSAKGGDPNAKKDGQSSQNGQFSQLAHQGPYGNSQAQQHMMVPMPGTD

SEQ ID NO: 341 - DNA, 839 bp, Arabidopsis thaliana
  G1379,family:AP2
ctctgcctctctctctctctcaaaacccatctcgaaagtctttctctttcgagggtttagatcctccatggaaggcggcggagttgctgacgtggctgtccccggtacgaggaagagagacagaccttacaaaggaattaggatgaggaagtggggaaagtgggtggcggagattcgtgagcctaacaagcgctctaggttatggcttggctcttactctactcccgaggcggcggcgcgagcttacgacacggcggttttctatcttagaggacctacggcgaggcttaacttccctgagcttcttcctggggagaaattctccgacgaggatatgtcggctgcgaccatcaggaagaaagccacggaggtcggtgctcaggttgatgctttgggcacggcggtgcaaaataaccgccaccgtgtttttggtcagaatcgagatagtgatgtggataataagaattttcatcggaattatcaaaacggtgaacgagaagaagaagaagaagatgaggatgacaagagattgaggagtggcggccggttattggatcgggttgacttgaataaattacccgacccggaaagctccgatgaagaatgggaaagcaaacattaaaaatatatagtttggagcggtggctgttgctaacgtacgccaacggcttgcttctacgaatcattagcgccgtttatgatttttttttttttttttttcattatctgaaaatttagggctttttagttattaatttttgttttgtttttttcctttcttgcgagttttgcggtttatggaattttaggctattgcttaacgaaaaaaaaaaaaaaaa

SEQ ID NO: 342 - protein, 184 aa, Arabidopsis thaliana
  G1379,AP2 domain coordinates 18-85
MEGGGVADVAVPGTRKRDRPYKGIRMRKWGKWVAEIREPNKRSRLWLGSYSTPEAAARAYDTAVFYLRGPTARLNFPELLPGEKFSDEDMSAATIRKKATEVGAQVDALGTAVQNNRHRVFGQNRDSDVDNKNFHRNYQNGEREEEEEDEDDKRLRSGGRLLDRVDLNKLPDPESSDEEWESKH

SEQ ID NO: 343 - DNA, 844 bp, Arabidopsis thaliana
  G1387,family:AP2
tctctctcccactctcactttctctcctattcttagttcgtgtcagaaacacacagagaaattaagaaccctaatttaaaacagaagaatggtacattcgaagaagttccgaggtgtccgccagcgtcagtggggttcttgggtttctgagattcgtcatcctctcttgaagagaagagtgtggctaggaacattcgacacggcggaaacagcggctagagcctacgaccaagccgcggttctaatgaacggccagagcgcgaagactaacttccccgtcatcaaatcgaacggttcaaattccttggagattaactctgcgttaaggtctcccaaatcattatcggaactattgaacgctaagctaaggaagaactgtaaagaccagacaccgtatctgacgtgtctccgcctcgacaacgacagctcacacatcggcgtctggcagaaacgcgccgggtcaaaaacgagtccaaactgggtcaagcttgttgaactaggtgacaaagttaacgcacgtcccggtggtgatattgagactaataagatgaaggtacgaaacgaagacgttcaggaagatgatcaaatggcgatgcagatgatcgaggagttgcttaactggacctgtcctggatctggatccattgcacaggtctaaaggagaatcattgaattatatgatcaagataataatatagttgagggttaataataatcgagggtaagtaatttacgtgtagctaataattaatataattttcgaacatatatatgaatatatgatagctctagaaatgagtacgtatatatacgtaaacatttttcctcaaatatagtatatgtg

SEQ ID NO: 344 - protein, 189 aa, Arabidopsis thaliana
  G1387,AP2 domain coordinates 4-71
MVHSKKFRGVRQRQWGSWVSEIRHPLLKRRVWLGTFDTAETAARAYDQAAVLMNGQSAKTNFPVIKSNGSNSLEINSALRSPKSLSELLNAKLRKNCKDQTPYLTCLRLDNDSSHIGVWQKRAGSKTSPNWVKLVELGDKVNARPGGDIETNKMKVRNEDVQEDDQMAMQMIEELLNWTCPGSGSIAQV

SEQ ID NO: 345 - DNA, 1258 bp, Arabidopsis thaliana
  G1416,family:AP2
attttttttcctctttactttacacaaaggaacaacaaataatgtggaaccttaacgactcacccgatcatcacgaagaatccgacagtagagggaatccggtcggacacgtgtcaaacgggatgagtcaatctgcaacgtggctaccgtttgtgcttccggtgaccaggaatttctttccggctcaaagcatggaaccgggagttcgttggtccggtttcaatagtgtcggtaagtcggatccaagcggatcgggtcgaccagaagagccggagatatcaccgccgataaagaagagccgacgtggtcctcgctcacgtagctctcagtatcgaggagttacgttttaccgacgaaccggaagatgggagtcacatatttgggactgtgggaagcaagtgtacttaggtggatttgacactgcacatgctgctgctcgagcctatgatcgagcggcgattaaattcagaggtgtagatgcagatattaatttcgacattgaagactaccttgacgatttgaaacagatgggaaatttgacaaaggaagagtttatgcatgtacttagaaggcaaagcactgggtttccaagaggcagttctaaatacagaggtgttactttgcacaaatgtggaagatgggagtcacgtttgggtcaattcctcaacaaaaagtacgtttatttgggtctctttgataccgagattgaagctgctagagcttatgataaagcggcaataaagtgtaatgggaaagacgctgttaccaattttgaccctaaagtatacgaggaagaagaagatcttagctcagagacgacgaggaacggtcataatcttggtctaagtctaggagaatcatcatctgaagagtttagactcaagtctgatattgcaagcataagaagtaggattagagatgaggagagattattagggagcgatctatcgctagcaatgatgacgacgactgtcagatcggaaaagcagcaatcggacggtggaggaaatcgagtggtgggaatggcagcatcatcaggattctctcctcaaccttccccttaccgcattcctcgcaccttccacttctctcgtccctgattcatcatcatcatcatcactatcatcacaatcatcatctgagctagtgttaaccaagttatgctttaatgaatttgagttattctcgagctatttttgggctctgtaatacatatatgttcttgagtacggtataacaagtttttttcttttggtaa

SEQ ID NO: 346 - protein, 352 aa, Arabidopsis thaliana
  G1416,AP2 domain coordinates 94-160,186-253
MWNLNDSPDHHEESDSRGNPVGHVSNGMSQSATWLPFVLPVTRNFFPAQSMEPGVRWSGFNSVGKSDPSGSGRPEEPEISPPIKKSRRGPRSRSSQYRGVTFYRRTGRWESHIWDCGKQVYLGGFDTAHAAARAYDRAAIKFRGVDADINFDIEDYLDDLKQMGNLTKEEFMHVLRRQSTGFPRGSSKYRGVTLHKCGRWESRLGQFLNKKYVYLGLFDTEIEAARAYDKAAIKCNGKDAVTNFDPKVYEEEEDLSSETTRNGHNLGLSLGESSSEEFRLKSDIASIRSRIRDEERLLGSDLSLAMMTTTVRSEKQQSDGGGNRVVGMAASSGFSPQPSPYRIPRTFHFSRP

SEQ ID NO: 347 - DNA, 820 bp, Arabidopsis thaliana
  G1419,family:AP2
gaagactccaacataattcatcatctatggcttcttcacatcaacaacagcaagaacaagaccagtcagctttagatctcataacccaacaccttcttactgatttcccttccttagacacctttgcctccaccatccaccactgcaccacctcaactctaagccaacgcaaaccacctcttgccactatagcagttcctactactgcaccggtggttcaagagaatgatcaaaggcattacagaggcgtcaggagaagaccatggggtaagtatgcggctgagatcagagacccaaacaagaaaggtgttcgtgtctggttaggcacttttgacacagccatggaagctgcaagaggttatgacaaggcagcttttaaactacgaggaagcaaagctattcttaacttcccacttgaagcaggaaagcatgaggacttgggagacaacaagaagactatttctttaaaagcaaagaggaagagacaggtgacggaggatgaaagccagctgatcagccgtaaagctgttaagagggaagaagctcaggttcaggctgatgcttgtccattaacgccatcaagttggaaggggttttgggacggagcagacagtaaagacatgggaatattttccgtgcctctgttatctccttgtccatctcttggacactctcaactcgtagttacttaagcttcagagggtcaaactggaaaaaatcaacattggattgttttcaaagcttctagattagctgattgtaaaaaaatgttttactatattcattcattcttcttaaatgcaattctttctacccttcc

SEQ ID NO: 348 - protein, 221 aa, Arabidopsis thaliana
  G1419,AP2 domain coordinates 69-137
MASSHQQQQEQDQSALDLITQHLLTDFPSLDTFASTIHHCTTSTLSQRKPPLATIAVPTTAPVVQENDQRHYRGVRRRPWGKYAAEIRDPNKKGVRVWLGTFDTAMEAARGYDKAAFKLRGSKAILNFPLEAGKHEDLGDNKKTISLKAKRKRQVTEDESQLISRKAVKREEAQVQADACPLTPSSWKGFWDGADSKDMGIFSVPLLSPCPSLGHSQLVVT

SEQ ID NO: 349 - DNA, 1164 bp, Arabidopsis thaliana
  G1425,family:NAC
actctctcaaaccataaaaaatattctccgatcatcattttaatggagagtacagattcttccggtggtcctccgccgccgcaaccaaacctccctccaggattccggtttcatccaacagacgaagaacttgtaattcattacctcaaacgcaaagcagattctgttcctttaccagtcgcgatcatcgccgacgttgatctttacaaatttgatccatgggaacttcccgcgaaagcttcgtttggagaacaagaatggtattttttcagtccaagagatcggaaatatcccaacggagctagacctaaccgagctgcgacttccggttattggaaagcgactggtacagataaaccggtgatttcaaccggcggtggtggtagtaaaaaagtgggagttaaaaaggctctagtgttttacagtggtaaaccaccaaaaggagttaaatcagattggattatgcatgaatatcggttaactgataataaacctactcacatttgtgacttcggcaacaagaaaaactctctcaggcttgatgattgggtgttgtgtcgtatctacaagaaaaacaatagtacagcatctagacatcatcatcatcttcatcatattcatctagataatgatcatcatcgtcatgatatgatgattgatgatgatcgattccgtcatgttcctcctggtcttcacttcccggcgattttttctgacaataatgatccgacggctatatatgatggtggcggcggcggatacggaggtggaagttactcgatgaatcattgtttcgcatctggatcaaagcaggagcagttgtttccaccggtgatgatgatgactagtctaaatcaagattccggtattggatcgtcgtcgtcacctagcaagagatttaacggcggcggcgttggagattgttcgacttctatggcggcgacgccgttaatgcagaaccaaggtgggatttaccaattgcctggtttgaattggtattcttgaaaacaatttacgatgaagaatttttaaaatttgtgtatatatatacggtttgagtgattagggggcattgggggatttatttacggttgattattattgtagtgttatagaactaaggagattaaattaaatagattggaggaaaaaaaaaaaaaaaaa

SEQ ID NO: 350 - protein, 320 aa, Arabidopsis thaliana
  G1425,NAC domain coordinates 20-173
MESTDSSGGPPPPQPNLPPGFRFHPTDEELVIHYLKRKADSVPLPVAIIADVDLYKFDPWELPAKASFGEQEWYFFSPRDRKYPNGARPNRAATSGYWKATGTDKPVISTGGGGSKKVGVKKALVFYSGKPPKGVKSDWIMHEYRLTDNKPTHICDFGNKKNSLRLDDWVLCRIYKKNNSTASRHHHHLHHIHLDNDHHRHDMMIDDDRFRHVPPGLHFPAIFSDNNDPTAIYDGGGGGYGGGSYSMNHCFASGSKQEQLFPPVMMMTSLNQDSGIGSSSSPSKRFNGGGVGDCSTSMAATPLMQNQGGIYQLPGLNWYS

SEQ ID NO: 351 - DNA, 1410 bp, Arabidopsis thaliana
  G1426,family:NAC
atgaatcagaatcttcatgtattatcaatggattcgttaccagttggattaagattccgtccaacagacgaggagctaatccgttactatctccgtaggaaaatcaacggtcacgatgacgacgtcaaagctatccgtgagatcgatatttgcaaatgggaaccttgggatttacctgatttttctgtgatcaaaactaaagactcagagtggctctacttctgtccattggatcggaagtatccgagtggaagtagacagaaccgggcaacagttgcagggtactggaaagccacaggaaaagaccggaagataaaatccggtaagactaacattattggtgtgaagagaactctagttttccacgcgggtagagctcctagggggacacgaaccaattggattattcatgagtatcgtgccacggaggatgatcttagtggtaccaatcctggccagagtccgtttgttatatgcaaattgttcaagaaagaagaactggttttaggggaagaagattcgaagtcagatgaagttgaagaacctgctgtctcgtctccaactgtcgaagtgactaagtcagaagtatctgaggtaattaaaacagaagacgtgaagcgtcatgacatagcagaatcttctcttgtaatctctggagattctcatagtgatgcttgtgatgaggctacaaccgcagagcttgtagattttaaatggtatccggaattggagtccttagatttcacgctgttctctccattacactctcaagtccaatctgagcttggatcctcttacaacacattccagcctggctcgagtaatttttcagggaacaacaacaacagcttccaaatccagactcagtatggtacaaatgaagtagatacgtatatatctgattttcttgattcgattctcaagagcccagacgaggatccagagaagcacaagtatgttttgcaaagtggttttgatgttgtagcaccagatcagattgcgcaagtgtgtcaacagggctcagcagttgacatgagcaatgatgtttcagtgacgggtatccagattaagagtcgccaggcacaaccctcaggttataccaatgactatatagcgcagggaaatggtccaagaaggctgcgtctgcaaagtaactttaatggcattaacacgaagaatcctgagcttcaagctataaagagagaggctgaggacacggttggagaaagtataaagaaaaggtgtggaaagctaatgagatcaaagaacgtgaccggttttgtgtttaaaaagattacgtcggtgaaatgttcatatggaggactctttagggcggcagtagttgcagttgtgttcttgatgtcagtctgcagtctaaccgtcgacttcagagcatctgcagtgtcctga

SEQ ID NO: 352 - protein, 469 aa, Arabidopsis thaliana
  G1426,NAC domain coordinates 3-131
MNQNLHVLSMDSLPVGLRFRPTDEELIRYYLRRKINGHDDDVKAIREIDICKWEPWDLPDFSVIKTKDSEWLYFCPLDRKYPSGSRQNRATVAGYWKATGKDRKIKSGKTNIIGVKRTLVFHAGRAPRGTRTNWIIHEYRATEDDLSGTNPGQSPFVICKLFKKEELVLGEEDSKSDEVEEPAVSSPTVEVTKSEVSEVIKTEDVKRHDIAESSLVISGDSHSDACDEATTAELVDFKWYPELESLDFTLFSPLHSQVQSELGSSYNTFQPGSSNFSGNNNNSFQIQTQYGTNEVDTYISDFLDSILKSPDEDPEKHKYVLQSGFDVVAPDQIAQVCQQGSAVDMSNDVSVTGIQIKSRQAQPSGYTNDYIAQGNGPRRLRLQSNFNGINTKNPELQAIKREAEDTVGESIKKRCGKLMRSKNVTGFVFKKITSVKCSYGGLFRAAVVAVVFLMSVCSLTVDFRASAVS

SEQ ID NO: 353 - DNA, 1281 bp, Arabidopsis thaliana
  G1435,family:GARP
gtgaaacatggggaaggaagttatggtgagcgattacggtgacgacgacggagaagacgccggcggcggcgatgaatataggattccggaatgggaaattggtttacccaacggagatgatttgactccgttatctcaatatctagtcccgtcgattctcgcgttagctttcagcatgatcccagaacgaagccgtacaattcacgacgtcaatcgcgcgtcgcaaatcacgctctcttcgttgagaagcagtaccaatgcttcgtctgtgatggaggaggtcgtggatcgagttgaatcgagtgttccaggatcagatccgaagaaacagaagaaatcggatggtggtgaagcagcggcggtggaggattccacggcggaggaaggagactccgggcctgaagacgcgtctgggaagacatcgaaacgaccgcgtttagtgtggacaccgcagctacacaagagatttgtggacgttgtggctcatctagggattaaaaacgcagtgccgaagacgattatgcagctgatgaacgtggaaggacttactcgtgagaacgttgcgtctcatttgcagaaatataggctttaccttaaacggattcaaggattgacgacggaagaagatccttattcgtcgtcggatcagctcttctcttcaacgccggttcctccacagagctttcaagacggcggaggaagtaacggaaagttgggggttccggttccggttccgtcgatggtgcctattccaggctatgggaatcaaatgggtatgcaaggatattatcaacagtatagtaaccatggcaatgaatcaaaccaatatatgatgcagcagaataagtttggaacaatggtgacatatccttctgttggtggtggtgacgtgaatgacaagtaaatggatcttaaaggtctataatttgctctacagagagatactggttcttggcttatggtttattttcccacttcatgaggttgttgtgacttttaattctccatgttttccacacaagtctttattgcctttgtatagaaaatgatttcgagaaaatcactgggaagcttggtattgttggaggatgaagccttctatgaatgatttagtttcctactgtctccattctttatgaggtaataaagccttcttttgctcatcgcttgtagtcttcttaaattcaagacagcgtcacatgtttgttcggttatgttaattgtttctttctttggataatgaagatagcatcaggtctcatgtctcctcactttgataaa

SEQ ID NO: 354 - protein, 298 aa, Arabidopsis thaliana
  G1435,GARP domain coordinates 146-194
MGKEVMVSDYGDDDGEDAGGGDEYRIPEWEIGLPNGDDLTPLSQYLVPSILALAFSMIPERSRTIHDVNRASQITLSSLRSSTNASSVMEEVVDRVESSVPGSDPKKQKKSDGGEAAAVEDSTAEEGDSGPEDASGKTSKRPRLVWTPQLHKRFVDVVAHLGIKNAVPKTIMQLMNVEGLTRENVASHLQKYRLYLKRIQGLTTEEDPYSSSDQLFSSTPVPPQSFQDGGGSNGKLGVPVPVPSMVPIPGYGNQMGMQGYYQQYSNHGNESNQYMMQQNKFGTMVTYPSVGGGDVNDK

SEQ ID NO: 355 - DNA, 1319 bp, Arabidopsis thaliana
  G1454,family:NAC
ctagtagtgatgatatgatcgcttcttctcctacaatctcagaaacctccgatcacggttttagatatcttctacaacggatacaatggagagcaccgattcttccggtggtccaccaccgccacaacctaaccttcctccaggcttccggtttcaccctaccgacgaagagcttgttgttcactacctcaaacgcaaagcagcctctgctcctttacctgtcgccatcatcgccgaagtcgatctctataaatttgatccatgggaacttcccgctaaagcatcgtttggagaacaagaatggtacttctttagtccacgagatcggaagtatccaaacggagcaagaccaaacagagcggcgacttcaggttattggaaagcgaccggtacagataaaccggtacttgcttccgacggtaaccaaaaggtgggcgtgaagaaggcactagtcttctacagtggtaaaccaccaaaaggcgttaaaagtgattggatcatgcatgagtatcgtctcatcgaaaacaaaccaaacaatcgacctcctggctgtgatttcggcaacaaaaaaaactcactcagacttgatgattgggtgttatgtagaatctacaagaagaacaacgcaagtcgacatgttgataacgataaggatcatgatatgatcgattacattttcaggaagattcctccgtctttatcaatggcggctgcttctacaggacttcaccaacatcatcataatgtctcaagatcaatgaatttcttccctggcaaattctccggtggtggttacgggattttctctgacggtggtaacacgagtatatacgacggcggtggcatgatcaacaatattggtactgactcagtagatcacgacaataacgctgacgtcgttggtttaaatcatgcttcgtcgtcaggtcctatgatgatggcgaatttgaaacgaactctcccggtgccgtattggcctgtagcagatgaggagcaagatgcatctccgagcaaacggtttcacggtgtaggaggaggaggaggagattgttcgaacatgtcttcctccatgatggaagagactccaccattgatgcaacaacaaggtggtgtgttaggagatggattattcagaacgacatcgtaccaattacccggtttaaattggtactcttcttaatcaaatgtgtttcgccgccggtgtgaagaattttccggtgacagtgaagatttttttccgattggtggggtcatttgcatgcattatataatttgagatttgtgtatatgttttgggttaattaattggtcacaggggc

SEQ ID NO: 356 - protein, 364 aa, Arabidopsis thaliana
  G1454,NAC domain coordinates 9-178
MESTDSSGGPPPPQPNLPPGFRFHPTDEELVVHYLKRKAASAPLPVAIIAEVDLYKFDPWELPAKASFGEQEWYFFSPRDRKYPNGARPNRAATSGYWKATGTDKPVLASDGNQKVGVKKALVFYSGKPPKGVKSDWIMHEYRLIENKPNNRPPGCDFGNKKNSLRLDDWVLCRIYKKNNASRHVDNDKDHDMIDYIFRKIPPSLSMAAASTGLHQHHHNVSRSMNFFPGKFSGGGYGIFSDGGNTSIYDGGGMINNIGTDSVDHDNNADVVGLNHASSSGPMMMANLKRTLPVPYWPVADEEQDASPSKRFHGVGGGGGDCSNMSSSMMEETPPLMQQQGGVLGDGLFRTTSYQLPGLNWYSS

SEQ ID NO: 357 - DNA, 1989 bp, Arabidopsis thaliana
  G1455,family:NAC
cgtcgacatgaaccaaataaaaaacaaaactttaccggagatgacgacggagcaagctttgttgtctatggaagctttacctttaggtttcagattcagaccaacggatgaagaactcatcaatcattacctaaggttaaaaatcaacggccgtgatttagaggttagagtcatccctgagatcgatgtttgcaagtgggaaccatgggacttacctgggctatcggtgataaagacagatgatcaagaatggttctttttttgtcctcgtgatcgaaagtatccgagtggtcatcgttctaatagagctactgatattggttactggaaagctactgggaaagatcgaactattaagtctaagaagatgattattggtatgaagaagactcttgttttctatcgtggaagagctcctagaggagagcgtactaattggattatgcatgagtatcgtgctacagacaaggaactagatggtactggacctggtcagaatccgtatgttttgtgtcgcttgttccacaagcctagtgatagttgtgatcctgcacactgtgaggaaatagagaaagttaattttactccaaccaccaccactagatgctctcctgatgacacatcttctgaaatggtccaagaaacagctacatctggtgtacatgctctagatagatcagatgacactgagaggtgtttaagtgacaagggcaataatgatgtgaaacctgatgtttcagtgataaacaatacttctgtcaatcacgctgaaacttctcgtgccaaagaccgtaatttgggcaagacgttagtagaggaaaatccacttctaagggacgttccaactcttcatggacccatcttgagtgagaaatcatattatccaggacagtcaagcatcggttttgctacatctcacatggattctatgtattctagtgattttggaaactgtgattatgggctacattttcaagatggtgcctctgaacaagatgcatctttaacagatgtcttggatgaagtattccataaccataatgaatcctctaatgacaggaaagactttgtacttccgaatatgatgcattggcctggtaatacaagactgttgtctactgagtacccatttctcaaagattctgttgcttttgttgacggcagtgctgaagtttccggctcacagcaatttgttcctgacattttagcttctagatgggtcagtgaacagaacgttgatagcaaggaggcagtagagattctatcttcaaccgggtcctctcggaccttgacgccacttcataacaacgtttttgggcaatatgcttcatcgtcttacgcagctatcgatccatttaactataatgtcaatcagcctgaacagtcatcctttgagcaaagccatgttgaccgcaacattagtcccagtaacatttttgagttcaaggctaggtctcgagagaatcagagagatctggactctgttgtggaccaaggcactgctcctagaagaattcggctgcagatcgaacagccattgacgccagttaccaacaagaaagagagagatgcggacaactatgaagaagaagatgaagtacaatctgccatgtccaaggtcgtagaggaagaaccggctaatttaagtgctcaggggactgctcagaggagaatccgcctgcagacgagattgaggaagcctctcataaccctaaacaatacaaaaagaaactcaaatggcagagaaggagaagcaagccataggaagtgtgaaatgcaggaaaaagaagatatatcatcatcatcatcatggcagaaacagaagaagagcttggtgcagtttagtagtgtggtgataatagtggcggtgatagttgttttagtagaaatatggaaagagtcaagagatgcgaaatgtagcttcttgtttcatcaattagattccttcaaaggcatgtttacttgatgatatattgtgccgcggccgct

SEQ ID NO: 358 - protein, 652 aa, Arabidopsis thaliana
  G1455,NAC domain coordinates 24-178
MNQIKNKTLPEMTTEQALLSMEALPLGFRFRPTDEELINHYLRLKINGRDLEVRVIPEIDVCKWEPWDLPGLSVIKTDDQEWFFFCPRDRKYPSGHRSNRATDIGYWKATGKDRTIKSKKMIIGMKKTLVFYRGRAPRGERTNWIMHEYRATDKELDGTGPGQNPYVLCRLFHKPSDSCDPAHCEEIEKVNFTPTTTTRCSPDDTSSEMVQETATSGVHALDRSDDTERCLSDKGNNDVKPDVSVINNTSVNHAETSRAKDRNLGKTLVEENPLLRDVPTLHGPILSEKSYYPGQSSIGFATSHMDSMYSSDFGNCDYGLHFQDGASEQDASLTDVLDEVFHNHNESSNDRKDFVLPNMMHWPGNTRLLSTEYPFLKDSVAFVDGSAEVSGSQQFVPDILASRWVSEQNVDSKEAVEILSSTGSSRTLTPLHNNVFGQYASSSYAAIDPFNYNVNQPEQSSFEQSHVDRNISPSNIFEFKARSRENQRDLDSVVDQGTAPRRIRLQIEQPLTPVTNKKERDADNYEEEDEVQSAMSKVVEEEPANLSAQGTAQRRIRLQTRLRKPLITLNNTKRNSNGREGEASHRKCEMQEKEDISSSSSWQKQKKSLVQFSSVVIIVAVIVVLVEIWKESRDAKCSFLFHQLDSFKGMFT

SEQ ID NO: 359 - DNA, 1392 bp, Arabidopsis thaliana
  G1461,family:NAC
accgcccgcccgggcaggttaaacagtgaaaaaatatccgtggaagaagggtagttgagaaataaaaagagatcaacaagggtaaattaatcaatacgaaacttagatataacggttgccattaacttaaaagcacatttatgaacatgagtcttcttcgcttcatctccaagaaacaacactcatttttgcgtttaatctttctctctctcttgatcgatttagtttctttatgaggacgaaccaatgaaagttgaagacgaagcaacttatgagcttatcaaagacgaactgatgaaagcagaagacgaagcaacttattggctaatcaaagaagaactgatcaaagcagaagacgatgtaatcatctcacgttatctgaagcgtatgatcgttaacggggattcgtggcctgatcacttcatcgaagatgtagacgtgttcaacaagaatccaaatgaggagtttcattctcagagccctagattcgtgatcgttaaaccacgaacagagaattgtggtagaaccgatggatgtcaatctggttgctggaggatcattggtcgtgataaactgataaaatcgaaggagactgggaagattctagggttcaagaagattctcaagttctgcctaaagaagaaacctagagaatacaagagaagttgggtaatggaagagtacaggcttaacaataacttgaactgcaagcaagatcatgtgatttgcaagattcggtttatgttcgatgctgaaatcagtttcttgctagccaagcatttctcgtgtctctccactagatcaccgcttcctgcaaatcaattgttgccagcttatggagtctgtttcttcgattcagaagcggagggtgcattttatctggagacgataatcggttatgatggaaacacttggcctagctacgttaccaacgatgtgtaccgtttgcatccgttgacgcttgtggatcctcaagatgacaagtttaaagagttcggaacctgtatctttgctaacaggacaaagacttgtggtaaaaccgatgaatgtgatggtggtggttgctggaggatcgtagaaggtcatagagttatcaagtcaaaaggtaaggttcttggttacaggaggatttttcaattttcggaaaatgaggaaccaagaaatgtttgtgaaggagaagatccgaagaaaactgcttggttcatagaagagtataggcctgacgaaaataataagaaggataaagtgttatgcgttatcaagttcttaatcccactcaaccaaaggtaacaaggagattttactctggaagtcatactccgtagcacttcgatgtgttcttactgagactggtcacattagctgatagggtatatcaaaaaaaaaaaaaaa

SEQ ID NO: 360 - protein, 347 aa, Arabidopsis thaliana
  G1461,NAC domain coordinates 37-163
MKVEDEATYELIKDELMKAEDEATYWLIKEELIKAEDDVIISRYLKRMIVNGDSWPDHFIEDVDVFNKNPNEEFHSQSPRFVIVKPRTENCGRTDGCQSGCWRIIGRDKLIKSKETGKILGFKKILKFCLKKKPREYKRSWVMEEYRLNNNLNCKQDHVICKIRFMFDAEISFLLAKHFSCLSTRSPLPANQLLPAYGVCFFDSEAEGAFYLETIIGYDGNTWPSYVTNDVYRLHPLTLVDPQDDKFKEFGTCIFANRTKTCGKTDECDGGGCWRIVEGHRVIKSKGKVLGYRRIFQFSENEEPRNVCEGEDPKKTAWFIEEYRPDENNKKDKVLCVIKFLIPLNQR

SEQ ID NO: 361 - DNA, 1092 bp, Arabidopsis thaliana
  G1462,family:NAC
cattcttgcgattgatctttctctagataatttttttgatcgatttagtttcattatggaggacgacgacgcagcttatgatctaatcaaacacgaactgttatactcagaagacgaagtaataatctcacgttatctgaagggtatggtcgttaacggagattcttggccagatcacttcatcgaagacgcaaacgtgttcaccaagaatccagataaggtgttcaattctgagagacctagattcgtgatcgttaaaccacgaacagaggcttgtggtaaaaccgatggatgtgattcgggttgctggaggatcattggtcgtgataaactgataaagtcggaggagactgggaagattctagggttcaagaagatactcaagttttgcctaaagaggaaacctatagactacaagagaagttgggtaatggaagagtataggcttaccaataacttgaactggaagcaagatcatgtgatttgcaaaattcggtttatgtttgaagctgaaattagtttcttgctaagcaagcatttctacactacatcagaatcggttcttgaaaatgagctgttgccatcttatggatattatttatccaatacacaagaggaggatgaattttatctggacgcgataatgacttcggaaggaaacgagtggcctagctacgttaccaacaacgtgtactgtctgcatccattggagcttgtggatcttcaagatcggatgtttaatgattacggaacctgcatcttcgctaacaagacttgtggtgaaactgataaatgcgatggtggttactggaagatcctgcacggtgataagctgatcaagtcaaatttcggaaaggtcattggtttcaagaaggtatttgagttctatgaaacggtgagacaaatatatctttgtgatggagaagaagtgacggtaacttggactatacaagagtataggcttagcaaaaacgtgaagcagaataaagtgttgtgcgttatcaagttgacttatgatagataggatactttactttggtttttgtgatcatcttagtatcttacgaatattctagatacacacatctatag

SEQ ID NO: 362 - protein, 322 aa, Arabidopsis thaliana
  G1462,NAC domain coordinates 14-273
MEDDDAAYDLIKHELLYSEDEVIISRYLKGMVVNGDSWPDHFIEDANVFTKNPDKVFNSERPRFVIVKPRTEACGKTDGCDSGCWRIIGRDKLIKSEETGKILGFKKILKFCLKRKPIDYKRSWVMEEYRLTNNLNWKQDHVICKIRFMFEAEISFLLSKHFYTTSESVLENELLPSYGYYLSNTQEEDEFYLDAIMTSEGNEWPSYVTNNVYCLHPLELVDLQDRMFNDYGTCIFANKTCGETDKCDGGYWKILHGDKLIKSNFGKVIGFKKVFEFYETVRQIYLCDGEEVTVTWTIQEYRLSKNVKQNKVLCVIKLTYDR

SEQ ID NO: 363 - DNA, 1066 bp, Arabidopsis thaliana
  G1465,family:NAC
ctcattcttgcgtttgatctttctttctctagatcccatatttttcttgatcaatttagtttcattatggaggaagatgcagcttttgatctactcaaagccgaactcttaaacgcagaagacgatgcaataatctcacgttatctgaagcgtatggtcgtcaacggagactcatggcctgatcacttcatcgaagacgcagacgtgttcaacaagaatccaaatgtggagttcgatgctgagagccctagcttcgtgatagttaaacctcgaacagaggcttgtggtaaaaccgatggatgtgaaactggttgctggaggatcatgggtcgtgataaaccgataaaatcgacggagactgtgaagattcaagggttcaagaagattctcaagttctgcctaaagaggaaacctagaggatacaagagaagttgggtaatggaagagtataggcttaccaataacttgaactggaagcaagatcatgtgatttgcaagattcggtttatgtttgaagctgaaatcagtttcttgctagccaagcatttctacactacatcagaatcacttcctcgaaatgagctgttgccagcttacggattcctttcatcagataagcaattggaggatgtatcttatccggtgacgataatgacttctgaaggaaacgattggcctagctacgttaccaacaatgtgtattgtctgcatccattggagctcgttgatcttcaagatcggatgtttaatgattacggaacctgcatcttcgctaacaagacttgtggtaaaaccgatagatgcattaatggtggttactggaaaattttgcaccgtgataggctgatcaagtcaaagtccgggatagttattggtttcaagaaggtgtttaagtttcatgaaacggagaaagaaagatacttctgtggtggagaagatgtgaaggtaacttggactctagaagagtataggcttagcgtgaagcagaataaattcttgtgcgttatcaagtttacttatgataactaagaatcttttctttggattttatgatcatcttagtatc

SEQ ID NO: 364 - protein, 320 aa, Arabidopsis thaliana
  G1465,NAC domain coordinates 242-306
MEEDAAFDLLKAELLNAEDDAIISRYLKRMVVNGDSWPDHFIEDADVFNKNPNVEFDAESPSFVIVKPRTEACGKTDGCETGCWRIMGRDKPIKSTETVKIQGFKKILKFCLKRKPRGYKRSWVMEEYRLTNNLNWKQDHVICKIRFMFEAEISFLLAKHFYTTSESLPRNELLPAYGFLSSDKQLEDVSYPVTIMTSEGNDWPSYVTNNVYCLHPLELVDLQDRMFNDYGTCIFANKTCGKTDRCINGGYWKILHRDRLIKSKSGIVIGFKKVFKFHETEKERYFCGGEDVKVTWTLEEYRLSVKQNKFLCVIKFTYDN

SEQ ID NO: 365 - DNA, 820 bp, Arabidopsis thaliana
  G149,family:MADS
gagtggaaaatcaaaatactgttgttgattagggttaattaaattagaagaatggtgaggggaaagacagagatgaagaggatagagaacgcaacgagcaggcaagtgactttctcaaaaagaagaaatggacttttgaagaaagcttttgaattatcagtcctttgtgatgctgaagttgccctaatcatcttctctcctagaggcaaactctatgagttctctagctcctccagtatacctaaaacagtagaaagatatcaaaagcgaatacaagatctcgggtctaaccataagagaaatgataattcacagcaatcgaaggacgaaacctatggcttggcgagaaagatcgaacatttggagatttcgacacgaaaaatgatgggagaaggacttgacgcatcttctatagaagagttacaacaattggagaaccagttggacagaagcttaatgaaaataagagccaaaaagtaccagttattacgagaagaaactgagaaattaaaagaaaaggagaggaacctcattgcagaaaataaaatgctgatggagaagtgtgagatgcaaggaagaggaataataggaagaatatcatcatcatcatcaacatcagaactggatatagatgacaatgaaatggaagtggtgactgatttgttcattggacctcctgagactcgacacttcaaaaagtttcctccttcaaactaacatatatagtacaatgcttatatagatattatgtagggaattacttttttccctgaagaaaaattgatgttacttactgaatttagcagttgcataaaaaaaa

SEQ ID NO: 366 - protein, 221 aa, Arabidopsis thaliana
  G149,MADS domain coordinates 2-57
MVRGKTEMKRIENATSRQVTFSKRRNGLLKKAFELSVLCDAEVALIIFSPRGKLYEFSSSSSIPKTVERYQKRIQDLGSNHKRNDNSQQSKDETYGLARKIEHLEISTRKMMGEGLDASSIEELQQLENQLDRSLMKIRAKKYQLLREETEKLKEKERNLIAENKMLMEKCEMQGRGIIGRISSSSSTSELDIDDNEMEVVTDLFIGPPETRHFKKFPPSN

SEQ ID NO: 367 - DNA, 1342 bp, Arabidopsis thaliana
  G1491,family:GARP
cgtcgactatctctgaactgagagtagcaggttgcaattaaaaactaaagattgtgtcagacttatgtattaccacaaccagcaccaaggaaagagcatcctctcttcatcgagaatgcccatttcttctgaaaggcatccgttcctcagaggaaatggcacaggagattctggactcattctctccactgatgcaaagccacgactaaaatggactccagatcttcacgagagatttgttgaagcggtcaaccagcttggaggaggagataaggctactcctaagacaatcatgaaagtcatgggcattccaggccttaccttataccatctcaagagtcatcttcagaaatataggctaagcaagaatcttaatggacaagctaacagcagtttaaacaagacaagtgtgatgaccatggtagaagaaaacccccctgaagtagacgaaagtcacagtgagagtttaagcattggaccacagccgagcatgaacttacccataagtgatgcccttcaaatgcaaatagaggtccagagacggctacacgagcaacttgagctcaggatagaggctcaaggaaagtacctgcaatcgattctggagaaagcacaagagactcttggaagacagaacctaggtgcagctgggattgaagcaacaaaagctcaactctcagaattagtatctaaagtatcagcagactatccagactctagtttcctcgaaccgaaagaactgcagaatctacaccatcaacagatgcaaaaaacgtatccacctaactcctccctggacagttgcctaacctcaagtgaaggaactcagaaagccccaaagatgcttgacaacagactgggattaagaacatatattggagattcaacttcagagcagaaagagataatggaagagccattcttccatagaatggagctcacatgggcagaagaagaaagcctcagagagaatcacaacaggccatatctttcaacaatggttaacaacgcagaaccgagaatctcgtcttcaagaagaagtcctggaagattgtcaataggagtgggattacatgaacacagaggaaggagtagcaacaacagtgagtatacagaagaaagattcaacgagaataatgaagattgcaagcttgaaacacacacaagaacagctctagatcttaacacacacgacgaaaactatggcacaacgcgtcctaaacagtttgatttaaatggtttcagctggaattgagaagaacaaataagctttagaagagtgcaacaacctttttatgataatcacacaggaaatgaaaagcctttcatttccgcggccgct

SEQ ID NO: 368 - protein, 396 aa, Arabidopsis thaliana
  G1491,GARP domain coordinates 50-100
MYYHNQHQGKSILSSSRMPISSERHPFLRGNGTGDSGLILSTDAKPRLKWTPDLHERFVEAVNQLGGGDKATPKTIMKVMGIPGLTLYHLKSHLQKYRLSKNLNGQANSSLNKTSVMTMVEENPPEVDESHSESLSIGPQPSMNLPISDALQMQIEVQRRLHEQLELRIEAQGKYLQSILEKAQETLGRQNLGAAGIEATKAQLSELVSKVSADYPDSSFLEPKELQNLHHQQMQKTYPPNSSLDSCLTSSEGTQKAPKMLDNRLGLRTYIGDSTSEQKEIMEEPFFHRMELTWAEEESLRENHNRPYLSTMVNNAEPRISSSRRSPGRLSIGVGLHEHRGRSSNNSEYTEERFNENNEDCKLETHTRTALDLNTHDENYGTTRPKQFDLNGFSWN

SEQ ID NO: 369 - DNA, 1306 bp, Arabidopsis thaliana
  G1496,family:HLH/MYC
aaacccaccaaataactcagagcttttttgcattttttcccattctctattttgttttgtacttttggtctcactttaaaagatcataagttgaaagatttctgcagagaacaatatgttggaaggtcttgtctctcaagaaagcttgtccttaaactctatggacatgtctgtacttgaaaggcttaaatgggtacaacagcaacaacagcaactgcaacaagttgtgtcccatagcagtaataattcacctgaacttcttcagatacttcagttccatggaagcaacaatgatgagttgttggagagtagtttcagccaatttcaaatgcttggatctggttttggaccaaactataacatgggttttggtcctccacatgaatccatttcaagaacaagtagctgccatatggaacctgtggatacaatggaggttttgttgaagaccggtgaagaaaccagagccgttgccttgaagaacaagagaaaaccagaggttaagacaagggaagagcaaaagacagagaagaagatcaaagtagaggctgagacagagtcaagcatgaaaggaaaatcaaacatgggaaacactgaagcatcttcagacacttcaaaggagacatcgaaaggagcttcagagaatcagaaattagattatatccacgtgagagctcgtcgaggccaagccactgacagacacagcttagcagaaagggcgagaagagaaaagatcagcaagaaaatgaaatatctgcaagatattgtgcctggatgcaataaggtcacaggaaaagctggtatgcttgatgagatcatcaattatgttcaatgtctccaaagacaagtcgagttcctgtcgatgaaacttgctgtcttgaacccggaactagagcttgccgtggaagatgtatccgtaaaacaggcttactttacaaatgtagttgcttcaaagcaatcaataatggttgatgtgccattgtttccgttagaccagcaaggatctctagatttgtctgcgataaacccgaaccaaacgacatctatcgaagctccatctggaagctgggaaactcaatcacagagtctctacaacacatctagcctcggttttcattactaagcaagattcattgaaacaacatggttgacatcaatcaatcatcaaaatcagaagcaaattctattacatttgctcatcaaagtagtaatttcgaaatttggttaatgcattatcctttgatccttgttttctgatatttaaaccagaagaactggagatagcaatccaatgatcttgtcacca

SEQ ID NO: 370 - protein, 335 aa, Arabidopsis thaliana
  G1496,HLH/MYC domain coordinates 188-246
MLEGLVSQESLSLNSMDMSVLERLKWVQQQQQQLQQVVSHSSNNSPELLQILQFHGSNNDELLESSFSQFQMLGSGFGPNYNMGFGPPHESISRTSSCHMEPVDTMEVLLKTGEETRAVALKNKRKPEVKTREEQKTEKKIKVEAETESSMKGKSNMGNTEASSDTSKETSKGASENQKLDYIHVRARRGQATDRHSLAERARREKISKKMKYLQDIVPGCNKVTGKAGMLDEIINYVQCLQRQVEFLSMKLAVLNPELELAVEDVSVKQAYFTNVVASKQSIMVDVPLFPLDQQGSLDLSAINPNQTTSIEAPSGSWETQSQSLYNTSSLGFHY

SEQ ID NO: 371 - DNA, 959 bp, Arabidopsis thaliana
  G152,family:MADS
cctagaacgcaccaagatctaaaggaagatcaaaatagggtttaaattaatggggagagggaagattgtgatccagaagatcgatgattccacgagtagacaagtcactttctccaaaagaagaaagggtctcatcaagaaagctaaagaacttgctattctctgcgacgccgaggtctgtctcatcattttctccaacactgacaagctctatgactttgccagctccagtgtgaaatctactattgaacgattcaatacggctaagatggaggagcaagaactaatgaaccctgcatcagaagttaagttttggcagagagaggctgaaactctaaggcaagaattgcactcattgcaagaaaattatcggcaactaacgggagtggaattaaatggtttgagcgttaaggagttacaaaacatagagagtcaacttgaaatgagtttacgtggaattcgtatgaaaagggaacaaattttgaccaatgaaattaaagagctaaccagaaagaggaatcttgttcatcatgaaaacctcgaattgtcgagaaaagtacaaaggattcatcaagaaaatgtcgaactatacaagaaggcttatggaacgtcgaacacaaatggattgggacatcatgagctagtagatgcagtttatgaatcccatgcacaggttaggctgcagctaagccagcctgagcagtcccattataagacatcttcaaacagctaagatcatataagagatatataacaaattgttcgttcttgattatctcaaaaccctttcaaatatatatacgtgcatattatatatgaagactcgtttgactatgtcaatatatatgttttcatgcaggagtaagtgtgagtgtaatcatgtcggagagcaaaccaaaggtttgatttgtacgatatatacttatatatggtctcaagtgaaagcaatggaacagctt

SEQ ID NO: 372 - protein, 227 aa, Arabidopsis thaliana
  G152,MADS domain coordinates 2-57
MGRGKIVIQKIDDSTSRQVTFSKRRKGLIKKAKELAILCDAEVCLIIFSNTDKLYDFASSSVKSTIERFNTAKMEEQELMNPASEVKFWQREAETLRQELHSLQENYRQLTGVELNGLSVKELQNIESQLEMSLRGIRMKREQILTNEIKELTRKRNLVHHENLELSRKVQRIHQENVELYKKAYGTSNTNGLGHHELVDAVYESHAQVRLQLSQPEQSHYKTSSNS

SEQ ID NO: 373 - DNA, 1098 bp, Arabidopsis thaliana
  G153,family:MADS
aaaaaaaagaagcttctcctcttcctctgccttcttctttccatttattgcaaaccctgatcaattggttttggtgttagtcttttggggagagagatggggagagggaagatagttatacgaaggatcgataactctacaagtagacaagtgactttctccaagagaaggagtggtttgcttaagaaagctaaagagttatcgatcctttgtgatgcagaagttggtgttatcatattctctagcaccggaaagctctacgactacgcaagcaattcaagtatgaaaacaatcattgagcggtacaacagagtaaaagaggagcagcatcaacttctgaatcatgcctcagagataaagttttggcaaagagaggttgcaagtttgcagcagcagctccaatatctacaagaatgccacaggaaactagtgggagaggaactttctggaatgaatgctaacgacctacaaaaccttgaagaccagctagtaacaagtctaaaaggtgttcgtctcaaaaaggatcaacttatgacaaatgaaatcagagaacttaatcgtaagggacaaatcatccaaaaagagaatcacgagctacaaaatattgtagatataatgcgtaaggaaaatattaaattgcaaaagaaggttcatggaagaacaaatgcgattgaaggcaattcaagtgtagatccaataagcaatggaaccacaacatatgcaccaccgcaacttcaactcatacaactacaaccagctcctagagaaaaatcaatcagactagggctacaactttcctagcaaaacatgtgggacatcgaacaatatacgaaaagagtttgtatgtcatcttcagtaacaaccaagctggatcatttcattcttggttatgtaattctgtttactactttggagtttaatatgttatatgacaagtttctctttgtcaagttacttgtgtatgtacatcataaaataatgatgtgatgtgagtgccgaacatactagacatcattttaccgtgtgtttttttcgggtacattaaatgtacaaaatccagtctaattggcatttttatacaaaaaaaaaaaaaaaaaa

SEQ ID NO: 374 - protein, 234 aa, Arabidopsis thaliana
  G153,MADS domain coordinates 1-57
MGRGKIVIRRIDNSTSRQVTFSKRRSGLLKKAKELSILCDAEVGVIIFSSTGKLYDYASNSSMKTIIERYNRVKEEQHQLLNHASEIKFWQREVASLQQQLQYLQECHRKLVGEELSGMNANDLQNLEDQLVTSLKGVRLKKDQLMTNEIRELNRKGQIIQKENHELQNIVDIMRKENIKLQKKVHGRTNAIEGNSSVDPISNGTTTYAPPQLQLIQLQPAPREKSIRLGLQLS

SEQ ID NO: 375 - DNA, 985 bp, Arabidopsis thaliana
  G154,family:MADS
ctctacctatacatacacaaaccctttatcctcgaaagcttcctcctggttaggtttttatcaaacccttttagccaatcgggaaattaactaaagaagaagatatggtgaggggcaaaactcagatgaagagaatagagaatgcaacaagcagacaagtgactttctccaaaagaaggaatggtttgttgaagaaagcctttgagctctcagtgctttgtgatgctgaagtttctcttatcatcttctctcctaaaggcaaactttatgaattcgccagctccaatatgcaagataccatagatcgttatctgaggcatactaaggatcgagtcagcaccaaaccggtttctgaagaaaatatgcagcatttgaaatatgaagcagcaaacatgatgaagaaaattgaacaactcgaagcttctaaacgtaaactcttgggagaaggcataggaacatgctcaatcgaggagctgcaacagattgagcaacagcttgagaaaagtgtcaaatgtattcgagcaagaaagactcaagtgtttaaggaacaaattgagcagctcaagcaaaaggagaaagctctagctgcagaaaacgagaagctctctgaaaagtggggatctcatgaaagcgaagtttggtcaaataagaatcaagaaagtactggaagaggtgatgaagagagtagcccaagttctgaagtagagacgcaattgttcattgggttaccttgttcttcaagaaagtgatctccactcaacaaaaaaaacaaaaaaacaaactaagtaaaaacaggtttagcagtactgagagtgtataaggacaagtaacaaaactctaaagctgcttctctcttgttgtcttatttctctctcactctctctctctcagtcacttctttaatgattctgaactgcttgtgttatgtatctatgttcttacacttgcctctctagaatgtaattttgattatgttttgttttca

SEQ ID NO: 376 - protein, 214 aa, Arabidopsis thaliana
  G154,MADS domain coordinates 2-57
MVRGKTQMKRIENATSRQVTFSKRRNGLLKKAFELSVLCDAEVSLIIFSPKGKLYEFASSNMQDTIDRYLRHTKDRVSTKPVSEENMQHLKYEAANMMKKIEQLEASKRKLLGEGIGTCSIEELQQIEQQLEKSVKCIRARKTQVFKEQIEQLKQKEKALAAENEKLSEKWGSHESEVWSNKNQESTGRGDEESSPSSEVETQLFIGLPCSSRK

SEQ ID NO: 377 - DNA, 883 bp, Arabidopsis thaliana
  G157,family:MADS
gggcataacccttatcggagatttgaagccatgggaagaagaaaaatcgagatcaagcgaatcgagaacaaaagcagtcgacaagtcactttctccaaacgacgcaatggtctcatcgacaaagctcgacaactttcgattctctgtgaatcctccgtcgctgttgtcgtcgtatctgcctccggaaaactctatgactcttcctccggtgacgacatttccaagatcattgatcgttatgaaatacaacatgctgatgaacttagagccttagatcttgaagaaaaaattcagaattatcttccacacaaggagttactagaaacagtccaaagcaagcttgaagaaccaaatgtcgataatgtaagtgtagattctctaatttctctggaggaacaacttgagactgctctgtccgtaagtagagctaggaaggcagaactgatgatggagtatatcgagtcccttaaagaaaaggagaaattgctgagagaagagaaccaggttctggctagccagatgggaaagaatacgttgctggcaacagatgatgagagaggaatgtttccgggaagtagctccggcaacaaaataccggagactctcccgctgctcaattagccaccatcatcaacggctgagttttcaccttaaactcaaagcctgattcataattaagagaataaatttgtatattataaaaagctgtgtaatctcaaaccttttatcttcctctagtgtggaatttaaggtcaaaaagaaaacgagaaagtatggatcagtgttgtacctccttcggagacaagatcagagtttgtgtgtttgtgtctgaatgtacggattggatttttaaagttgtgctttctttcttcaaaaaaaaaaa

SEQ ID NO: 378 - protein, 196 aa, Arabidopsis thaliana
  G157,MADS domain coordinates 2-57
MGRRKIEIKRIENKSSRQVTFSKRRNGLIDKARQLSILCESSVAVVVVSASGKLYDSSSGDDISKIIDRYEIQHADELRALDLEEKIQNYLPHKELLETVQSKLEEPNVDNVSVDSLISLEEQLETALSVSRARKAELMMEYIESLKEKEKLLREENQVLASQMGKNTLLATDDERGMFPGSSSGNKIPETLPLLN

SEQ ID NO: 379 - DNA, 1136 bp, Arabidopsis thaliana
  G1750,family:AP2
cccttttcctctctttctccaaatctctgaaaattttcaccagaatctctgttctttttttcaccagaatctctctgtttaaaataataggtgatgatgatggatgagtttatggatcttagaccagtgaagtacacagagcacaagactgttatcagaaagtacactaaaaagtcgtctatggagaggaagaccagtgttcgtgactcggccaggttggttcgggtctcaatgacggatcgtgacgccactgattcatcaagcgacgaggaagagtttctgttccctcgaagacgtgtcaagagattgattaacgagatcagagtcgagcctagcagctcttccaccggcgacgtctctgcttctccgacgaaggaccggaaaagaatcaacgttgattctacggttcaaaagccctctgtttccggccaaaaccagaagaagtaccgcggcgtgagacagcgaccatggggaaaatgggcggcggagattcgtgatcctgagcaacgccggagaatctggctcggtacttttgcaacggcggaggaagctgccatcgtctacgacaacgcagcaatcaaacttcgtggccctgatgctcttaccaacttcaccgtacaaccagaaccagaaccggtacaagaacaagaacaagaaccggagagcaacatgtcggtttcgatatcagaatcaatggacgattctcaacatctatcatctccgacatcggttctcaactaccaaacatatgtctcggaggaaccaatcgatagtcttatcaaaccggttaaacaagagtttcttgaaccagaacaagagccaataagctggcatcttggagaaggtaatactaatactaatgatgattcatttccattggacattacatttctcgacaactatttcaatgaatcattaccagacatctccatcttcgatcaacctatgtctcctattcaaccaacagagaatgatttcttcaacgaccttatgttattcgatagcaacgcagaagaatactactcctccgagatcaaagagattggttcatcgttcaacgatcttgatgattctttgatatccgatctcttacttgtgtgatatttttgccattaaccaaacaccggtttggttgc

SEQ ID NO: 380 - protein, 335 aa, Arabidopsis thaliana
  G1750,AP2 domain coordinates 115-177
MMMDEFMDLRPVKYTEHKTVIRKYTKKSSMERKTSVRDSARLVRVSMTDRDATDSSSDEEEFLFPRRRVKRLINEIRVEPSSSSTGDVSASPTKDRKRINVDSTVQKPSVSGQNQKKYRGVRQRPWGKWAAEIRDPEQRRRIWLGTFATAEEAAIVYDNAAIKLRGPDALTNFTVQPEPEPVQEQEQEPESNMSVSISESMDDSQHLSSPTSVLNYQTYVSEEPIDSLIKPVKQEFLEPEQEPISWHLGEGNTNTNDDSFPLDITFLDNYFNESLPDISIFDQPMSPIQPTENDFFNDLMLFDSNAEEYYSSEIKEIGSSFNDLDDSLISDLLLV

SEQ ID NO: 381 - DNA, 1393 bp, Arabidopsis thaliana
  misc_feature (1385)..(1385): n is a, c, g, or t
  G1754,family:AP2
aacctttctcttctctgctaacgagaaaacaaaagctatcgtctttgctactactactactactattattacattgaatcctttgtgttcttcttcttcagctgctactttgttcgagtgctttcttacatgccgtcggagattgttgacaggaaaaggaagtctcgtggaacacgagatgtagctgagattctaaggcaatggagagagtacaatgagcagattgaggcagaatcttgtatcgatggtggtggtccaaaatcaatccgaaagcctcctccaaaaggttcgaggaagggttgtatgaaaggtaaaggtggacctgaaaacgggatttgtgactatagaggagttagacagaggagatggggtaaatgggttgctgagatccgtgagccagacggaggtgctaggttgtggctcggtactttctccagttcatatgaagctgcattggcttatgacgaggcggccaaagctatatatggtcagtctgccagactcaatcttcccgagatcacaaatcgctcttcttcgactgctgccactgccactgtgtcaggctcggttactgcattttctgatgaatctgaagtttgtgcacgtgaggatacaaatgcaagttcaggttttggtcaggtgaaactagaggattgtagcgatgaatatgttctcttagatagttctcagtgtattaaagaggagctgaaaggaaaagaggaagtgagggaagaacataacttggctgttggttttggaattggacaggactcgaaaagggagactttggatgcttggttgatgggaaatggcaatgaacaagaaccattggagtttggtgtggatgaaacgtttgatattaatgagctattgggtatattaaacgacaacaatgtgtctggtcaagagacaatgcagtatcaagtggatagacacccaaatttcagttaccaaacgcagtttccaaattctaacttgctcgggagcctcaaccctatggagattgctcaaccaggagttgattatggatgtccttatgtgcagcccagtgatatggagaactatggtattgatttagaccatcgcaggttcaatgatcttgacatacaggacttggattttggaggagacaaagatgttcatggatctacataagatttcaaatttcgtttgactggcctaagtttgtgattctgctccgagacggtgtagctgttactagctagaagctgcccttctttgaagctactgatactttctgatattaatggttgtgagacgtagtacatgtagttaggtaatgtaggacaagttcaaatatgattccttctttctttttcttgtgaatacatatgacatatgaagaagttcaaacgttgggtttnaaaaaaaa

SEQ ID NO: 382 - protein, 341 aa, Arabidopsis thaliana
  G1754,AP2 domain coordinates 69-136
MPSEIVDRKRKSRGTRDVAEILRQWREYNEQIEAESCIDGGGPKSIRKPPPKGSRKGCMKGKGGPENGICDYRGVRQRRWGKWVAEIREPDGGARLWLGTFSSSYEAALAYDEAAKAIYGQSARLNLPEITNRSSSTAATATVSGSVTAFSDESEVCAREDTNASSGFGQVKLEDCSDEYVLLDSSQCIKEELKGKEEVREEHNLAVGFGIGQDSKRETLDAWLMGNGNEQEPLEFGVDETFDINELLGILNDNNVSGQETMQYQVDRHPNFSYQTQFPNSNLLGSLNPMEIAQPGVDYGCPYVQPSDMENYGIDLDHRRFNDLDIQDLDFGGDKDVHGST

SEQ ID NO: 383 - DNA, 943 bp, Arabidopsis thaliana
  G1759,family:MADS
cgagaaaaggaaaaaaaaaaatagaaagagaaaacgcttagtatctccggcgacttgaacccaaacctgaggatcaaattagggcacaaagccctctcggagagaagccatgggaagaaaaaaactagaaatcaagcgaattgagaacaaaagtagccgacaagtcaccttctccaaacgtcgcaacggtctcatcgagaaagctcgtcagctttctgttctctgtgacgcatccgtcgctcttctcgtcgtctccgcctccggcaagctctacagcttctcctccggcgataacctggtcaagatccttgatcgatatgggaaacagcatgctgatgatcttaaagccttggatcatcagtcaaaagctctgaactatggttcacactatgagctacttgaacttgtggatagcaagcttgtgggatcaaatgtcaaaaatgtgagtatcgatgctcttgttcaactggaggaacaccttgagactgccctctccgtgactagagccaagaagaccgaactcatgttgaagcttgttgagaatcttaaagaaaaggagaaaatgctgaaagaagagaaccaggttttggctagccagatggagaataatcatcatgtgggagcagaagctgagatggagatgtcacctgctggacaaatctccgacaatcttccggtgactctcccactacttaattagccaccttaaatcggcggttgaaatcaaaatccaaaacatatataattatgaagaaaaaaaaaataagatatgtaattattccgctgataagggcgagcgtttgtatatcttaatactctctctttggccaagagactttgtgtgtgatacttaagtagacggaactaagtcaatactatctgttttaagacaaaaggttgatgaactttgtaccttattcgtgtgagaaaaaaaaaaaaaaaa

SEQ ID NO: 384 - protein, 196 aa, Arabidopsis thaliana
  G1759,MADS domain coordinates 2-57
MGRKKLEIKRIENKSSRQVTFSKRRNGLIEKARQLSVLCDASVALLVVSASGKLYSFSSGDNLVKILDRYGKQHADDLKALDHQSKALNYGSHYELLELVDSKLVGSNVKNVSIDALVQLEEHLETALSVTRAKKTELMLKLVENLKEKEKMLKEENQVLASQMENNHHVGAEAEMEMSPAGQISDNLPVTLPLLN

SEQ ID NO: 385 - DNA, 578 bp, Arabidopsis thaliana
  G1789,family:MYB-related
caaggactctgcgacatctgtgcaacatatcatttcctcagaatctctttcttttctaggtttattactacacaaaaccaaacatcatcaactttagttactaaacaatggcatcaggctcaatgtcttcttatggctctggctcatggactgttaagcagaacaaagcctttgagcgtgctctagcagtctatgaccaagacactccggaccgttggcacaatgttgctagagctgttggtggtaaaacaccagaagaagctaagagacagtatgaccttctagttcgtgacatcgaaagcatcgagaatggtcacgtgccattccctgactacaagactactacaggaaacagcaacagaggcaggctgcgtgatgaggaaaagaggatgagaagcatgaagctgcagtgagacaagaagcaacaaaacctaactacgtatgatcgtcaaaataaaagagaatcacttcagagagatgtgtttttttcaatgtctgacgaatcaatgtttttttcttgcaatttctcatgtttttccctaagaaatggtttttttttcgaggcaacaaaaaaaaaa

SEQ ID NO: 386 - protein, 101 aa, Arabidopsis thaliana
  G1789,MYB-related domain coordinates 12-62
MASGSMSSYGSGSWTVKQNKAFERALAVYDQDTPDRWHNVARAVGGKTPEEAKRQYDLLVRDIESIENGHVPFPDYKTTTGNSNRGRLRDEEKRMRSMKLQ

SEQ ID NO: 387 - DNA, 549 bp, Arabidopsis thaliana
  G1791,family:AP2
atgtacatgcaaaaacaaaaaccttaaaagctttcatggaacgtatagagtcttataacacgaatgagatgaaatacagaggcgtacgaaagcgtccatggggaaaatatgcggcggagattcgcgactcagctagacacggtgctcgtgtttggcttgggacgtttaacacagcggaagacgcggctcgggcttatgatagagcagctttcggcatgagaggccaaagggccattctcaattttcctcacgagtatcaaatgatgaaggacggtccaaatggcagccacgagaatgcagtggcttcctcgtcgtcgggatatagaggaggaggtggtggtgatgatgggagggaagttattgagttcgagtatttggatgatagtttattggaggagcttttagattatggtgagagatctaaccaagacaattgtaacgacgcaaaccgctagatcatcactacttacttacagtgtaatgtttttggagtaaagagtaataatcaatataatatactttagtttaggaaaaaaaaaaaaaaaaaaa

SEQ ID NO: 388 - protein, 139 aa, Arabidopsis thaliana
  G1791,AP2 domain coordinates 10-74
MERIESYNTNEMKYRGVRKRPWGKYAAEIRDSARHGARVWLGTFNTAEDAARAYDRAAFGMRGQRAILNFPHEYQMMKDGPNGSHENAVASSSSGYRGGGGGDDGREVIEFEYLDDSLLEELLDYGERSNQDNCNDANR

SEQ ID NO: 389 - DNA, 696 bp, Arabidopsis thaliana
  G1792,family:AP2
aatccatagatctcttattaaataacagtgctgaccaagctcttacaaagcaaaccaatctagaacaccaaagttaatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagataatcacgattagttttgttttgatattttatgtggcactgttgtggctacctacgtgcattatgtgcatgtataggtcgcttgattagtactttataacatgcatgccacgaccataaattgtaagagaagacgtactttgcgttttcatgaaatatgaatgttagatggtttgagtacaaaaaaaaaaaaaaaaaaaaaaa

SEQ ID NO: 390 - protein, 139 aa, Arabidopsis thaliana
  G1792,AP2 domain coordinates 16-80
MESSNRSSNNQSQDDKQARFRGVRRRPWGKFAAEIRDPSRNGARLWLGTFETAEEAARAYDRAAFNLRGHLAILNFPNEYYPRMDDYSLRPPYASSSSSSSSGSTSTNVSRQNQREVFEFEYLDDKVLEELLDSEERKR

SEQ ID NO: 391 - DNA, 615 bp, Arabidopsis thaliana
  G1797,family:MADS
actgaaatggtgagaggaaagatcgaaatcaagaagattgagaacgtgacaagtagacaagtcacgttttcgaagcgaaggagtggtctctttaagaaggctcatgagctttctgttctatgtgatgctcaagtggcagctatgatcttctctcagaaaggaagattatatgaattcgctagctccgatatcaggaacacgataaagcgatacgctgagtacaagagagagtattttgttgcagaaactcatcctatagagcaatacgtgcaggggctaaagaaggaaatggtgacaatggtgaaaaagattgaagtgcttgaagtccataaccggaagatgatgggacaaagtttggattcttgttcggtaaaagaactttcagagatagccacacagatagagaaaagccttcatatggttagattaagaaaggctaagttatatgaagatgagctacagaaactaaaagccaaggagagggaactcaaggacgagagagtcaggctttctctaaaggttggagaaagaccaatggggatgccgtcgggaagcaaagagaaagaggatgttgaaactgatctatttattggatttctgaagaaccgaccataa

SEQ ID NO: 392 - protein, 202 aa, Arabidopsis thaliana
  G1797,MADS domain coordinates 1-57
MVRGKIEIKKIENVTSRQVTFSKRRSGLFKKAHELSVLCDAQVAAMIFSQKGRLYEFASSDIRNTIKRYAEYKREYFVAETHPIEQYVQGLKKEMVTMVKKIEVLEVHNRKMMGQSLDSCSVKELSEIATQIEKSLHMVRLRKAKLYEDELQKLKAKERELKDERVRLSLKVGERPMGMPSGSKEKEDVETDLFIGFLKNRP

SEQ ID NO: 393 - DNA, 1356 bp, Arabidopsis thaliana
  G1806,family:bZIP
atgcagagcagcttcaaaaccgttcctttcactcctgatttctactctcaatcctcttacttcttcagaggagatagttgtcttgaggagtttcatcaaccagtcaatggttttcaccatgaagaagctatcgatttaagtccaaatgtcactattgcttcagctaacttacactacacgacgtttgatacggttatggattgtggtggtggtggtggtggcttgagggagagacttgaaggaggagaagaggagtgtttggacacagggcaattagtgtaccagaaagggacaagattagtaggaggaggagtaggagaagtgaacagcagttggtgtgattcggtttcagctatggctgataacagtcaacatactgacacttccacagatattgatactgatgacaagactcagttgaatggaggtcatcaagggatgctattggctacaaattgttcagatcaatccaatgtgaaatctagtgatcaaaggacacttcgtcgacttgctcagaaccgggaggctgctaggaaaagtcggttgaggaaaaaggcctatgttcagcaacttgagaatagtcgaatcaggcttgcacagctagaggaagagctcaaaagagctcgccaacagggatctttggttgaaagaggagtttcagcggatcacacgcatttggcagcaggaaatggtgtcttttcatttgaattggaatatacacgttggaaggaggaacatcaaagaatgatcaacgacttaagatcgggtgtgaattcgcagttaggtgacaacgatctacgcgttctagtggatgctgtgatgagtcactatgatgaaatattcaggctaaagggaattggcactaaagttgaagtctttcatatgctctcaggcatgtggaagacacctgccgagagatttttcatgtggttaggtggatttagatcatcagagttacttaagatattggggaaccatgtggatccattgacggaccagcagttgataggcatttgcaaccttcagcaatcgtctcaacaagcagaggatgcattgtcacaaggcatggaagctctacaacaatcacttctcgagacgctttcttctgcttctatgggtccaaactcttcagcaaatgttgcagattatatgggtcatatggctatggctatgggcaaacttggcactcttgaaaacttccttcgccaggctgatttattgaggcaacaaactctgcaacagcttcacagaattctcaccacacgacaagctgctcgcgcctttttggtcatccacgattatatttctcggcttagagcacttagctctctatggttagccagacctagagactaa

SEQ ID NO: 394 - protein, 451 aa, Arabidopsis thaliana
  G1806,bZIP domain coordinates 165-225
MQSSFKTVPFTPDFYSQSSYFFRGDSCLEEFHQPVNGFHHEEAIDLSPNVTIASANLHYTTFDTVMDCGGGGGGLRERLEGGEEECLDTGQLVYQKGTRLVGGGVGEVNSSWCDSVSAMADNSQHTDTSTDIDTDDKTQLNGGHQGMLLATNCSDQSNVKSSDQRTLRRLAQNREAARKSRLRKKAYVQQLENSRIRLAQLEEELKRARQQGSLVERGVSADHTHLAAGNGVFSFELEYTRWKEEHQRMINDLRSGVNSQLGDNDLRVLVDAVMSHYDEIFRLKGIGTKVEVFHMLSGMWKTPAERFFMWLGGFRSSELLKILGNHVDPLTDQQLIGICNLQQSSQQAEDALSQGMEALQQSLLETLSSASMGPNSSANVADYMGHMAMAMGKLGTLENFLRQADLLRQQTLQQLHRILTTRQAARAFLVIHDYISRLRALSSLWLARPRD

SEQ ID NO: 395 - DNA, 977 bp, Arabidopsis thaliana
  G1808,family:bZIP
aattcttcccttttccccttctaatttctctcatctctctattagaaaaattattagcaattatgttgtccactgcaccggccttttcattctccgaaccgggtttggttaatcaattctcgggtttccaaaccgggttcactccttgggaatgggattgctctgatctctttttcgtggaccaaatgtctcttgaaccggccatccctagtccttgttatggtgaatccgacactggttccgtcaaaattaattccggttctcatgacatgaaaaccggttctgacgaatcttgtgccggtttcgtcaaaattaatcctcgttgtgacgacgccgacatatcaaacgatctaccgtgctctcaagcagatgaaccggactcggacgacacaaaacaattgacagccatcacaaatttcggttcgggagagaataaccataaccggaaaaaaatgatccaaccggagatgaccgacgagcggaagaggaagaggatggagtcaaaccgggaatcagcgaaacggtcaagaatgcgtaaacaaagtcacattgataacttacgagagcaagtaaaccggttggatttagaaaaccgtgagctcgggaaccgactccggttagttttacaccagcttcaacgagtgaattccgacaataaccggctcgtgacagaacaagagatactccggctaagattgtcggagatgcgtcggattctgatcattagacaacttcaacaacagcaacaatgggaactacataaccggagaatgatcatgactgaacaaaaccaccctcatcttcaatgatagatcaaaatatttaagaagaaaaaatatcgaaaaacttagaacaataaccaaaaaaaaaaagcaaagcaaaaaagaaactctcgctatgtctctctatctctctatgtaaatgaaatgaaggttaggaagagaaaatgatagttttctaattttcctttccacttt

SEQ ID NO: 396 - protein, 248 aa, Arabidopsis thaliana
  G1808,bZIP domain coordinates 140-200
MLSTAPAFSFSEPGLVNQFSGFQTGFTPWEWDCSDLFFVDQMSLEPAIPSPCYGESDTGSVKINSGSHDMKTGSDESCAGFVKINPRCDDADISNDLPCSQADEPDSDDTKQLTAITNFGSGENNHNRKKMIQPEMTDERKRKRMESNRESAKRSRMRKQSHIDNLREQVNRLDLENRELGNRLRLVLHQLQRVNSDNNRLVTEQEILRLRLSEMRRILIIRQLQQQQQWELHNRRMIMTEQNHPHLQ

SEQ ID NO: 397 - DNA, 1059 bp, Arabidopsis thaliana
  G1842,family:MADS
actattacatgcctcttcctcgcttcaaaacggcaccgtttccacttgttattatttttctctctatcgtctaacaaaaaaaaaaactgacttgggattttttttcatttgtctagcccaaaagaagaagatagaaacgaagaaaaaaagcaaacacattttgggtccccggtggttaggatcaaattagggcacaaaccttatcggagaaagaagccatgggaagaagaaaagtcgagatcaagcgaatcgagaacaaaagcagtcgacaagtcactttctccaaacgacgcaaaggtctcatcgaaaaagctcgacaactttcaattctctgtgaatcttccatcgctgttgtcgccgtctccggttccggaaaactctacgactctgcctccggtgacaacatgtcaaagatcattgatcgttatgaaatacatcatgctgatgaacttaaagccttagatcttgcagaaaaaattcggaattatcttccacacaaggagttactagaaatagtccaaagcaagcttgaagaatcaaatgtcgataatgtaagtgtagattctctaatatctatggaggaacagctcgagactgctctgtcagtaattagagctaagaagacagaactaatgatggaggatatgaagtcacttcaagaaagggagaagttgctgatagaagagaaccagattctggctagccaggtggggaagaagacgtttctggttatagaaggtgacagaggaatgtcacgggaaaatggctccggcaacaaagtaccggagactctttcgctgctcaagtaatcaccatcatcaacggctgagctttcaccataaacttactcacagcctgattcagaagcttttacaaaattgtaaattataaaaagctgcataataatctcaacctttttatcttcctcgcgccaatgtggaaataaaggtaaaacaaaacgaagctcttttcttttatgcgaaagaattgtaaaactaagataaagctaccgatctttgttgtaccttagtagacaaatatcagagttcttgtgcttgt

SEQ ID NO: 398 - protein, 196 aa, Arabidopsis thaliana
  G1842,MADS domain coordinates 2-57
MGRRKVEIKRIENKSSRQVTFSKRRKGLIEKARQLSILCESSIAVVAVSGSGKLYDSASGDNMSKIIDRYEIHHADELKALDLAEKIRNYLPHKELLEIVQSKLEESNVDNVSVDSLISMEEQLETALSVIRAKKTELMMEDMKSLQEREKLLIEENQILASQVGKKTFLVIEGDRGMSRENGSGNKVPETLSLLK

SEQ ID NO: 399 - DNA, 818 bp, Arabidopsis thaliana
  G1843,family:MADS
cagacatcacaatcaaattaggtcagaagaattagtcggagaaaacagccatgggaagaagaaaagtagagatcaaacgaattgagaacaaaagctctcgacaagttactttctgtaaacgacgaaatggtctcatggagaaagctcgtcaactctcaattctttgtgaatcctccgtcgctcttatcatcatctctgccaccggaagactctacagcttctcctcaggtgatagcatggccaagatcctcagtcgttatgaattagaacaggctgatgatcttaaaaccttggatctagaagaaaaaactcttaattatctttcgcacaaggagttgctagaaacaatccaatgcaagattgaagaagcgaaaagcgataatgtaagtatagattgtctaaagtccctggaagagcagctcaagactgctctgtctgtaactagagctaggaagacagaactaatgatggagcttgtgaagacccatcaagagaaggagaagctgctgagagaggagaaccagagtttgactaaccagcttataaagatggggaagatgaagaagtctgtggaagcagaggatgcaagagcaatgtcaccggaaagtagctctgacaacaagccaccggagactctcctgcttctcaagtaaccaccatcaccaacgactgattcgaaaaataaaaattgtaaaaattatgatttgtagttcataaggaaagctacatactgtatgttaaaaatcctcttcttccccctgctacggaaaagtcatccaaggagatgcatcaaataaagtaattgatttttattgtta

SEQ ID NO: 400 - protein, 200 aa, Arabidopsis thaliana
  G1843,MADS domain coordinates 2-57
MGRRKVEIKRIENKSSRQVTFCKRRNGLMEKARQLSILCESSVALIIISATGRLYSFSSGDSMAKILSRYELEQADDLKTLDLEEKTLNYLSHKELLETIQCKIEEAKSDNVSIDCLKSLEEQLKTALSVTRARKTELMMELVKTHQEKEKLLREENQSLTNQLIKMGKMKKSVEAEDARAMSPESSSDNKPPETLLLLK

SEQ ID NO: 401 - DNA, 942 bp, Arabidopsis thaliana
  G1847,family:WRKY
atggaaatgatgaattgggagcggaggagtttgctaaacgagctaattcatggactaaaagcggccaagcagcttcagggttcgtcttctccatcgttgtcagcttcttcttcatatttgacgacggagataaaggagaatctcttacataacatagtttcttccttcaaaaaagctattttgatgctcaacggatccaccacacaacacaatccaacgatagagcttgcgcctgatcccctagctcatcccggaaaggttccaggatctccagcatcgatcaccggaaatccgagaagcgaagagtttttcaatgtaagatcgaaagaattcaacttaagttctaaaaagaggaagatgttgccaaagtggacagagcaagtgagaattagcccagagagaggcttagaaggacctcatgacgatatcttcagctggagaaaatatggccagaaagacattttgggcgccaaattcccaaggagttattacagatgcacatttcgtaacacacagtactgttgggctacgaaacaagtccaaagatcggacggtgatccaacgatcttcgaagtaacatacagaggaacacacacttgttcacaggggatcccacttccagagaaacgagaaaccaaaccaaaacacacagtagcagtaaattaccagaatctcagggccagtcttaccgtacgtaccggcggacttggaagcgaagctttctcattccccgtcacgtcgccgttatacacttacgagtccatcaacggtggtggaacgttttaccaccacgtgggaagttctggtccgtcggatttcactggattgatctcaacaaatacttccacaggaagttctccaatcttcgacgttaattttcaatttgatccaacggctgagattaacacaggcttccccacttttttccacaattcgatttaa

SEQ ID NO: 402 - protein, 313 aa, Arabidopsis thaliana
  G1847,WRKY domain coordinates 141-200
MEMMNWERRSLLNELIHGLKAAKQLQGSSSPSLSASSSYLTTEIKENLLHNIVSSFKKAILMLNGSTTQHNPTIELAPDPLAHPGKVPGSPASITGNPRSEEFFNVRSKEFNLSSKKRKMLPKWTEQVRISPERGLEGPHDDIFSWRKYGQKDILGAKFPRSYYRCTFRNTQYCWATKQVQRSDGDPTIFEVTYRGTHTCSQGIPLPEKRETKPKHTVAVNYQNLRASLTVRTGGLGSEAFSFPVTSPLYTYESINGGGTFYHHVGSSGPSDFTGLISTNTSTGSSPIFDVNFQFDPTAEINTGFPTFFHNSI

SEQ ID NO: 403 - DNA, 729 bp, Arabidopsis thaliana
  G1888,family:Z-CO-like
atgaagatttggtgtgctgtttgtgataaagaagaagcttcggtgttttgttgtgcggatgaagcagctctttgtaatggttgcgatcgccatgttcatttcgccaataaactagccgggaaacatctccggttctctctcacttctcctactttcaaagatgctcctctttgtgatatttgcggggagaggcgtgcattattattttgccaagaagacagagcaatactatgcagagaatgtgacattccaatacatcaagctaatgagcacactaagaaacacaatagattcctccttaccggcgttaagatctctgcctccccgtcagcctacccaagagcctccaattccaactctgctgctgcatttggtcgagccaaaacccgaccaaaatcagtatcgagcgaggtcccgagctcggcctccaatgaggtatttacgagctcttcttcgacgaccacgagcaattgctattatgggatagaagaaaactaccatcacgtgagcgattcggggtcgggatcgggttgtacaggtagtatatccgagtatttgatggagacattaccgggttggagagtggaggatttgcttgaacacccttcttgtgtctcctatgaggataacattattactaataacaataacagtgagtcttatagggtttatgatggttcttcacaattccatcatcaagggttttgggatcacaaacccttctcttga

SEQ ID NO: 404 - protein, 242 aa, Arabidopsis thaliana
  G1888,Z-CO-like domain coordinates 2-33,58-100
MKIWCAVCDKEEASVFCCADEAALCNGCDRHVHFANKLAGKHLRFSLTSPTFKDAPLCDICGERRALLFCQEDRAILCRECDIPIHQANEHTKKHNRFLLTGVKISASPSAYPRASNSNSAAAFGRAKTRPKSVSSEVPSSASNEVFTSSSSTTTSNCYYGIEENYHHVSDSGSGSGCTGSISEYLMETLPGWRVEDLLEHPSCVSYEDNIITNNNNSESYRVYDGSSQFHHQGFWDHKPFS

SEQ ID NO: 405 - DNA, 585 bp, Arabidopsis thaliana
  G1901,family:Z-Dof
atgcaggatctgacgtcagcagcagcgtattatcatcagtcgatgatgatgacgacggcgaaacagaaccaaccagagttaccagaacaagaacagctaaagtgtcctcgctgtgactcacctaacactaaattctgttactacaacaattacaatctgtcacagccccgtcacttttgcaaaaactgtcgtcgttactggactaaaggcggtgctcttcgtaacatccccgtcggtggtggaactcggaaaagcaacaaacgatccggttcttctccgtctagtaatctcaagaaccaaaccgtcgctgagaaacctgatcatcatgggtccgggtcagaagaaaaagaagagagagtttcgggtcaagaaatgaatccgacccggatgttatacgggttaccagttggagatccgaatggtgcgagttttagttcgttgttggcgtcgaatatgcagatgggtgggcttgtttacgagtccgggtcgcgttggttaccaggtatggatttgggtttgggttcggtacggaggagtgatgacacgtggactgacttagctatgaacagaatggagaagaattga

SEQ ID NO: 406 - protein, 194 aa, Arabidopsis thaliana
  G1901,Z-Dof domain coordinates NA
MQDLTSAAAYYHQSMMMTTAKQNQPELPEQEQLKCPRCDSPNTKFCYYNNYNLSQPRHFCKNCRRYWTKGGALRNIPVGGGTRKSNKRSGSSPSSNLKNQTVAEKPDHHGSGSEEKEERVSGQEMNPTRMLYGLPVGDPNGASFSSLLASNMQMGGLVYESGSRWLPGMDLGLGSVRRSDDTWTDLAMNRMEKN

SEQ ID NO: 407 - DNA, 1200 bp, Arabidopsis thaliana
  G1903,family:Z-Dof
atgtctaaatctagagatacggagataaagttgtttgggaggacaatcacatctcttttagatgtgaattgttatgatccgtcgtcgttgtcccctgttcacgatgtttcttctgatccaagcaaggaggattcgtcttcttcttcatcttcttgttctccaactattggaccaatcagggttccggttaaaaaaagtgagcaagagagtaacaaattcaaagatccatatatattatccgatctaaacgaaccaccaaaagcagtatctgagatttcatcaccaagaagttccaagaacaactgtgatcaacagagcgagatcacaacaacaactaccacaagtactacatcaggagagaaatcaacggctctcaagaaaccggacaagcttattccatgtcctagatgtgaaagcgcaaacaccaaattctgttattacaacaactacaacgtgaaccagccacgttacttctgcaggaactgtcagaggtattggacagctggtggatctatgaggaacgttcctgttggctcaggtcgtcgcaagaacaaaggatggccttcttcaaaccattacttgcaagtcacttctgaggattgtgataataataactcggggacgatccttagtttcggttcttcggagtcttcggttacagagactggtaagcatcagtcaggtgatacagcaaagataagtgctgattcagtttctcaagaaaataaaagctaccaagggtttcttcctccgcaagtaatgttacctaataattcttctccttggccttaccaatggagtccaacgggtcctaacgctagtttctaccctgtccccttctactggggatgcacggttccgatataccctacctcagagacttcatcatgtttaggaaaacggtcaagagatcaaactgaaggaagaatcaatgatactaatacaacaataactactacaagagcaagattggtctcagaatctcttagaatgaatatcgaagctagtaagagcgctgtgtggtctaagttaccgacaaaacccgagaaaaaaacgcaaggattcagtttgttcaatggatttgacacaaagggaaacagcaacagaagtagcttggtctccgaaacttctcacagtctacaagcaaaccctgcagcgatgtctagagctatgaacttcagggagagcatgcaacaataa

SEQ ID NO: 408 - protein, 399 aa, Arabidopsis thaliana
  G1903,Z-Dof domain coordinates 134-180
MSKSRDTEIKLFGRTITSLLDVNCYDPSSLSPVHDVSSDPSKEDSSSSSSSCSPTIGPIRVPVKKSEQESNKFKDPYILSDLNEPPKAVSEISSPRSSKNNCDQQSEITTTTTTSTTSGEKSTALKKPDKLIPCPRCESANTKFCYYNNYNVNQPRYFCRNCQRYWTAGGSMRNVPVGSGRRKNKGWPSSNHYLQVTSEDCDNNNSGTILSFGSSESSVTETGKHQSGDTAKISADSVSQENKSYQGFLPPQVMLPNNSSPWPYQWSPTGPNASFYPVPFYWGCTVPIYPTSETSSCLGKRSRDQTEGRINDTNTTITTTRARLVSESLRMNIEASKSAVWSKLPTKPEKKTQGFSLFNGFDTKGNSNRSSLVSETSHSLQANPAAMSRAMNFRESMQQ

SEQ ID NO: 409 - DNA, 1116 bp, Arabidopsis thaliana
  G1959,family:GARP
cgtcgactgtccataaatccggagcctgacccgacgtttgacccggatccgaaactcccacaatctccataccacccaaattcatctcccctaaagctttctctcactttcccgggaaaatcggcgaccaaaattggaaaatgtactcagcgattcgctcgcttccactcgatggtggacacgttggtggtgactaccatggacctcttgacggaaccaatcttcccggtgacgcttgtttggttttaacgactgaccctaaacctcgtctccggtggacaactgagcttcatgagagattcgttgacgccgttactcagctcggtggtcctgacaaagcgactcccaaaactattatgagaacaatgggagtgaagggtctcactctctaccacctcaaatcacatcttcagaaattccgcctagggaggcaagctggcaaagaatcaactgagaactctaaagatgcttcttgtgtaggggagagtcaggacacaggttcatcttcgacatcatcaatgagaatggcgcagcaggagcagaacgagggttaccaagtcaccgaagctctacgtgctcagatggaagtccaaagaagactacacgatcaattggaggtgcaacggaggctccagctgaggatagaggcacaaggaaaatacctgcaatcgattcttgaaaaagcttgcaaggcctttgacgagcaagctgctacttttgctggacttgaggctgctagggaagagctatcagagctagccatcaaagtctccaatagctctcaaggaacatcagtcccgtacttcgatgcaacaaagatgatgatgatgccatcgttgtcagagcttgcagtagcaatagacaacaaaaacaacatcacaaccaactgttcagtagaaagctctctgacttccatcacacatgggagctctatatctgctgcatcaatgaagaagcgtcaacgtggagacaatttgggcgtagggtatgaatcaggctggattatgcctagtagcaccattggataaagtttaggagagggaaaaagttcattatgggaaaggtagagataagatttaactgttctttacttgctttgaggggcctgcggccgct

SEQ ID NO: 410 - protein, 295 aa, Arabidopsis thaliana
  G1959,GARP domain coordinates 46-97
MYSAIRSLPLDGGHVGGDYHGPLDGTNLPGDACLVLTTDPKPRLRWTTELHERFVDAVTQLGGPDKATPKTIMRTMGVKGLTLYHLKSHLQKFRLGRQAGKESTENSKDASCVGESQDTGSSSTSSMRMAQQEQNEGYQVTEALRAQMEVQRRLHDQLEVQRRLQLRIEAQGKYLQSILEKACKAFDEQAATFAGLEAAREELSELAIKVSNSSQGTSVPYFDATKMMMMPSLSELAVAIDNKNNITTNCSVESSLTSITHGSSISAASMKKRQRGDNLGVGYESGWIMPSSTIG

SEQ ID NO: 411 - DNA, 1029 bp, Arabidopsis thaliana
  G2053,family:NAC
atggagaatccggtgggtttaagattccgtccgaccgacaaggagatcgtcgtcgattacctccgaccaaaaaactccgatagggacacgagtcatgttgatcgagtcattagcacagtcactatccgtagcttcgacccttgggagttaccttgccagtctaggatcaaactgaaagatgagtcttggtgtttcttcagccctaaggagaacaaatatggcagaggtgatcaacaaattagaaaaacgaaatctggttactggaagattactggcaaaccaaagcctatcttgcgtaaccgccaagagatcggtgagaaaaaggttttgatgttttacatgagtaaggaacttggtggatccaaatccgactgggttatgcacgagtaccatgctttctctcctactcagatgatgatgacatatacaatatgtaaagttatgtttaagggtgacgtgagagagatttcttcttcttctgcttcttatggtagtgaaattgagcagagtcgtgactctttaatccctcttcttgtgaacgattctgaggaagaagctcaaatcgaggatgctataccaatagaggaatgggaaacatggttgactgatgatggtgttgatgagcaggtgaatcatattatgaatatgaaagatgatcgcaacaaccacaggcctcaaaagccattgactggtgtcttgattgacgatagtagtgatgatgatgatgattctgatttgctatctccaacaacaaattctattgaaaattcgagcacttgtgatagttttggtagctcagaccaaatcaacttagtgtcactaactcaagaggtgagccaagctctgataaccagtattgatacacccgagaagattaagagtccttatgatgatgcacaagggactggggctggagggcaaaaattgggtcaagagactcgagagaagaaacgagctggtttctttcacaggatgatacaaatattcgtcaagaaaattcaccaatgttcttctatctcaagaacataa

SEQ ID NO: 412 - protein, 342 aa, Arabidopsis thaliana
  G2053,NAC domain coordinates 6-152
MENPVGLRFRPTDKEIVVDYLRPKNSDRDTSHVDRVISTVTIRSFDPWELPCQSRIKLKDESWCFFSPKENKYGRGDQQIRKTKSGYWKITGKPKPILRNRQEIGEKKVLMFYMSKELGGSKSDWVMHEYHAFSPTQMMMTYTICKVMFKGDVREISSSSASYGSEIEQSRDSLIPLLVNDSEEEAQIEDAIPIEEWETWLTDDGVDEQVNHIMNMKDDRNNHRPQKPLTGVLIDDSSDDDDDSDLLSPTTNSIENSSTCDSFGSSDQINLVSLTQEVSQALITSIDTPEKIKSPYDDAQGTGAGGQKLGQETREKKRAGFFHRMIQIFVKKIHQCSSISRT

SEQ ID NO: 413 - DNA, 1080 bp, Arabidopsis thaliana
  G2058,family:MADS
tctttgagtttgttggttgcattgatcggatataagagacatgggtcgagtgaaattggagataaaacgaatagaaaacacaacgaatcgacaagttacattctccaaaagacgaaatggtcttataaagaaagcttatgaattgtccattctttgtgacatcgacattgctctcctcatgttctctccctctgatcgccttagcctcttttcgggcaaaacaaggattgaagacgttttctctagatacatcaatctttctgatcaagaacgagagaatgctctagtattccccgatcaaagtcgacgcccagatttccagagcaaagagtatctactccggactttgcagcaactcaaggctgagaatgatattgctcttcaacttaccaaccctacagctatcaactccgacgtcgaggaacttgagcatgaagtttataagttacaacaacaacttctcatggcagaggaagaactaaggaaatacgaaccagatccaatcaggtttacaacaatggaagagtacgaaacttgtgagaagcagctcatggacaccttaacacgtgtcaatcaacgacgggaacatatattgagtcaagaccaattatcttcatatgaagcatctgctttacaacaacagcaaagcatgggtgggccttttggaaacgacgtcgttggaggatggctgactgaaaatgggcctaacgaagcccatttattcgacgcatcggcacattcagcaatgtatgaaactttattgcaaggaagtagctcaagctcgaaccaaaacaacattatgggtgaatccaatgtgtcaaatcataacggtgacatgtttcaagaatgggcccaagcctataattctactacggcccataacccttcgactctatttcctcctatgcagcatcagcatggactggtggttgatcccaatatagaagaaattgaaataccggttatgaagaaggatgcacaagcagaccacgaggtctccgactatgatataagaatgcctcagctcagtagccaataatctcaaggaatttcaattttaccatatattattgacataat

SEQ ID NO: 414 - protein, 332 aa, Arabidopsis thaliana
  G2058,MADS domain coordinates 2-57
MGRVKLEIKRIENTTNRQVTFSKRRNGLIKKAYELSILCDIDIALLMFSPSDRLSLFSGKTRIEDVFSRYINLSDQERENALVFPDQSRRPDFQSKEYLLRTLQQLKAENDIALQLTNPTAINSDVEELEHEVYKLQQQLLMAEEELRKYEPDPIRFTTMEEYETCEKQLMDTLTRVNQRREHILSQDQLSSYEASALQQQQSMGGPFGNDVVGGWLTENGPNEAHLFDASAHSAMYETLLQGSSSSSNQNNIMGESNVSNHNGDMFQEWAQAYNSTTAHNPSTLFPPMQHQHGLVVDPNIEEIEIPVMKKDAQADHEVSDYDIRMPQLSSQ

SEQ ID NO: 415 - DNA, 1828 bp, Arabidopsis thaliana
  G2110,family:WRKY
gagagctaataaaaaatttatcaaagaagactaatatggagaaggacgatttcttgaggagtggtcatggaagagaagaaagccatgatgagatgagaaaacttgattcatctcacgatgattctcatcaagaacacgaccatattataagatccaagttggactcaactaaagtcgaaatggatgaggctaaagaggaaaatcgaagactaaagtcatcattgagtaaaatcaagaaagattttgacatccttcaaacacaatacaaccaattaatggccaaacataacgaaccaaccaagttccaatcaaaagggcatcatcaagacaaaggcgaagatgaagacagagaaaaagttaacgaacgtgaagaacttgtctcgttgagcctaggcagacggttaaattcagaggttccaagtggttcgaataaagaagaaaaaaataaagatgttgaagaagcggaaggtgacagaaattatgatgataatgaaaaaagcagtattcaagggttgagtatggggattgaatacaaggctttgagtaatcctaatgagaagttagagattgatcataatcaagaaaccatgtcgttggagattagtaacaataataagatcagatcacaaaatagttttgggtttaagaatgatggagatgatcatgaagatgaagatgagattttgcctcaaaaccttgttaagaaaactagggtttcggtgagatcaagatgtgagacaccaacgatgaacgacggatgtcaatggaggaaatatggccagaaaatagctaaaggcaatccatgtccccgagcttactatcgttgcaccattgcagcttcttgtccagtaagaaaacaggtgcaaagatgttcagaagatatgtctatacttatctcaacgtacgaaggaacacataaccatccacttcccatgtcagcaactgccatggcctctgccacttccgctgccgcctccatgcttctctccggcgcctcctcctcctcatccgccgcagctgatcttcatggccttaacttctctctttccggcaacaacatcactccaaaacctaaaactcatttcctccaatccccttcttcttctggccatccgaccgtcactctcgacctcacaacctcctcctcgtcgcagcaaccgttcttatcaatgctcaatagattcagctctcctccaagtaatgtctcacgatctaatagttatccttcaaccaatctcaacttttcaaacaacaccaacacattgatgaattggggtggtggtggtaatcccagtgatcaataccgtgcagcttacggcaacattaacacccatcagcaatcaccttaccacaaaatcattcaaacccgaaccgccgggtcatctttcgatccgtttggaagatcatcttcatcacattctccacaaataaatcttgatcatatcggaatcaagaacatcatcagtcaccaagtgccatctttaccggctgaaacaatcaaggcaatcacgacagatccaagtttccaatcggctttggcgacagctctatcttccatcatgggcggcgatttaaagattgatcacaatgtgactagaaatgaagctgagaagagcccttaaagagaattgttatatatatgttcttatatactcagtacattggtaaatgggtttagactttcactagtttcctagttcatctatatattggttgtttaatcacaagtttattttgttgttggagtttatggaactaatgtgtacatatgaaactttagaacgaataaataaaacttggaattcctttttaaaaaaaaaaaaaaaaa

SEQ ID NO: 416 - protein, 528 aa, Arabidopsis thaliana
  G2110,WRKY domain coordinates 239-298
MEKDDFLRSGHGREESHDEMRKLDSSHDDSHQEHDHIIRSKLDSTKVEMDEAKEENRRLKSSLSKIKKDFDILQTQYNQLMAKHNEPTKFQSKGHHQDKGEDEDREKVNEREELVSLSLGRRLNSEVPSGSNKEEKNKDVEEAEGDRNYDDNEKSSIQGLSMGIEYKALSNPNEKLEIDHNQETMSLEISNNNKIRSQNSFGFKNDGDDHEDEDEILPQNLVKKTRVSVRSRCETPTMNDGCQWRKYGQKIAKGNPCPRAYYRCTIAASCPVRKQVQRCSEDMSILISTYEGTHNHPLPMSATAMASATSAAASMLLSGASSSSSAAADLHGLNFSLSGNNITPKPKTHFLQSPSSSGHPTVTLDLTTSSSSQQPFLSMLNRFSSPPSNVSRSNSYPSTNLNFSNNTNTLMNWGGGGNPSDQYRAAYGNINTHQQSPYHKIIQTRTAGSSFDPFGRSSSSHSPQINLDHIGIKNIISHQVPSLPAETIKAITTDPSFQSALATALSSIMGGDLKIDHNVTRNEAEKSP

SEQ ID NO: 417 - DNA, 485 bp, Arabidopsis thaliana
  G2133,family:AP2
atctcatcttcatccacccaaaaacatggattcaagagacaccggagaaactgaccagagcaagtacaaaggtatccgtcgtcggaaatggggaaaatgggtatcagagattcgtgtcccgggaactcgtcaacgtctctggttaggctctttctccaccgcagaaggcgctgccgtagcccacgacgtcgctttttactgcttgcaccgaccatcttccctcgacgacgaatcttttaacttccctcacttacttacaacctccctcgcctccaatatatctcctaagtccatccaaaaagctgcttccgacgccggcatggccgtggacgccggattccatggtgctgtgtctgggagtggtggttgtgaagagagatcttccatggcgaatatggaggaggaggacaaacttagtatctccgtgtatgattatcttgaagacgatctcgtttgatctatacgagtacgtttttagcagttaa

SEQ ID NO: 418 - protein, 143 aa, Arabidopsis thaliana
  G2133,AP2 domain coordinates 10-77
MDSRDTGETDQSKYKGIRRRKWGKWVSEIRVPGTRQRLWLGSFSTAEGAAVAHDVAFYCLHRPSSLDDESFNFPHLLTTSLASNISPKSIQKAASDAGMAVDAGFHGAVSGSGGCEERSSMANMEEEDKLSISVYDYLEDDLV

SEQ ID NO: 419 - DNA, 539 bp, Arabidopsis thaliana
  G2138,family:AP2
ggaaccctaatttccgcaaattcactatgaagcgtattatcagaatctcattcaccgacgcagaagccaccgattcttctagcgacgaagacacggaggagcgtggaggagcatcccagactcggcgccgtgggaaacgcctcgttaaagagatcgtaatcgatccttccgattccgccgataaactcgatgtctgcaaaacacggttcaaaatcaggatcccggcggaatttctcaagacggcgaaaacggagaagaaatatcgtggagtgaggcagaggccgtgggggaagtgggtggcggagatcagatgtggaagaggagcttgtaaaggacgacgtgatcgtctctggctgggtacttttaacactgctgaggaagctgctctagcttatgataacgcttcaattaagctgattggacctcacgcgccgaccaattttggtttgccggcggagaatcaagaggataagacggtgattggagcttctgaggttgctagaggcgcgtgaagtggggttggtaatttagttgttagc

SEQ ID NO: 420 - protein, 161 aa, Arabidopsis thaliana
  G2138,AP2 domain coordinates 76-148
MKRIIRISFTDAEATDSSSDEDTEERGGASQTRRRGKRLVKEIVIDPSDSADKLDVCKTRFKIRIPAEFLKTAKTEKKYRGVRQRPWGKWVAEIRCGRGACKGRRDRLWLGTFNTAEEAALAYDNASIKLIGPHAPTNFGLPAENQEDKTVIGASEVARGA

SEQ ID NO: 421 - DNA, 1024 bp, Arabidopsis thaliana
  G2143,family:HLH/MYC
tcttcttcttcctccataccttatctcaccagcttctccatatctctcaaagaaaaaacaaaccctataaattccacaaaaaaggaggatggataactccgacattctaatgaacatgatgatgcagcagatggagaagcttcctgaacacttctctaactcaaaccctaaccctaatccccataacattatgatgctttctgaatccaacacccacccgttcttcttcaaccccactcattctcatctcccatttgaccaaaccatgcctcaccaccaacccggtttaaatttccggtacgccccctccccgtcatcatctctcccggagaagagaggaggctgcagcgacaacgccaacatggcggcgatgagagagatgatctttcgaatagccgtgatgcagcctatacatattgatccggaatccgtaaagccaccaaagagaaagaacgtgaggatctctaaggatccacagagcgtggcagctcggcatcgaagggagaggataagcgagcggattcggattcttcagcggcttgttcccggtgggactaagatggatacggcgtcgatgctcgatgaggctatccattacgttaagtttctcaagaagcaagtgcagtcgctggaggaacatgcggtggttaacggcggaggaatgacggcggtggccggaggagcacttgcgggtactgttggtggaggatatggaggaaaagggtgtggcattatgcggtctgatcatcaccagatgcttggaaatgcacagattcttagatgatgatgatgttgatttttaaatatatatcatatgtttattaatatgacgggaaaaaatattatcgagggagttgaatttagtatcatgaaactatgagagcattttttttaaatgtttttatctttccgggtttcgataatgtttgggatggttaattaacaatttaaaagtcagacaacttggttgtaaagactaaagaataagcatagtttatcaatttatcattactaaatgaaatag

SEQ ID NO: 422 - protein, 231 aa, Arabidopsis thaliana
  G2143,HLH/MYC domain coordinates 122-179
MDNSDILMNMMMQQMEKLPEHFSNSNPNPNPHNIMMLSESNTHPFFFNPTHSHLPFDQTMPHHQPGLNFRYAPSPSSSLPEKRGGCSDNANMAAMREMIFRIAVMQPIHIDPESVKPPKRKNVRISKDPQSVAARHRRERISERIRILQRLVPGGTKMDTASMLDEAIHYVKFLKKQVQSLEEHAVVNGGGMTAVAGGALAGTVGGGYGGKGCGIMRSDHHQMLGNAQILR

SEQ ID NO: 423 - DNA, 1456 bp, Arabidopsis thaliana
  G2144,family:HLH/MYC
attagggttttgttgtcgtgagatttgattacacaaattgctgaatttggtttcgattattggtgttattgttttcgaagatttccagtgagtttccgtttatggatctgactggaggatttggagctagatccggcggtgttggaccgtgccgggaaccaataggccttgaatcgctacatctcggtgacgaatttcggcaactagtgacgactttacctcccgagaaccccggcggttcgttcacggctttgcttgagcttccacctacacaagcagtggagcttctccatttcactgattcttcgtcttctcaacaagcggcagtgacagggatcggtggagagattcctccgccgcttcactctttcggtgggacattggcttttccttctaactcagttctcatggagcgagcagctcgtttctcggtgattgccactgagcaacaaaacggaaatatctccggggagactccgacgagctctgtaccttccaattcaagtgctaatctcgacagagtcaagacggagcctgctgagaccgattcatctcagcggttgatttctgattcagcgattgagaatcaaatcccttgccctaaccagaacaatcgaaatgggaagaggaaagatttcgaaaagaagggtaaaagctcgacgaagaagaacaaaagctctgaagagaacgagaagctgccatatgttcacgttagagctcgtcgtggtcaagcaaccgatagccatagcttagcagaacgagcaagaagagagaagataaatgcacgaatgaagctgttacaggaactggtcccaggctgtgataagattcaaggtaccgcgctggtgctggatgaaatcattaaccatgtccagtcattacaacgtcaagtggagatgctatcaatgagacttgctgcggtaaaccccagaatcgacttcaatctcgacaccatattggcttcagaaaacggttctttaatggatgggagcttcaatgccgcaccaatgcagcttgcttggcctcagcaagccattgagaccgaacagtcctttcatcaccggcaactgcaacaaccaccaacacaacaatggccttttgacggcttgaaccagccggtatggggaagagaagaggatcaagctcatggcaatgataacagcaatttgatggcagtttctgaaaatgtaatggtggcttctgctaatttgcacccaaatcaggtcaaaatggagctgtaagttgggaaaacggtagagatcatgaatgtgtatatacatcgtataagctcgtttctctctatataaatataatcataaatatagatatctgttaagaaggtatcagtcatttgattcagagagacaacactggtatgattgtttcttattcttgtaccagatttcgacaatgtagaatttagtaggatatgatcattttgatctcgttatatata

SEQ ID NO: 424 - protein, 379 aa, Arabidopsis thaliana
  G2144,HLH/MYC domain coordinates 207-265
MDLTGGFGARSGGVGPCREPIGLESLHLGDEFRQLVTTLPPENPGGSFTALLELPPTQAVELLHFTDSSSSQQAAVTGIGGEIPPPLHSFGGTLAFPSNSVLMERAARFSVIATEQQNGNISGETPTSSVPSNSSANLDRVKTEPAETDSSQRLISDSAIENQIPCPNQNNRNGKRKDFEKKGKSSTKKNKSSEENEKLPYVHVRARRGQATDSHSLAERARREKINARMKLLQELVPGCDKIQGTALVLDEIINHVQSLQRQVEMLSMRLAAVNPRIDFNLDTILASENGSLMDGSFNAAPMQLAWPQQAIETEQSFHHRQLQQPPTQQWPFDGLNQPVWGREEDQAHGNDNSNLMAVSENVMVASANLHPNQVKMEL

SEQ ID NO: 425 - DNA, 777 bp, Arabidopsis thaliana
  G2145,family:HLH/MYC
atggacgtttttgttgatggtgaattggagtctctcttggggatgttcaactttgatcaatgttcatcatctaaagaggagagaccgcgagacgagttgcttggcctctctagcctttacaatggtcatcttcatcaacatcaacaccataacaatgtcttatcttctgatcatcatgctttcttgctccctgatatgttcccatttggtgcaatgccgggaggaaatcttccggccatgcttgattcttgggatcaaagtcatcacctccaagaaacgtcttctcttaagaggaaactacttgacgtggagaatctatgcaaaactaactctaactgtgacgtcacaagacaagagcttgcgaaatccaagaaaaaacagagggtaagctcggaaagcaatacagttgacgagagcaacactaattgggtagatggtcagagtttaagcaacagttcagatgatgagaaagcttcggtcacaagtgttaaaggcaaaactagagccaccaaagggacagccactgatcctcaaagcctttatgctcggaaacgaagagagaagattaacgaaaggctcaagacactacaaaaccttgtgccaaacgggacaaaagtcgatataagcacgatgcttgaagaagcggtccattacgtgaagttcttgcagcttcagattaagttgttgagctcggatgatctatggatgtacgcaccattggcttacaacggcctggacatggggttccatcacaaccttttgtctcggcttatgtga

SEQ ID NO: 426 - protein, 258 aa, Arabidopsis thaliana
  G2145,HLH/MYC domain coordinates 170-227
MDVFVDGELESLLGMFNFDQCSSSKEERPRDELLGLSSLYNGHLHQHQHHNNVLSSDHHAFLLPDMFPFGAMPGGNLPAMLDSWDQSHHLQETSSLKRKLLDVENLCKTNSNCDVTRQELAKSKKKQRVSSESNTVDESNTNWVDGQSLSNSSDDEKASVTSVKGKTRATKGTATDPQSLYARKRREKINERLKTLQNLVPNGTKVDISTMLEEAVHYVKFLQLQIKLLSSDDLWMYAPLAYNGLDMGFHHNLLSRLM

SEQ ID NO: 427 - DNA, 1104 bp, Arabidopsis thaliana
  G216,family:MYB-(R1)R2R3
atgaacggagaaatctctcgtccgccggagctaatatcgtcccggaatccttgcaagagttttgaaaatgcaatacacaaagcagttgaggcagagctcgccgagctagcgaaaagcgacgcgaacggcggcggaaagagtaaagtgaaaggaccttggttgccggagcaagatgaggctctcacgaggcttgtgaaaatgtgtgggccgaggaactggaatctaatctcccgtggaatcccaggtcgctctggtaaatcttgccgattacgttggtgtaatcagctcgatcctatcctcaaacgaaaacctttctctgatgaggaggagcatatgataatgtctgcacaggcggttcttgggaacaaatggtctgtgattgctaaactcttacctgggagaacagataatgccattaagaatcattggaactctaatcttagacgtaaaccagcagaacaatggaagattcctctattgatgtctaatacagagatagtatatcaactgtatccatcaatggtcagaaggatatcaaacgcatcccccaaagaacatctacctcaagaagaagaaaccggtgtattaagtgatgataaaatggatgatgaagcaaaggagcctcctcgggagcaaaatagtaaaactggtgtttatcgtccagtggctcgaatgggtgctttcagtgtctgtaaaccaggatacatggctccatgtgagggacctttggttcaagcatcaagacctgactcattggctggtaaatttcttcagtctctttgttatgatcctattatcccttcaaaatgcggtcacggttgctgcaaccatcaagacagcacaacactgtcatcatcgtcggtgctgggatcagagtttgtggattatgaggaacattcttctgcagagttagataaagaattgatctctatatcaaatgacctgaacaatactgcttggattaggagtgggaaggaagctgaacagagtttgaaggctgatgatcagtttcgtcgtgagtatgctcactcgaaatttagtggaatggtaaacaatggtgtatcaagtcagatggtgagacaagatttaagggctttgagctaa

SEQ ID NO: 428 - protein, 367 aa, Arabidopsis thaliana
  G216,MYB-(R1)R2R3 domain coordinates 49-151
MNGEISRPPELISSRNPCKSFENAIHKAVEAELAELAKSDANGGGKSKVKGPWLPEQDEALTRLVKMCGPRNWNLISRGIPGRSGKSCRLRWCNQLDPILKRKPFSDEEEHMIMSAQAVLGNKWSVIAKLLPGRTDNAIKNHWNSNLRRKPAEQWKIPLLMSNTEIVYQLYPSMVRRISNASPKEHLPQEEETGVLSDDKMDDEAKEPPREQNSKTGVYRPVARMGAFSVCKPGYMAPCEGPLVQASRPDSLAGKFLQSLCYDPIIPSKCGHGCCNHQDSTTLSSSSVLGSEFVDYEEHSSAELDKELISISNDLNNTAWIRSGKEAEQSLKADDQFRREYAHSKFSGMVNNGVSSQMVRQDLRALS

SEQ ID NO: 429 - DNA, 1389 bp, Arabidopsis thaliana
  G2316,family:PMR
atggagagtagagaggattcattcatatcaaaagagaagaaatcaactatgaaaaaagaaaaacaagcgattgcatcacaaagaaatagaagaagagtaattaaaaatagaggaaacgggaagcgattgattgcatcattatcacaacgaaagagaagaagaatacctagaggaagaggaaacgagaaggcagtgtttgcaccatcatcactaccaaacgatgttgtagaggaaatcttcttacgacttccggtgaaagcaataatccaactaaagtctctctcaaaacaatggagatcgacgatcgagtctcgcagttttgaagagagacacttgaagatcgtcgagcgatcacgcgtggattttccacaggtcatggtcatgtctgaagaatattccttgaaaggaagtaaaggtaatcagcctcgtccagatacagacattggttttagtacaatctgtttggaatcggcttctattctgtcctccactcttatcactttccctcaaggatttcaacaccggatctatgcttctgaaagctgtgacggacttttctgcatccattccctaaaaacacaagccatatatgtagttaacccggccactcggtggtttcgacaacttcctccggctaggtttcagattttgatgcaaaagttataccccactcaagacacttggattgacataaaaccagtagtctgttatacagcattcgtgaaggccaatgattacaaattagtgtggttgtataattctgatgcctcgaatccaaacctgggagttacaaagtgcgaggtttttgattttagggcaaacgcttggaggtacttgacttgcactccaagctatcggatattccctgaccaagtaccagcagctacaaacgggtctatttattggttcacggaaccatataatggcgaaataaaagtggtagctctcgatattcacactgaaacgtttcgtgtgctacctaagattaatccggccattgctagttcagatcctgaccatatcgacatgtgcactttggataatggtttgtgcatgtcgaaaagagaatcggatacgttggtccaagagatatggaggttaaaatcatcagaagactcatgggagaaggtttataccatagatttgctttcttgttcttcttcttctttatctgagttccgcgatggatttaattggacacgaaaagatttggttgagccatccacaccagtggcgatatgcaaggacaagaagattctgctctcacatcgctatgcccgcaatatgatcaaatacgatccccaaataaaatctatcagtttaatttaccaacctcctttgtgtagaagatatgcttcttattttcagagtttgatctctcatatataa

SEQ ID NO: 430 - protein, 462 aa, Arabidopsis thaliana
  G2316,PMR domain coordinates 96-282
MESREDSFISKEKKSTMKKEKQAIASQRNRRRVIKNRGNGKRLIASLSQRKRRRIPRGRGNEKAVFAPSSLPNDVVEEIFLRLPVKAIIQLKSLSKQWRSTIESRSFEERHLKIVERSRVDFPQVMVMSEEYSLKGSKGNQPRPDTDIGFSTICLESASILSSTLITFPQGFQHRIYASESCDGLFCIHSLKTQAIYVVNPATRWFRQLPPARFQILMQKLYPTQDTWIDIKPVVCYTAFVKANDYKLVWLYNSDASNPNLGVTKCEVFDFRANAWRYLTCTPSYRIFPDQVPAATNGSIYWFTEPYNGEIKVVALDIHTETFRVLPKINPAIASSDPDHIDMCTLDNGLCMSKRESDTLVQEIWRLKSSEDSWEKVYTIDLLSCSSSSLSEFRDGFNWTRKDLVEPSTPVAICKDKKILLSHRYARNMIKYDPQIKSISLIYQPPLCRRYASYFQSLISHI

SEQ ID NO: 431 - DNA, 896 bp, Arabidopsis thaliana
  G2345,family:CAAT
agatcagatcaaatctctctctccatctccgtctcctcctccaatcatcatttctctctccgtctcccgctctttttcgaattctccttcttcttcagggtttctgagatggccgaatcgcaaaccggtggtggtggtggtggaagccatgagagtggcggtgatcagagcccgaggtctttgaatgttcgtgagcaggacaggtttcttccgattgctaacataagccgtatcatgaagagaggtttacctctaaatggcaaaatcgctaaagatgctaaagagactatgcaggaatgtgtctctgaattcatcagcttcgtcaccagcgaggctagtgataagtgccaaagagagaaaaggaagaccatcaatggagatgatttgctttgggctatggccactttaggattcgaagattacatcgatcccctcaaggtttacctgatgcgatatagagagatggagggtgacactaaaggatcaggaaaaggcggggaatcgagtgcaaagagagatggtcaaccaagccaagtgtctcagttctcgcaggttcctcaacaaggctcattctcacagggtccttatggaaactctcaaggttcgaatatgatggttcaaatgccgggcacagagtagtactaggacactattcatcacaatcttccgagactcgactatgcctgttgtgtctgagaatctgagtgatccactttccatagatatggattgtggtatctcagtttttgggagagagaagatttgtatatgattgtgttgtagggagaagagtttggtttgcttatgataagaattgaaaagcaccttttttttcttttgactgttatgtttcttaggttttggtcttaagcagaagctatttaccaaaaaaaaaa

SEQ ID NO: 432 - protein, 176 aa, Arabidopsis thaliana
  G2345,CAAT domain coordinates 28-117
MAESQTGGGGGGSHESGGDQSPRSLNVREQDRFLPIANISRIMKRGLPLNGKIAKDAKETMQECVSEFISFVTSEASDKCQREKRKTINGDDLLWAMATLGFEDYIDPLKVYLMRYREMEGDTKGSGKGGESSAKRDGQPSQVSQFSQVPQQGSFSQGPYGNSQGSNMMVQMPGTE

SEQ ID NO: 433 - DNA, 1370 bp, Arabidopsis thaliana
  G2394,family:RING/C3H2C3
gcggttgtgtgttacgagagctagagttgaatttgctttggtcaacacaatggggacttgtggttgctgacttttgtgattttcagttttctacttggatttagatggatgtttcttccattgtgcgaaatacaaccctaactgatcaagatcctttgttaatggaccacggtaaccgcgagcacatcgttgacattacaagcaatgacgaggaggactcttcatcaagatcttctctcgatgagcttactcctcaaggtaactcacatcaaggtgaagagacagtattatcatcatcaaatgctacacaacaacacccaactcatccatctcctcctcagcaaagaccaacttcttctaggagaggagataacgggaatggtcgccgtactaggagtccattgaattctggcctctggatctcagttgagttagttgtcactgtcgctcagattgttgcagccattgtagttatggttctggctaaagatgaacatcctgaagcgccattatttacttgggttattggatatacttgtggctgtctagccactctccctattctctattggcgttttcgcacttataatcgagctacagggcaagactcttcacaacgtgctacctcttctcaaggcaatagtgagtccacaccatatacagcagtctcagttgctcaagcagcagatgaagaaaatagcactggcgtgagtgcagcacctagaaacaatcaagttggggaaagcttaagaacaaggctcaacgggctagtggaccacttcaagatggcgattgattgtttctttgcggtgtggtttgttgtggggaatgtatggatatttggaggtcactcatctccttctgattctcctaaactgtacaggttatgcatagcgttccttactttcagttgcattggatatgcaatgccattcatactatgtgcaaccatatgttgttgtttgccttgcttaatctcggttctcggatttcgagagaacttctcacaaactagaggagccactgccgaggccatcaacgcattgcctgtctacaggttcaaatcaaaaagtagaaatgatttggagttttcagaagaaggtgaaggtggatttcttctcttggggtctcagaagaaacgtcttatatcaggcgaggatgccagctgttgcatctgcttgactagatatggagacgacgaacaagttagagagctgccatgctcacatgtcttccatgtagactgtgtagacaaatggcttaaaatcaatgcgacttgccctctctgcaaaaatgaggttggagaaagcagcagtgcttcctcatagacaaaagctgagttgatcgcaactgtttggaatttgggatcc

SEQ ID NO: 434 - protein, 407 aa, Arabidopsis thaliana
  G2394,RING/C3H2C3 domain coordinates 355-395
MDVSSIVRNTTLTDQDPLLMDHGNREHIVDITSNDEEDSSSRSSLDELTPQGNSHQGEETVLSSSNATQQHPTHPSPPQQRPTSSRRGDNGNGRRTRSPLNSGLWISVELVVTVAQIVAAIVVMVLAKDEHPEAPLFTWVIGYTCGCLATLPILYWRFRTYNRATGQDSSQRATSSQGNSESTPYTAVSVAQAADEENSTGVSAAPRNNQVGESLRTRLNGLVDHFKMAIDCFFAVWFVVGNVWIFGGHSSPSDSPKLYRLCIAFLTFSCIGYAMPFILCATICCCLPCLISVLGFRENFSQTRGATAEAINALPVYRFKSKSRNDLEFSEEGEGGFLLLGSQKKRLISGEDASCCICLTRYGDDEQVRELPCSHVFHVDCVDKWLKINATCPLCKNEVGESSSASS

SEQ ID NO: 435 - DNA, 957 bp, Arabidopsis thaliana
  G24,family:AP2
cggacgcgtgggcaaatattaaaataaaaagtgtcggtgaattctcaatctttgtcttctttcgtcgtctctttaaaactcctccgtccctccttattatgtaaccgtctcgccgtcaaattttcaaaatctctccctccgttcataaacccagatcgaaatttatggttttgtaatttttttaccggcggttatggagacggaagcggcggtgacagcgacggttacggcggcgacgatggggattgggacgaggaagagagatctgaaaccgtataaaggaatacgaatgaggaaatgggggaaatgggtggcggagatacgggaaccgaataagagatcaaggatctggttaggttcttatgcgacgcctgaagcggcggcgagagcttacgacactgctgttttttacctccgtggtccttcagcgaggcttaattttccggagcttttggctggacttactgtttctaacggcggaggaagaggtggtgatttatcggcggcgtatattaggagaaaagcggcggaggttggtgctcaggttgatgcgcttggagcgacggtggttgtgaataccggcggcgagaatcgcggtgattacgagaagattgagaattgtcgtaagagcggtaacgggtcattggaacgggtcgatttgaataaattacccgacccggaaaattcggatggtgatgatgacgaatgtgtgaaaagaagatagaaaaaataaaaagtagttgtagaaggagagacgagaatgtttgtctttaagatgcgctgttgccgctaacatgcgctttcgattttagtgttaaacatgcgcctccattgtttttgggttttgttttcgtcgtcgataatcaaagattttaaaacacaattctcaaatttttcacttgttacaaactagatttgcatgatctttgtattaacgaataacgattaagtcctaaa

SEQ ID NO: 436 - protein, 176 aa, Arabidopsis thaliana
  G24,AP2 domain coordinates 25-92
METEAAVTATVTAATMGIGTRKRDLKPYKGIRMRKWGKWVAEIREPNKRSRIWLGSYATPEAAARAYDTAVFYLRGPSARLNFPELLAGLTVSNGGGRGGDLSAAYIRRKAAEVGAQVDALGATVVVNTGGENRGDYEKIENCRKSGNGSLERVDLNKLPDPENSDGDDDECVKRR

SEQ ID NO: 437 - DNA, 762 bp, Arabidopsis thaliana
  G2421,family:MYB-(R1)R2R3
atggagggttcgtccaaagggttgaggaaaggtgcatggactgctgaagaagatagtctcttgaggcagtgtattggtaagtatggagaaggcaaatggcatcaagttcctttaagagctgggctaaatcggtgcaggaaaagttgtagactaagatggttaaactatttgaagccaagtatcaagagaggaaaatttagttctgatgaagttgatcttcttcttcgtcttcataagcttctaggaaataggtggtccttgattgctggtcgattacctggtcggaccgctaatgatgtcaagaactactggaacacccatctgagtaagaagcatgaaccgtgttgtaaaactaagataaaaaggataaatattataacccctcctaatacaccggcccaaaaagtttgtgaaaatagtatcacatgtaacaaagatgatgagaaagatgattttgtggataattttatggttggagataatatatggttggagcgtttgctagacgagggccaagaggtagatgtgctggttacagaagcggcggcaacagaaaaggagggcactttggcgtttgacgttgagcaactttggaatttgttcgatggagagactgtgatctttgattagtgtttataaacgtttgtgttctcttgtttgtgaggtttctctatttaatttagtatctattttctaaattaactaatatcttatagtattttaggcaaaccttatgtttccgtttctgtgcggccgctctag

SEQ ID NO: 438 - protein, 209 aa, Arabidopsis thaliana
  G2421,MYB-(R1)R2R3 domain coordinates 9-110
MEGSSKGLRKGAWTAEEDSLLRQCIGKYGEGKWHQVPLRAGLNRCRKSCRLRWLNYLKPSIKRGKFSSDEVDLLLRLHKLLGNRWSLIAGRLPGRTANDVKNYWNTHLSKKHEPCCKTKIKRINIITPPNTPAQKVCENSITCNKDDEKDDFVDNFMVGDNIWLERLLDEGQEVDVLVTEAAATEKEGTLAFDVEQLWNLFDGETVIFD

SEQ ID NO: 439 - DNA, 741 bp, Arabidopsis thaliana
  G2422,family:MYB-(R1)R2R3
atgggcgaatcacccaaagggttgagaaaaggtacatggactactgaagaagatattctcttgaggcaatgcattgataagtatggagaaggcaaatggcatcgagttcctttaagaactggtctcaatcggtgccgaaagagttgtagacttagatggttgaattatttgaagccaagtattaagagaggaaaactctgctccgatgaagttgatcttgttcttcgccttcataaacttctaggaaataggtggtccttgatcgctggtagattgcctggtcggactgctaatgatgtcaagaattactggaacactcatttgagtaagaagcacgatgaacgatgctgtaagacgaagatgataaacaaaaacattacttctcatcctacttcatcggcccaaaaaatcgatgttttaaagcctcggcctcgatccttctccgataaaaatagttgcaacgatgtcaatatcttgccaaaagttgacgttgttcctttacatcttggactcaacaacaattatgtttgtgaaagtagtattacatgtaacaaagatgagcaaaaagataagcttattaatattaatctattggatggagataatatgtggtgggaaagtttactggaggcagatgtgttgggtccagaagctacggaaacagcaaagggtgtgaccttaccgcttgactttgagcaaatttgggctcggtttgatgaagagactttagaactgaattag

SEQ ID NO: 440 - protein, 246 aa, Arabidopsis thaliana
  G2422,MYB-(R1)R2R3 domain coordinates 9-110
MGESPKGLRKGTWTTEEDILLRQCIDKYGEGKWHRVPLRTGLNRCRKSCRLRWLNYLKPSIKRGKLCSDEVDLVLRLHKLLGNRWSLIAGRLPGRTANDVKNYWNTHLSKKHDERCCKTKMINKNITSHPTSSAQKIDVLKPRPRSFSDKNSCNDVNILPKVDVVPLHLGLNNNYVCESSITCNKDEQKDKLININLLDGDNMWWESLLEADVLGPEATETAKGVTLPLDFEQIWARFDEETLELN

SEQ ID NO: 441 - DNA, 1017 bp, Arabidopsis thaliana
  G243,family:MYB-(R1)R2R3
atgtcaaagagaccatattgtatcggagaaggactgaagaaaggagcatggactacagaagaggataaaaaactcatctcttatatccacgaccacggtgaaggaggctggcgtgacattccagaaaaagctgggctgaaacggtgtggaaagagttgtagattacggtggactaactatttgaaaccagatatcaagagaggagagtttagctatgaggaagagcagattatcatcatgcttcatgcatctcgtggcaataagtggtctgtcatagctagacatttgccaaaaagaacggataacgaggtcaaaaactattggaacacacatctcaagaaacgtttaatcgatgatggcattgatcccgtgacacacaagccactagcttcttctaaccctaatccagttgagcccatgaagttcgatttccaaaagaaatccaatcaggatgagcactcttcacagtctagttctacaactccagcatctcttcccctttcctcgaatttgaacagtgttaaatccaaaattagcagtggtgagacgcagatagaaagtggtcacgtgagctgcaagaaacgttttggacgatcgagctctacatcaaggttgttaaacaaagttgcagctagagcttcttccatcggcaacatcttatcaacatccatagaaggaaccttgagatctcccgcatcatcttcaggactcccagactcgttctctcaatcatatgagtacatgatcgataacaaagaagatctcggtacgagcattgatctcaacatccccgagtatgatttcccacagtttcttgagcaactcattaacgatgacgacgaaaatgagaacattgttgggcccgaacaagatctccttatgtccgatttcccatcaacattcgttgatgaagacgatatacttggagacataaccagttggtcaacttatcttcttgaccatcccaattttatgtatgaatcggatcaagattccgacgagaagaacttcttatga

SEQ ID NO: 442 - protein, 338 aa, Arabidopsis thaliana
  G243,MYB-(R1)R2R3 domain coordinates 12-128
MSKRPYCIGEGLKKGAWTTEEDKKLISYIHDHGEGGWRDIPEKAGLKRCGKSCRLRWTNYLKPDIKRGEFSYEEEQIIIMLHASRGNKWSVIARHLPKRTDNEVKNYWNTHLKKRLIDDGIDPVTHKPLASSNPNPVEPMKFDFQKKSNQDEHSSQSSSTTPASLPLSSNLNSVKSKISSGETQIESGHVSCKKRFGRSSSTSRLLNKVAARASSIGNILSTSIEGTLRSPASSSGLPDSFSQSYEYMIDNKEDLGTSIDLNIPEYDFPQFLEQLINDDDENENIVGPEQDLLMSDFPSTFVDEDDILGDITSWSTYLLDHPNFMYESDQDSDEKNFL

SEQ ID NO: 443 - DNA, 890 bp, Arabidopsis thaliana
  G2456,family:YABBY
ctatctgaacatcgatcagtcatatcttttcaatcaaatcaaagccctcctctctctcttactccttttttgttttaaatcaagaaaaagactccatgtcgagcatgtccatgtcgtcctcctcagctccagcttttccaccggaccacttctcatctacggaccagctctgttacgtccattgcagcttctgcgacactgtccttgctgtgagtgttcctccgagtagtttgttcaagacggtgacggtcagatgcggccactgttcgaaccttttgtcggtgaccgtgagcatgagagctcttcttcttccatccgtttccaaccttggccattcctttttacctccccctcctcctcctcctcctccaaatcttttggaggaaatgcgaagcggagggcagaatataaacatgaacatgatgatgagccatcacgcttcagctcaccacccgaacgagcatttggttatggcgactcgcaacggaagatcagtggatcatctacaagagatgcctcggccaccaccagccaatagacccccagagaagcgacaaagagtaccatctgcatacaaccgattcatcaaagaggagatccaacgtataaaggcaggcaaccctgatatcagccacagagaagccttcagtgctgctgccaaaaactgggctcatttccctcacatacactttggactcatggctgaccatcctcccacgaagaaggctaacgtgcgccaacaggaaggagaggatgggatgatgggaagagaagggttttacggttcagctgccaacgttggggtggcccataactagctacgaagactttcccaatcttttgtaatcttcaaaatgtggttactttcagctcaaacttaacgcggccgc

SEQ ID NO: 444 - protein, 240 aa, Arabidopsis thaliana
  G2456,YABBY domain coordinates 25-63,148-195
MSSMSMSSSSAPAFPPDHFSSTDQLCYVHCSFCDTVLAVSVPPSSLFKTVTVRCGHCSNLLSVTVSMRALLLPSVSNLGHSFLPPPPPPPPPNLLEEMRSGGQNINMNMMMSHHASAHHPNEHLVMATRNGRSVDHLQEMPRPPPANRPPEKRQRVPSAYNRFIKEEIQRIKAGNPDISHREAFSAAAKNWAHFPHIHFGLMADHPPTKKANVRQQEGEDGMMGREGFYGSAANVGVAHN

SEQ ID NO: 445 - DNA, 849 bp, Arabidopsis thaliana
  G2467,family:HS
atggacccgtcgtcaagctccagagcacggtcaatgccaccgccggtgcctatggagggattgcaggaagcagggccttctccttttctaacaaagacgttcgagatggttggtgatccaaacacaaaccacattgtgtcttggaacaggggaggcatcagttttgtcgtgtgggatccacattccttctcggccactattctgcctctatacttcaagcacaacaacttctccagctttgtcagacaacttaacacttatggattcagaaagatcgaggcagagagatgggagtttatgaatgaaggtttcttgatgggtcagagggaccttctcaaaagcatcaagcgacgaacctcctcttcttcccctccttcgcttaactactctcagtctcagcccgaggctcatgacccaggcgtcgagcttccgcagctccgagaagagaggcatgtcctaatgatggagatctcgacgctcagacaggaggagcaaagagcgagaggctacgtccaagccatggagcagaggattaatggagcagagaagaaacagaggcatatgatgtccttcttgaggcgtgcggtggagaatccttcccttctgcagcagattttcgagcagaagagagaccgagaggaggccgcgatgattgatcaggctggcttgatcaaaatggaagaggtggagcacctgtcggagctggaggctctggcgcttgagatgcaaggatatggacggcaacggactgatggtgtggagagggagcttgacgacgggttttgggaagagttactcatgaacaatgaaaactccgacgaagaagaggcgaatgtgaagcaagattag

SEQ ID NO: 446 - protein, 282 aa, Arabidopsis thaliana
  G2467,HS domain coordinates 28-119
MDPSSSSRARSMPPPVPMEGLQEAGPSPFLTKTFEMVGDPNTNHIVSWNRGGISFVVWDPHSFSATILPLYFKHNNFSSFVRQLNTYGFRKIEAERWEFMNEGFLMGQRDLLKSIKRRTSSSSPPSLNYSQSQPEAHDPGVELPQLREERHVLMMEISTLRQEEQRARGYVQAMEQRINGAEKKQRHMMSFLRRAVENPSLLQQIFEQKRDREEAAMIDQAGLIKMEEVEHLSELEALALEMQGYGRQRTDGVERELDDGFWEELLMNNENSDEEEANVKQD

SEQ ID NO: 447 - DNA, 1024 bp, Arabidopsis thaliana
  G251,family:MYB-(R1)R2R3
acccacgcgtccggagaagtaaaattttctattgcagagagaaagagagttagagaaagagagagagagatgaaacttgtgcaagaagaataccgtaaaggaccgtggacagaacaggaggacatcctcttggtcaactttgtccacttgttcggagatcgaagatgggattttgtagcgaaagtttcaggtttaaacagaacaggaaagagttgcaggttaaggtgggttaattacctgcatcctggtctcaaacgtggtaagatgactccacaagaagagcgtttagtccttgagcttcacgccaaatggggaaacaggtggtcaaaaattgcccggaaattaccggggagaacagataatgagataaagaactactggaggactcatatgaggaagaaggctcaagagaagaagcgacctatgtctcctacttcctcatcttcaaactgttgctcatcatctatgaccactactactactcaagacactggaggctccaacgggaaaatgaatcaagaaggcgaagacgggtactactccatggatgacatatggagagagattgatcagtctggacacgttattaaaccggtaaaagacaactactactcagagcaaagttgttacttgaatttccctcctctggcttctccaacatgggaaagttccttggagtctatatggaacatggatgcagatgaaagtaagatgtcttcttttgctattgatcagtttcctctaagttttgaacatggtagtggtcgcctttagtctaggatttgattcatttggaatgtttatatgtgcagcatatatatgttatcaaacgacgactgtagtagtttcctatgacttacatcaaaaaacaccacccactgtactaatctcataagtagtcatcatcctatgcctttgtttagtttgtagagtgagtgaaaagatgtgtaatacaagtcagaactctaattccaaaataaatagacttttgaagcttctgtgaaaaaaaaaaaaaaaaaaaaaa

SEQ ID NO: 448 - protein, 234 aa, Arabidopsis thaliana
  G251,MYB-(R1)R2R3 domain coordinates 9-112
MKLVQEEYRKGPWTEQEDILLVNFVHLFGDRRWDFVAKVSGLNRTGKSCRLRWVNYLHPGLKRGKMTPQEERLVLELHAKWGNRWSKIARKLPGRTDNEIKNYWRTHMRKKAQEKKRPMSPTSSSSNCCSSSMTTTTTQDTGGSNGKMNQEGEDGYYSMDDIWREIDQSGHVIKPVKDNYYSEQSCYLNFPPLASPTWESSLESIWNMDADESKMSSFAIDQFPLSFEHGSGRL

SEQ ID NO: 449 - DNA, 1547 bp, Arabidopsis thaliana
  G256,family:MYB-(R1)R2R3
tcgtgagcgttgtgtttctcctcaacattcaaagtctttagtgaaacctctcttgtaagaagccaaaaaaataaagagaaagattcaaagaaggaaagaaattgaggatgactatttcaagtccaaagagagattttgagtagaccctcttcacaaaaatccaatcttagagtcttactagttactatctagcttacatacacagagacactataccaaaaatccaatcttattagagtacttactatatagcttacacatacacacacacgaagtactatttcaacgatcaagagcgtgtgcgtgaggatatgggtagaccaccttgttgcgagaagattgaggtgaagaaaggaccatggactcccgaagaagacataatcttggtctcttatatccaacaacacggccctggaaattggagatctgtccctgcaaacaccggtttgctaaggtgtagcaagagttgcagacttagatggactaattaccttcgtcccgggatcaaacgaggaaatttcactcaaccggaagagaagatgatcatccaccttcaagctcttttgggaaatagatgggcagctatagcatcatatctacctcagaggaccgacaatgatatcaagaactactggaacactcatcttaaaaagaaactagtgatgatgaagtttcaaaatggtatcatcaacgaaaacaaaaccaatctggcaacagatatttcgtcttgtaataataacaacaatggatgtaatcacaacaaaaggaccaccaacaaaggccaatgggagaaaaaacttcaaacagacatcaacatggccaaacaagccttattccaagccttgtcacttgaccaaccatcttcattgatccctcccgatcctgactcaccaaaacctcatcatcattctaccaccacttatgcctcaagcacagataacatctctaaattactccagaactggacaagctcatcatcgtcaaagcctaacacttcatcagtctccaacaaccggagctcaagccccggtgaaggaggactttttgatcatcactctttgttctcatcgaattcagaatctggatcagttgatgagaagctgaatttgatgtccgagacaagcatgttcaaaggtgagagcaagccagacatagacatggaagctacacctactactactactactactactgatgatcaaggctcgttgtcattgatcgagaaatggttgtttgatgatcaaggcttggttcagtgtgatgatagtcaagaagatctcatcgacgtgtctttagaggagttaaaataatgataacaacagtcaagatttgttctataagaaaataaaacgtatagaacaacgataaagctagctaggtttattaatttttctttcttttgtcttttctctatgatctttagttacattttattttactgtgtggcttgcttgtggtcaagtcgatgaagatcaaactgtgatatactatttatatgtaaagtactataaagttaagagtagttgaataaaaaaaaaaaaaaaaaa

SEQ ID NO: 450 - protein, 332 aa, Arabidopsis thaliana
  G256,MYB-(R1)R2R3 domain coordinates 14-116
MGRPPCCEKIEVKKGPWTPEEDIILVSYIQQHGPGNWRSVPANTGLLRCSKSCRLRWTNYLRPGIKRGNFTQPEEKMIIHLQALLGNRWAAIASYLPQRTDNDIKNYWNTHLKKKLVMMKFQNGIINENKTNLATDISSCNNNNNGCNHNKRTTNKGQWEKKLQTDINMAKQALFQALSLDQPSSLIPPDPDSPKPHHHSTTTYASSTDNISKLLQNWTSSSSSKPNTSSVSNNRSSSPGEGGLFDHHSLFSSNSESGSVDEKLNLMSETSMFKGESKPDIDMEATPTTTTTTTDDQGSLSLIEKWLFDDQGLVQCDDSQEDLIDVSLEELK

SEQ ID NO: 451 - DNA, 1008 bp, Arabidopsis thaliana
  G2578,family:MADS
atgggtcgggtgaaattagaaatcaagagaatagagaacacaacgaatcgacaagttacgttttcaaaacgtagaaatggtttgattaagaaagcttatgaattgtcgattctttgtgatatcgacattgctcttatcatgttctctccttctgatcgccttagccttttctccggaaaaactcggattgaagacgttttttcaagattcatcaatcttcctaaacaagaacgagagagtgctctatactttcctgaccagaatagacgcccagatattcaaaacaaagagtgtctactaaggattctgcagcaactcaagactgaaaatgacatcgctcttcaagtcacgaaccctgcagctatcaactctgacgtcgaggaacttgagcatgaagtttgtaggttacaacaacaactccaaatggcagaagaagaactaaggagatacgaaccggatccaataagattcacgaccatggaggaatacgaagtttctgagaagcaacttctcgacactctaacacatgttgtccaacggcgagaccatctcatgagcaaccatttatcttcgtatgaagcatctactatgcaaccaaacattggtggtccttttgtaaatgacgtcgttgaaggttggctacctgaaaatgggaccaatcaaacccatttgtttgatgcatcggcccattctaaccaactcagagaattatcatcggcaatgtatgaaccattgttgcaaggaagtagctcaagctcgaaccaaaacaacatgagtgaatgccacgtgacgaaccacaatggtgaaatgttccctgagtgggctcaggcgtattcatcctcggccttattcgcttctatgcagcaacagcatgaaggtgtgggtcccagtatagaagagatgatgccagctcagcagagtgatattccgggagtgacggcggagacacaagttgatcatgaagtctccgactatgaaacaaaggttcctcaactcagtagccaataa

SEQ ID NO: 452 - protein, 335 aa, Arabidopsis thaliana
  G2578,MADS domain coordinates 1-57
MGRVKLEIKRIENTTNRQVTFSKRRNGLIKKAYELSILCDIDIALIMFSPSDRLSLFSGKTRIEDVFSRFINLPKQERESALYFPDQNRRPDIQNKECLLRILQQLKTENDIALQVTNPAAINSDVEELEHEVCRLQQQLQMAEEELRRYEPDPIRFTTMEEYEVSEKQLLDTLTHVVQRRDHLMSNHLSSYEASTMQPNIGGPFVNDVVEGWLPENGTNQTHLFDASAHSNQLRELSSAMYEPLLQGSSSSSNQNNMSECHVTNHNGEMFPEWAQAYSSSALFASMQQQHEGVGPSIEEMMPAQQSDIPGVTAETQVDHEVSDYETKVPQLSSQ

SEQ ID NO: 453 - DNA, 750 bp, Arabidopsis thaliana
  G2586,family:WRKY
atgttctccaacatcgatcaaacagctgtggcagcactcctccgtggccaaggatgcgctaacagtctcaagaggctcctcgaaaaccacaagttaagctcagattcaacagagccgctcatctacaccatactcaattctttctcacttgctctctcttttgtggacccgcctagtcttctaccacacaatgagtcttctcttcaaaacatgacaagtcatgttcttcagagatcatcaaagaaaaaatattatggagcagaagatttagagtattacagagacgaatccccgactccacgccccgatgacggcttcacctggaggaaatatggacaaaaaactatcaaaacctcaccgtaccaaaggtgttactatcggtgtacctatgcaaaagaccaaaactgcaatgctagaaagcgggtgcagatgatccaagataaccctccagtgtacagaactacttatttgggaaaacatgtgtgtaaagctgttgcagttcatgatgatacatatggttctgaaatgataaaattcgaccaagttgtatctgaatcggttatgcctcaactcgcaacaattgacgaacaagcaattaccatggaggacgaagccatagaccatatcatgaaccaagaatgtgatattaatgatttttctgtggatgatgacccattttgggctagtcaatttcctccattttcatcggaagacattatgttttttgacaatattgctaatcttgattag

SEQ ID NO: 454 - protein, 249 aa, Arabidopsis thaliana
  G2586,WRKY domain coordinates 103-160
MFSNIDQTAVAALLRGQGCANSLKRLLENHKLSSDSTEPLIYTILNSFSLALSFVDPPSLLPHNESSLQNMTSHVLQRSSKKKYYGAEDLEYYRDESPTPRPDDGFTWRKYGQKTIKTSPYQRCYYRCTYAKDQNCNARKRVQMIQDNPPVYRTTYLGKHVCKAVAVHDDTYGSEMIKFDQVVSESVMPQLATIDEQAITMEDEAIDHIMNQECDINDFSVDDDPFWASQFPPFSSEDIMFFDNIANLD

SEQ ID NO: 455 - DNA, 765 bp, Arabidopsis thaliana
  G2587,family:WRKY
atggtttccaacattgatcacaaggctatggaagcactcctccgtggccaaggatgcgctaacaacctcaagattctccttgaaaacggcgaaataagctcagtttcaacagaaccactcatccacaccattctcgattctttctcacttgctctgtcttttatggattctcctaatcatccaccataccatgaatcctcttctcataacatggcaagtcatatgtcccggagatcatctaagcaagtacaacatcgcagaaaactttgtgtagcagaaggtttagtgaattacaatcacgattcccggactatgtgccccaatgatggcttcacctggaggaaatatggacaaaaaaccattaaagcctcagcgcacaaaaggtgttactatcggtgtacctatgcaaaagaccaaaactgcaatgctacaaagcgggtgcagaagatcaaagacaaccctccagtgtacagaaccacttacttgggaaaacatgtgtgtaaagcttttgcagttcatgatgatacatatagttccacgatgattcgattcgaccaagttgttcctgaaccgattatgccgcagctcacaacaattgaccaccaagtaattaccgtggaggaaaactccgcagaacatatcatgaaccaagaatgtgatattaatgattatttggtggatgatgacccattttgggctagtcaatttcccccgtttccatcgagtgacacaatgttcttggaaaacatttctgcttttgattag

SEQ ID NO: 456 - protein, 254 aa, Arabidopsis thaliana
  G2587,WRKY domain coordinates 108-165
MVSNIDHKAMEALLRGQGCANNLKILLENGEISSVSTEPLIHTILDSFSLALSFMDSPNHPPYHESSSHNMASHMSRRSSKQVQHRRKLCVAEGLVNYNHDSRTMCPNDGFTWRKYGQKTIKASAHKRCYYRCTYAKDQNCNATKRVQKIKDNPPVYRTTYLGKHVCKAFAVHDDTYSSTMIRFDQVVPEPIMPQLTTIDHQVITVEENSAEHIMNQECDINDYLVDDDPFWASQFPPFPSSDTMFLENISAFD

SEQ ID NO: 457 - DNA, 1470 bp, Arabidopsis thaliana
  G265,family:HS
ctttggtcttggaagccaaatcaaacctttccttcaatcctcaaattttcgaaaattttctcttttgctttacgttctctcaattcttatttgtaagaaagtttgttcctttaatcaatcaaatcaaagagacttttgaagattgtttcccaatttgcgtcaatcgggatcgagtcaaatctgaaatcttctccactcatcatctgactataagacttaatcaagggactttttgttcgggtttggttttaaacgtcttggattcgaagtggttaaggtatggatgaaaataatggaggttcaagctcacttccacctttccttactaaaacatatgaaatggttgatgattcttcttctgactcggtcgttgcttggagcgaaaacaacaaaagcttcatcgtcaagaatccagcagagttttcaagagaccttcttccgagattcttcaagcataagaatttctcaagtttcatccgtcagcttaatacatatggttttcgaaaagtagatcctgagaaatgggaattcttgaatgatgattttgttagaggtcgaccttaccttatgaagaacattcatagacgaaaaccggttcatagccactcgttagtgaatctacaagcgcaaaatcctttgacggaatcagaaagacggagcatggaggatcagatagaaagactgaaaaatgagaaagaaggccttcttgcggagttacagaaccaagagcaagaacggaaagagtttgagctgcaagtaacgacattgaaagatcggttacaacatatggaacaacatcagaaatcaatagtggcatatgtttcacaggttttgggaaaaccaggactttcactaaacctcgaaaaccatgagagaagaaaaagaagatttcaagagaactctcttcctccaagcagttcacacatagaacaggtcgaaaagttagaatcttcgctaacgttttgggagaatcttgtatcggaatcatgcgagaagagcggtttgcagtcatcaagcatggatcatgatgcagctgagtcaagtctaagtattggcgatacacgacccaaatcatcgaagattgatatgaactcagagccgcccgttaccgttactgcgcctgctccaaaaacaggcgttaacgatgacttttgggaacaatgtttgacagagaaccctggatcaaccgagcaacaagaagttcagtcagagagaagagatgtcggtaatgataataatggtaataagattggaaatcaaaggacgtattggtggaattcagggaatgtaaataacattacagagaaagcttcttgacatgaatgaggtttttgtaaaatagttttcttttggttccactgagattattgtatgtgttcattatttattactctgtttctgtaaaaacaaatctctctattgtttgaggcaggagtgacataaatgcatatgcagaattggtttcaaaaa

SEQ ID NO: 458 - protein, 345 aa, Arabidopsis thaliana
  G265,HS domain coordinates 13-104
MDENNGGSSSLPPFLTKTYEMVDDSSSDSVVAWSENNKSFIVKNPAEFSRDLLPRFFKHKNFSSFIRQLNTYGFRKVDPEKWEFLNDDFVRGRPYLMKNIHRRKPVHSHSLVNLQAQNPLTESERRSMEDQIERLKNEKEGLLAELQNQEQERKEFELQVTTLKDRLQHMEQHQKSIVAYVSQVLGKPGLSLNLENHERRKRRFQENSLPPSSSHIEQVEKLESSLTFWENLVSESCEKSGLQSSSMDHDAAESSLSIGDTRPKSSKIDMNSEPPVTVTAPAPKTGVNDDFWEQCLTENPGSTEQQEVQSERRDVGNDNNGNKIGNQRTYWWNSGNVNNITEKAS

SEQ ID NO: 459 - DNA, 1424 bp, Arabidopsis thaliana
  G2657,family:AT-hook
gaaaataaaaccttaccaaatcaatcaaagaataagatgaagaacaaaattccagcttgatgtattttgtgaaaacattattattcttttcctcttctatctagagtctctcctaggtcaaattatcaaaatcaattctcatctcaacatagaatggatccagttcaatctcatggatcacaaagctctcttcctcctcctttccatgctagagatttccaattacatcttcaacaacaacaacaacatcaacaacaacatcaacaacaacaacaacaacagttctttctccaccatcatcagcaaccacaaagaaaccttgatcaagatcacgagcagcaaggagggtcaatattgaatagatctatcaagatggatcgcgaagagacaagcgataacatggacaacatcgctaataccaacagcggtagcgaaggtaaagagatgagtttacacggaggagaaggaggaagcggtggtggaggaagtggagaacagatgacaagaaggccaagaggaagaccagcaggatccaagaacaaacctaaagctccaataatcataacaagagacagcgcaaacgcgcttcgaactcacgtcatggagataggagacggatgtgacatagttgactgtatggctacgttcgctagacgccgccaaagaggcgtttgcgttatgagcggtacaggaagcgttactaacgtcactatacgtcagcctggatcgccacctggctcggtggttagccttcacggccggtttgaaatcctctctctttcgggatctttcttgcctccgcctgcgccgcctgcagccaccggactaagcgtttacctagccggaggacaagggcaggtcgttggaggtagtgtggtgggacctttgttgtgttcgggtcctgtggtggttatggcggcttcttttagcaatgcggcgtacgaaaggctgcctttggaagaagatgagatgcagacgccagttcaaggaggcggtggaggaggaggaggtggtggtggaatgggatctcccccgatgatgggacagcaacaagctatggcagctatggcggcggctcaaggactaccaccgaatcttcttggttcggttcagttgccaccgccacaacagaatgatcagcagtattggtctacgggtcggccaccgtattgattattagattgctattattatatatacatgatcaatggaatatatacatatatagctatgtatttgtatatatgtagctatttactaatagatcttacatatatataaagcaagctaacatggaatcattaaaaggaggtctacgaagtatgacgtgaagttgaagacggcgataatattgaagatcaacaattcagtagatggttttcaggttcttctttgttttttttgtttcctttgggttcgtttta

SEQ ID NO: 460 - protein, 339 aa, Arabidopsis thaliana
  G2657,AT-hook domain coordinates 118-126,127-270
MDPVQSHGSQSSLPPPFHARDFQLHLQQQQQHQQQHQQQQQQQFFLHHHQQPQRNLDQDHEQQGGSILNRSIKMDREETSDNMDNIANTNSGSEGKEMSLHGGEGGSGGGGSGEQMTRRPRGRPAGSKNKPKAPIIITRDSANALRTHVMEIGDGCDIVDCMATFARRRQRGVCVMSGTGSVTNVTIRQPGSPPGSVVSLHGRFEILSLSGSFLPPPAPPAATGLSVYLAGGQGQVVGGSVVGPLLCSGPVVVMAASFSNAAYERLPLEEDEMQTPVQGGGGGGGGGGGMGSPPMMGQQQAMAAMAAAQGLPPNLLGSVQLPPPQQNDQQYWSTGRPPY

SEQ ID NO: 461 - DNA, 819 bp, Arabidopsis thaliana
  G2665,family:Z-C2H2
atggattcttccagcggaaaaccaagatcatctgattcctcatgcatcatttctgcatccaccagtcttcaattttcagattccccaaagctgagcctagaaaattacaacatagacacagtagcagcacaagaagaagatgatcatgaccaaaaagaaggagtggaaggtataaagcttgaccttatgctagcaggatatgattctagtcaaccacagctcaatcaagaactcaatctcctcgactgcttagagacaggtgtagtcactccgagttttaacgggtcaacttccactgaacagaagctcttctcatgcaactactgtcaaagaacattctacagctcacaggcgcttggtggtcaccaaaacgcccacaaaagagaaaggactttggcaaagcgagggcaacggatggcatctgccgcagctttcgggcatccatatggttttgctccggtcccgttccatggacagtacagcaacagaaccttgggtattcaggcacactcaatgagtcataagccaagttcatataacgtttacggtggtgagtatggtcagatcaactggtcaaggataccactagttcagcaaccagcaatagcaaaactaacttcaacagagaatcattataatcatcatcagatgatgattgctccaccgttgacttccacatgtgaaaacatcggtaggttcgatgtaggaaggattccagtagagtttccaacttctgaactatggcagagaggcgaggaattgttgaagccagctgaagaagagaagcagaagaaccttgacttgtcccttaaactttga

SEQ ID NO: 462 - protein, 272 aa, Arabidopsis thaliana
  G2665,Z-C2H2 domain coordinates 106-126
MDSSSGKPRSSDSSCIISASTSLQFSDSPKLSLENYNIDTVAAQEEDDHDQKEGVEGIKLDLMLAGYDSSQPQLNQELNLLDCLETGVVTPSFNGSTSTEQKLFSCNYCQRTFYSSQALGGHQNAHKRERTLAKRGQRMASAAAFGHPYGFAPVPFHGQYSNRTLGIQAHSMSHKPSSYNVYGGEYGQINWSRIPLVQQPAIAKLTSTENHYNHHQMMIAPPLTSTCENIGRFDVGRIPVEFPTSELWQRGEELLKPAEEEKQKNLDLSLKL

SEQ ID NO: 463 - DNA, 294 bp, Arabidopsis thaliana
  G2721,family:MYB-related
atggcgtcaaactcaagaagttcaatctcaccatggacgtttagtcaaaacaagatgttcgagagggccttggcagtttacgacaaggacacacccgaccgatggcacaatgtggcaaaagctgtcggagggaaaactgtagaagaagtgaagcgccactatgacattctcgtcgaggatctcatcaacatcgagactggtcgtgtccctttgcccaattacaagaccttcgaatctaactcaagaagcatcaatgactttgacacaaggaaaatgaagaatttgaagatctaa

SEQ ID NO: 464 - protein, 97 aa, Arabidopsis thaliana
  G2721,MYB-related domain coordinates 10-60
MASNSRSSISPWTFSQNKMFERALAVYDKDTPDRWHNVAKAVGGKTVEEVKRHYDILVEDLINIETGRVPLPNYKTFESNSRSINDFDTRKMKNLKI

SEQ ID NO: 465 - DNA, 1016 bp, Arabidopsis thaliana
  G2779,family:HLH/MYC
aaagaagttgtcagaaaaaaaaaaaaaaaaaagtgtcaagaagatcatatctcaattcattatattatggcaaatttcgagaatctttcttctgattttcagacaatagccatggatatatattcttccataactcaagctgcagatctaaacaacaacaacagtaaccttcattttcaaacatttcatccttcctctacttctctcgaatcgctcttccttcatcatcatcaacaacaattacttcactttcccggaaactctccagacagtagtaacaatttctcttcaacttcaagtttcctccatagtgatcacaacatcgtcgatgagaccaagaagagaaaagctttgttacctactttgtcttcatcagagactagcggcgtctccgataatacgaatgttattgccactgaaacaggttctttgagaagaggtaagaggttgaagaagaagaaggaagaagaagacgagaaagagagagaagttgttcatgtgagagccagaagaggccaagccactgatagccacagcttagcagaacgggttcggcgagggaaaataaacgagagattaagatgcttgcaagatatggtgcccggatgttataaggctatgggaatggctacgatgcttgacgagataattaattatgtccagtctctacagaatcaagtcgagttcctctcgatgaaactcactgcagcaagttcgttttatgactttaactcagagacagatgcagttgattccatgcagagagcaaaggcacgtgagacagtggagatggggagacaaacaagagatgggagtcctgtcttccatttatcaacatggtccctttgacttttgttttctcttttctcttttccttcttttttattgttttcgaaattattcttctatttatttggatgcgatatgtcatatatacgacccaacttgggataatatttgtaatctgtatacttgtaatttcgacgatataaatttattggtgacttataattgtc

SEQ ID NO: 466 - protein, 260 aa, Arabidopsis thaliana
  G2779,HLH/MYC domain coordinates 148-206
MANFENLSSDFQTIAMDIYSSITQAADLNNNNSNLHFQTFHPSSTSLESLFLHHHQQQLLHFPGNSPDSSNNFSSTSSFLHSDHNIVDETKKRKALLPTLSSSETSGVSDNTNVIATETGSLRRGKRLKKKKEEEDEKEREVVHVRARRGQATDSHSLAERVRRGKINERLRCLQDMVPGCYKAMGMATMLDEIINYVQSLQNQVEFLSMKLTAASSFYDFNSETDAVDSMQRAKARETVEMGRQTRDGSPVFHLSTWSL

SEQ ID NO: 467 - DNA, 2104 bp, Arabidopsis thaliana
  G278,family:AKR
tcgatctttaaccaaatccagttgataaggtctcttcgttgattagcagagatctctttaatttgtgaatttcaattcatcggaacctgttgatggacaccaccattgatggattcgccgattcttatgaaatcagcagcactagtttcgtcgctaccgataacaccgactcctctattgtttatctggccgccgaacaagtactcaccggacctgatgtatctgctctgcaattgctctccaacagcttcgaatccgtctttgactcgccggatgatttctacagcgacgctaagcttgttctctccgacggccgggaagtttctttccaccggtgcgttttgtcagcgagaagctctttcttcaagagcgctttagccgccgctaagaaggagaaagactccaacaacaccgccgccgtgaagctcgagcttaaggagattgccaaggattacgaagtcggtttcgattcggttgtgactgttttggcttatgtttacagcagcagagtgagaccgccgcctaaaggagtttctgaatgcgcagacgagaattgctgccacgtggcttgccggccggcggtggatttcatgttggaggttctctatttggctttcatcttcaagatccctgaattaattactctctatcagaggcacttattggacgttgtagacaaagttgttatagaggacacattggttatactcaagcttgctaatatatgtggtaaagcttgtatgaagctattggatagatgtaaagagattattgtcaagtctaatgtagatatggttagtcttgaaaagtcattgccggaagagcttgttaaagagataattgatagacgtaaagagcttggtttggaggtacctaaagtaaagaaacatgtctcgaatgtacataaggcacttgactcggatgatattgagttagtcaagttgcttttgaaagaggatcacaccaatctagatgatgcgtgtgctcttcatttcgctgttgcatattgcaatgtgaagaccgcaacagatcttttaaaacttgatcttgccgatgtcaaccataggaatccgaggggatatacggtgcttcatgttgctgcgatgcggaaggagccacaattgatactatctctattggaaaaaggtgcaagtgcatcagaagcaactttggaaggtagaaccgcactcatgatcgcaaaacaagccactatggcggttgaatgtaataatatcccggagcaatgcaagcattctctcaaaggccgactatgtgtagaaatactagagcaagaagacaaacgagaacaaattcctagagatgttcctccctcttttgcagtggcggccgatgaattgaagatgacgctgctcgatcttgaaaatagagttgcacttgctcaacgtctttttccaacggaagcacaagctgcaatggagatcgccgaaatgaagggaacatgtgagttcatagtgactagcctcgagcctgaccgtctcactggtacgaagagaacatcaccgggtgtaaagatagcacctttcagaatcctagaagagcatcaaagtagactaaaagcgctttctaaaaccgtggaactcgggaaacgattcttcccgcgctgttcggcagtgctcgaccagattatgaactgtgaggacttgactcaactggcttgcggagaagacgacactgctgagaaacgactacaaaagaagcaaaggtacatggaaatacaagagacactaaagaaggcctttagtgaggacaatttggaattaggaaattcgtccctgacagattcgacttcttccacatcgaaatcaaccggtggaaagaggtctaaccgtaaactctctcatcgtcgtcggtgagactcttgcctcttagtgtaatttttgctgtaccatataattctgttttcatgatgactgtaactgtttatgtctatcgttggcgtcatatagtttcgctcttcgttttgcatcctgtgtattattgctgcaggtgtgcttcaaacaaatgttgtaacaatttgaaccaatggtatacagatttgtaatatatatttatgtacatcaacaataaaaaaaaaaaaaaaaaa

SEQ ID NO: 468 - protein, 593 aa, Arabidopsis thaliana
  G278,AKR domain coordinates 2-593
MDTTIDGFADSYEISSTSFVATDNTDSSIVYLAAEQVLTGPDVSALQLLSNSFESVFDSPDDFYSDAKLVLSDGREVSFHRCVLSARSSFFKSALAAAKKEKDSNNTAAVKLELKEIAKDYEVGFDSVVTVLAYVYSSRVRPPPKGVSECADENCCHVACRPAVDFMLEVLYLAFIFKIPELITLYQRHLLDVVDKVVIEDTLVILKLANICGKACMKLLDRCKEIIVKSNVDMVSLEKSLPEELVKEIIDRRKELGLEVPKVKKHVSNVHKALDSDDIELVKLLLKEDHTNLDDACALHFAVAYCNVKTATDLLKLDLADVNHRNPRGYTVLHVAAMRKEPQLILSLLEKGASASEATLEGRTALMIAKQATMAVECNNIPEQCKHSLKGRLCVEILEQEDKREQIPRDVPPSFAVAADELKMTLLDLENRVALAQRLFPTEAQAAMEIAEMKGTCEFIVTSLEPDRLTGTKRTSPGVKIAPFRILEEHQSRLKALSKTVELGKRFFPRCSAVLDQIMNCEDLTQLACGEDDTAEKRLQKKQRYMEIQETLKKAFSEDNLELGNSSLTDSTSSTSKSTGGKRSNRKLSHRRR

SEQ ID NO: 469 - DNA, 1025 bp, Arabidopsis thaliana
  G29,family:AP2
cctcttcaattctctgtttcctccaaaatggctacaccaaacgaagtatcagctcttttcctcatcaagaagtatctcctcgacgaattgtctccgttgcctactactgccaccaccaatcgatggatgaacgatttcacgtcatttgatcaaaccggtttcgagttttctgaatttgaaaccaaaccggaaataatcgatctcgtcactcccaaaccggagatttttgatttcgatgtgaaatctgaaattccatctgaatcgaacgattccttcacgttccaatcgaatcctcctcgcgttactgttcaatccaatcgaaaaccgccgttgaagatcgcaccaccgaaccgaaccaagtggattcaattcgcaaccggaaatcctaaaccggaacttcccgtaccggttgtagcagcagaggagaagaggcattacagaggagtgaggatgaggccgtgggggaaattcgcggcggagattcgagacccgactcgtcgtggaactcgtgtttggctcgggacgtttgagacggcgatcgaagcggctagagcttacgacaaagaagcgtttagactacgaggatcaaaggcgattctgaatttcccgcttgaagttgacaagtggaatccacgcgctgaagatggtcgtggcctgtacaacaaacggaagagagacggcgaggaggaggaagtgacggtggttgagaaagtgctaaagacggaggagagttacgacgttagcggcggcgagaatgttgagtcaggtttgacggcgatagatgactgggatttgacggagtttctgagcatgccgcttttatcgccgttatctccacacccaccgtttggttatccacaattgaccgttgtttgaattctatttttctgtttgggtcagcttgttgtatgctgacgtggaattatgctatatcttttgcttattttatgttcacattcgagcaaaatttattcattcgtttatttgttttttaatacaactcttgatatttctaaattctaacc

SEQ ID NO: 470 - protein, 282 aa, Arabidopsis thaliana
  G29,AP2 domain coordinates 134-197
MATPNEVSALFLIKKYLLDELSPLPTTATTNRWMNDFTSFDQTGFEFSEFETKPEIIDLVTPKPEIFDFDVKSEIPSESNDSFTFQSNPPRVTVQSNRKPPLKIAPPNRTKWIQFATGNPKPELPVPVVAAEEKRHYRGVRMRPWGKFAAEIRDPTRRGTRVWLGTFETAIEAARAYDKEAFRLRGSKAILNFPLEVDKWNPRAEDGRGLYNKRKRDGEEEEVTVVEKVLKTEESYDVSGGENVESGLTAIDDWDLTEFLSMPLLSPLSPHPPFGYPQLTVV

SEQ ID NO: 471 - DNA, 1011 bp, Arabidopsis thaliana
  G2989,family:ZF-HB
taagcttaacataaaccctaatattttcttgatttttttcaagaaaataaaaacataaagatgcttgaagttagatcaatggatatgactccaaaatcaccagaacccgaatccgaaactccgacccggatccaaccagctaaaccaatctctttcagtaacggaatcatcaaacgccaccaccaccaccaccacaacaacaacaaagtcacttacaaagaatgtctcaagaaccacgcggcggcgattggtggtcacgcgcttgacggttgcggcgaatttatgccgtctccttcgtcaacaccttccgatccaacttctctcaagtgtgcagcttgtggttgtcaccgtaacttccaccgccgtgaaactgacgattcctccgccgttccaccaccgtctcttcttccatcttcaacaacaaccgccgcaattgagtatcagcctcatcaccgtcatcatcctcctcctccgctagctcctccgttaccacgtagtcctaattcatcttctccgccgcctatctcttcctcctacatgcttttagctctctccggtaataataaaaccgcaccgttctcagatctaaacttcgccgccgcggctaaccatctctccgccacgcctggctcgaggaagcgattcaggacgaagtttagctcaaatcagaaagagaagatgcatgaattcgccgatcgaatcggttggaagattcagaaacgtgacgaagacgaagttcgtgatttttgccgtgagatcggagttgataaaggtgttctcaaagtttggatgcataataacaaaaactccttcaaattctccggcggaggagcaaccaccgtgcagagaaacgataacggtatcggcggcgagaacagtaacgatgatggagttcgcggtttagctaacgacggtgacggtggtggtgggagatttgagagtgatagtggaggagctgatggtggcggaaacgtaaacgcctcgtcgtcttcgtcgtgaagaagaaaacat

SEQ ID NO: 472 - protein, 312 aa, Arabidopsis thaliana
  G2989,ZF-HB domain coordinates 50-105,192-255
MLEVRSMDMTPKSPEPESETPTRIQPAKPISFSNGIIKRHHHHHHNNNKVTYKECLKNHAAAIGGHALDGCGEFMPSPSSTPSDPTSLKCAACGCHRNFHRRETDDSSAVPPPSLLPSSTTTAAIEYQPHHRHHPPPPLAPPLPRSPNSSSPPPISSSYMLLALSGNNKTAPFSDLNFAAAANHLSATPGSRKRFRTKFSSNQKEKMHEFADRIGWKIQKRDEDEVRDFCREIGVDKGVLKVWMHNNKNSFKFSGGGATTVQRNDNGIGGENSNDDGVRGLANDGDGGGGRFESDSGGADGGGNVNASSSSS

SEQ ID NO: 473 - DNA, 553 bp, Arabidopsis thaliana
  G30,family:AP2
ctcttctgacgcacaacagtatatacacatacacagatatatggatcaaggaggtcgtagcagtggtagtggaggaggaggagccgagcaagggaagtaccgtggagtaaggagacgaccttggggtaaatacgccgcggaaataagagattcgaggaagcacggagagcgtgtgtggctagggacattcgacactgcggaagacgcggctcgagcctatgaccgagccgcctattcaatgagaggcaaagctgccattctcaacttccctcacgagtataacatgggaaccggatcctcatccactgcggctaattcttcttcctcgtcgcagcaagtttttgagtttgagtacttggacgatagcgttttggatgaacttcttgaatatggagagaactataacaagactcataatatcaacatgggcaagaggcaataaagggaatacaatcggtattaactgaaagttatgtgaaagaccattttcagttataacaaataaaataaaatcccaagcgtacaaagctgtttctaaaaaaaaaaaaaaaaa

SEQ ID NO: 474 - protein, 133 aa, Arabidopsis thaliana
  G30,AP2 domain coordinates 16-80
MDQGGRSSGSGGGGAEQGKYRGVRRRPWGKYAAEIRDSRKHGERVWLGTFDTAEDAARAYDRAAYSMRGKAAILNFPHEYNMGTGSSSTAANSSSSSQQVFEFEYLDDSVLDELLEYGENYNKTHNINMGKRQ

SEQ ID NO: 475 - DNA, 944 bp, Arabidopsis thaliana
  G3079,family:bZIP-ZW2
taaccagctaaaaacaataagagagatatggaaagatcttcgagttatggggttgaaaaacttcaaaaaagatgttaccatgagtggatgagtttacaaactaaacacatagatgatctcaaagaagcactcatgtgtcaacgaaacaacgatgacaaactcgaagacctcgttggtaaaatcgtcaatgactaccacacatatgcgggaaaacgatcagagctctcgtaccgatgctgcgctcactactttgcaccgtcgtggaacactcctatagagaacagtatgctatggatgggaggatgtcgtccttcttctttcattagacttatatacgcactttgtggatcccaggccgaaactcagctttctcaatatcttcttaagatcgatgacgacttcgatataaaccatggtggtttcatgagtgatcttaccgcgacacagcttggaaaactcaatgacttgcatttggaggtaataaagaaagaagacaagattacgaagacatctgcgaattttcaagacgatgtggcggatttgccaatcgcggatgtggtgcatgctgatgtagcggtggaggatgctttggataagcatgaagagggaatggcggttttactggcggaggctgataaactgaggtttgagacgcttaggaagattgtggacgttgtcacaccgcttcaagcggtggagtttttgcttgccggaaaaagattacagctgtcgttgcacgaccggggaagagttagagcagatgtttgtggaggagtggggggcgccgctgtctgaagaggtgaggtggagcggggatgtcagacagagccacttgttaaagtgcgtgtcagtcagtagcgtataatatatgtgtaatatttgtctaattagagatgggtcatgtttagtgtgtgcttcatgtgtatgagatgttgcattattat

SEQ ID NO: 476 - protein, 255 aa, Arabidopsis thaliana
  G3079,bZIP-ZW2 domain coordinates 74-104,202-229
MERSSSYGVEKLQKRCYHEWMSLQTKHIDDLKEALMCQRNNDDKLEDLVGKIVNDYHTYAGKRSELSYRCCAHYFAPSWNTPIENSMLWMGGCRPSSFIRLIYALCGSQAETQLSQYLLKIDDDFDINHGGFMSDLTATQLGKLNDLHLEVIKKEDKITKTSANFQDDVADLPIADVVHADVAVEDALDKHEEGMAVLLAEADKLRFETLRKIVDVVTPLQAVEFLLAGKRLQLSLHDRGRVRADVCGGVGGAAV

SEQ ID NO: 477 - DNA, 579 bp, Oryza sativa (japonica cultivar-group)
  G3380,family:AP2
ggtccgatccgtaacagtagtagctagttaatttgattattgtccgtccgcggccggtcagtggtcgcaatcgatcgatcgatatcatggacggcgacggcggcggcggatgggacgatcagggcaacggcggcggcgagacgaccaagtaccgtggcgtgcgtcgccggccttctggcaagttcgcggcggagatccgtgactccagcaggcagagcgtccgcgtctggctgggaaccttcgacaccgccgaggaggctgcgcgggcttacgaccgcgccgcctacgccatgcgcggccacctcgccgtcctcaacttccctgctgaggcgcgcaactacgtgcggggatcaggctcgtcgtcctcgtcccgacagcatcagcagcggcaggtgatcgagctggagtgcctagacgaccaagtgctgcaagagatgctcaagggtggcgacgatcagtacaggtcagcagctgggagcaagaggaataactactagctatatatgctgctaacctacttacaatcgcgatacatatcgaggtttggggattttcttctcacctgtgtgcagaggctgc

SEQ ID NO: 478 - protein, 136 aa, Oryza sativa (japonica cultivar-group)
  G3380,AP2 domain coordinates 18-82
MDGDGGGGWDDQGNGGGETTKYRGVRRRPSGKFAAEIRDSSRQSVRVWLGTFDTAEEAARAYDRAAYAMRGHLAVLNFPAEARNYVRGSGSSSSSRQHQQRQVIELECLDDQVLQEMLKGGDDQYRSAAGSKRNNY

SEQ ID NO: 479 - DNA, 514 bp, Oryza sativa (japonica cultivar-group)
  G3381,family:AP2
atcgatcatctgctacgaactcaccctatatatatatactccatcttaggagctgcttgatcgatcgacatatatataactaatggatcatcatcatcagcagcagcagcaggagggtgagctggtggccaagtacaggggcgtgcggcggcggccgtggggcaaattcgcggcagagatccgcgactcgagccggcacggcgtccgcgtgtggctgggcaccttcgacacagccgaggaggccgctcgcgcctacgaccgctccgcctactccatgcgcggcgccaacgccgtcctcaacttccccgccgacgcccacatctacgcccgtcaactacacaataataacgccgctgctggctcttcatcttcctcttccgccgccgccgcagcagccaggccgccgccgatcgagttcgagtacctcgatgaccacgtcctgcaggagatgctccgagaccacaccaccaacaagtagcttactactccactatatatgctgcctgctgcttgt

SEQ ID NO: 480 - protein, 131 aa, Oryza sativa (japonica cultivar-group)
  G3381,AP2 domain coordinates 14-78
MDHHHQQQQQEGELVAKYRGVRRRPWGKFAAEIRDSSRHGVRVWLGTFDTAEEAARAYDRSAYSMRGANAVLNFPADAHIYARQLHNNNAAAGSSSSSSAAAAAARPPPIEFEYLDDHVLQEMLRDHTTNK

SEQ ID NO: 481 - DNA, 375 bp, Oryza sativa (japonica cultivar-group)
  G3383,family:AP2
atggaggacaaccggagcaaggacacggcgaccaagtaccgcggcgtgaggaggcggccgtggggcaagttcgcggcggagatccgcgacccggagcgcggcggggcgcgcgtctggctcggcaccttcgacaccgccgaggaggcggcgcgtgcctacgaccgcgcggcctacgcccagcgcggcgccgccgccgtgctcaacttcccggccgccgccgccgccggcaggggtggaggagccggcggcgccgcttccgggtcgtcgtcgtcgtcgtccgcgcagcgcggcaggggcgacaagatcgagttcgagtacctcgacgacaaggtgctcgacgatctcctcgacgacgagaagtaccgtggtaaatga

SEQ ID NO: 482 - protein, 124 aa, Oryza sativa (japonica cultivar-group)
  G3383,AP2 domain coordinates 9-73
MEDNRSKDTATKYRGVRRRPWGKFAAEIRDPERGGARVWLGTFDTAEEAARAYDRAAYAQRGAAAVLNFPAAAAAGRGGGAGGAASGSSSSSSAQRGRGDKIEFEYLDDKVLDDLLDDEKYRGK

SEQ ID NO: 483 - DNA, 966 bp, Oryza sativa (japonica cultivar-group)
  G3384,family:MYB-(R1)R2R3
atggggaggccgccgtgctgcgacaaggtcggggtgaagaaggggccatggacgccggaggaggacctgatgctggtctcctacatccaggagcacggcgccggcaactggcgcgccgtgccgacgaacaccgggctgatgcgttgcagcaagagctgccggctccggtggacgaactacctcaggccggggatcaagcgggggaacttcaccgagcaggaggagaagctcatcgtccacctccaggctctcctcggcaaccggtgggcagcgatagcgtcgtacttgccggagaggacggacaacgacatcaagaactactggaacacgcacctcaagaagaagctcaagaagatgcaggccgccggaggtggggaagacagcggcgccgcctcggagggtggcggcggccgcggcgacggcgacggcggcgggaaaagcgtgaaggccgccgcacctaaggggcagtgggagcggcggctgcagacggacatccacacggcgcggcaggcgctgcgcgacgcgctctcgctcgaccaccccgacccgtcgccggcgacggcggcggcggcggcgacgccagcggggtcgtcggcggcgtacgcgtcgagcgcggacaacatcgcgcggctgctgcagggctggatgcgcccgggcggcggcggcggcggcaacggcaagggccccgaggcgtcggggtcgacctccacgacggcgacgacgcagcagcagccgcagtgctccggcgagggcgcggcatccgcgtccgcgtcggcgagccagagcggcgccgccgccgcggcgactgcccagacgccggagtgctcgacggagacgagcaagatggccaccggcggcggcgccggcggccccgcgccggcgttctcgatgctggagagctggctgctcgacgacggcggcatggggctcatggacgtggtgccattgggggaccccagtgagtaa

SEQ ID NO: 484 - protein, 321 aa, Oryza sativa (japonica cultivar-group)
  G3384,MYB-(R1)R2R3 domain coordinates 14-118
MGRPPCCDKVGVKKGPWTPEEDLMLVSYIQEHGAGNWRAVPTNTGLMRCSKSCRLRWTNYLRPGIKRGNFTEQEEKLIVHLQALLGNRWAAIASYLPERTDNDIKNYWNTHLKKKLKKMQAAGGGEDSGAASEGGGGRGDGDGGGKSVKAAAPKGQWERRLQTDIHTARQALRDALSLDHPDPSPATAAAAATPAGSSAAYASSADNIARLLQGWMRPGGGGGGNGKGPEASGSTSTTATTQQQPQCSGEGAASASASASQSGAAAAATAQTPECSTETSKMATGGGAGGPAPAFSMLESWLLDDGGMGLMDVVPLGDPSE

SEQ ID NO: 485 - DNA, 924 bp, Oryza sativa (japonica cultivar-group)
  G3385,family:MYB-(R1)R2R3
atggggcggccgccgtgttgcgagaaggagggggtgaagaaggggccatggacgccggaggaggacatggtgctggcgtcgtacgtgcaggagcacggcccgggcaactggcgcgccgtgccgcccaggacgggcctcctccgctgcagcaagagctgccgcctccgctggaccaactacctccgcccgggcatccgccgcggcggcttctcccaccacgaggagcgcctcatcctccacctccaggccctcctcggcaaccgctgggccgccatcgcctcctacctcccccaccgcaccgacaacgacgtcaagaacttctggaacacccacctcaagaagaagctcgccctcacctcctcctcctcctcgccgccgacgccgacgacgccgctcgtcgccagggggcagtgggagcgcaagctgcagaccgacatcgacctcgccaggcgcgccctccgcgacgccctctccgtcgacgacgccgcctccccggcgatgatcagcagcgggccgcccgcgccggcggcggcggcggcgtacgccctgagcgagcgcaacatctccgtgatgctgagcggctgggcggcgccgcctccggccaggaaaggattgtcagcctgcaacccggcggcggcgacgacgacgcccggtggcgccgccgcggagagcgcgtccacggccgggacgtcgttggagctcaccgccgactgctgctccggcggcggcgactccagcgcgtccaactgcctgccgtcgtccatgctcctcgcgtgcgacgacggcgacgcgacggcgacggcggccggggtggcgccgctgtcggcgatcgagtcgtggctgctgctcgacgacagcggagagccgcagctggcactggacgagcagctgctggacgtagctctccgtaattacgctttctaa

SEQ ID NO: 486 - protein, 307 aa, Oryza sativa (japonica cultivar-group)
  G3385,MYB-(R1)R2R3 domain coordinates 14-118
MGRPPCCEKEGVKKGPWTPEEDMVLASYVQEHGPGNWRAVPPRTGLLRCSKSCRLRWTNYLRPGIRRGGFSHHEERLILHLQALLGNRWAAIASYLPHRTDNDVKNFWNTHLKKKLALTSSSSSPPTPTTPLVARGQWERKLQTDIDLARRALRDALSVDDAASPAMISSGPPAPAAAAAYALSERNISVMLSGWAAPPPARKGLSACNPAAATTTPGGAAAESASTAGTSLELTADCCSGGGDSSASNCLPSSMLLACDDGDATATAAGVAPLSAIESWLLLDDSGEPQLALDEQLLDVALRNYAF

SEQ ID NO: 487 - DNA, 1026 bp, Oryza sativa (japonica cultivar-group)
  G3386,family:MYB-(R1)R2R3
atggtgaggccgccgtgctgcgacaaggacggcgtcaagaagggcccgtggacgccggaggaggacctcgtcctcgtctcctacgtccaggagcacggccccggcaactggcgcgccgtcccgaccagaacagggctgatgcggtgcagcaagagctgtaggctccggtggaccaactacctgaggcccgggatcaagcggggaaacttcaccgaccaggaggagaagctcatcgtccacctccaggcgctcctcggcaaccgctgggcggccatcgcgtcgtacctccccgagcgcacggacaacgacatcaagaactactggaacacccacctcaagcgcaagctgcagggcggcggcgccggcggtgacggagacggtggcgccgccggcgacgcggtctccccgaagcccgccgcgcagaggcccgcgtcgtcgtccaaggggcagtgggagcggcgcctgcagaccgacatcgacatggcgcgccgcgcgctccgcgaggcgctcacgtcgctcgacgacgtcaagccaccgcatcagcccgacgccgccaacgccgccgcggggggaggcggcgccaccaccggagcagcagcgtccgccggcgccgatagccccgccgcgtcgagcacgtcgggggcgtcgcagtgctccccgtcatccgccggctacgtcctcaccaccgagaacatctcccggatgctcgacgggtgggcccggaagaagggcggcggcggcggcaggcgcgccgccggcagcgggccggccacccccggcgccaccgagagcgcgtccggctcgtcggaagcctccgaggtgtcctacggcggcacggccttgtccgcagcggcggcgcccgcgtccgccttcgagtacgagacaaagccgaccgtcaccgccgccgccgccgccgacgccggcgacgagacgcagctctccgccatcgagtcgtggctgttcgccgacgccgacggcatcgagagtggcagcttgctcgacgcggccatggattacaccttctaa

SEQ ID NO: 488 - protein, 341 aa, Oryza sativa (japonica cultivar-group)
  G3386,MYB-(R1)R2R3 domain coordinates 14-118
MVRPPCCDKDGVKKGPWTPEEDLVLVSYVQEHGPGNWRAVPTRTGLMRCSKSCRLRWTNYLRPGIKRGNFTDQEEKLIVHLQALLGNRWAAIASYLPERTDNDIKNYWNTHLKRKLQGGGAGGDGDGGAAGDAVSPKPAAQRPASSSKGQWERRLQTDIDMARRALREALTSLDDVKPPHQPDAANAAAGGGGATTGAAASAGADSPAASSTSGASQCSPSSAGYVLTTENISRMLDGWARKKGGGGGRRAAGSGPATPGATESASGSSEASEVSYGGTALSAAAAPASAFEYETKPTVTAAAAADAGDETQLSAIESWLFADADGIESGSLLDAAMDYTF

SEQ ID NO: 489 - DNA, 1291 bp, Oryza sativa (japonica cultivar-group)
  G3388,family:AP2
ctagacactgccctaattacaacccatttgcttatctctctcctctctctctctctctcgctgcagccatagcttagctagagctagagctttcttggtgccgagatgggggtggtcagcttctcctcgacttcctccggcgcgtccacggccaccaccgagtccggcggcgccgtgcggatgtcgccggagccggtggtggcggtggcggcggcggctcaacagctaccggtggtgaagggagttgactcggcggatgaggtggtgacgtcgaggccggcggcggcggcggcgcagcagtcgtcgcggtacaagggggtggtgccgcagccgaacgggaggtggggggcgcagatctacgagcggcacgcgcgggtgtggctcgggacgttccccgacgaggaggcggcggcgcgggcctacgacgtggcggcgctccggtaccgggggcgcgacgcggccaccaacttccccggggccgcggcgtcggccgccgagctcgcgttcctcgccgcgcactccaaggccgagatcgtcgacatgctccggaagcacacctacgccgacgagctccgccaggggctccgccgcggccgcggcatgggcgcccgcgcccagcccacgccgtcgtgggcgcgcgagccgctgttcgagaaggccgtgacgcccagcgacgtcggcaagctcaaccgcctcgtggtgcccaagcagcacgccgagaagcacttcccgctccgccgcgcggcgagctccgactccgcctccgccgccgccaccggcaagggcgtgctcctcaacttcgaggacggcgaggggaaggtgtggcgattccggtactcgtactggaacagcagccagagctacgtgctgaccaaggggtggagccgattcgtgagggagaagggcctccgcgccggcgacaccatagtcttctcccgctcggcgtacggccccgacaagctgctcttcatcgactgcaagaagaacaacgcggcggcggcgaccaccacctgcgccggcgacgagaggccaaccacaagcggcgccgaaccacgcgtcgtgaggctcttcggcgtcgacatcgccggcggcgattgccggaagcgggagagggcggtggagatggggcaagaggtcttcctactgaagaggcaatgcgtggttcatcagcgtactcctgccctaggtgccctgctgttatagcatcaaatcaaattcatatatagatcaaatcaaatcttcttctcttccatcttttttgttgttcatcgtctgttgtttcatcttcgag

SEQ ID NO: 490 - protein, 365 aa, Oryza sativa (japonica cultivar-group)
  G3388,AP2 domain coordinates 66-129,181-274
MGVVSFSSTSSGASTATTESGGAVRMSPEPVVAVAAAAQQLPVVKGVDSADEVVTSRPAAAAAQQSSRYKGVVPQPNGRWGAQIYERHARVWLGTFPDEEAAARAYDVAALRYRGRDAATNFPGAAASAAELAFLAAHSKAEIVDMLRKHTYADELRQGLRRGRGMGARAQPTPSWAREPLFEKAVTPSDVGKLNRLVVPKQHAEKHFPLRRAASSDSASAAATGKGVLLNFEDGEGKVWRFRYSYWNSSQSYVLTKGWSRFVREKGLRAGDTIVFSRSAYGPDKLLFIDCKKNNAAAATTTCAGDERPTTSGAEPRVVRLFGVDIAGGDCRKRERAVEMGQEVFLLKRQCVVHQRTPALGALLL

SEQ ID NO: 491 - DNA, 1068 bp, Oryza sativa (japonica cultivar-group)
  G3389,family:AP2
gctaggctgttctctctttccattcgtcaagaactaccacgacgtcgacatcataatcgtcagagagctcgagaaattttttagtatctttgatccagatcgatcatggagcaagaagctgccatggtcgtcttctcctgcaactccggctccggtgggtcgtcgtcgacgaccgattcaaagcaagaggaggaggaggaggaggagttggccgcaatggaggaagacgagttgatccacgtcgtccaggcggcggagctgcggctgccgtcgtcgacgacggcgacgcggccgtcgtcgcggtacaagggggtggtgccgcagccgaacgggcggtggggggcgcagatctacgagcggcacgcgcgggtgtggctcgggacgttccccgacgaggaggcggcggcgcgcgcctacgacgtggcggcgctccgcttccgggggcgcgacgccgtcaccaaccgcgccccggcggcggagggcgcgtccgccggcgagctcgcgttcctggccgcgcactccaaggcggaggtcgtggacatgctgcggaagcacacctacgacgacgagctccagcagggcctccgccgcggctcgcgcgcgcagccgacgccgcggtgggcgcgcgagccgctgttcgagaaggccgtgacgccgagcgacgtcggcaagctcaaccgcctcgtggtgcccaagcagcaggccgagaggcatttcccgttcccgctccgccgccacagctccgacgccgccggcaagggcgtgctcctcaacttcgaggacggcgacggcaaggtgtggcgattccggtactcgtactggaacagcagccagagttacgtgctcaccaaggggtggagccgattcgtgagggagaagggcctccgaccaggcgacaccgtggccttctcccggtcggcggcggcgtgggggacggagaagcacctcctcatcgactgcaagaagatggagaggaacaacctggcaaccgtcgacgacgatgcccgtgtcgtcgtcaagctgttcggcgttgacatcgccggagacaagacgaggtaacacgcaagc

SEQ ID NO: 492 - protein, 317 aa, Oryza sativa (japonica cultivar-group)
  G3389,AP2 domain coordinates 64-129,177-266
MEQEAAMVVFSCNSGSGGSSSTTDSKQEEEEEEELAAMEEDELIHVVQAAELRLPSSTTATRPSSRYKGVVPQPNGRWGAQIYERHARVWLGTFPDEEAAARAYDVAALRFRGRDAVTNRAPAAEGASAGELAFLAAHSKAEVVDMLRKHTYDDELQQGLRRGSRAQPTPRWAREPLFEKAVTPSDVGKLNRLVVPKQQAERHFPFPLRRHSSDAAGKGVLLNFEDGDGKVWRFRYSYWNSSQSYVLTKGWSRFVREKGLRPGDTVAFSRSAAAWGTEKHLLIDCKKMERNNLATVDDDARVVVKLFGVDIAGDKTR

SEQ ID NO: 493 - DNA, 1348 bp, Oryza sativa (japonica cultivar-group)
  G3390,family:AP2
cttcagaggcttcacctttcatcagcttagctagctagctgctcgatccggcggcgtgatcgatcgatctctctgattctatcaggtgttcgaccagattccatcgatggacagcacgagctgtctcttggacgacgcgagcagcggcgcgtccacgggcaagaaggcggcggcggcggcggcgtcgaaggcgctgcagcgcgtgggcagcggcgccagcgcggtgatggacgcggccgagcctggcgccgaggcggactcgggcggcgagcggcgcggcggcggcggcgggaagctgccgtcgtccaagtacaagggcgtggtgccgcaaccgaacgggcggtggggcgcgcagatatacgagcggcaccagcgggtgtggctcggcacgttcaccggcgaggcggaggcggcgcgcgcctacgacgtggcggcgcagcggttccgcggccgcgacgccgtcaccaacttccgcccgctcgccgagtccgacccggaggccgccgtcgagctccgcttcctcgcgtcccgctccaaggccgaggtcgtcgacatgctccgcaagcacacctacctcgaggagctcacgcagaacaagcgcgccttcgccgccatctccccgccgccccccaagcaccccgcctcctctccgacgtcctcctccgccgcgcgcgagcacctgttcgacaagacggtgacgcccagcgacgtcgggaagctgaaccggctggtgatccccaagcagcacgccgagaagcacttcccgctccagctccctccccctaccacaacctcctccgtcgccgccgccgccgacgccgccgccggcggcggcgattgcaagggcgtcctcctcaacttcgaggacgccgccgggaaggtgtggaaattccggtactcctactggaacagcagccagagctacgtgctcaccaaggggtggagccgcttcgtcaaggagaaggggctccacgccggcgacgccgtcggcttctaccgcgccgccggtaagaacgcgcagctcttcatcgactgcaaggtccgggcaaaacccaccaccgccgccgccgccgccgccttcctcagcgcggtggccgccgccgccgcgccgccacccgccgtgaaggctatcaggctgttcggtgtcgacctgctcacggcggcggcgccggagctgcaggacgccggcggcgccgccatgaccaagagcaagagagccatggacgccatggctgagtcacaagcacacgtggtttttaagaagcaatgcatagagcttgcgctaacctagctagcacgctgatgcagctagcgttttttttgctcattcgcttgcttgcttaattat

SEQ ID NO: 494 - protein, 394 aa, Oryza sativa (japonica cultivar-group)
  G3390,AP2 domain coordinates 66-131,192-294
MDSTSCLLDDASSGASTGKKAAAAAASKALQRVGSGASAVMDAAEPGAEADSGGERRGGGGGKLPSSKYKGVVPQPNGRWGAQIYERHQRVWLGTFTGEAEAARAYDVAAQRFRGRDAVTNFRPLAESDPEAAVELRFLASRSKAEVVDMLRKHTYLEELTQNKRAFAAISPPPPKHPASSPTSSSAAREHLFDKTVTPSDVGKLNRLVIPKQHAEKHFPLQLPPPTTTSSVAAAADAAAGGGDCKGVLLNFEDAAGKVWKFRYSYWNSSQSYVLTKGWSRFVKEKGLHAGDAVGFYRAAGKNAQLFIDCKVRAKPTTAAAAAAFLSAVAAAAAPPPAVKAIRLFGVDLLTAAAPELQDAGGAAMTKSKRAMDAMAESQAHVVFKKQCIELALT

SEQ ID NO: 495 - DNA, 1338 bp, Oryza sativa (japonica cultivar-group)
  G3391,family:AP2
ggagagtaggagtgtgctagtgtgtgaggtctactgaaatggacagctccagctgcctggtggatgataccaacagcggcggctcgtccacggacaagctgagggcgttggccgccgcggcggcggagacggcgccgctggagcgcatggggagcggggcgagcgcggtggtggacgcggccgagcctggcgcggaggcggactccgggtccgggggacgtgtgtgcggcggcggcggcggcggtgccggcggtgcgggagggaagctgccgtcgtccaagttcaagggcgtcgtgccgcagcccaacgggaggtggggcgcgcagatctacgagcggcaccagcgggtgtggctcggcacgttcgccggggaggacgacgccgcgcgcgcctacgacgtcgccgcgcagcgcttccgcggccgcgacgccgtcaccaacttccgcccgctcgccgaggccgacccggacgccgccgccgagcttcgcttcctcgccacgcgctccaaggccgaggtcgtcgacatgctccgcaagcacacctacttcgacgagctcgcgcagagcaagcgcaccttcgccgcctccacgccgtcggccgcgaccaccaccgcctccctctccaacggccacctctcgtcgccccgctcccccttcgcgcccgccgcggcgcgcgaccacctgttcgacaagacggtcaccccgagcgacgtgggcaagctgaacaggctcgtcataccgaagcagcacgccgagaagcacttcccgctacagctcccgtccgccggcggcgagagcaagggtgtcctcctcaacttcgaggacgccgccggcaaggtgtggcggttccggtactcgtactggaacagcagccagagctacgtgctaaccaagggctggagccgcttcgtcaaggagaagggtctccacgccgacggcaagctcttcatcgactgcaagttagtacggtcgaccggcgccgccctcgcgtcgcccgctgatcagccagcgccgtcgccggtgaaggccgtcaggctcttcggcgtggacctgctcacggcgccggcgccggtcgaacagatggccgggtgcaagagagccagggacttggcggcgacgacgcctccacaagcggcggcgttcaagaagcaatgcatagagctggcactagtatagagttagcactattagctcgatcttctctagctagtgtcttttttgctcccatgcatcataattcaggtggtagctagcttagtcccttgttgatcctatctactaatctcacttggttttttttgttaatttattcgcccatgttcttgcttgctttgctgta

SEQ ID NO: 496 - protein, 378 aa, Oryza sativa (japonica cultivar-group)
  G3391,AP2 domain coordinates 79-148,215-300
MDSSSCLVDDTNSGGSSTDKLRALAAAAAETAPLERMGSGASAVVDAAEPGAEADSGSGGRVCGGGGGGAGGAGGKLPSSKFKGVVPQPNGRWGAQIYERHQRVWLGTFAGEDDAARAYDVAAQRFRGRDAVTNFRPLAEADPDAAAELRFLATRSKAEVVDMLRKHTYFDELAQSKRTFAASTPSAATTTASLSNGHLSSPRSPFAPAAARDHLFDKTVTPSDVGKLNRLVIPKQHAEKHFPLQLPSAGGESKGVLLNFEDAAGKVWRFRYSYWNSSQSYVLTKGWSRFVKEKGLHADGKLFIDCKLVRSTGAALASPADQPAPSPVKAVRLFGVDLLTAPAPVEQMAGCKRARDLAATTPPQAAAFKKQCIELALV

SEQ ID NO: 497 - DNA, 1231 bp, Oryza sativa (indica cultivar-group)
  G3394,family:CAAT
ggccgcttctcttctccagcgtccgatctccccctctcgcctctccgcctcacctccgctccgcttcccacccccgcttcctctctctctcctctccccccccctctctctctctctctctctctctctctcctcctcgcttcaccacctcgcgcccaacccccctctctctcctctccacgtcgcgccctctccgcgcgcgcccgcgcttctatataaggaggggggaggtgggatggcggatgggccggggagcccggggggaggaggggggagccacgagagcgggagcccgagggggggagggggaggagggggaggtgggggtggggggggcccactcgtccggcaggacaggttcctccccatcgccaacatcagccgcatcatgaagaaggccatcccggccaacgggaagatcgccaaggacgccaaggagaccgtgcaggagtgcgtctccgagttcatctccttcatcaccagcgaggcgagcgataaatgccagagggagaagcgcaagaccatcaacggcgacgacttgctgtgggcgatggccacgctgggcttcgaggactacatcgagcccctcaaggtctacctgcagaagtacagagagatggagggtgatagtaaattaactgcaaaggctggtgatggctctgtgaaaaaggatgtacttggttctcatggaggaagcagttcaagtgcccaagggatgggccaacaagcagcatacaatcaaggaatgggttatatgcaacctcagtaccataatggggatgtctcaaactgaagataggaccttttcatgcaactgttgctaggtggattttatttggtgctgcagtcgttagctaatatatatacctacacctcatggtgagcagtgaaggaagtaacttgctaccacctctaggtcccatgtttgtcaaccaggaactgatgctgcttggaagcgtcgagccaaggctgcttctcagatgtaaattactccccgtgaggatagtttcggttcgtggtctagctctgttgttgtatgtatattcaggataatttaacaattggtctttggctgtcattcggttccatataatctgtattgggaggcataaatattcatgttgtatttcgtcctgaactagcgtgttgtactattgagaaatagatgctctctgtaatggtagcaattttactctgattcccaaaaaaaaaaaaaaaaaaaaaaaaaaaa

SEQ ID NO: 498 - protein, 185 aa, Oryza sativa (indica cultivar-group)
  G3394,CAAT domain coordinates 38-126
MADGPGSPGGGGGSHESGSPRGGGGGGGGGGGGGPLVRQDRFLPIANISRIMKKAIPANGKIAKDAKETVQECVSEFISFITSEASDKCQREKRKTINGDDLLWAMATLGFEDYIEPLKVYLQKYREMEGDSKLTAKAGDGSVKKDVLGSHGGSSSSAQGMGQQAAYNQGMGYMQPQYHNGDVSN

SEQ ID NO: 499 - DNA, 610 bp, Oryza sativa (japonica cultivar-group)
  G3395,family:CAAT
tggatctagggtttttggagggcggcgcggggatggcggacgcggggcacgacgagagcgggagcccgccgaggagcggcggggtgagggagcaggacaggttcctgcccatcgccaacatcagccgcatcatgaagaaggccgtcccggcgaacggcaagatcgccaaggacgccaaggagaccctgcaggagtgcgtctcggagttcatctccttcgtcaccagcgaggcgagcgacaaatgtcagaaggagaagcgcaagaccatcaacggggaagatctcctctttgcgatgggtacgcttggctttgaggagtacgttgatccgttgaagatctatttacacaagtacagagagatggagggtgatagtaagctgtcctcaaaggctggtgatggttcagtaaagaaggatacaattggtccgcacagtggcgctagtagctcaagtgcgcaagggatggttggggcttacacccaagggatgggttatatgcaacctcagtatcataatggggacacctaaagatgaggatagtgaaaattttcagtaactggtgtcctctgtgagttattatccatctgttaaggaagaacccacattagggc

SEQ ID NO: 500 - protein, 164 aa, Oryza sativa (japonica cultivar-group)
  G3395,CAAT domain coordinates 19-108
MADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQYHNGDT

SEQ ID NO: 501 - DNA, 837 bp, Oryza sativa (japonica cultivar-group)
  G3396,family:CAAT
gtcgagatccggcggccggtggcgtcctcctccctctccctcctccccaaccaacggcgctgatcccctccgccatctccgtccatctccgcctaaaaaaactaagcgatgtcggaggggttcgacgggacggagaacggcggcggcggcggcggaggcggagtagggaaggagcaggaccggttcctgccgatcgccaacatcggccgcatcatgcgccgggccgtgccggagaacggcaagatcgccaaggactccaaggagtccgtccaggagtgcgtctccgagttcatcagcttcatcaccagcgaagcaagcgacaagtgcctcaaggagaagcgcaagaccatcaatggggacgacctgatctggtcaatgggcacgctcggattcgaggactatgtcgagcctctcaagctctacctcaggctctaccgggagacggagggtgacacaaagggttcaagagcttctgaactgccagtaaagaaagatgttgtacttaatggagatcctggatcatcgtttgaaggcatgtaggacgaggagtgtgatagcatctaggaaggagaaccatcgtttttagggaaagaacgctccagcatcctgttatgttgtaagcaggatgcttctaaagttccaataccttgttaccacgaatgttagtcgtcgttctttttgaaatgttcttgtgttagccaggatgtccaaatttgttgtaggttctagttcagtcgtgtgttgtgtggttgtgtctaaccatatttggccgtttccggctgtcctgcatatgctaaattcagaggggtaaagagatctaagaaaaaaaaaaaaaaa

SEQ ID NO: 502 - protein, 143 aa, Oryza sativa (japonica cultivar-group)
  G3396,CAAT domain coordinates 21-110
MSEGFDGTENGGGGGGGGVGKEQDRFLPIANIGRIMRRAVPENGKIAKDSKESVQECVSEFISFITSEASDKCLKEKRKTINGDDLIWSMGTLGFEDYVEPLKLYLRLYRETEGDTKGSRASELPVKKDVVLNGDPGSSFEGM

SEQ ID NO: 503 - DNA, 720 bp, Oryza sativa (japonica cultivar-group)
  G3397,family:CAAT
gcgtctgatttgctgaagaggaggaggaggatgccggactcggacaacgactccggcgggccgagcaactacgcgggaggggagctgtcgtcgccgcgggagcaggacaggttcctgccgatcgcgaacgtgagcaggatcatgaagaaggcgctgccggcgaacgccaagatcagcaaggacgccaaggagacggtgcaggagtgcgtctccgagttcatctccttcatcaccggcgaggcctccgacaagtgccagcgcgagaagcgcaagaccatcaacggcgacgacctgctctgggccatgaccaccctcggcttcgaggactacgtcgaccccctcaagcactacctccacaagttccgcgagatcgagggcgagcgcgccgccgcctccaccaccggcgccggcaccagcgccgcctccaccacgccgccgcagcagcagcacaccgccaatgccgccggcggctacgccgggtacgccgccccgggagccggccccggcggcatgatgatgatgatggggcagcccatgtacggctcgccgccaccgccgccacagcagcagcagcagcaacaccaccacatggcaatgggaggaagaggcggcttcggtcatcatcccggcggcggcggcggcgggtcgtcgtcgtcgtcggggcacggtcggcaaaacaggggcgcttgacatcgctccgagacgagtagcatgcaccat

SEQ ID NO: 504 - protein, 219 aa, Oryza sativa (japonica cultivar-group)
  G3397,CAAT domain coordinates 23-112
MPDSDNDSGGPSNYAGGELSSPREQDRFLPIANVSRIMKKALPANAKISKDAKETVQECVSEFISFITGEASDKCQREKRKTINGDDLLWAMTTLGFEDYVDPLKHYLHKFREIEGERAAASTTGAGTSAASTTPPQQQHTANAAGGYAGYAAPGAGPGGMMMMMGQPMYGSPPPPPQQQQQQHHHMAMGGRGGFGHHPGGGGGGSSSSSGHGRQNRGA

SEQ ID NO: 505 - DNA, 761 bp, Oryza sativa (japonica cultivar-group)
  G3398,family:CAAT
cctctcctcttcgtcttcctcctcgccttcgcttcgactgcttcgatcgagggagatcgaggttgcgatgccggattcggacaacgagtcaggggggccgagcaacgcgggggagtacgcgtcggcgagggagcaggacaggttcctgccgatcgcgaacgtgagcaggatcatgaagagggcgctcccggcgaacgccaagatcagcaaggacgccaaggagacggtgcaggagtgcgtctcggagttcatctccttcatcaccggcgaggcctccgacaagtgccagcgggagaagcgcaagaccatcaacggcgacgacctcctctgggcgatgaccacgctcggcttcgaggactacatcgacccgctcaagctctacctccacaagttccgcgagctcgagggcgagaaggccatcggcgccgccggcagcggcggcggtggcgccgcctcctccggcggctccggctccggctccggctcgcaccaccaccaggatgcttcccggaacaatggcggatacggcatgtacggcggcggcggcggcatgatcatgatgatgggacagcctatgtacggctcgccgccggcgtcgtcagctgggtacgcgcagccgccgccgccccaccaccaccaccaccagatggtgatgggagggaaaggtgcgtatggccatggcggcggcggcggcggcgggccctccccgtcgtcgggatacggccggcaagacaggctatgagcttgctttcttggttggt

SEQ ID NO: 506 - protein, 224 aa, Oryza sativa (japonica cultivar-group)
  G3398,CAAT domain coordinates 21-110
MPDSDNESGGPSNAGEYASAREQDRFLPIANVSRIMKRALPANAKISKDAKETVQECVSEFISFITGEASDKCQREKRKTINGDDLLWAMTTLGFEDYIDPLKLYLHKFRELEGEKAIGAAGSGGGGAASSGGSGSGSGSHHHQDASRNNGGYGMYGGGGGMIMMMGQPMYGSPPASSAGYAQPPPPHHHHHQMVMGGKGAYGHGGGGGGGPSPSSGYGRQDRL

SEQ ID NO: 507 - DNA, 1152 bp, Oryza sativa (japonica cultivar-group)
  G3404,family:AT-hook
accgtgagagagggagacagatggatccggtgacggcggcggcggcgcatgggggtgggcaccaccaccaccaccacttcggagcgccaccggtggcggcgttccaccaccacccgttccaccacggcggcggggcgcactacccggcggcgttccagcagtttcaggaggagcagcagcagcttgtggcggcggcggcggcggctggtgggatggcgaagcaggagctggtggatgagagcaacaacaccatcaacagcggcgggagcaacgggagcggcggggaggagcagaggcagcagtccggggaggagcagcaccagcaaggggcggcggcgccggtggtgatccggcgtcccaggggccgccccgccggctccaagaacaagcccaagcctccggtcatcatcacgcgcgacagcgccagcgcgctgcgggcgcacgtcctcgaggtcgcctccgggtgcgacctcgtcgacagcgtcgccacgttcgcgcgccgccgccaggtcggtgtctgcgtgctcagcgccaccggcgccgtcaccaacgtctccgtccggcagcccggcgcgggccccggcgccgtcgtcaacctcaccggccgcttcgacatcctctcgctgtccggctccttcctcccgccgccggcgcctccctccgccaccggcctcaccgtctacgtctccggcggccaggggcaggtcgtgggcggcacggtcgccggaccgctcatcgccgtcggccccgtcgtcatcatggccgcctcgttcgggaacgccgcctacgagcgcctcccgctcgaggacgacgagccgccgcagcacatggcgggcggcggccagtcctcgccgccgccgccgccgctgccattaccaccacaccagcagccgattcttcaagaccatctgccacacaacctgatgaacggaatccacctccccggcgacgccgcctacggctggaccagcggcggcggcggcggcggccgcgcggcgccgtactgatcaacatcgatctcgccggagagaaaaaaaatggaggagaaggatcggagcgagccgtgcatggtgtaggatgaattaagctaagagttaatttcttcttccgcctttgctaatcatgatgctctcgtgttgtttaatctgtggc

SEQ ID NO: 508 - protein, 328 aa, Oryza sativa (japonica cultivar-group)
  G3404,AT-hook domain coordinates 111-119,120-263
MDPVTAAAAHGGGHHHHHHFGAPPVAAFHHHPFHHGGGAHYPAAFQQFQEEQQQLVAAAAAAGGMAKQELVDESNNTINSGGSNGSGGEEQRQQSGEEQHQQGAAAPVVIRRPRGRPAGSKNKPKPPVIITRDSASALRAHVLEVASGCDLVDSVATFARRRQVGVCVLSATGAVTNVSVRQPGAGPGAVVNLTGRFDILSLSGSFLPPPAPPSATGLTVYVSGGQGQVVGGTVAGPLIAVGPVVIMAASFGNAAYERLPLEDDEPPQHMAGGGQSSPPPPPLPLPPHQQPILQDHLPHNLMNGIHLPGDAAYGWTSGGGGGGRAAPY

SEQ ID NO: 509 - DNA, 1013 bp, Oryza sativa (japonica cultivar-group)
  G3405,family:AT-hook
ctagctaattgattgctagcttgcaaggatggatccggtcacggcatcaatacacggtcaccatcttcctccaccgttcaacacccgcgacttccatcaccatctccagcagcagcagcaccagctgcatctcaagaccgaggatgaccaaggcggcggcactccgggtgtcttcggcagccgcggcaccaagcgcgaccacgacgacgacgagaacagtggcaacggccatggaagcggtggtgacggcggtgacctcgcgctggtacccccctcgggtggcgggccggacggcgccgggagcgagagcgccacgcgccgcccgaggggacgcccggcggggtccaagaacaagccgaagccaccgatcatcatcaccagggacagcgccaacacgctccggacgcacgtcatggaggtggccggcggctgcgacatctccgagagcatcaccacgttcgcgcgacgccggcagcgcggggtttgcgtgctcagcggcgccggcaccgtcactaacgtcacgctgcggcagcccgcatcgcagggagcggtcgttgcgctccacggccggttcgagatactctccctctccggctccttcctcccgccgcccgccccgccggaggccacggggctcaccgtctacctggccggaggccagggccaggtcgtgggcggcagcgtcgtcggcgcgctgaccgcggctgggcctgtggtgataatggcggcgtcttttgcgaacgcggtgtacgagcggctgccgttggaggacgacgagctactggcggctcaagggcaagccgacagcgctgggttgctcgccgcggggcagcaagcggcgcagctcgccggcggggccgtcgatccaagcctcttccaaggactaccaccaaacctactcggaaacgtgcagctgccgccggaagccgcctacggatggaaccctggagccggcggtggccgcccggcgccgttctgagatggatcgattccgcgacagcaacgcagcatag

SEQ ID NO: 510 - protein, 316 aa, Oryza sativa (japonica cultivar-group)
  G3405,AT-hook domain coordinates 97-105,106-248
MDPVTASIHGHHLPPPFNTRDFHHHLQQQQHQLHLKTEDDQGGGTPGVFGSRGTKRDHDDDENSGNGHGSGGDGGDLALVPPSGGGPDGAGSESATRRPRGRPAGSKNKPKPPIIITRDSANTLRTHVMEVAGGCDISESITTFARRRQRGVCVLSGAGTVTNVTLRQPASQGAVVALHGRFEILSLSGSFLPPPAPPEATGLTVYLAGGQGQVVGGSVVGALTAAGPVVIMAASFANAVYERLPLEDDELLAAQGQADSAGLLAAGQQAAQLAGGAVDPSLFQGLPPNLLGNVQLPPEAAYGWNPGAGGGRPAPF

SEQ ID NO: 511 - DNA, 918 bp, Oryza sativa (japonica cultivar-group)
  G3406,family:AT-hook
atggcaggtctcgacctcggcaccgccgcgacgcgctacgtccaccagctccaccacctccaccccgacctccagctgcagcacagctacgccaagcagcacgagccgtccgacgacgaccccaacggcagcggcggcggcggcaacagcaacggcgggccgtacggggaccatgacggcgggtcctcgtcgtcaggtcctgccaccgacggcgcggtcggcgggcccggcgacgtggtggcgcgccggccgcgggggcgcccgcctggctccaagaacaagccgaagccgccggtgatcatcacgcgggagagcgccaacacgctgcgcgcccacatcctggaggtcgggagcggctgcgacgtgttcgagtgcgtctccacgtacgcgcgccggcggcagcgcggcgtgtgcgtgctgagcggcagcggcgtggtcaccaacgtgacgctgcgtcagccgtcggcgcccgcgggcgccgtcgtgtcgctgcacgggaggttcgagatcctgtcgctctcgggctccttcctcccgccgccggctccccccggcgccaccagcctcaccatcttcctcgccgggggccagggacaggtcgtcggcggcaacgtcgtcggcgcgctctacgccgcgggcccggtcatcgtcatcgcggcgtccttcgccaacgtcgcctacgagcgcctcccactggaggaggaggaggcgccgccgccgcaggccggcctgcagatgcagcagcccggcggcggcgccgatgctggtggcatgggtggcgcgttcccgccggacccgtctgccgccggcctcccgttcttcaacctgccgctcaacaacatgcccggtggcggcggctcacagctccctcccggcgccgacggccatggctgggccggcgcacggccaccgttctga

SEQ ID NO: 512 - protein, 305 aa, Oryza sativa (japonica cultivar-group)
  G3406,AT-hook domain coordinates 82-90,91-232
MAGLDLGTAATRYVHQLHHLHPDLQLQHSYAKQHEPSDDDPNGSGGGGNSNGGPYGDHDGGSSSSGPATDGAVGGPGDVVARRPRGRPPGSKNKPKPPVIITRESANTLRAHILEVGSGCDVFECVSTYARRRQRGVCVLSGSGVVTNVTLRQPSAPAGAVVSLHGRFEILSLSGSFLPPPAPPGATSLTIFLAGGQGQVVGGNVVGALYAAGPVIVIAASFANVAYERLPLEEEEAPPPQAGLQMQQPGGGADAGGMGGAFPPDPSAAGLPFFNLPLNNMPGGGGSQLPPGADGHGWAGARPPF

SEQ ID NO: 513 - DNA, 987 bp, Oryza sativa (japonica cultivar-group)
  G3407,family:AT-hook
tcatcatcatcatcacttgcatatcgaattattaataatatcgaagatggcaggccttgatttgggcaccagctacctccaccaccaccaatcactgcatctccgccacgacgatggcggcgccggctccgacgacggcggccacgacgacctctcgccggggagcggcggtggcggcgggcccagcagcacggccggtggcgccgggatcggcggcggcgaggtcgtcgctcgccgcccccgcggccgcccgccgggctccaagaacaagcccaagccgccggtgatcatcaccagggagagcgccaacgcgctcagggcgcatatcctcgaggtagccgccggttgcgatgtgttcgaggcgctgacggcgtacgcgcgccgccggcagcgcggggtgtgcgtgctctcggcggcggggacagtggcgaacgtcacgctccggcagccgcagtcggcgcagcccgggccggcctcgccggcggtggcgacgctgcacggcaggttcgagatactctccctcgcgggctccttcctgcccccgcccgcgccgccgggcgccaccagcctcgccgcgttcctcgccggcgggcaggggcaggtcgtcggtggcagcgtcgccggcgcgctcatcgcggcggggcccgtcgtcgtcgtcgccgcgtcgttcagcaacgtggcgtacgagaggctgccgctcgaggacggcgacgaggtggtccccccggcgccggcagggagcgaccagggcggcggcggcagcggcggcatgccaccattaggcgttgatccgtcgggcggcgccgccaccggtgggctcccgttcttcaacatgccgttcgggatgccgccaatgccggtggacggccacgccggctggcctggcgccggcgtcgggaggccaccgttctcatgatggatggatccccatattccggcgagcggccggcggcgaggtggtcggcaagattgaagacatggacatgg

SEQ ID NO: 514 - protein, 289 aa, Oryza sativa (japonica cultivar-group)
  G3407,AT-hook domain coordinates 63-71,72-220
MAGLDLGTSYLHHHQSLHLRHDDGGAGSDDGGHDDLSPGSGGGGGPSSTAGGAGIGGGEVVARRPRGRPPGSKNKPKPPVIITRESANALRAHILEVAAGCDVFEALTAYARRRQRGVCVLSAAGTVANVTLRQPQSAQPGPASPAVATLHGRFEILSLAGSFLPPPAPPGATSLAAFLAGGQGQVVGGSVAGALIAAGPVVVVAASFSNVAYERLPLEDGDEVVPPAPAGSDQGGGGSGGMPPLGVDPSGGAATGGLPFFNMPFGMPPMPVDGHAGWPGAGVGRPPFS

SEQ ID NO: 515 - DNA, 920 bp, Oryza sativa (japonica cultivar-group)
  G3429,family:CAAT
ccaggtcattgagacttgagagacatggcagggaacaaaaagcgtggtatagtagtatagtcagtactaggattagtacttgataactagcacaacaaaaagctactatcatttttgcattcaaagtggtaattaagaatcggatgatcattttgattgttcctcttcatttgttttggatgtcaggtggcaggaacatggatcaggtcaagaaggcggcagtgagatcggatggggtgggaggtagtgcgaccaacgccgagctgccgatggccaacctcgtacgcctgataaagaaggtgctcccagggaaagcgaagatcgggggagcagccaagggtctcacccatgattgcgcggtggagttcgtcgggttcgtcggcgacgaggcctccgagaaggccaaggcagagcaccgccgcaccgtagcgccggaagactacttgggctcattcggcgaccttggcttcgatcgctacgtcgaccccatggatgcctacatccatggttaccgtgagtttgagagggctggtgggaataggagggtggcgccgcctcctccggcggcagctacaccgctgacgcccggtggaccgacattcactgacgcagagctgcagtttctccggtcggtgatcccctccagaagtgatgatgaatatagcggctcatcaccagccataggcggctatggctatggatatggctatggaaaaaatatgtgaacaacttgatgcatgtgtgtgtgtacactgcatgcatgcgtggagggtcaaacagagtcaagactcttgtggtggtttcaataagtctctagtgacaatataagttgtgtatcgttgtttcctttgtaaaaaaaaaaacgtcatgtatcgttgtgtgtcctcatccggtaatcctttacgtgggtgggttatggc

SEQ ID NO: 516 - protein, 193 aa, Oryza sativa (japonica cultivar-group)
  G3429,CAAT domain coordinates 40-124
MIILIVPLHLFWMSGGRNMDQVKKAAVRSDGVGGSATNAELPMANLVRLIKKVLPGKAKIGGAAKGLTHDCAVEFVGFVGDEASEKAKAEHRRTVAPEDYLGSFGDLGFDRYVDPMDAYIHGYREFERAGGNRRVAPPPPAAATPLTPGGPTFTDAELQFLRSVIPSRSDDEYSGSSPAIGGYGYGYGYGKNM

SEQ ID NO: 517 - DNA, 1290 bp, Zea mays
  G3432,family:AP2
ctatagctagcactagcagtggtgcacactgaaatggacagcgccagcagcctcgtggacgacaccagtagcggtggcggcggcggcgcgtccacggacaagctaagggctctggccgtcttcgccgccgcctcggggacgccgctggagcgcatgggcagcggcgccagcgcggtcgtggacgcggccgagccgggcgccgaggcggactccggttccggtgccgccgcggtgagcgtcggcgggaagctgccgtcgtcaaggtacaagggcgtggtgccgcagcccaacgggcggtggggcgcgcagatctacgagcgccaccagcgcgtgtggctcggcaccttcgcgggcgaggccgacgcggcgcgcgcctacgacgtcgcggcgcagcggttccgcggccgcgacgcggtcaccaacttccgcccgctcgcggacgccgacccggacgccgccgccgagctccggttcctggcgtcccgctccaaggccgaggtcgtcgacatgctccgcaagcacacctacttcgacgagctcgcgcagaacaagcgcgccttcgccgccgcgtccgcgtccgcggccaccgcctcgtcgctggccaacaacccttcttcctacgcgtcgctctcccccgcgaccgcgacggccgccgcgcgggagcacctcttcgacaagacggtcacccccagcgacgtgggcaagctgaaccggctggtgatcccgaagcagcacgccgagaagcacttcccgctgcagctcccatccgccggcggcgagagcaagggcgtgctcctcaacctggaggacgccgcgggcaaggtgtggcggttccgctactcgtactggaacagcagccagagctacgtgctcaccaagggctggagccgcttcgtcaaggagaagggcctccaagccggcgacgtcgtcggcttctaccgctccgctgccggcgccgacaccaagctcttcatcgactgcaagctgcggcccaacagcgtcgtcgtcgcctcgacggcaggcccgtcgcctccggcgccggtggcgaaggccgtgcgtctcttcggcgtcgacctgctgacggcaccggccaccgccgcggcgccggcggaggccgtggccgggtgcaagagagccagggacttgggttcgcccccgcaggcggcgttcaagaagcagctcgtggagctggcactagtgtagattaatgctacggagcgatcgatctttccctggctagctagtcttttttttttttgctcgatcgctcaactcagatggtagcatcat

SEQ ID NO: 518 - protein, 389 aa, Zea mays
  G3432,AP2 domain coordinates 75-140,212-299
MDSASSLVDDTSSGGGGGASTDKLRALAVFAAASGTPLERMGSGASAVVDAAEPGAEADSGSGAAAVSVGGKLPSSRYKGVVPQPNGRWGAQIYERHQRVWLGTFAGEADAARAYDVAAQRFRGRDAVTNFRPLADADPDAAAELRFLASRSKAEVVDMLRKHTYFDELAQNKRAFAAASASAATASSLANNPSSYASLSPATATAAAREHLFDKTVTPSDVGKLNRLVIPKQHAEKHFPLQLPSAGGESKGVLLNLEDAAGKVWRFRYSYWNSSQSYVLTKGWSRFVKEKGLQAGDVVGFYRSAAGADTKLFIDCKLRPNSVVVASTAGPSPPAPVAKAVRLFGVDLLTAPATAAAPAEAVAGCKRARDLGSPPQAAFKKQLVELALV

SEQ ID NO: 519 - DNA, 1437 bp, Zea mays
  G3433,family:AP2
cccacgcgtccgcccacgcgtccgcgcaagcgcaacagaagcatactacgccgctacgcgctgggcggtgccgcacagctatagatagctagcagtgttgcatagaaatggacagcgccagcagcctcgtggacgacaccagcggcagcggcggcggcgcgtgcacggacaagctaagggctttggccgccgccgccgcctccgcctcggggccaccgccggagcgcatgggcagcggagccagcgcggtcgtggacgcggccgagccgggcgccgaggcggactccggctccgccccggcctccgtcgccgccgtcgcggcgggcgtgggcgggaagctgccgtcgtccaggtacaagggcgtggtgccgcagcccaacgggcggtggggcgcgcagatctacgagcgccacctgcgcgtgtggctcggcaccttcacgggcgaggccgaggccgcgcgcgcctacgacgtggccgcgcagcggttccgggggcgcgacgccgtcaccaacttccgcccgctcgcggagtcggacttggacccggacgccgccgccgagctccggttcctcgcgtcccggtccaaggccgaggtcgtcgacatgctccgcaagcacacctacggcgaggagctcgcgcagaacaggcgcgccttcgccgctgcggcggcgtccctggcctcgccgcagctgccgccggccaagaacactagcccggcggcggcgcgcgagcacatgttcgacaaggtgctgaccccgagcgacgtaggcaagctcaaccggctggtggtgccaaagcagcacgcggagcggttcttcccggcggccggcgccgggtcgacgcagctgtgcttccaggaccgcggcggggcgctgtggcagttccgctactcctactgggggagcagccagagctatgtcatgaccaaggggtggagccgcttcgtccgcgccgcacgacttgccgcgggggacaccgtcaccttctcccgcagcggcggcggccgatacttcatcgagtaccgccactgccagcgccggcgccgcgacgtcgatatcagcttcggcgacgctgccaccgtgccggcgtggccgaggccgatagttatcggaaccgcggccatgaataatgggggtgcaacggtggcgtccgccaccatcgccggccatgacatcgaggtggcagtggcaccctcgggggcgaggagcttcaggctcttcgggttcaatgttgagtgcagcggcgacgatgcaccggcaccggcacctgctcccgccgaagtggagtatgtcgacggcgacacctagtagcagcggcggcgtagagtgcgcagagagacgatgaacgatggtgatctactgatcagggaccttattacaccataggtggcgtgcatgccttgttgaatcttaattagtcatgtttttcgaaaaaaaa

SEQ ID NO: 520 - protein, 399 aa, Zea mays
  G3433,AP2 domain coordinates 80-151,210-291
MDSASSLVDDTSGSGGGACTDKLRALAAAAASASGPPPERMGSGASAVVDAAEPGAEADSGSAPASVAAVAAGVGGKLPSSRYKGVVPQPNGRWGAQIYERHLRVWLGTFTGEAEAARAYDVAAQRFRGRDAVTNFRPLAESDLDPDAAAELRFLASRSKAEVVDMLRKHTYGEELAQNRRAFAAAAASLASPQLPPAKNTSPAAAREHMFDKVLTPSDVGKLNRLVVPKQHAERFFPAAGAGSTQLCFQDRGGALWQFRYSYWGSSQSYVMTKGWSRFVRAARLAAGDTVTFSRSGGGRYFIEYRHCQRRRRDVDISFGDAATVPAWPRPIVIGTAAMNNGGATVASATIAGHDIEVAVAPSGARSFRLFGFNVECSGDDAPAPAPAPAEVEYVDGDT

SEQ ID NO: 521 - DNA, 819 bp, Zea mays
  G3434,family:CAAT
tcgacaagggttgcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatggggaaacctaacaaagggctaatacagcagcaatttatgctagggaagtctctgcattgcttaccatgtgtattggcagaaaacaggaggcacttacaaagggtgttaatctctgcgatggctgcctctcaggtgtaaattggcttcggtttagcgctgcttttgtccgtatatttaggatgatttgactgttgctacttttggcaaccttttacatttacagatatgtattattcagcataaatataatatagtagtcctaggcctaaataatggtgattaaaaaaaaaaaaaaaa

SEQ ID NO: 522 - protein, 164 aa, Zea mays
  G3434,CAAT domain coordinates 18-107
MADDGGSHEGSGGGGGVREQDRFLPIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNQGMGYMQPQYHNGET

SEQ ID NO: 523 - DNA, 735 bp, Zea mays
  G3435,family:CAAT
cggcggtggccttgagctgaggcggcggagcgatgccggactcggacaacgactccggcgggccgagcaacgccgggggcgagctgtcgtcgccgcgggagcaggaccggttcctgcccatcgccaacgtgagccggatcatgaagaaggcgctcccggccaacgccaagatcagcaaggacgccaaggagacggtgcaggagtgcgtgtccgagttcatctccttcatcaccggcgaggcctccgacaagtgccagcgcgagaagcgcaagaccatcaacggcgacgacctgctgtgggccatgaccacgctcggcttcgaggactacgtcgagccgctcaagcactacctgcacaagttccgcgagatcgagggcgagagggccgccgcgtccgccggcgcctcgggctcgcagcagcagcagcagcagggcgagctgcccagaggcgccgccaatgccgccgggtacgccgggtacggcgcgcctggctccggcggcatgatgatgatgatgatggggcagcccatgtacggcggctcgcagccgcagcaacagccgccgccgcctcagccgccacagcagcagcagcaacatcaacagcatcacatggcaataggaggcagaggaggattcggccaacaaggcggcggcggcggctcctcgtcgtcgtcagggcttggccggcaagacagggcgtgagttgcgacgatacgtcagaatcagaatcgctgat

SEQ ID NO: 524 - protein, 222 aa, Zea mays
  G3435,CAAT domain coordinates 22-111
MPDSDNDSGGPSNAGGELSSPREQDRFLPIANVSRIMKKALPANAKISKDAKETVQECVSEFISFITGEASDKCQREKRKTINGDDLLWAMTTLGFEDYVEPLKHYLHKFREIEGERAAASAGASGSQQQQQQGELPRGAANAAGYAGYGAPGSGGMMMMMMGQPMYGGSQPQQQPPPPQPPQQQQQHQQHHMAIGGRGGFGQQGGGGGSSSSSGLGRQDRA

SEQ ID NO: 525 - DNA, 803 bp, Zea mays
  G3436,family:CAAT
tttgacttgaccggacagtgctgttcggtggctcggccgcgatgccggactccgacaacgagtccggcgggccgagcaacgcggagttctcgtcgccgcgggagcaggaccggttcctgccgatcgcgaacgtgagccggatcatgaagaaggcgctcccggccaacgccaagatctccaaggacgccaaggagacggtgcaggagtgcgtgtcggagttcatctccttcatcaccggcgaggcctccgacaagtgccagcgcgagaagcgcaagaccatcaacggcgacgacctactctgggccatgaccacgctcggcttcgaggactacgtcgagccgctcaagctctacctccacaagttccgcgagctcgagggcgagaaggcggccacgacgagcgcctcctccggcccgcagccgccgctgcacagggagacgacgccgtcgtcgtcaacgcacaatggcgcgggcgggcccgtcgggggatacggcatgtacggcggcgcgggcgggggaagcggtatgatcatgatgatgggacagcccatgtacggcggctccccgccggccgcgtcgtccgggtcgtacccgcaccaccagatggccatgggcggaaaaggtggcgcctatggctacggcggaggctcgtcgtcgtcgccgtcagggctcggcaggtaggacaggttgtgaccgtcgccgtccatgcttgcatggccatggccatggcatggctcccgccgccggcttcttgcttggtgtcggtaattagcgctggtggcctgcgctggttaagttcaccat

SEQ ID NO: 526 - protein, 212 aa, Zea mays
  G3436,CAAT domain coordinates 20-109
MPDSDNESGGPSNAEFSSPREQDRFLPIANVSRIMKKALPANAKISKDAKETVQECVSEFISFITGEASDKCQREKRKTINGDDLLWAMTTLGFEDYVEPLKLYLHKFRELEGEKAATTSASSGPQPPLHRETTPSSSTHNGAGGPVGGYGMYGGAGGGSGMIMMMGQPMYGGSPPAASSGSYPHHQMAMGGKGGAYGYGGGSSSSPSGLGR

SEQ ID NO: 527 - DNA, 1322 bp, Zea mays
  G3437,family:CAAT
tattgtctatgagggaagcagatcctctacgctgcaattgggccactgacatgtgggaccaggtctagattggacccacacatcaatgaccgaaatgcagaagagggtctcgttgccactgtaagctatctcctagagttcagagcagggcaagaatcttgcaatgctcacatgaacataatataatcgttgtgttagctatgcgtcggcatcactaccgtcctcccactggcatctcccgtctactattttgggacgaacagaacagagacactagctaactagcttattagcttgctcccctccttcctttcaagctttaaaaggagaccatctcttgcaccacctcttcatccatccggccaagcaaggggcatgaagaacaggaagggctacgggcaccagggccacctgctgagccccgtgggcagcccgctgtcggacaacgagtccggcgccgcggcagcggccggcggcggcgggtgcgggagcagcgtggggtactgcggcggcggcggcggtgagtcgccggccaaggagcaagaccggttcctgccgatcgccaacgtgtcgcgcatcatgaagcgctccctgccggcgaacgccaagatctccaaggaggccaaggagacggtgcaggagtgcgtgtccgagttcatcagcttcgtcacgggggaggcctccgacaagtgccagcgcgagaagcgcaagaccatcaacggcgacgacctgctctgggccatgaccacgctcggcttcgaggcctacgtcgccccgctcaagtcctacctcaaccgctaccgcgaggccgagggcgagaaggccgccgtgctcggcggcggcgcgcgccacggcgacggcgcggcgcggcggacgacgccggcccactcgccgcgcaatggcgcgggcgggcccgtcgggggatacggcatgtacggcggcgcgggcgggggaagcggtatgatcatgatgatggggcagcccatgtacggcggctccccgccggccgcgtcgtccgggtcgtacccgcaccaccagatggccatgggcggaaaaggtggcgcctatggctacggcggaggctcgtcgtcgtcgccgtcagggctcggcaggtaggccaggttgtgaccgtcgccgtccatgcttgcatggccatggcatggctcagtcccgccgccggcttcttgcttggtgtcggtaattagcgctggttaagttaaccttcggtttttccccccttttcttttcgtggtaagtaatgttgtgctgaatggagccagtgatatggttaagatagctccataacctctcggtaaaaaaaa

SEQ ID NO: 528 - protein, 246 aa, Zea mays
  G3437,CAAT domain coordinates 54-143
MKNRKGYGHQGHLLSPVGSPLSDNESGAAAAAGGGGCGSSVGYCGGGGGESPAKEQDRFLPIANVSRIMKRSLPANAKISKEAKETVQECVSEFISFVTGEASDKCQREKRKTINGDDLLWAMTTLGFEAYVAPLKSYLNRYREAEGEKAAVLGGGARHGDGAARRTTPAHSPRNGAGGPVGGYGMYGGAGGGSGMIMMMGQPMYGGSPPAASSGSYPHHQMAMGGKGGAYGYGGGSSSSPSGLGR

SEQ ID NO: 529 - DNA, 1253 bp, Glycine max
  G3451,family:AP2
ctagaatccgtacaatctaatcaacataacaaaaatggatgcaattagttgcatggatgagagcaccaccactgagtcactctctataagtctttctccgacgtcatcgtcggagaaagcgaagccttcttcgatgattacatcgtcggagaaggtttctctgtccccgccgccgtcaaacagactatgccgtgttggaagcggcgcgagcgcagtcgtggatcctgatggcggcggcagcggcgctgaggtagagtcgcggaaactcccctcgtcgaagtacaagggcgtggtgccccagcccaacggccgctggggtgcgcagatttacgagaagcaccagcgcgtgtggcttggaacgttcaacgaggaagacgaggcggcgcgtgcgtacgacatcgccgcgcagcggttccgcggcaaggacgccgtcacgaacttcaagccgctcgccggcgccgacgacgacgacggagaatcggagtttctcaactcgcattccaaacccgagatcgtcgacatgctgcgaaagcacacgtacaatgacgagctggagcagagcaagcgcagccgcggcgtcgtccggcggcgaggctccgccgccgccggcaccgcaaactcaatttccggcgcgtgctttactaaggcacgtgagcagctattcgagaaggctgttacgccgagcgacgttgggaaattgaaccgtttggtgataccgaagcagcacgcggagaagcactttccgttacagagctctaacggcgttagcgcgacgacgatagcggcggtgacggcgacgccgacggcggcgaagggcgttttgttgaacttcgaagacgttggagggaaagtgtggcggtttcgttactcgtattggaacagtagccagagttacgtcttaaccaaaggttggagccggttcgttaaggagaagaatctgaaagctggtgacacggtttgttttcaccggtccactggaccggacaagcagctttacatcgattggaagacgaggaatgttgttaacaacgaggtcgcgttgttcggaccggtcggaccggttgtcgaaccgatccagatggttcggctctttggggttaacattttgaaactacccggttcagatactattgttggcaataacaataatgcaagtgggtgctgcaatggcaagagaagagaaatggaactgttctcgttagagtgtagcaagaaacctaagattattggtgctttgtaacgttacgttaggc

SEQ ID NO: 530 - protein, 401 aa, Glycine max
  G3451,AP2 domain coordinates 80-141,209-308
MDAISCMDESTTTESLSISLSPTSSSEKAKPSSMITSSEKVSLSPPPSNRLCRVGSGASAVVDPDGGGSGAEVESRKLPSSKYKGVVPQPNGRWGAQIYEKHQRVWLGTFNEEDEAARAYDIAAQRFRGKDAVTNFKPLAGADDDDGESEFLNSHSKPEIVDMLRKHTYNDELEQSKRSRGVVRRRGSAAAGTANSISGACFTKAREQLFEKAVTPSDVGKLNRLVIPKQHAEKHFPLQSSNGVSATTIAAVTATPTAAKGVLLNFEDVGGKVWRFRYSYWNSSQSYVLTKGWSRFVKEKNLKAGDTVCFHRSTGPDKQLYIDWKTRNVVNNEVALFGPVGPVVEPIQMVRLFGVNILKLPGSDTIVGNNNNASGCCNGKRREMELFSLECSKKPKIIGAL

SEQ ID NO: 531 - DNA, 1081 bp, Glycine max
  G3452,family:AP2
caccaacacaaaatggatggaggctgtgtcacagacgaaaccaccacatccagcgactctctttccgttccgccgcccagccgcgtcggcagcgttgcaagcgccgtcgtcgaccccgacggttgttgcgtttccggcgaggccgaatcccggaaactcccttcgtcgaaatacaaaggcgtggtgccgcaaccgaacggtcgctggggagctcagatttacgagaagcaccagcgcgtgtggctcggcactttcaacgaggaagacgaagccgccagagcctacgacatcgccgcgctgcgcttccgcggccccgacgccgtcaccaacttcaagcctcccgccgcctccgacgacgccgagtccgagttcctcaactcgcattccaagttcgagatcgtcgacatgctccgcaagcacacctacgacgacgagctccagcagagcacgcgcggtggtaggcgccgcctcgacgctgacaccgcgtcgagcggtgtgttcgacgcgaaagcgcgtgagcagctgttcgagaaaacggttacgccgagcgacgtcgggaagctgaatcgattagtgataccgaagcagcacgcggagaagcactttccgttaagcggatccggcgacgaaagctcgccgtgcgtggcgggggcttcggcggcgaagggaatgttgttgaactttgaggacgttggagggaaagtgtggcggtttcgttactcttattggaacagtagccagagctacgtgcttaccaaaggatggagccggttcgttaaggagaagaatcttcgagccggtgacgcggttcagttcttcaagtcgaccggaccggaccggcagctatatatagactgcaaggcgaggagtggtgaggttaacaataatgctggcggtttgtttgttccgattggaccggtcgttgagccggttcagatggttcggcttttcggggtcaaccttttgaaactacccgtacccggttcggatggtgtagggaagagaaaagagatggaactgtttgcatttgaatgttgcaagaagttaaaagtaattggagctttgtaacattacatagtgc

SEQ ID NO: 532 - protein, 351 aa, Glycine max
  G3452,AP2 domain coordinates 51-116,171-266
MDGGCVTDETTTSSDSLSVPPPSRVGSVASAVVDPDGCCVSGEAESRKLPSSKYKGVVPQPNGRWGAQIYEKHQRVWLGTFNEEDEAARAYDIAALRFRGPDAVTNFKPPAASDDAESEFLNSHSKFEIVDMLRKHTYDDELQQSTRGGRRRLDADTASSGVFDAKAREQLFEKTVTPSDVGKLNRLVIPKQHAEKHFPLSGSGDESSPCVAGASAAKGMLLNFEDVGGKVWRFRYSYWNSSQSYVLTKGWSRFVKEKNLRAGDAVQFFKSTGPDRQLYIDCKARSGEVNNNAGGLFVPIGPVVEPVQMVRLFGVNLLKLPVPGSDGVGKRKEMELFAFECCKKLKVIGAL

SEQ ID NO: 533 - DNA, 1442 bp, Glycine max
  G3453,family:AP2
acgagtatagctcttaaaatactcaacaataaccaaacctaatcaaaacccttatctacactcacttcacacaaaccaaagttagttcgttaaccgttacaaacacaaaatggatggaggcagtgtcacagacgaaaccaccacaaccagcaactctctttcggttccggcgaatctatctccgccgcctctcagccttgacggaagcggcgcaaccgccgtcgtctaccccgacggttgttgcgtctccggcgaagccgaatcccggaaactcccgtcctcgaaatacaaaggcgtggtgccgcaaccgaacggtcgttggggagctcagatttacgagaagcaccagcgcgtgtggctcggcaccttcaacgaggaagacgaagccgtcagagcctacgacatcgtcgcgcatcgcttccgcggccgcgacgccgtcactaacttcaagcctctcgccggcgccgacgacgccgaagccgagttcctcagcacgcattccaagtccgagatcgtcgacatgctccgcaggcacacctacgacaacgagctccagcagagcacccgcggcggcaggcgccgccgggacgccgaaaccgcgtcgagcggcgcgttcgacgcgaaggcgcgtgagcagctggtcgagaaaaccgttacgccgagcgacgtcgggaagctgaaccgattagtgataccaaagcagcacgcggagaagcactttccgttaagcggatccggcggcggagccttgccgtgcatggcggcggctgcgggggcgaaaggaatgttgctgaactttgaggacgttggagggaaagtgtggcggttccgttactcgtattggaacagtagccagagctacgtgcttaccaaaggatggagccggttcgttaaggagaagaatcttcgagctggtgacgcggttcagttcttcaagtcgaccggactggaccggcaactatatatagactgcaaggcgaggagtggtaaggttaacaataatgctgccggtttgtttattccggttggaccggttgttgagccggttcagatggtacggcttttcggggtcgaccttttgaaactacccgtacccggttcggatggtattggggttggctgtgacgggaagagaaaagagatggagctgtttgcatttgaatgtagcaagaagttaaaagtaattggagctttgtaacattacatagtttttgagtttcttttgttaattttgtaactgttgaattcgtgaggtagagatggtgatggcgttgttgttgcaagttgccactcacaaaacgtgtatattcttaatttgatgggaaaaaaaaggagaaattagggcaagaagaattgtataatgcaaaggtttttttcaaaagaaaggaacatggagtgccactatttatttttgtaaaaaaacagagaaaagggcggcccgc

SEQ ID NO: 534 - protein, 362 aa, Glycine max
  G3453,AP2 domain coordinates 57-122,177-272
MDGGSVTDETTTTSNSLSVPANLSPPPLSLDGSGATAVVYPDGCCVSGEAESRKLPSSKYKGVVPQPNGRWGAQIYEKHQRVWLGTFNEEDEAVRAYDIVAHRFRGRDAVTNFKPLAGADDAEAEFLSTHSKSEIVDMLRRHTYDNELQQSTRGGRRRRDAETASSGAFDAKAREQLVEKTVTPSDVGKLNRLVIPKQHAEKHFPLSGSGGGALPCMAAAAGAKGMLLNFEDVGGKVWRFRYSYWNSSQSYVLTKGWSRFVKEKNLRAGDAVQFFKSTGLDRQLYIDCKARSGKVNNNAAGLFIPVGPVVEPVQMVRLFGVDLLKLPVPGSDGIGVGCDGKRKEMELFAFECSKKLKVIGAL

SEQ ID NO: 535 - DNA, 1188 bp, Glycine max
  G3454,family:AP2
atggatgcaattagttgcatggatgagagcaccaccaccgagtcactctccataagtcaggcgaagccttcttcgacgattatgtcgtccgagaaggcttctccttccccgccgccgccgaacaggctgtgccgcgtcggtagcggtgctagcgcagtcgtggattccgacggcggcggcgggggtggcagcaccgaggtggagtcgcggaagctcccctcgtccaagtataagggcgtcgtgccccagcccaacggccgctggggctcgcagatttacgagaagcaccagcgcgtgtggctgggaacgttcaacgaggaagacgaggcggcgcgtgcgtacgacgtcgccgtgcagcgattccgcggcaaggactccgtcacgaacttcaagccgctcgccggcgccgacgacgacgacggagaatcggagtttctcaactcgcattccaaacccgagatcgtcgacatgctgcgaaagcacacgtacaatgacgagctggagcatagcaagcgcaaccgcggcgtcgtccggcggcgaggctccgccgccgtcggcaccgcagactcaatttccggcgcgtgctttactaatgcacgtgagcagctattcgagaaagctgttacgccgagcgacgtttggaaattgaaccgtttggtgataccgaagcagcacgcggagaagcactttccgttacagagctctaacggcgttagcgcgacgacgatagcggcggtgacggcgacgccgacggcggcgaagggcgttttgttgaacttcgaagacgttggagggaaagtgtggcggtttcgttactcgtattggaacagtagccagagttacgtcttaaccaaaggttggagccggttcgttaaggagaagaatctgaaagctggtgacacggtttgttttcaccggtccactggaccggacaagcagctttacatcgattggaagacgaggaatgttgttaacaacgaggtcgcgttgttcggaccggtcggaccggttgtcgaaccgatccagatggttcggctctttggggttaacattttgaaactacccggttcagatactattgttggcaataacaataatgcaagtgggtgctgcaatggcaagagaagagaaatggaactgttctcgttagagtgtagcaagaaacctaagattattggtgctttgtaa

SEQ ID NO: 536 - protein, 395 aa, Glycine max
  G3454,AP2 domain coordinates 74-141,203-302
MDAISCMDESTTTESLSISQAKPSSTIMSSEKASPSPPPPNRLCRVGSGASAVVDSDGGGGGGSTEVESRKLPSSKYKGVVPQPNGRWGSQIYEKHQRVWLGTFNEEDEAARAYDVAVQRFRGKDSVTNFKPLAGADDDDGESEFLNSHSKPEIVDMLRKHTYNDELEHSKRNRGVVRRRGSAAVGTADSISGACFTNAREQLFEKAVTPSDVWKLNRLVIPKQHAEKHFPLQSSNGVSATTIAAVTATPTAAKGVLLNFEDVGGKVWRFRYSYWNSSQSYVLTKGWSRFVKEKNLKAGDTVCFHRSTGPDKQLYIDWKTRNVVNNEVALFGPVGPVVEPIQMVRLFGVNILKLPGSDTIVGNNNNASGCCNGKRREMELFSLECSKKPKIIGAL

SEQ ID NO: 537 - DNA, 1301 bp, Glycine max
  G3455,family:AP2
tcttagaatccgtacggtctaatcaacacaacaaaatggatgcaattagttgcctggatgagagcaccaccaccgagtcactctccataagtcaggcgaagccttcttcgacgattatgtcgtccgagaaggcttctccttccccgccgccgccgaacaggctgtgccgcgtcggtagcggtgctagcgcagtcgtggattccgacggcggcggcgggggtggcagcaccgaggtggagtcgcggaagctcccctcgtccaagtataagggcgtcgtgccccagcccaacggccgctggggctcgcagatttacgagaagcaccagcgcgtgtggctgggaacgttcaacgaggaagacgaggcggcgcgtgcgtacgacgtcgccgtgcagcgattccgcggcaaggacgccgtcacaaacttcaagccgctctccggcaccgacgacgacgacggggaatcggagtttctcaactcgcattcgaaatccgagatcgtcgacatgctgcgtaagcatacgtacaatgacgagctggaacaaagcaagcgcagccgcggcttcgtacgtcggcgcggctccgccgccggcgccggaaacggaaactcaatctccggcgcgtgtgttatgaaggcgcgtgagcagctattccagaaggccgttacgccgagcgacgttgggaaactgaaccgtttggtgataccgaagcagcacgcggagaagcactttcctttacagagcgctgctaacggcgttagcgcgacggcgacggcggcgaagggcgttttgttgaacttcgaagacgttggagggaaagtgtggcggtttcgttactcgtattggaacagtagccagagttacgtcttgaccaaaggttggagccggttcgttaaggagaagaatctgaaagccggtgacacggtttgttttcaacggtccactggaccggacaggcagctttacatcgattggaagacgaggaatgttgttaacgaggtcgcgttgttcggaccggttgtcgaaccgatccagatggttcggctctttggtgttaacattttgaaactacccggttcagattctatcgccaataacaataatgcaagtgggtgctgcaatggcaagagaagagaaatggaactcttttcattagagtgtagcaagaaacctaagattattggtgctttgtagcgttacgttactttttttgagttttttttttttttttgagttttgtgactgatgaaagaaagaaggtacaagaagaacggcggtgtagtggcatagtggcatcgcaagttg

SEQ ID NO: 538 - protein, 384 aa, Glycine max
  G3455,AP2 domain coordinates 74-143,201-300
MDAISCLDESTTTESLSISQAKPSSTIMSSEKASPSPPPPNRLCRVGSGASAVVDSDGGGGGGSTEVESRKLPSSKYKGVVPQPNGRWGSQIYEKHQRVWLGTFNEEDEAARAYDVAVQRFRGKDAVTNFKPLSGTDDDDGESEFLNSHSKSEIVDMLRKHTYNDELEQSKRSRGFVRRRGSAAGAGNGNSISGACVMKAREQLFQKAVTPSDVGKLNRLVIPKQHAEKHFPLQSAANGVSATATAAKGVLLNFEDVGGKVWRFRYSYWNSSQSYVLTKGWSRFVKEKNLKAGDTVCFQRSTGPDRQLYIDWKTRNVVNEVALFGPVVEPIQMVRLFGVNILKLPGSDSIANNNNASGCCNGKRREMELFSLECSKKPKIIGAL

SEQ ID NO: 539 - DNA, 1153 bp, Glycine max
  G3458,family:AT-hook
tcgcccacgcgtccgtacggctgcgagaagacgacagaaggggccactttatttgtctctctctttcccttccaacctcatcccattccgttttctctgcagtactcaattgatccctttgtttttctattcgttctgagagctttgtgtgtatggccggcatagacttgggttcagcatcacattttgttcatcatcgccttgaacgccctgaccttgaagacgatgagaaccaacaagaccaagacaacaaccttaacaatcacgaagggcttgacctagttacaccaaattcaggtcctggtgatgttgttggtcgcaggccaagaggaagacctccaggttcaaagaacaagccaaaaccaccagttatcatcacaagagagagtgcaaacacccttagggctcacatccttgaagttagtagtggttgtgacgtctttgaatcggtcgctacctatgcaaggaagcgacaaagagggatctgtgtcctcagtgggagtggcaccgtgaccaacgtgacattgaggcagccggccgcggctggtgccgtcgtcacgctgcacggaaggtttgagatcctctctttgtcaggatcattcctcccacctccagctccaccaggtgctacaagtttgactgtgttccttggtggaggacagggtcaagtggtgggaggaaatgttgttggtcctttggtggcttctgggcctgttattgttattgcttcatcttttactaatgtagcatatgagaggttgcctttggatgaagatgaatctatgcagatgcaacaagggcaatcatcagctggtgatggtagcggtgaccatggtggtggagttagtaataactcttttccggatccgtcttccgggcttccattcttcaatttgccactaaacatgcctcagttacctgttgatggttgggctggcaactctggtggaaggcaatcttactgatccagagtctttgggggcacaaaggtgagaagttgaattgatctcatatatattggtcttctctaatctttcctctgaatattgcttgtgaagaagtactgatttttctattgaagaaatcgtttgtttggctaggtttgttgtaaggacgatcagtttctaggaacaactgtaaaacgttttctctt

SEQ ID NO: 540 - protein, 270 aa, Glycine max
  G3458,AT-hook domain coordinates 56-64,65-207
MAGIDLGSASHFVHHRLERPDLEDDENQQDQDNNLNNHEGLDLVTPNSGPGDVVGRRPRGRPPGSKNKPKPPVIITRESANTLRAHILEVSSGCDVFESVATYARKRQRGICVLSGSGTVTNVTLRQPAAAGAVVTLHGRFEILSLSGSFLPPPAPPGATSLTVFLGGGQGQVVGGNVVGPLVASGPVIVIASSFTNVAYERLPLDEDESMQMQQGQSSAGDGSGDHGGGVSNNSFPDPSSGLPFFNLPLNMPQLPVDGWAGNSGGRQSY

SEQ ID NO: 541 - DNA, 1596 bp, Glycine max
  G3459,family:AT-hook
ctgtcgcgtgggaaacaaatggctgcattgtgagttctttgtccccttcaacctcatttcaattctctctctcccccattcttacttcacccgcgccccctcccccgcccgctcccgtcccttttctttctctgcactccatctttctttccaaaacccacccttttctattcctcttcctcttcctccttttcccttctttttatttccttacactcacaacatttcccttaaaataaacataaacaaaccagcactgttcttgacccccaaaaaaaaaaaatctctactatttattaactatattaattcctccataatataatcatttgttttccttgttttctgttttctcttataatatataaccttcttttatctattttttctgttttgcaccttgtgattgtgagttatatctatttatatttatatatcattctctctcttttttttggatgtgtctatggctggtttggatttaggaagcgcctcacgctttgttcaaaaccttcacagaccagacttgcacttgcaacaaaatttccagcagcaccaggaccagcagcaccagcgtgatttggaggagcagaaaactcctccgaatcacagaatgggggcgccgttcgacgatgatagcgatgatagaagcccgggcctggagctcacttcaggtcctggcgacatcgtcggacggcgcccgcgtggcaggcctcctgggtcgaagaacaagcctaagccgcccgtcataatcacccgggagagcgccaacacgctgagggcgcacatcctcgaggtcggaagcggctccgacgtcttcgactgtgtcaccgcgtatgcccggcggcgccagcgtgggatctgcgtcctcagtggcagcggcaccgtcaccaatgtcagtctccggcagcctgcagctgccggtgccgtcgtcacgctgcacggcaggttcgagattctctccctctctggctcgttcctcccgccgccggctccgccgggagccaccagcctcacaatctacctggccggcgggcaggggcaggttgtcggaggaaacgtcatcggagaattaaccgcagcagggccagtaatcgtcatcgcagcgtcgttcaccaacgtggcttacgagaggttacccttagaagaagatgaacaacagcagcaacaacagcagcttcagattcagccacctgcaacgacgtcgtctcaaggaaacaacaacaacaataaccctttccccgacccttcttcaggacttcccttcttcaatttaccactcaatatgcagaatgttcagttaccagttgagggttgggctgtaaaccctgcttcacgtccacaacctttttgagagttcatgaagatgttgacggaggatttatatcacaaaaggctttatattattttaaggtcagcaaattaatattcatggactacaacatatatataaactatatgttttttcttcttcttcatgttattttgtttttttcttatgttgttaatggatataatatgacatgataattattatgtagtctgattttcatctccttggaattttatatacttatttcccctgttaaaaaaaaa

SEQ ID NO: 542 - protein, 295 aa, Glycine max
  G3459,AT-hook domain coordinates 77-85,86-228
MAGLDLGSASRFVQNLHRPDLHLQQNFQQHQDQQHQRDLEEQKTPPNHRMGAPFDDDSDDRSPGLELTSGPGDIVGRRPRGRPPGSKNKPKPPVIITRESANTLRAHILEVGSGSDVFDCVTAYARRRQRGICVLSGSGTVTNVSLRQPAAAGAVVTLHGRFEILSLSGSFLPPPAPPGATSLTIYLAGGQGQVVGGNVIGELTAAGPVIVIAASFTNVAYERLPLEEDEQQQQQQQLQIQPPATTSSQGNNNNNNPFPDPSSGLPFFNLPLNMQNVQLPVEGWAVNPASRPQPF

SEQ ID NO: 543 - DNA, 862 bp, Glycine max
  G3460,family:AT-hook
tatggctggtttggatttaggaagcgcgtcacgctttgttcagaatcttcacttaccggacttgcacttgcaacaaaattaccagcaaccccggcacaagcgcgattcggaggagcaagagactcctccgaacccgggaacagcgctggcgccgttcgacaacgatgatgacaaaagccagggcctggagctggcttcaggccctggggacatcgttggacggcgcccacgcggcagaccttccgggtccaagaacaagccgaagccaccggtgataatcacccgggagagcgccaacacgctgagggcgcacattctcgaggtaggaagcggctccgacgtcttcgactgtgtcaccgcttatgcgcggcggcgccagcgcgggatctgcgtcctcagcggcagtggtaccgtcaccaatgtcagtctccggcagcctgcggctgccggagccgtcgtcaggctgcacggaaggttcgagattctctctctctccggctcgttcctcccgccgccggctccgccgggagccaccagtctcacaatctacctcgccggcgggcagggccaggtcgtcggaggaaacgtcgtgggagaattaaccgcggcagggccagtaatcgtcatcgcagcatcgttcaccaacgtggcttacgagaggctccccttagaagaagatgaacaacaacaacaacagcttcagattcagtcacccgcaacgacgtcatctcaaggaaacaacaacaataaccctttccctgacccttcttcaggacttcccttcttcaacttaccactcaatatgcagaatgttcagttaccacctttttgagggttcatgaatctgataatatgagactga

SEQ ID NO: 544 - protein, 276 aa, Glycine max
  G3460,AT-hook domain coordinates 74-82,83-225
MAGLDLGSASRFVQNLHLPDLHLQQNYQQPRHKRDSEEQETPPNPGTALAPFDNDDDKSQGLELASGPGDIVGRRPRGRPSGSKNKPKPPVIITRESANTLRAHILEVGSGSDVFDCVTAYARRRQRGICVLSGSGTVTNVSLRQPAAAGAVVRLHGRFEILSLSGSFLPPPAPPGATSLTIYLAGGQGQVVGGNVVGELTAAGPVIVIAASFTNVAYERLPLEEDEQQQQQLQIQSPATTSSQGNNNNNPFPDPSSGLPFFNLPLNMQNVQLPPF

SEQ ID NO: 545 - DNA, 936 bp, Glycine max
  G3461,family:AT-hook
ttcccttctaacctcccattccgttttctctgcagtactcaattgatccctttgtttttctattcgttctgagagctttgtgtgtatggccggcatagacttgggttcagcatcacattttgttcatcatcgccttcaacgccctgaccttgaagacgatgagaaccaacaagaccaagacaacaccgtgaccaacgtgacgttgagacagccagctgcggctggtgccgtcgtcacgctgcacggaaggtttgagatcctctctttgtcaggatcgttcctcccacctccagctccaccaggtgctacaagtttgactgtgttccttggtggaggacagggtcaagtggtgggaggaaatgttgttggtcctttggtggcttctgggcctgttattgttattgcttcatcttttactaatgtagcatatgagaggttgcctttggatgaagatgaatctatgcagatgcaacaagggcaatcatcagctggtgatggtagcggtgaccatggtggtggagttagtaataactcttttccggatccgtcttccgggcttccattcttcaatttgccactaaacatgcctcagttacctgttgatggttgggctggcaactctggtggaaggcaatcttactgatccagagtctttgggggcacaaaggtgagaagttgaattgatctcatatatattggtcttctctaatctttcctctgaatattgcttgtgaagaagtactgatttttctattgaagaatcgttttgtttggctaggtttgttgtaaggacgatcagtttctaggaacaactgtaaaacgttttctcttggttgctggagttattagactagactgttgtgcattaaccttgagttgaataaatcataggctcaaatcaataaccaaaatatatattttggataattaaaaaaa

SEQ ID NO: 546 - protein, 185 aa, Glycine max
  G3461,AT-hook domain coordinates NA
MAGIDLGSASHFVHHRLQRPDLEDDENQQDQDNTVTNVTLRQPAAAGAVVTLHGRFEILSLSGSFLPPPAPPGATSLTVFLGGGQGQVVGGNVVGPLVASGPVIVIASSFTNVAYERLPLDEDESMQMQQGQSSAGDGSGDHGGGVSNNSFPDPSSGLPFFNLPLNMPQLPVDGWAGNSGGRQSY

SEQ ID NO: 547 - DNA, 555 bp, Glycine max
  G3470,family:CAAT
tcaccgggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcaggtcaaaatgctcagcttgttcatcagggttcgctgaactatattggtttgcaggtgcaaccacaacatctggttatgccttcaatgcaaggccatgaatagtttagatgcttcta

SEQ ID NO: 548 - protein, 174 aa, Glycine max
  G3470,CAAT domain coordinates 27-116
MSDAPASPSHESGGEQSPRGSLSGAAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSARPDQVGLAGQNAQLVHQGSLNYIGLQVQPQHLVMPSMQGHE

SEQ ID NO: 549 - DNA, 556 bp, Glycine max
  G3471,family:CAAT
gtagggtttgtgagatgtcggatgcgccaccgagcccgactcatgagagtgggggcgagcagagcccgcgcggttcgtcgtccggcgcgagggagcaggaccggtacctcccgattgccaacatcagccgcattatgaagaaggctctgcctcccaacggcaagattgcaaaggatgccaaagacaccatgcaggaatgcgtttctgagttcatcagcttcattaccagcgaggcgagtgagaaatgccagaaggagaagagaaagacaatcaatggagacgatttgctatgggccatggccactttaggatttgaagactacatagagccgcttaaggtgtacctggctaggtacagagaggcggagggtgacactaaaggatctgctagaagtggtgatggatctgctacaccagatcaagttggccttgcaggtcaaaattctcagcttgttcatcagggttcgctgaactatattggtttgcaggtgcaaccacaacatctggttatgccttcaatgcaaagccatgaatagtttagatgcttctacgcatc

SEQ ID NO: 550 - protein, 173 aa, Glycine max
  G3471,CAAT domain coordinates 26-115
MSDAPPSPTHESGGEQSPRGSSSGAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSATPDQVGLAGQNSQLVHQGSLNYIGLQVQPQHLVMPSMQSHE

SEQ ID NO: 551 - DNA, 547 bp, Glycine max
  G3472,family:CAAT
taaggctagctagctagccatggctgagtcggacaacgagtccggaggtcacacggggaacgcaagcggaagcaacgaattctccggttgcagggagcaagacaggttccttccgatagcgaacgtgagcaggatcatgaagaaggcgttgccggcgaacgcgaagatctcgaaggaggcgaaggagacggtgcaggagtgcgtgtcggagttcatcagcttcataacaggagaagcgtccgataagtgccagaaggagaagaggaagacgatcaacggcgatgatctgctgtgggccatgaccacgctgggattcgaggagtacgtggagcctctcaaggtttatctgcataagtatagggagctggaaggggagaaaactgctatgatgggaaggccacatgagagggatgagggttatggtcatgcaactcctatgatgatcatgatggggcatcaacagcagcagcatcagggacacgtgtatggatctggaactactactggatcagcatcttctgcaagaactagataacaggtttatgca

SEQ ID NO: 552 - protein, 171 aa, Glycine max
  G3472,CAAT domain coordinates 25-114
MAESDNESGGHTGNASGSNEFSGCREQDRFLPIANVSRIMKKALPANAKISKEAKETVQECVSEFISFITGEASDKCQKEKRKTINGDDLLWAMTTLGFEEYVEPLKVYLHKYRELEGEKTAMMGRPHERDEGYGHATPMMIMMGHQQQQHQGHVYGSGTTTGSASSARTR

SEQ ID NO: 553 - DNA, 1818 bp, Glycine max
  G3473,family:CAAT
tttttaaataataaaatgtttctttggaaatttcttaaaaagtatgaacataaatttaaattattattttatattaaatgcacttatgttaatttatttgtcttgcatacacatttaatgttatccttctttatatctatattaaactatatatataaagaaaagattttgaaatttgaataagataagagtgtccaggtcagaggcgagcacgtgccagataccaaagcaacggtccagatcatggagcactcaccaaatccaagggctccaattcgtccgtggacactcacacttatcgactaacaacggtccacaaatcgccacgtgtcctcaagataaagcgttattaacccttctgatccaacggatcctgctcattatctcccaaacaaacccctccgttccgtttcacctttccccttcccgccggagccgccgtcaccggtcgctggccaccgtatccgaccctcccaatacaccctttccgagtcccacacaaaattgcacgattctgtgatttcaattttcaggtctcgaggatttcgtttcagaagcgcttccatttgacgcagaaccaccgactcaaaccgattcgcgccgagttcgtgactcgaattttcaacttctcattcatattccaaatcgaatttgaaactccgaagaaaaattcaccgaacactgaatctcagtttccaaggagcttcttctacgaagagcgcttcaattccacgcagaaccaccaagtcaagccggttcgtgactcggattctcaattcctcgttcattcccgaacgaattttaaattccgaagaaaaccgcaccgaacactgaatttcagattctgaacaagtttcttccgcgaaacagcacagcacttcaatttcacgtggaacagagacaaagggattcgtggttcgaattctcaatcgattttcaaattccgaacagcgaacagtacttcaatttcacgtcgaactagtcaaagcgattcaaatcgatttcgcgaactcgtccgatattttccctgcactgacttagtgattcgtttcatctttctcagcgcgtcttcgatttttccgttagtcgatggcggactccgacaacgactccggcggcgcgcacaacggcggcaaggggagcgagatgtcgccgcgggagcaggaccggtttctcccgatcgcgaacgtgagccgcatcatgaagaaggcgctgccggcgaacgcgaagatctcgaaggacgcgaaggagacggtgcaggagtgcgtgtcggagttcatcagcttccattcaccggggggcctcgccggtgagtgccagaaggagaagaggaagacgatcaacggcgatgatctgctgtgggccatgaccacgctgggattcgaggagtacgtggagcctctcaaggtttatctgcataagtatagggagctggaaggggagaaaactgctatgatgggaaggccacatgagagggatgagggttatggtcatgcaactcctatgatgatcatgatggggcatcagcagcagcagcatcagggacacgtgtatggatctggaactactactggatcagcatcttctgcaagaactagataacaggtttatgcatgtgttatctcatctgtttaagcttattaagggtggtctttttggatggtgattttgtttgattttagaaacaccccagctccagcttgtaattgttgcttgaaacttcgttgttgagagaatatagccattattgtggatggtgatgtgacatgcacagaatttttgtattcttctttcttccaatggatttatctcgggccc

SEQ ID NO: 554 - protein, 170 aa, Glycine max
  G3473,CAAT domain coordinates 23-113
MADSDNDSGGAHNGGKGSEMSPREQDRFLPIANVSRIMKKALPANAKISKDAKETVQECVSEFISFHSPGGLAGECQKEKRKTINGDDLLWAMTTLGFEEYVEPLKVYLHKYRELEGEKTAMMGRPHERDEGYGHATPMMIMMGHQQQQHQGHVYGSGTTTGSASSARTR

SEQ ID NO: 555 - DNA, 553 bp, Glycine max
  G3474,family:CAAT
gatatccatggctgagtccgacaacgagtcaggaggtcacacggggaacgcgagcgggagcaacgagttgtccggttgcagggagcaagacaggttcctcccaatagcaaacgtgagcaggatcatgaagaaggcgttgccggcgaacgcgaagatatcgaaggaggcgaaggagacggtgcaggagtgcgtgtcggagttcatcagcttcataacaggagaggcttccgataagtgccagaaggagaagaggaagacgatcaacggcgacgatcttctctgggccatgactaccctgggcttcgaggactacgtggatcctctcaagatttacctgcacaagtatagggagatggagggggagaaaaccgctatgatgggaaggccacatgagagggatgagggttatggccatggccatggtcatgcaactcctatgatgacgatgatgatggggcatcagccccagcaccagcaccagcaccagcaccagggacacgtgtatggatctggatcagcatcttctgcaagaactagatagcatgtgtcatct

SEQ ID NO: 556 - protein, 177 aa, Glycine max
  G3474,CAAT domain coordinates 25-114
MAESDNESGGHTGNASGSNELSGCREQDRFLPIANVSRIMKKALPANAKISKEAKETVQECVSEFISFITGEASDKCQKEKRKTINGDDLLWAMTTLGFEDYVDPLKIYLHKYREMEGEKTAMMGRPHERDEGYGHGHGHATPMMTMMMGHQPQHQHQHQHQGHVYGSGSASSARTR

SEQ ID NO: 557 - DNA, 600 bp, Glycine max
  G3475,family:CAAT
tcgattatccgtttgtcgatggcggactcggacaacgactccggcggcgcgcacaacgccgggaaggggagcgagatgtcgccgcgggagcaggaccggttcctgccgatcgcgaacgtgagccgcatcatgaagaaggcgctgccggcgaacgcgaagatctcgaaggacgcgaaggagacggtgcaggagtgcgtgtcggagttcatcagcttcatcaccggcgaggcctccgacaagtgccagcgggagaagcgcaagacgatcaacggcgacgacctgctctgggcgatgaccactctcggcttcgaggactacgtcgagcctctcaagggctacctccagcgcttccgagaaatggaaggagagaagacagtggcggcgcgtgacaaggacgcgcctcctcctaccaatgctaccaacagtgcctacgagagtcctagttatgctgctgctcctggtggaatcatgatgcatcagggacacgtgtacggttctgccggcttccatcaagtggctggtggtgctataaagggtgggcctgtttatcccgggcctggatccaatgccggtaggcccaggtagatgggcctatgttat

SEQ ID NO: 558 - protein, 188 aa, Glycine max
  G3475,CAAT domain coordinates 23-112
MADSDNDSGGAHNAGKGSEMSPREQDRFLPIANVSRIMKKALPANAKISKDAKETVQECVSEFISFITGEASDKCQREKRKTINGDDLLWAMTTLGFEDYVEPLKGYLQRFREMEGEKTVAARDKDAPPPTNATNSAYESPSYAAAPGGIMMHQGHVYGSAGFHQVAGGAIKGGPVYPGPGSNAGRPR

SEQ ID NO: 559 - DNA, 528 bp, Glycine max
  G3476,family:CAAT
ggattgattgtgaagatggctgagtcggacaacgactcgggaggggcgcagaacgcgggaaacagtggaaacttgagcgagttgtcgcctcgggaacaggaccggtttctccccatagcgaacgtgagcaggatcatgaagaaggccttgccggcgaacgcgaagatctcgaaggacgcgaaggagacggtgcaggaatgcgtgtcggagttcatcagcttcataacgggtgaggcgtcggacaagtgccagagggagaagcgcaagaccatcaacggcgacgatcttctctgggccatgacaaccctgggattcgaagagtacgtggagcctctgaagatttacctccagcgcttccgcgagatggagggagagaagaccgtggccgcccgcgactcttctaaggactcggcctccgcctcctcctatcatcagggacacgtgtacggctcccctgcctaccatcatcaagtgcctgggcccacttatcctgcccctggtagacccagatgacgtgctcctctattc

SEQ ID NO: 560 - protein, 165 aa, Glycine max
  G3476,CAAT domain coordinates 26-115
MAESDNDSGGAQNAGNSGNLSELSPREQDRFLPIANVSRIMKKALPANAKISKDAKETVQECVSEFISFITGEASDKCQREKRKTINGDDLLWAMTTLGFEEYVEPLKIYLQRFREMEGEKTVAARDSSKDSASASSYHQGHVYGSPAYHHQVPGPTYPAPGRPR

SEQ ID NO: 561 - DNA, 602 bp, Glycine max
  G3478,family:CAAT
ttccgttagtcgatggcggactccgacaacgactccggcggcgcgcacaacggcggcaaggggagcgagatgtcgccgcgggagcaggaccggtttctcccgatcgcgaacgtgagccgcatcatgaagaaggcgctgccggcgaacgcgaagatctcgaaggacgcgaaggagacggtgcaggagtgcgtgtcagagttcatcagcttcatcaccggcgaggcctccgacaagtgccagcgcgagaagcgcaagacgatcaacggcgacgacctgctctgggcgatgaccactctgggcttcgaggactacgtggagcctctcaaaggctacctccagcgcttccgagaaatggaaggagagaagaccgtggcggcgcgtgacaaggacgcgcctcctcttacgaatgctaccaacagtgcctacgagagtgctaattatgctgctgctgctgctgttcctggtggaatcatgatgcatcagggacacgtgtacggttctgccggcttccatcaagtggctggcggggctataaagggtgggcctgcttatcctgggcctggatccaatgccggtaggcccagataaagagcctattatta

SEQ ID NO: 562 - protein, 191 aa, Glycine max
  G3478,CAAT domain coordinates 23-112
MADSDNDSGGAHNGGKGSEMSPREQDRFLPIANVSRIMKKALPANAKISKDAKETVQECVSEFISFITGEASDKCQREKRKTINGDDLLWAMTTLGFEDYVEPLKGYLQRFREMEGEKTVAARDKDAPPLTNATNSAYESANYAAAAAVPGGIMMHQGHVYGSAGFHQVAGGAIKGGPAYPGPGSNAGRPR

SEQ ID NO: 563 - DNA, 736 bp, Oryza sativa (japonica cultivar-group)
  G3479,family:MADS
aatccagctgagatcgatcgatcgatcgatggggaggggcaagatagtgatccggcggatcgacaactcgacgagccggcaggtgacgttctcgaagcggcgcaacgggatcttcaagaaggccaaggagctggccatcctgtgcgacgccgaggtcggcctcgtcatcttctccagcaccggccgcctctacgagtatgccagcaccagcatgaagtcagtgattgatcgatatgggcgagctaaggaggagcagcagcacgtcgcaaaccccaactcggagctgaagttctggcaaagggaggcagcaagcttgagacaacaactgcacagcttgcaagaaaatcatcggcagttgatggggcaagatctttctggattgggtgtcaaggaactgcaaactctagaaaatcagctagaaatgagcatacgctgcatccggacaaaaaaggaccagctcatgattgatgaaatccacgaactgaatcgaaagggaagtctcatccaccaagaaaacatggaactgtacagaaaggtcaacctgattcgccaagaaaatgctgagctgtacaagaagctctatgagacaggggcagaaaatgaagcgaatcgagattcaacaactccatacaactttgcggttatcgaggaagccaacactcctgctcgtcttgaactcaatcccccaagccaacaaaatgatgctgagcaaaccacacctcctaaactagggtaa

SEQ ID NO: 564 - protein, 235 aa, Oryza sativa (japonica cultivar-group)
  G3479,MADS domain coordinates 2-57
MGRGKIVIRRIDNSTSRQVTFSKRRNGIFKKAKELAILCDAEVGLVIFSSTGRLYEYASTSMKSVIDRYGRAKEEQQHVANPNSELKFWQREAASLRQQLHSLQENHRQLMGQDLSGLGVKELQTLENQLEMSIRCIRTKKDQLMIDEIHELNRKGSLIHQENMELYRKVNLIRQENAELYKKLYETGAENEANRDSTTPYNFAVIEEANTPARLELNPPSQQNDAEQTTPPKLG

SEQ ID NO: 565 - DNA, 723 bp, Oryza sativa (japonica cultivar-group)
  G3480,family:MADS
atggggagggggaagattgtgatccgccggatcgacaactcgacgagccggcaggtgacgttctcgaagcggaggaacgggatcttcaagaaggccaaggagctggccatcctctgcgacgccgaggtcggcctcatgatcttctccagcaccggccgcctctacgagtactccagcaccagcatgaagtcagttatagatcggtatggcaagtccaaggatgagcagcaagccgtcgcaaatcccaactcggagcttaagttttggcaaagggaggcagcaagcttgagacaacaactgcacaacttgcaagaaaatcatcggcagttgatgggcgaagatctatctgggctgaatgttaaggaattgcaatctctagagaatcagctggaaataagtctacgtagtgtccgtacaaagaaggaccacgtcttgattgatgaaattcatgaactgaatcggaagggaagtctagttcaccaagaaaacatggaattatacaagaagatcagtttaattcgtcaagaaaatgctgagttatataagaagatctacgagactgaaggaccaagtgaagtcaatcgggattcaccaactccttacaattttgcagtaattgaaaaaacaaatgttcctgtgcaacttggactcagcacactaccacaacatagtgacgccgaacaatcaactgctcctaagctagggttacagttgaatccatga

SEQ ID NO: 566 - protein, 240 aa, Oryza sativa (japonica cultivar-group)
  G3480,MADS domain coordinates 2-57
MGRGKIVIRRIDNSTSRQVTFSKRRNGIFKKAKELAILCDAEVGLMIFSSTGRLYEYSSTSMKSVIDRYGKSKDEQQAVANPNSELKFWQREAASLRQQLHNLQENHRQLMGEDLSGLNVKELQSLENQLEISLRSVRTKKDHVLIDEIHELNRKGSLVHQENMELYKKISLIRQENAELYKKIYETEGPSEVNRDSPTPYNFAVIEKTNVPVQLGLSTLPQHSDAEQSTAPKLGLQLNP

SEQ ID NO: 567 - DNA, 782 bp, Oryza sativa (japonica cultivar-group)
  G3481,family:MADS
gtcttagatctgggagagagcgaggagatggggagggggaagatagtgataaggaggatagacaactcgacgagcaggcaggtgacgttctcgaagcgtcggaacgggcttctgaagaaggcgaaggagctatccatcctctgcgatgcggaggtcggccttgtcgtcttctccagcaccggcaggctctatgagttctccagcaccaacatgaaaactgtgatagaccggtataccaacgcaaaggaggagctacttggcgggaatgcaacttcagaaattaagatttggcagagggaggcagcaagcttgaggcagcaactgcacaacttgcaagaaagccacaagcaactgatgggtgaggagctttctggcctaggtgttagagacctacaaggtttagagaataggcttgaaataagtctacgtaatatcagaatgagaaaggacaatcttttgaaaagtgaaatcgaggagttacatgtgaagggaagcctaattcaccaggaaaacatcgaactttctagaagcctaaatgtcatgtcgcaacaaaaattggaactgtataacaagcttcaggcctgtgaacagagaggtgccacagatgcaaatgaaagttccagcactccatacagctttcgtatcatacaaaatgctaatatgcctcctagtcttgaattgagccaatcacagcaaagagaaggggagtgcagcaaaacagctgctccagaactgggacttcatctgccttaagactatgccgtacaagctggacgataagt

SEQ ID NO: 568 - protein, 241 aa, Oryza sativa (japonica cultivar-group)
  G3481,MADS domain coordinates 2-57
MGRGKIVIRRIDNSTSRQVTFSKRRNGLLKKAKELSILCDAEVGLVVFSSTGRLYEFSSTNMKTVIDRYTNAKEELLGGNATSEIKIWQREAASLRQQLHNLQESHKQLMGEELSGLGVRDLQGLENRLEISLRNIRMRKDNLLKSEIEELHVKGSLIHQENIELSRSLNVMSQQKLELYNKLQACEQRGATDANESSSTPYSFRIIQNANMPPSLELSQSQQREGECSKTAAPELGLHLP

SEQ ID NO: 569 - DNA, 636 bp, Oryza sativa (japonica cultivar-group)
  G3482,family:MADS
atgagggggaagggatgctggagcaaaggagaggagggtcaagaggagaagataaaaattaaggagaggatggaggagagaaaaaggtgcagcgtatctagagaaagtagtttctgcacatctgatacccacgccataggtatatttctagctcatttcaggactacccaattttatgaggtggatggtttcaatctttgtttggagttctggcaagcagaggcggaacgtttaaaacagcaactgcataacttagaaggaagtcaaaggcagttgttggcacatgatctctctggccttgaatggaatgacctgaagagtctagaaaatcaactggagacgagcttgcataacgttcgtctaaagaaggacaaaatcatggtcgaacaaattcaagaattgagaaagaaggagaacatcatgcaccgagaaaacatggaactccaccgtgagttcaacatgatccgtcaagatagtgtgaatttccagcgaaaggtttatggaaaacaagatgtaaatggaggacagggaagttctgttactcagaacaccaatactcaggatgatgcagacgaaattcgtcttgagctaagccaaccacaggttccggatgagaaaccagaagcagcagcataa

SEQ ID NO: 570 - protein, 211 aa, Oryza sativa (japonica cultivar-group)
  G3482,MADS domain coordinates 2-57
MRGKGCWSKGEEGQEEKIKIKERMEERKRCSVSRESSFCTSDTHAIGIFLAHFRTTQFYEVDGFNLCLEFWQAEAERLKQQLHNLEGSQRQLLAHDLSGLEWNDLKSLENQLETSLHNVRLKKDKIMVEQIQELRKKENIMHRENMELHREFNMIRQDSVNFQRKVYGKQDVNGGQGSSVTQNTNTQDDADEIRLELSQPQVPDEKPEAAA

SEQ ID NO: 571 - DNA, 354 bp, Oryza sativa (japonica cultivar-group)
  G3483,family:MADS
atggggagagggaagatagagataaagaggatcgacaacgcgacgagccgacaggtgacattctcgaagcggcggagcgggctgttcaagaaggcgagggagctctccatcctctgcgatgccgaggtcggcctcctcgtcttctccagcaccagccgtctctatgactttgccagctccagcatgaaatccataattgagagatacaatgagacgaaagaagatccccatcaaaccatgaacgcaagttctgaggcaaaggaatatatgtcctcagacttgtttaaagtggttaaagtagggatatctgttgattctaggtatctgtactgtataatattccaccaggcatag

SEQ ID NO: 572 - protein, 117 aa, Oryza sativa (japonica cultivar-group)
  G3483,MADS domain coordinates 2-57
MGRGKIEIKRIDNATSRQVTFSKRRSGLFKKARELSILCDAEVGLLVFSSTSRLYDFASSSMKSIIERYNETKEDPHQTMNASSEAKEYMSSDLFKVVKVGISVDSRYLYCIIFHQA

SEQ ID NO: 573 - DNA, 745 bp, Glycine max
  G3484,family:MADS
tttgaccaaagatggggagaggtaagattgcgattcgaaggatcgacaactccactagccggcaagtgactttctcaaagagaagaaatggattgctgaagaaagctagagaattatcaattctttgtgatgctgaagttggattgatggtgttctccagcactgggaagctttatgactatgcaagcacaagcatgaaagcggttattgaacgctacaacaagctaaaagaggaaacccatcacctcatgaatccggcttcagaagagaagttttggcagacagaagcagcaagcttgaggcagcagcttcagtacttgcaagaatgccacaggcaattaatgggggaagaacttacgggtttgggtattaaagaactacaaaatctggaaaaccaactggagatgagtttaaagggtgtccgcatgaaaaaggatcaaattttaactaatgagattaaagaactacgccaaaagggaaatatcattcatcaagaaaatgttgaactctatcaaaagatggagcagatccaaaaagaaaatgcagagctacaaaagaaggtttatgaagcaaggagtacaaatgaagaaaatgtggcatccaatccttcttacaacgtcagaaatggatatgattcacttgcatctatcagtctccagctaagtcagccacagtctcaatacaaatacagtgaaccatcaaccaaagcaatgaaactcggattgcagctgcattagcaaaaact

SEQ ID NO: 574 - protein, 241 aa, Glycine max
  G3484,MADS domain coordinates 2-57
MGRGKIAIRRIDNSTSRQVTFSKRRNGLLKKARELSILCDAEVGLMVFSSTGKLYDYASTSMKAVIERYNKLKEETHHLMNPASEEKFWQTEAASLRQQLQYLQECHRQLMGEELTGLGIKELQNLENQLEMSLKGVRMKKDQILTNEIKELRQKGNIIHQENVELYQKMEQIQKENAELQKKVYEARSTNEENVASNPSYNVRNGYDSLASISLQLSQPQSQYKYSEPSTKAMKLGLQLH

SEQ ID NO: 575 - DNA, 1019 bp, Glycine max
  G3485,family:MADS
attcggctcgaagggcgctttgtctgttataatcaacgcgctcctcacgagtgaatttctggttcggaaggatctgattgttagggtttggtatggggagaggtaagatcgtgataaggaggatcgacaattccacgagcaggcaagtgacgttctcgaagcgaaggaacggtttgctgaagaaggcgaaggagcttgcgatcttgtgcgatgctgaagtcggagttatgatcttctccagcaccggaaaactctacgatttcgccagctccagcatgaaatcagtaatggaccgatacagcaaatcaaaagaagaaccttgtcaacttgggagttcagcctctgaaattaaattttggcaaagggaggcagcaatgttaaggcaacaattacacaatttgcaagaaagtcaccgcaggaaaatgatgggggaagaactgtcaggcttgacagtcaaagaattaccaaatttggagaaccaattagaaattagccttcatggtgtccgaatgaaaaaggatcaacttttaatgggtgaaatacaagagctaaatcgaaagggaaacctcatacaccaagaaaatgtggaactgtataagaaggtctatggaacacaagatgataacgaaacaaacagagattctgttctcacaaatggtctaggcataggagaggatttgcaagtgcctgtgaatctccagctaagccagccaagcaccagcaacaacactacaaggcaccttcaggaactacaaaaatgggcagattgcaattgcattgatccatatacaggatgcgtgtgtttcacaattgctatcaagaaaaatggactcagatttaaacctcgatgtcttcgtataaatgttgtggcatatagaccacagacaaattggcttaaagattttaatttgaaattatcagaaaaagaaaaggcaaccctagcatgtatgtaagaaacaatgaaagcatcttatgagaaaccaagactcaaatcaaggaagaaattcttccacccgccc

SEQ ID NO: 576 - protein, 286 aa, Glycine max
  G3485,MADS domain coordinates 2-57
MGRGKIVIRRIDNSTSRQVTFSKRRNGLLKKAKELAILCDAEVGVMIFSSTGKLYDFASSSMKSVMDRYSKSKEEPCQLGSSASEIKFWQREAAMLRQQLHNLQESHRRKMMGEELSGLTVKELPNLENQLEISLHGVRMKKDQLLMGEIQELNRKGNLIHQENVELYKKVYGTQDDNETNRDSVLTNGLGIGEDLQVPVNLQLSQPSTSNNTTRHLQELQKWADCNCIDPYTGCVCFTIAIKKNGLRFKPRCLRINVVAYRPQTNWLKDFNLKLSEKEKATLACM

SEQ ID NO: 577 - DNA, 691 bp, Zea mays
  G3487,family:MADS
ggagatggggagagggaagatagagatcaagaggatcgacaacgcgacgagccggcaggtaacgttctccaagcgccggggcgggctgttcaagaaggccaaggagctcgccatcctttgcgatgccgaggtcggcctcgtcgtcttctccagcaccggccgcctgtatcacttcgctagcaccagcatggaatctgtgattgaaagatacgaggaaagagaggggcaccatcagactatgagcgcaagtgctgaggccaagctttggcaaagggaggcaggaagcttgaggcagcaactgcataacttgcaagagcaccatcggaagttgttgggtcagcagctctctggcctggacgtgagagatttgcagaatttagagaatcagctggagacaagcctaagaaatattcgtctaaagatggaccaacttattttttatcagattcaagaattaaacaggaagggatacctcatgcaccaggaaaacatagaactacacaacaaagtcaaccttcttcatcaagagaacattaaattacgtagaaaggcgtatggacaaggagtaaatgagcatccaacaagtactacagttagacacagtattctgaatacagagaatgaagatgttcggatcaatcttgagctgagtgtgcaaagggacaaatcagaaacaccaagtgtagggtga

SEQ ID NO: 578 - protein, 228 aa, Zea mays
  G3487,MADS domain coordinates 2-57
MGRGKIEIKRIDNATSRQVTFSKRRGGLFKKAKELAILCDAEVGLVVFSSTGRLYHFASTSMESVIERYEEREGHHQTMSASAEAKLWQREAGSLRQQLHNLQEHHRKLLGQQLSGLDVRDLQNLENQLETSLRNIRLKMDQLIFYQIQELNRKGYLMHQENIELHNKVNLLHQENIKLRRKAYGQGVNEHPTSTTVRHSILNTENEDVRINLELSVQRDKSETPSVG

SEQ ID NO: 579 - DNA, 1209 bp, Zea mays
  G3488,family:MADS
gaattcccgggtcgacccacgcgtccgcccacgcgtccggtcgtcctcttctctcgcctccaataattcgtaaccattctccttccaggccgggctcctgctggccggagttcccatctccctctttccttctcggttactatccgtgagtgtgcctgcccccgtgtgtgcgcgtgcaagatcgaccgggcgcagcttcacgatggggcgcggcaagatagtgatccgccggatcgacaactccacgagccggcaggtgacgttctccaagcggcggaacgggatcttcaagaaggcaagggagctcgccatactctgcgacgcagaggtcgggttggtcatcttctccagcaccggtcgtctctatgaatacgccagcacaagcataaagtcagtgattgatcgatatggtcgagcaaaggaggaggagcatgtagcagaccccaacacagagcttaagttctggcaaagggaggcagcaagcttgagacaacaactgcacaacttgcaagaaaatcatcggaggcagttgatgggacaaaatctttctggactaggtgtcaagggacttcaaaatctagaaaatcagctagagatgagcatttgttgcatccggacaaaaaaggaccaactcttggttgacgaaattcacgaactgaatcgaaagggaagtctcatccaacaagacaacatgggattacacagaaaggtcaacctaattcgtcaagaaaatgccgaattatataagaagctctatgagaaagaagcagaaggtgaagtcaaccgagattcaacaactccgtacaactttgtagttgcagagggtgccaacgttcctatccatcttgagcttaatattccactgcaagaaaatggtgttgagcaacctgtggctcctaaattagggttgcaattaaatcaatgaagacatgcaggacattgcctttgttctcattgtccttgaagtctgcaactcaaagcagcctaaaatgataggttgtaacaggcctaaaaacattgcaagacaaataaagtatgcatgccagagacagtggcaatggtagtgcaaatctatctcaaataacttgtgttatattgaataatccagcaaatggtttgttttttacacgttatgcaagtttgtttgaccaaaatggtatgtaacatgtacaaatttccaagtgaacttattgaaaaaattctataaaa

SEQ ID NO: 580 - protein, 240 aa, Zea mays
  G3488,MADS domain coordinates 2-57
MGRGKIVIRRIDNSTSRQVTFSKRRNGIFKKARELAILCDAEVGLVIFSSTGRLYEYASTSIKSVIDRYGRAKEEEHVADPNTELKFWQREAASLRQQLHNLQENHRRQLMGQNLSGLGVKGLQNLENQLEMSICCIRTKKDQLLVDEIHELNRKGSLIQQDNMGLHRKVNLIRQENAELYKKLYEKEAEGEVNRDSTTPYNFVVAEGANVPIHLELNIPLQENGVEQPVAPKLGLQLNQ

SEQ ID NO: 581 - DNA, 784 bp, Zea mays
  G3489,family:MADS
aagaagagagctagctataggccggagatcgatggggaggggaaagatcgtgatccgcaggatcgataactccacgagccggcaggtgaccttctccaagcgccggaacgggatcttcaagaaggccaaggagctcgccatcctctgcgatgcggaggtcggcctcgtcatcttctccagcaccggccgcctctacgagtactctagcaccagcatgaaatcagttatagatcggtacggcaaggccaaggaagagcagcaagtcgtcgcaaatcccaactcggagcttaagttttggcaaagggaggcagcaagcttgagacaacaactgcacaacttgcaagaaaattatcggcagttgacgggagatgatctttctgggctgaatgtcaaagaactgcagtccctggagaatcaattggaaacaagcctgcgtggtgtccgcgcaaagaaggaccatctcttgatagatgagattcacgatttgaatcgaaaggcaagtttatttcaccaagaaaatacagacttgtacaataagatcaacctgattcgccaagaaaatgatgagttacataaaaagatatatgagactgaaggaccaagtggagttaatcgggagtcaccgactccattcaactttgcagtagtagaaaccagagatgttcctgtgcaacttgaactcagcacactgccacagcaaaataacattgagccatctactgctcctaagctaggattgcaattaattccatgaagaagagtaaaactgccgtcttatgatgct

SEQ ID NO: 582 - protein, 240 aa, Zea mays
  G3489,MADS domain coordinates 2-57
MGRGKIVIRRIDNSTSRQVTFSKRRNGIFKKAKELAILCDAEVGLVIFSSTGRLYEYSSTSMKSVIDRYGKAKEEQQVVANPNSELKFWQREAASLRQQLHNLQENYRQLTGDDLSGLNVKELQSLENQLETSLRGVRAKKDHLLIDEIHDLNRKASLFHQENTDLYNKINLIRQENDELHKKIYETEGPSGVNRESPTPFNFAVVETRDVPVQLELSTLPQQNNIEPSTAPKLGLQLIP

SEQ ID NO: 583 - DNA, 1105 bp, Zea mays
  G3490,family:HB
gccatctgttcaaaataaatatatatataatcgtcgtcatgcatatttcgatttttcgaatcgtgcgaaactagcttgtctgttgtgtttacttatatatattctgaaagtactccgtattttctggagtcaagaacagcatactgtattttctgtgatttttaaaggagctaacttggctatatatgaacaaccgatggttgttgcttggcggccgcagaggggtttggatgcaacaacaacaacgggagcgggaacgggtaacaacatgagggacctggacatgaaccagccggcgagcggcggcgaggaggaggagttcccaatggggagcgtggaggaggaggaggacgagcgcggcggcgccggcgggccgcaccgcgccaagaagctccggctgtccaaggagcagtcccgcctcctggaggagagcttccgcctcaaccacaccctcacaccgaagcaaaaggaggccttggctgtcaagctcaagctgcggcccaggcaggtggaggtctggttccagaaccgcagggctaggacgaagcttaagcagacggagctggagtgcgagtacctgaagcgctgcttcggctcgctgaccgaggagaaccggcggctgcagcgggaggtggaggagctgcgcgcgatgcgggtggccccgcccaccgtgctctccccgcacacccggcagccgctcccggcgtccgcgctcgccatgtgcccgcgctgcgagcgcatctccgccgcaacggccggcgcgcaccccacgcccggcgcccgccgcgagccccttccacccgcgccgcccgtccgcggcgttttagcctagtctcccgctgcatgcgactccggccggtaggggaaggagcggaaagtttggttgttgttagggggggcaaagtgtttgtgctgtgtaaatttgatgatggatggagaaaaccagcgcgggcccgtgtagctttttaggtgtaggtggtagggtttcgaccttggagtcccttcgcgtcaacgtccccgtccccgtgttccgttccatgccgtgcatgctgatggatcaaaagtttgtactagcttcctatcgtcgtcactccattcagaatga

SEQ ID NO: 584 - protein, 211 aa, Zea mays
  G3490,HB domain coordinates 60-120
MVVAWRPQRGLDATTTTGAGTGNNMRDLDMNQPASGGEEEEFPMGSVEEEEDERGGAGGPHRAKKLRLSKEQSRLLEESFRLNHTLTPKQKEALAVKLKLRPRQVEVWFQNRRARTKLKQTELECEYLKRCFGSLTEENRRLQREVEELRAMRVAPPTVLSPHTRQPLPASALAMCPRCERISAATAGAHPTPGARREPLPPAPPVRGVLA

SEQ ID NO: 585 - DNA, 1354 bp, Solanum lycopersicum
  G3500,family:MYB-(R1)R2R3
aaacaaggcaaaaaaagggttgtgttccaatgggtagagtcccttgttgtgataaaatgggagtgaagaaagggccatggactcctgaagaagatataatgttagtctcttatgtgcaacaacatggtccaggcaattggagggcacttcccactaaaacagggttgcgtaggtgtagcaagagctgcaggctaagatggacaaactaccttaggccagggataaagaggggtaacttcacagatcaagaagaaaaaatgattatccagcttcaagcacttttaggaaacaaatgggctgcaatagcttcgtatctgccagagagaacagataacgacataaaaaactactggaatactcatctaaagaaaaagatgaaaaggcttgaccaatgtcatggatcaaatgatctattttctttagaaaatgggcttactcacttatcatcttcaaattcatcaacttctaggggacaatgggaaaggacacttcaagctgatattaacatggctaaaaaggctttacataatgctttgtcacttgaaaatccaacaagctcacacaataataatattaaacaagaaaatacacaagtttcttctacttctactatttatgcatcaagtactgaaaatatagctagattgctacaaggatggataggatcaagtacttcttccacaaataattctgaaagttcaaaaacttcatcaaacaacattgcaacaactgattcatcttcatgtgatgggactccaaatgctgaaaccaaaggtggaatggggttgatggaagcatttgagtcactatttggtttggaatcatttgaatcatcaagttcagatgagttgtctcaaacaacaactcctgaggctattaaaattgaaataaagaaggaagaaaatgaacatgatgttgaagtgccactatctattatcttagagaattggttgcttgatgaaaatacactcaatattcaaccaaaaaatgacttgactaccttgatatcttttgatgaaactccacaacttttctacaagtttttttttttgttgattcttttgatggaataattttgaaaaaattgtatgtttttgattgatttccccattgattgtttttattttgatgtggcgattttaacaagtcatgtatatttagccattattattatatttagactatatatagctcaatcaagacttaatctagagtggttttatcatatgactaagttgtatcctttttaaatttcgttttatagatttcaattattgtactaagttagggaattttatatctctttcaatacaaaattttgttttattttaaaaaaaaaaaaaaaaaaaaaaaa

SEQ ID NO: 586 - protein, 347 aa, Solanum lycopersicum
  G3500,MYB-(R1)R2R3 domain coordinates 14-118
MGRVPCCDKMGVKKGPWTPEEDIMLVSYVQQHGPGNWRALPTKTGLRRCSKSCRLRWTNYLRPGIKRGNFTDQEEKMIIQLQALLGNKWAAIASYLPERTDNDIKNYWNTHLKKKMKRLDQCHGSNDLFSLENGLTHLSSSNSSTSRGQWERTLQADINMAKKALHNALSLENPTSSHNNNIKQENTQVSSTSTIYASSTENIARLLQGWIGSSTSSTNNSESSKTSSNNIATTDSSSCDGTPNAETKGGMGLMEAFESLFGLESFESSSSDELSQTTTPEAIKIEIKKEENEHDVEVPLSIILENWLLDENTLNIQPKNDLTTLISFDETPQLFYKFFFLLILLME

SEQ ID NO: 587 - DNA, 1426 bp, Solanum lycopersicum
  G3501,family:MYB-(R1)R2R3
tataaacatagctagagaaaaaaaaaaaaaacttcaagaaaatcaaaagtgcttttgttgttgaattaaatcaaagaagatttgtttattttgatttttagaaatgggaaggcctccttgttgtgaaaaaagtggggtgaaaaaagggccatggacaccagaagaagatatcattttggtttcatacattcaagaacatggccctggaaactggagaaatattccaactaatactggtttgctaagatgcagcaaaagttgtagacttcgatggactaattatctccggccagggatcaaacgtggaaacttcactgaacatgaagaaaaaatgatcatccatcttcaagctcttcttggcaatcgatgggcagctatagcttcataccttccgcaaagaacagacaacgatatcaagaattactggaacactcatttgaaaaagaagcttaataacaacaagaaggttgaaggtcatgatgatcatcaagaaggaacttcagcatcatcatcatcatctcaatcaaaaatcataaaaggacagtgggaaaggaggcttcaaactgacattcacactgctaaacaagctctttgtgatgctttgtcacttgatacaactccaaataacaaaaacaacaacaataatccacctcctcatgatcaggatcaacaaccaccatcagttcaaacacctactacctatgcttcaagtgctgaaaacattgctaagttgcttcaaaattggatgaaaaattcacccaaatcgacctcgtctagtagctcgaaaattactcctatgtcatccttgaacaacaatttatcaatcggtgcagtttcaagttctagccctagtgaagggacggtaaatgttactcctggacaaggtttggactctatctttagctttaattcatctaataattcggatgtttcgcaatccgtatcggtcgatgagggtggtaatttcagtacacctgagaatcataataataacaacaacaacaatgctgggatttatcaagttgaaagcaagccaaatttgcctgatttcaagccagaaaatgggaattttcaagaggagagtaagcaaaatatggagacacaacaagtgcctttaactatgctggagaaatggctacttgaggatgctaatgcacaagctgaacaagaagatcagttaatgggaattggaatgggaatgggaatgacctttagctgaaactaatgatttgttttgaagaaaaaaaaaattgtttactagtactcccttcgtttcaatttatctgccttgatttgaccgaacatgaaagtgaagaaaaaaaataagtaaaacggataaattgaagcgcagggagtagtaaatatttcttcaaacaacataggacagtttggggtaagtgggcttttggggtattttaatagttgg

SEQ ID NO: 588 - protein, 371 aa, Solanum lycopersicum
  G3501,MYB-(R1)R2R3 domain coordinates 14-118
MGRPPCCEKSGVKKGPWTPEEDIILVSYIQEHGPGNWRNIPTNTGLLRCSKSCRLRWTNYLRPGIKRGNFTEHEEKMIIHLQALLGNRWAAIASYLPQRTDNDIKNYWNTHLKKKLNNNKKVEGHDDHQEGTSASSSSSQSKIIKGQWERRLQTDIHTAKQALCDALSLDTTPNNKNNNNNPPPHDQDQQPPSVQTPTTYASSAENIAKLLQNWMKNSPKSTSSSSSKITPMSSLNNNLSIGAVSSSSPSEGTVNVTPGQGLDSIFSFNSSNNSDVSQSVSVDEGGNFSTPENHNNNNNNNAGIYQVESKPNLPDFKPENGNFQEESKQNMETQQVPLTMLEKWLLEDANAQAEQEDQLMGIGMGMGMTFS

SEQ ID NO: 589 - DNA, 936 bp, Oryza sativa (japonica cultivar-group)
  G3502,family:MYB-(R1)R2R3
atggggaggccgccgtgctgcgtgaaggcggaggtgaagaaggggccgtggacgccggaggaggacctcatgctcgtcgcctacgtccaggagcacggcccgggcaactggcgcgccgtgcccaccaacaccgggctgatgcggtgcagcaagagctgccggctccggtggaccaactacctccggccggggatcaagcgggggaacttcaccgaccaggaggagaagctcatcgtccacctccaggccctcctcggcaacaggaggtgggcggcgatcgcgtcctacttgccggagaggacggacaacgacatcaagaactactggaacacgcacctcaagaagaagctcaagaagatgagcgccaccggcggcggcggcgacgacggcgagggaggtggcgccggcgaggtgaagaccagggcggctgcgccgaaggggcagtgggagcggcgcctgcagacggacatccacaccgcgcgccaggcgctccgcgacgcgctctcgctggacccctcgccgccggccaagccgctggactcgtcgtcgggcgccacggcgccgccgtcgtcgcaggcggcgacgtcgtacgcatccagcgccgagaacatcgcgcggctcctggagggctggatgcgccccggcggcggcggcggcaagacgacgacgacgccgtcctccgggtcgaggtcgtcggcggcgtcggtgctgtccggggaggccagccacagcggcggcgccacggcgccgacgcccgacggctcgacggtcaccagcaagacgaaggacgaggagaccgccggcgcgccgccgccgccgccgccgccggcgttctccatgctggagagctggctgctcgacgacggcatgggccacggcgaggtggggctcatggacgtggtggtgccattgggggacccgagtgagttcttttag

SEQ ID NO: 590 - protein, 311 aa, Oryza sativa (japonica cultivar-group)
  G3502,MYB-(R1)R2R3 domain coordinates 14-119
MGRPPCCVKAEVKKGPWTPEEDLMLVAYVQEHGPGNWRAVPTNTGLMRCSKSCRLRWTNYLRPGIKRGNFTDQEEKLIVHLQALLGNRRWAAIASYLPERTDNDIKNYWNTHLKKKLKKMSATGGGGDDGEGGGAGEVKTRAAAPKGQWERRLQTDIHTARQALRDALSLDPSPPAKPLDSSSGATAPPSSQAATSYASSAENIARLLEGWMRPGGGGGKTTTTPSSGSRSSAASVLSGEASHSGGATAPTPDGSTVTSKTKDEETAGAPPPPPPPAFSMLESWLLDDGMGHGEVGLMDVVVPLGDPSEFF

SEQ ID NO: 591 - DNA, 775 bp, Arabidopsis thaliana
  G351,family:Z-C2H2
ctcacgcaacttcctctcttctcaagattcttctccatacttcaccttcttctatatatctctctgctctcaaattaggttttaaattttctatagcaatggcgcttgaagctcttaattcaccaagattggtcgaggatcccttaagattcaatggcgttgagcagtggaccaaatgtaagaaacgatccaaacgttcgagatctgatcttcatcataaccaccgtctcactgaggaagagtatctagctttctgtctcatgcttcttgctcgggatggcggcgatcttgactctgtgacggttgcggagaagccgagttataagtgtggcgtttgttacaagacgttttcgtcttaccaagctctcggcggtcataaagcgagccaccggagcttatacggtggtggagagaatgataaatcgacaccatccaccgccgtgaaatctcacgtttgttcggtttgcgggaaatctttcgccaccggtcaagctctcggcggccacaagcggtgccactacgatggtggcgtttcgaactcggaaggtgtggggtctactagccacgtcagcagtagtagccaccgtggatttgaccttaatattataccggtgcagggattttcgccggacgacgaagtgatgagtccgatggcgactaagaagcctcgcctgaagtaagtctttgttgaagacctggaagtttatcaaatgtaaatatcaaatttcaatttcaaggaacagttttgttgattctattaccaatacacaatacg

SEQ ID NO: 592 - protein, 193 aa, Arabidopsis thaliana
  G351,Z-C2H2 domain coordinates 77-97,118-140
MALEALNSPRLVEDPLRFNGVEQWTKCKKRSKRSRSDLHHNHRLTEEEYLAFCLMLLARDGGDLDSVTVAEKPSYKCGVCYKTFSSYQALGGHKASHRSLYGGGENDKSTPSTAVKSHVCSVCGKSFATGQALGGHKRCHYDGGVSNSEGVGSTSHVSSSSHRGFDLNIIPVQGFSPDDEVMSPMATKKPRLK

SEQ ID NO: 593 - DNA, 1174 bp, Oryza sativa (japonica cultivar-group)
  G3510,family:HB
tctccctccgcctttgccccgccttccctgcccttttctcttgctgagccgcttctgcattggcttgtgatgatgggggccacttctccgtcaggcctggagctcaccatggctgtccccggcctcagctcctctggttcagaaggggccggttgcaacaacaacaacgccggtggcggctgcaacatgagggacctggacatcaaccagccggcgagcggcggcgaggaggaggagttcccgatgggcagcgtggaggaggacgaggaggagaggggcgtcggtgggccccaccgccccaagaagctccgcctctccaaggagcagtcccgcctcctcgaggagagcttccgcctcaaccataccctcacgccgaagcaaaaggaggccttggcgatcaaactgaagctgcggccgaggcaggtggaggtctggtttcagaaccgtagggcaaggacgaagctgaagcagacggagatggagtgcgagtacctgaagcgctgcttcgggtcgctgacggaggagaaccgccggctgcagcgggaggtggaggagctgcgggcgatgcgggtggccccgcccacggtgctctcgccgcacaccaggcagccgctcccggcgtccgcgctcaccatgtgcccccgctgcgagcgcatcaccgccgccaccggcccgcctgccgtgcgcccgccgccgtcgtcagccgccgccgccgccccctcgcccttccaccctcgccgcccctctgcggccttctaggcccaaggtctcgcatcctaaaggccacaaaaagatgggcctcgccgtcccgtgtaaattgaaggagacgacgcagcggtagagggccccgtgtcggcgttgttgcgtcgggtccagtcgtctcagaggagtcagaggcgtggacaaaatgtttgttgcggtgtttgtgttccattggtcgttgatcttagcttgatgatctgtgattcgcgccttgctcgtctaggtttctcttgggccgacgcatgatcttttttcccccgtgtcggaccttattgggccttttgagatcgacgggccccctccttgtttcgcatgtggacatgttatttcgtccttttgggccaacaattcagcacggtggccaacggtgcgtagttcgtcgccgttttctttcaaaaaaaaaaaaaaaaaa

SEQ ID NO: 594 - protein, 229 aa, Oryza sativa (japonica cultivar-group)
  G3510,HB domain coordinates 74-134
MMGATSPSGLELTMAVPGLSSSGSEGAGCNNNNAGGGCNMRDLDINQPASGGEEEEFPMGSVEEDEEERGVGGPHRPKKLRLSKEQSRLLEESFRLNHTLTPKQKEALAIKLKLRPRQVEVWFQNRRARTKLKQTEMECEYLKRCFGSLTEENRRLQREVEELRAMRVAPPTVLSPHTRQPLPASALTMCPRCERITAATGPPAVRPPPSSAAAAAPSPFHPRRPSAAF

SEQ ID NO: 595 - DNA, 466 bp, Oryza sativa (japonica cultivar-group)
  G3515,family:AP2
gtgtgcgagcggttgcgtccgcatggaggacgacaagagtaaggaggggaaatcgtcgtcgtcgtaccgcggcgtgcggaagcggccgtggggcaagttcgcggcggagatccgcgacccggagcgcgggggagcccgcgtgtggctcggcacgttcgacaccgcggaggaggccgcgcgggcgtacgaccgcgccgcattcgccatgaagggcgccacggccatgctcaacttcccgggagatcatcatcacggcgccgcaagcaggatgaccagcaccggctcttcttcgtcctccttcaccacgcctcctccggcgaactcctccgcggcggcgggccgcggcggctccgatcggacgacggacaaggtggagctggagtgcctcgacgacaaggtcctggaggacctcctcgcggagaccaactatcgtgataagaactactagctagctagctactatggc

SEQ ID NO: 596 - protein, 141 aa, Oryza sativa (japonica cultivar-group)
  G3515,AP2 domain coordinates 11-75
MEDDKSKEGKSSSSYRGVRKRPWGKFAAEIRDPERGGARVWLGTFDTAEEAARAYDRAAFAMKGATAMLNFPGDHHHGAASRMTSTGSSSSSFTTPPPANSSAAAGRGGSDRTTDKVELECLDDKVLEDLLAETNYRDKNY

SEQ ID NO: 597 - DNA, 393 bp, Zea mays
  G3516,family:AP2
atggaggacgacaagaaggagggcaagtaccgcggcgtgcggaagcggccgtggggcaagttcgccgcggagatccgggacccggagcgcggcggctcccgcgtctggctcggcaccttcgacaccgccgaggaggccgccagggcctacgaccgcgccgcattcgccatgaagggcgccacggccgtgctcaacttccccgccagcggaggatcgtcagctggcgcggctcccggcggccggaccagcggcggctcctcctcgtccaccacgtcggctccggccagcagggggagggcccgtgttcccgactcggagaaggtggagctggagtgcctcgacgacagggtcttggaagagctgctcgcggaagacaagtacaacaagaactaa

SEQ ID NO: 598 - protein, 130 aa, Zea mays
  G3516,AP2 domain coordinates 6-70
MEDDKKEGKYRGVRKRPWGKFAAEIRDPERGGSRVWLGTFDTAEEAARAYDRAAFAMKGATAVLNFPASGGSSAGAAPGGRTSGGSSSSTTSAPASRGRARVPDSEKVELECLDDRVLEELLAEDKYNKN

SEQ ID NO: 599 - DNA, 477 bp, Zea mays
  G3517,family:AP2
tacgtccgatccacagccatcatcgccacccgcgcgcttatggatggcgagtggtccaaggacggcggaggcggcgagccgaccaagtaccgcggcgtgcggcgtcggccctggggcaagtacgcggcggagatccgcgactcgagccggcacggcgtccgcatctggctcggcacgttcgacaccgccgaggaggccgccagggcgtacgaccgctccgccaactccatgcgcggcgccaacgccgtgctcaacttcccggaggacgcgcccgcctacgccgccgccgcctcccgtggctccgccggcggatcctcgtccagaccggcgggctccggccgggacgtgatcgagtttgagtacctcgacgacgaggtgctgcaggagatgctcaggagccaggagccgtcggcggcggcggcgcagaagaagaagtagcgcgagcgccacaggtggcgaaacggccgcttttccaaa

SEQ ID NO: 600 - protein, 132 aa, Zea mays
  G3517,AP2 domain coordinates 13-77
MDGEWSKDGGGGEPTKYRGVRRRPWGKYAAEIRDSSRHGVRIWLGTFDTAEEAARAYDRSANSMRGANAVLNFPEDAPAYAAAASRGSAGGSSSRPAGSGRDVIEFEYLDDEVLQEMLRSQEPSAAAAQKKK

SEQ ID NO: 601 - DNA, 717 bp, Glycine max
  G3518,family:AP2
ctaacacacataacaataacttagcaacattttttccttccttctttctttctttctatactttttgttgttaattctaagttctaagagaagaaaaatggagggtggaagatcatcagtttcaaatgggaatgttgaggttcgttatagagggattagaagaaggccatggggaaagtttgcagcagagattcgtgaccctacaaggaaaggaacaaggatatggcttggaacatttgacactgctgaacaagctgcacgagcttatgatgctgctgcttttcattttcgtggccacagagcaattctcaacttcccaaatgagtatcaatctcataatccaaactcttctttgcctatgcctctagctgtgtcagctcctccttcttattcttcttcttcttccacttctaattattccggtgatgataataataaccaccttgtgagaccagctttttctggagaaataatgcaaggtggtgatcatgatgatgatacttttgagttggagtacttcgataataagttgctcgaggaactccttcagatgcaagataacagacacttctaaaagtaaaatataacacaagccagctatgttgtgttagtcactggcatgaaataaaatgcaaagaaatattgttgattttatttaatatattttgtttgatttttttttttttttttgtagctgatcaaagttcttcgaaatga

SEQ ID NO: 602 - protein, 158 aa, Glycine max
  G3518,AP2 domain coordinates 13-77
MEGGRSSVSNGNVEVRYRGIRRRPWGKFAAEIRDPTRKGTRIWLGTFDTAEQAARAYDAAAFHFRGHRAILNFPNEYQSHNPNSSLPMPLAVSAPPSYSSSSSTSNYSGDDNNNHLVRPAFSGEIMQGGDHDDDTFELEYFDNKLLEELLQMQDNRHF

SEQ ID NO: 603 - DNA, 609 bp, Glycine max
  G3519,family:AP2
tttctttctttctatactttttgtggttctgattattaagttctaagagaataacaatggagggtggaagatcatctgtttcaaatgggaattgtgaggttcggtatagagggattagaagaaggccatggggcaagtttgcagcagagattcgtgaccctacgaggaaagggacaaggatatggcttggaacatttgacactgcggaacaagctgctcgagcttatgatgctgctgcttttcattttcgtggtcatagagcaattctcaacttcccaaatgagtaccaatctcataatccaaactcttctttgcctatgcctctaattgtgcctcctccttcttattcttcttctttcacttctaattattctgctgatgataataaccaccttgtgagacctggagaaataatgcaaggtggtgatcttgatgacacttttgagttggagtacttggataataagttgctcgaggaactccttcagatgcaagataacagacacttctaaaagtaaaatataacacaagccagctatgttgtgttagtcactggcatgaaataaaatgcaaagaaatattgttgattttatttaatatattttgttt

SEQ ID NO: 604 - protein, 151 aa, Glycine max
  G3519,AP2 domain coordinates 13-77
MEGGRSSVSNGNCEVRYRGIRRRPWGKFAAEIRDPTRKGTRIWLGTFDTAEQAARAYDAAAFHFRGHRAILNFPNEYQSHNPNSSLPMPLIVPPPSYSSSFTSNYSADDNNHLVRPGEIMQGGDLDDTFELEYLDNKLLEELLQMQDNRHF

SEQ ID NO: 605 - DNA, 440 bp, Glycine max
  G3520,family:AP2
aaggcacacaatggaagaggagtcaaaggagaaaaagaaggacactaaggaggaaccacgttatagaggagtgcggcggcggccgtgggggaagttcgcggccgagattcgggacccggcccggcacggtgcccgagtgtggctggggacatttctcacggcggaggaggctgctagggcttatgaccgagctgcctatgagatgaggggcgctttagccgttctcaattttccaaatgagtatccttcatgctcttctatgaactcatcttcaacattagcaccttcatcttcttcttcaaattcaatgcttaaaagtgatcatggtaaacaagttattgagttcgagtgcttggatgacaaattgttagaggaccttcttgattgtgatgactatgcctacgagaaagacttgcctaagaactgaacggtttgatcaa

SEQ ID NO: 606 - protein, 138 aa, Glycine max
  G3520,AP2 domain coordinates 14-78
MEEESKEKKKDTKEEPRYRGVRRRPWGKFAAEIRDPARHGARVWLGTFLTAEEAARAYDRAAYEMRGALAVLNFPNEYPSCSSMNSSSTLAPSSSSSNSMLKSDHGKQVIEFECLDDKLLEDLLDCDDYAYEKDLPKN

SEQ ID NO: 607 - DNA, 1096 bp, Glycine max
  G3524,family:HB
tgcttcttctgtcttccttttcatgtgtgtctccttctgtttctccactttaccttttttctctcctttttgttgatccccctcttcctcttcttcatctcacatcatttttttcttcatccctttcattgttttctgtgtgttttctatggcggttttaccaagtagctcctcaagcttggaattgaccatatctgtacctggttttgcttcttcaccaacccttcttccctcatcatctgtgaaagaattggacataaatcaagtacctcttgaagaagattggatggcatcaaacatggaagatgaagaagaaagcagcaatggagaacctcctcgaaagaaactccgtctcacaaaggaacaatctcgtctccttgaagaaagctttagacaaaaccacacgttgaacccaaagcagaaagagtctttggcaatgcaactgaagctgcgaccaaggcaagtggaggtgtggtttcagaaccgtagggccaggagcaagctgaagcagacagagatggagtgcgagtacctcaagaggtggttcggttccctcacagagcagaaccggaggctccagagggaagtggaggagctgcgagccattaaggtgggcccacccaccgtgatctcccctcactcctgcgaaccgctcccggcctccacactttccatgtgtccccgctgcgagcgtgtcacctccaccgccgacaaaccgccctccgccgcggccactttgtccgctaaagtgccgccaactcaatcccgccaaccctccgcggcctgttgaccctataactatagtccatcgcctactctgcacgccacctctactacctcatcatctaattaatcagaaacagggcacaaacttaactaaactttacaaaactaaaaagttagtgtgaatgaagatataatatgtgttagaaaaaataatgtttttttttttttttttactaaaagggcgttttcggatagggaaacttttgtagttagtagtagtactttcaatggtcaatgcgtatctgattattgggctttcatattgactttctcctttttcaaatatggatagaacttttatttaaaaaaa

SEQ ID NO: 608 - protein, 213 aa, Glycine max
  G3524,HB domain coordinates 60-120
MAVLPSSSSSLELTISVPGFASSPTLLPSSSVKELDINQVPLEEDWMASNMEDEEESSNGEPPRKKLRLTKEQSRLLEESFRQNHTLNPKQKESLAMQLKLRPRQVEVWFQNRRARSKLKQTEMECEYLKRWFGSLTEQNRRLQREVEELRAIKVGPPTVISPHSCEPLPASTLSMCPRCERVTSTADKPPSAAATLSAKVPPTQSRQPSAAC

SEQ ID NO: 609 - DNA, 1672 bp, Glycine max
  G3537,family:MYB-(R1)R2R3
gataattgagcttttcccagtgcagctacattgaatgtcacgcggtttcgagagagaggtatctatgaggtgaataattttggtccttactccttcagttaatgctcttgctgtcaacttttgacttggctacctggtttactagtttaagtcagcttctcatcacaccccacaccatacatatccttacccctttcatttttagctataaatgtgcatcaagcaaaggttaggctccgagacgtccgattagaaccctatcaagtaaagagggttagagaaataaaaagagaaagccgacagcacatagatagagagaggaaaacgacttaatattctttttccttgagacctgaaggggctaaggaaaattagaaggacacacaagtataaaggcggtgaaataaaagagaaagacaagaagaagacatgggaagaccaccttgttgtgacaaagaaggggtcaagaaagggccttggactcctgaagaagacatcatattggtgtcttatattcaggaacatggtcctggaaattggagggcagttcctgccaaaacagggttgtcaagatgcagcaagagttgcagacttagatggactaattacctgaggccaggaatcaaacggggcaacttcacagaacaagaggagaagatgataatccatcttcaagatcttttaggaaacagatgggctgcaatagcttcataccttccacagagaacagacaatgacataaagaactattggaacacccatttgagaaagaagctgaagaagatgcaagtaggttgtgaaggtggtagctttggagaagggttttcagcctcaaggcaaatccctagaggccagtgggaaagaaggctccaaactgatatccaaatggcaaagagagccctcagtgaagctctttcaccagagaagccatcttgtaatttatctgcctcaaactcaaacccttcagatagtagcagctccttctcttccacaaaaccaacaacaacacaaactgtgtgctatgcctcaagtgctgacaacatagctagaatgctaaagggttggatgaaaaacccaccaaagtcctcaagaacaaactcatcatctgtgactcagaactccttcaacaactttgctgcagcaggtgctgatactgcttctagtattggagcaaagggaccaccaagcagtgctgaattgtctgaaaacaattttgaatcattgtttgattttgatcagtctttggagtcttcaaactctgatgaattctctcggtcattgtctcctgaggccactgttttgcaagatgaaagcaagcctgatgttattggtgcagaaattatgccattctctttgcttgagaaatggcttcttgatgaggctggttgccaagagaaattagttggttgtggtgatgatgccaagtttttctaagttgggttcattttgtgacatatatgagactgtggaattttttattttatttcataagttataggtagggcctcatcaattaatcttcgctttggccttagagagagaagtttttcaagcctttggtgctagacgtgtatatgttaataactattgaaattatgattattgttatcatactgtgttagatgccacactggaaaacaagcaactaagatgtaaagttgatcctgcgatg

SEQ ID NO: 610 - protein, 334 aa, Glycine max
  G3537,MYB-(R1)R2R3 domain coordinates 14-118
MGRPPCCDKEGVKKGPWTPEEDIILVSYIQEHGPGNWRAVPAKTGLSRCSKSCRLRWTNYLRPGIKRGNFTEQEEKMIIHLQDLLGNRWAAIASYLPQRTDNDIKNYWNTHLRKKLKKMQVGCEGGSFGEGFSASRQIPRGQWERRLQTDIQMAKRALSEALSPEKPSCNLSASNSNPSDSSSSFSSTKPTTTQTVCYASSADNIARMLKGWMKNPPKSSRTNSSSVTQNSFNNFAAAGADTASSIGAKGPPSSAELSENNFESLFDFDQSLESSNSDEFSRSLSPEATVLQDESKPDVIGAEIMPFSLLEKWLLDEAGCQEKLVGCGDDAKFF

SEQ ID NO: 611 - DNA, 1342 bp, Glycine max
  G3538,family:MYB-(R1)R2R3
ccccgcgcccccaccagtccgtaagaagaaaatcatgaaaagagagaaaagaagagagggagatagatatattatagctagctagatagagattagaagctatattattatatacataaagttatattatttatattgaactaaaagaaagggtacaagggaaagatgggaaggccaccatgttgtgataaaggtgtgaagaaaggaccttggactcctgaagaagacatcattttggtgtcttatattcaggaacatggtcctggcaattggaaagctgttcctgccaatactgggttgtcaaggtgcagtaagagttgtagacttagatggactaattacctgaggccaggaatcaaaaggggtaacttcacagaccaagaggagaagatgattatccatcttcaagcacttttagggaacagatgggctgcaatagctgcttacctaccacaaagaacagataatgacataaaaaactattggaacacatatttgaaaaagaagctgaacaaaaaattggaagcaggttctgatcaaggaagcttgttgggaggaggacataataatattgggttttcatcagtttctcaaccaatgtctagaggccagtgggaaagaaggcttcaaacagatattcacatggccaaaaaagcacttagtgaagcactctcaccaaacaaggcatcatcatcatcatcaaccttgttagctgaatcaaattcaaacctctccaatgaaaatagtaccttctataatagtaacactaataaaccaacaacaacacaatctatgtgctatgcttcaagtgctgacaacatagctcgtttgttgaaagggtggatgaaaaacacaccaaaatcagcctcatgtgctgcctcggctgtgactcaaaattcctgttcttctagtgaaggaattacaacaacaaagggaagcacaacaagcactagtactgttgaattgtctgagacttttgagtccttgtttggttatgagtctttcgataattactcttcaaattctgagttctcaccatctctttctcctgaggctactcttttccaagatgagggcaagccagatataactacaggattaatagacatgcctttctctttgcttgagaaatggcttctagatgttgatgctggtagtcaagagaaacttggcttctagattattagttcaatttgatatgttttttcttagttacaggagagtaagttaaatctctctctcactttggccctcaacccttcttttggttctagaagtgtatattccaatccaatgttcacattattatatgataaatctataataccactatcctataatt

SEQ ID NO: 612 - protein, 337 aa, Glycine max
  G3538,MYB-(R1)R2R3 domain coordinates 13-117
MGRPPCCDKGVKKGPWTPEEDIILVSYIQEHGPGNWKAVPANTGLSRCSKSCRLRWTNYLRPGIKRGNFTDQEEKMIIHLQALLGNRWAAIAAYLPQRTDNDIKNYWNTYLKKKLNKKLEAGSDQGSLLGGGHNNIGFSSVSQPMSRGQWERRLQTDIHMAKKALSEALSPNKASSSSSTLLAESNSNLSNENSTFYNSNTNKPTTTQSMCYASSADNIARLLKGWMKNTPKSASCAASAVTQNSCSSSEGITTTKGSTTSTSTVELSETFESLFGYESFDNYSSNSEFSPSLSPEATLFQDEGKPDITTGLIDMPFSLLEKWLLDVDAGSQEKLGF

SEQ ID NO: 613 - DNA, 1472 bp, Glycine max
  G3539,family:MYB-(R1)R2R3
gaaataaaaagagaagaaagaaaacacgatagtatcatcatatcaccaccacacacatagatagagagaggaaaacgacctatattttttttcctttgagagcttcaggggctaggaaaattagaaggacagccacaagtataaaggcggtgaaataaaagagaaagacaagaaggagacatgggaagaccaccttgttgtgacaaagaaggggtcaagaaagggccttggactcctgaagaagacatcatattggtgtcttatattcaggaacatggtcctggaaattggagggcagttcctgccaaaacagggttgtcaagatgcagcaagagttgcagacttagatggacgaattacctgaggccaggaatcaagcgtggtaacttcacagaacaagaggagaagatgataatccatcttcaagatcttttaggaaacagatgggctgcaatagcttcataccttccacaaagaacagacaatgacataaagaactattggaatacccatttgagaaagaagctgaagaagatgcaagcaggcggtgaaggtggtagctttggagaagggttttcagcctcaaggcaaatccctagaggccagtgggaaagaaggctccaaactgatatccaaatggcaaagagagccctcagtgaagctctttcaccagagaaaaagccatcttgtaatttatctggcacaaactcaaacccttcagataggagcagctccatctcttccacaaaaccaacaacaacacaaactgtgtgctatgcatcaagtgctgacaacatagctagaatgctcaagggtgggatgaagaacccaccaaagtcctcaagaaccaactcgtctatgactcagaactcattcaacaacttagcaggtgctgatactgcttgtagtagtggagcaaagggaccactaagcagtgccgaattgtctgagaataattttgaatccttgtttgattttgatcagtctttggagtcttcaaactctgatcaattctctcagtccttgtctcctgaggccactgttttgcaagatgaaagcaagcctgatattaatattgctgcagaaattatgcccttctctttgcttgagaaatggctccttgatgaggcaggttgccaagagaaattagttggttgttgtggtgatgccaagtttttctaagttgggttcattttgtgacatatgagactgtgggatttttttattttattttattttatttcataagttataggtagggcctcatcaattaatctcgcttcggccttattagagagagaagttttccagcctttggtgctagacgtgtatatgttaattattattgacattatgatgattattatcatactgtgttagttgccatacactggcaaacttgcttctcttatgtaaagttgatcttgcgacgagatcttgctttatgaattaattgtttttaaagtaaaaaa

SEQ ID NO: 614 - protein, 333 aa, Glycine max
  G3539,MYB-(R1)R2R3 domain coordinates 14-118
MGRPPCCDKEGVKKGPWTPEEDIILVSYIQEHGPGNWRAVPAKTGLSRCSKSCRLRWTNYLRPGIKRGNFTEQEEKMIIHLQDLLGNRWAAIASYLPQRTDNDIKNYWNTHLRKKLKKMQAGGEGGSFGEGFSASRQIPRGQWERRLQTDIQMAKRALSEALSPEKKPSCNLSGTNSNPSDRSSSISSTKPTTTQTVCYASSADNIARMLKGGMKNPPKSSRTNSSMTQNSFNNLAGADTACSSGAKGPLSSAELSENNFESLFDFDQSLESSNSDQFSQSLSPEATVLQDESKPDINIAAEIMPFSLLEKWLLDEAGCQEKLVGCCGDAKFF

SEQ ID NO: 615 - DNA, 1369 bp, Zea mays
  G3540,family:MYB-(R1)R2R3
gcaccagacggaatcgatcgatcggtgctttgatctctgagcctgagcaagcggtcgagctcaccaaccgccacgctcaagacaggtcgagtagctagctagctgccggagcggaaaaggaggcggtgcagtggcatggggaggccgccgtgctgcgacaagatgggggtgaagaaaggcccgtggacccccgaggaggacctcatgctcgtctcctatgtccaggagcacggccccgggaactggcgcgccgtgccgaccaacaccgggctgatgcggtgcagcaagagctgcaggttgcggtggacaaactacctccggccgggaatcaagcgcggcaactttaccgagcaggaggagaagctcatcgtccacctccaggctctccttggcaacaggtgggcggccatagcatcctacttgccgaagaggacggacaacgatatcaagaactactggaacacgcatcttaagaagaagctgaagaacatgcagggcggcgaagggggcgcgggagggaagcgcccggccgttcccaaggggcagtgggagcggcggctgcagactgacatccacacggcgcggcaggctctgcgcgacgcgctctcactggagccttcggcgacgccgctggccaaggtggagcctctgccgacggctccggggtgcgcgacgtacgcgtctagcgccgacaacatcgcgcggctgctggaggggtggctgcgcccgggcagcggcaaggggccggaggcgtcgggttcgacgtcgacgacggccacgacgcgccagcggccgcagtgctccggtgagggcacggcgtctgcgtcggcgagccacagtggcggggcggccgcgaacacggcggcgcagacccccgagtgctcgacggagaccagtaagatggccggcagctcggtcggcgcgggctccgcgccggcgttctcgatgctggagagatggctgctggacgacggcatggggcacgctgaggtggggctcatgaccgacgtggtgccattaggggaccccagtgagttcttttaattaaggcacaagtaccaccaaaagcaaactgatcaagtagagatgcaagaacaaaaagaagaaattaatcgccgggttaggtaactagttaagcagaaatccaacaaaactaaatgtatttgaattctcggtgaatttgatcgagttggatgtcgatatagtttttgttttagtcccttcttttatttttttctctgttgtttctctgatgttagggtttgtaactgatcatgtaagcttatactaatgacaggttcctaaatggaccctgcatgaaaatacatcttataaattaaaagatctatacaaaaaaaaaaaaaaaaaa

SEQ ID NO: 616 - protein, 302 aa, Zea mays
  G3540,MYB-(R1)R2R3 domain coordinates 14-118
MGRPPCCDKMGVKKGPWTPEEDLMLVSYVQEHGPGNWRAVPTNTGLMRCSKSCRLRWTNYLRPGIKRGNFTEQEEKLIVHLQALLGNRWAAIASYLPKRTDNDIKNYWNTHLKKKLKNMQGGEGGAGGKRPAVPKGQWERRLQTDIHTARQALRDALSLEPSATPLAKVEPLPTAPGCATYASSADNIARLLEGWLRPGSGKGPEASGSTSTTATTRQRPQCSGEGTASASASHSGGAAANTAAQTPECSTETSKMAGSSVGAGSAPAFSMLERWLLDDGMGHAEVGLMTDVVPLGDPSEFF

SEQ ID NO: 617 - DNA, 1225 bp, Zea mays
  G3541,family:MYB-(R1)R2R3
gaattcccgggtcgaccctcgcggccgcggacgcgtgggcggacccgtggggccacaactccggccagaagctagctagccaagttattagctagtacatactagtggccggccggacacgatcgatgggcaggccgccgtgctgcgacaaggcgggggtcaagaaggggccatggacgccggaggaggacatcgtcctggtgtcctacgtccaggagcacggccccggcaactggcgcgccgtgcccgtcagcacgggcctcatgcgctgcagcaagagctgccgcctccgctggaccaactacctccgccccggcatccggcgcggcaacttcacaccccacgaggaaggcatcatcgtccacctccaggccttgctaggcaacagatgggcggccattgcttcttacctcccacagagaaccgacaacgacatcaagaactactggaacacccacctcaagaagaagctccggaagcagcaagccatcggcgccatcttcgcgccacctcccccctccgaacccaccgccggccatgccgattgccgtcgtcacgacatgacccgctcctccaaggacagccacgctgcttgcccggccgacagcacaccagcggctgatgaggtcgtcacccagctcatcgcccagcagttcgccgccaccgacggcgacacctcgtcgtcgtcgtcctactcgtacgcctccagcacggacaacatctccaagctgctgaacggcttcatgatgaagagcgcctcgccggcgcgggacgacgctaccgacaccatcaagacttcctcggccattgacatcgaccctttcgaccacaagtccggcggggccgcactaccaccacccaagaagcggcagcagcagcagcatctgtcctccatagagaactggttgttcgacgatgccactgagcagctcgttgtccagctgatggaggagatctccggcggctcatgctcagttcccatgctgctttattagcaccaagaaaaagaagcgaacatgcatgatagccgatcgatagatgtgacttggataggagaatgaatgtgtgcatgggtgcaagttacccagctgataggagaattttatatacaccaatatgcatgtttggttttatttacacaagcatgagccatgagacaagaacaatatatatgcatagttaatcaaaactcccaagcgagaggcacctcaaagaactcaaaaaa

SEQ ID NO: 618 - protein, 289 aa, Zea mays
  G3541,MYB-(R1)R2R3 domain coordinates 14-118
MGRPPCCDKAGVKKGPWTPEEDIVLVSYVQEHGPGNWRAVPVSTGLMRCSKSCRLRWTNYLRPGIRRGNFTPHEEGIIVHLQALLGNRWAAIASYLPQRTDNDIKNYWNTHLKKKLRKQQAIGAIFAPPPPSEPTAGHADCRRHDMTRSSKDSHAACPADSTPAADEVVTQLIAQQFAATDGDTSSSSSYSYASSTDNISKLLNGFMMKSASPARDDATDTIKTSSAIDIDPFDHKSGGAALPPPKKRQQQQHLSSIENWLFDDATEQLVVQLMEEISGGSCSVPMLLY

SEQ ID NO: 619 - DNA, 1082 bp, Glycine max
  G3643,family:AP2
ccacgcgtccgcttcttctctcagaatacacaacacaaagtcaatataattatagtatatccctatgagtaggagttcggcgatgcatggaattacaagcacaaacaacaagttgaagggagttcggcgtcgaaaatggggcaaatgggtgtcggagattcgtgttccgggcacgcaagagcgtttgtggttgggaacctacgccacgccggaggctgccgcggtggctcacgacgttgccgtctactgtctaagtaggccttcttcgttggacaaacttaacttccccgaaaccttgtcttcgtacagtgttcagctcagggacatgtctccgaggtctgtgcagaaggtggcttccgatgttggcatggatgttgatgcaagaaacattgttgcgggcaaaacttcaacggtgggggcagaaactaattgcgagagtgatgagaggactagtactgcgtctgtgtgtaatgttgttggagaaggtggtgctgatcattcggatgtgttttggtgggatgatgatggtgggtcttggcatggaagtggtggagattctacggaaagggatgccttgagcatttccattgaagattatctttagctgttctaggtttcaactttagttatctttttttttttttttttgagttatgatcgatgcgcatagttagtagttacagataattactgctagtgttgggtgtttaaacggtcagagatgatgatatataaatttgatgtgcgctagctgcctttttgaagaaactaaaaaaaggtaaaacaagaaagattgtacccccaaaatgaacttggtcaatttcacactttcacgccatttgcattttgtgcacgttgttagttttcaaattgttaattcccttgctaaacccactcaaacttgagtgcgttcaccttttattaccacgtagtaactgagagttaacgaaaatatttctttataaaaattatttaccatttagtgtctttcgtttacttgtaattattcaacttgtcaataagatgaaagttctaattttagatataataaaattcagctagtatttgtgaattactcactt

SEQ ID NO: 620 - protein, 179 aa, Glycine max
  G3643,AP2 domain coordinates 13-78
MSRSSAMHGITSTNNKLKGVRRRKWGKWVSEIRVPGTQERLWLGTYATPEAAAVAHDVAVYCLSRPSSLDKLNFPETLSSYSVQLRDMSPRSVQKVASDVGMDVDARNIVAGKTSTVGAETNCESDERTSTASVCNVVGEGGADHSDVFWWDDDGGSWHGSGGDSTERDALSISIEDYL

SEQ ID NO: 621 - DNA, 687 bp, Oryza sativa (japonica cultivar-group)
  G3644,family:AP2
atgccttttgtacgtacacttgctttcccaacgctcgcgaatcaaatcgagggtgaaattaagtcaagaacggagagagatcacggtgaggttgatctcagctcgccggaggaggcaatgagccgggcggagtgcggcggcggcgaggaggaggagcggtgcaggtacaggggcgtgcggcggcggcggtgggggaagtgggtgtcggagatccgggtgcccggcacgcgggagcggctgtggctggggtcctacgccacgccggaggccgccgccgtcgcgcacgacacggccgtctacttcctccgcggaggcgcgggcgacggcggtggcggcggcgcgacgctcaacttcccggagcgcgcggcggccacgtacggcggcggcgccgccgtggcgcgcctgtcgccgcggtccgtgcagcgcgtggcgtccgacgccggcatggccgccgacgcgcagctcgtggcggcgcgggacgccgcgcccgcgcccgcgccggcgacggcgtacgcgcgcccggatcactgcgccggcgcgacgacggcgcggcacgacgagctggcgcgccgcgggatgtacggcgctcacgcgcatgccgccggcgcgaacgccaggacgagcggcgagcggcagctcgtctgtgccgaggagattagcgtggatgacatggagatcctgatgtaa

SEQ ID NO: 622 - protein, 228 aa, Oryza sativa (japonica cultivar-group)
  G3644,AP2 domain coordinates 52-122
MPFVRTLAFPTLANQIEGEIKSRTERDHGEVDLSSPEEAMSRAECGGGEEEERCRYRGVRRRRWGKWVSEIRVPGTRERLWLGSYATPEAAAVAHDTAVYFLRGGAGDGGGGGATLNFPERAAATYGGGAAVARLSPRSVQRVASDAGMAADAQLVAARDAAPAPAPATAYARPDHCAGATTARHDELARRGMYGAHAHAAGANARTSGERQLVCAEEISVDDMEILM

SEQ ID NO: 623 - DNA, 656 bp, Brassica rapa subsp. Pekinensis
  G3645,family:AP2
cccacgcgtccgatggattacatcgacaacaccgtcgaaactcaatcaaagtacaaaggcatccgtcgccggaaatgggggaaatgggtatcggagattcgagttccgggaactcgcgaccgtctctggttaggctcattctccacggcggaaggcgcagccgtggcgcacgacgtggctttctactgtttacaccaaccaaactcgctcgaatctctcaacttccctcacttgcttcctccttccattgtttccaagacttcgccgaggtctatccagcaagctgcttctaatgccggaatggccgttgacgccggaatcgttaacagctgtgatcacgcgtcagggaactctgggaatggagatacaacgacggcgtattgtgagaatggaggtgcgttgaatatatcagtgtatgattatttggacggtcacgatcacgtttgaacttcatcttcttgttttttcgtttaaagatacagctactcaaaagaagcagtgatggagcctggtgtgtaagcaagcaaaacgttgtgaatatatataccggtatgtttcgctgttggcccaatgcaagaaacttttgtagtacgaatatatatattttattttgaatgccttcaagaggattataatgcgagtgaagctttgtttca

SEQ ID NO: 624 - protein, 144 aa, Brassica rapa subsp. Pekinensis
  G3645,AP2 domain coordinates 10-75
MDYIDNTVETQSKYKGIRRRKWGKWVSEIRVPGTRDRLWLGSFSTAEGAAVAHDVAFYCLHQPNSLESLNFPHLLPPSIVSKTSPRSIQQAASNAGMAVDAGIVNSCDHASGNSGNGDTTTAYCENGGALNISVYDYLDGHDHV

SEQ ID NO: 625 - DNA, 649 bp, Brassica oleracea
  G3646,family:AP2
cagccgcataacatattactattccccctggtcatatctttgacttttatttttatttgctctaacctaaaagtattatataagtattgcacaattcatacaatcggaattgactttcttctcctccaatcgtatttttattcaacagttcctctcaagatcatcaactcaaaaaatggatcctagagacggcggagaaacccatcaggccaagtacaaaggcatccgtcgccggaaatggggaaaatgggtatcggagattagggttccagcaactcgtgaacgactctggttaggctctttctccaccgccgaaggagctgcggtagcccacgacgtcgctttttactgcttgcaccgaccatcttctctcgacaacgaagcttttaacttccctcacttgctgcaaccttcccttgcctccaacacatctcctaagtccatacaaaaagctgcttcggacgcaggcatgggcgtagacgcaggattcgccctaaacaacgacagcgcgagtggtggcgtggaggaaggcaccgaacgggaaacgttgaacatctccgtgtacgattatctagacgacggtcgcatttgatatattggtttatatctacgagcaccttatattagtaattaatataggatgtgaata

SEQ ID NO: 626 - protein, 138 aa, Brassica oleracea
  G3646,AP2 domain coordinates 10-77
MDPRDGGETHQAKYKGIRRRKWGKWVSEIRVPATRERLWLGSFSTAEGAAVAHDVAFYCLHRPSSLDNEAFNFPHLLQPSLASNTSPKSIQKAASDAGMGVDAGFALNNDSASGGVEEGTERETLNISVYDYLDDGRI

SEQ ID NO: 627 - DNA, 495 bp, Zinnia elegans
  G3647,family:AP2
attcgcggccgcgaatatgagtaccagctcagatgaaggtaacaactgtttaagccaaaagacttacaaaggcgttaggtgccgacgatggggcaaatgggtgtcagagattcgagttccaggaagtcgagaacggctctggctaggcacgtactctacgcctgagggtgcagctgtggctcatgatgtagcctcgtactgtttaaaagggaatacgtcttttcataaacttaatattccgtctatgttacctccgacagcacggacagacctatctcctaggtccatccaaaaggctgcgtctgatgctggtatggccatagacgcacggtttatcgcgtctagagataccacaccgactaatgaggcgttgaacatttctgtagatgattatctttaaattttgagaactaatattgtgtcaccaatattgtaagtcgatctacattggcaaacacaatgtacgtgtttggtggcacttccagattattgttt

SEQ ID NO: 628 - protein, 127 aa, Zinnia elegans
  G3647,AP2 domain coordinates 13-78
MSTSSDEGNNCLSQKTYKGVRCRRWGKWVSEIRVPGSRERLWLGTYSTPEGAAVAHDVASYCLKGNTSFHKLNIPSMLPPTARTDLSPRSIQKAASDAGMAIDARFIASRDTTPTNEALNISVDDYL

SEQ ID NO: 629 - DNA, 594 bp, Oryza sativa (japonica cultivar-group)
  G3649,family:AP2
atgggccgggtggcggcgagcggcggcggcggcggcggaggggagatgatgaggtacaggggcgtgcggcggcggcggtgggggaagtgggtgtcggagatccgggtgcccgggacgcgggagcgcctgtggctcggctcctacgccaccgccgaggccgccgccgtcgcgcacgacgccgccgtctgcctcctccggctcggcggcggccgccgcgccgccgcaggcggaggcggcgggctcaacttccccgcccgcgcgctcgccgcggcggcggccgcctcctcctacggcggcgccggcggtctcctgtccccgcgctccgtgcagcgcgtggcgtccgacgccggcatggccgccgacgcgcagctcgtggacctgcgccgcgaccacccgcccgccgccgccgccgcctcatcctccggcagcggcgtggcgggagacggtgcaagaaagcaagggacacgtggcgaggttagcgacacgtattggtgtaggaatggagaggatgggagcagaagccggagctccgggagtgaggagctcattgtttacgagggcttaagtgtagatgacatggaaattttgatgtaa

SEQ ID NO: 630 - protein, 197 aa, Oryza sativa (japonica cultivar-group)
  G3649,AP2 domain coordinates 15-87
MGRVAASGGGGGGGEMMRYRGVRRRRWGKWVSEIRVPGTRERLWLGSYATAEAAAVAHDAAVCLLRLGGGRRAAAGGGGGLNFPARALAAAAAASSYGGAGGLLSPRSVQRVASDAGMAADAQLVDLRRDHPPAAAAASSSGSGVAGDGARKQGTRGEVSDTYWCRNGEDGSRSRSSGSEELIVYEGLSVDDMEILM

SEQ ID NO: 631 - DNA, 813 bp, Zea mays
  G3650,family:AP2
ccacccgtgctcgatcgatcatgccatgtcaacgcccccggccgcgctgaccttgatccttctcgtctcaccgcaccttataaatacgcccacgtcgctcgtgtcgtcgtgtgctccatcgcaaacggccaaaaaccaccagcacaagtgcacaagccattgcccatcggacgcccagccggccagcccctgtcccgacggtcggccgacgacgatgagccgcgcagcgaccaacagcggcgcggagcggcggtgccggtacaggggcgtgcggcggcgggcctgggggaagtgggtgtcggagatccgggtgccgggcacgcgggagcggctgtggctgggatcctacgcggcgcccgaggccgccgccgtcgcgcacgacgccgccgcgtgcctcctccgcggctgcgcgggccgccgcctcaacttcccgggccgcgccgcctgctactacgcctgcggcgggcagcagccgctgtcgccgcgctccgtgcagcgcgtcgcgtccgacgccggcatggccgccgacgcgcagatcgtcgacgcgcgggcggccctcgcctcgccgccgcccgttgtccagcccgccgctctcgctggcattattggcggcgccgcgcgagaaggcggcggaggcgtgcgaggccccgcgtgcgcgccggcgccgccaagcaacggcgctggcagcagcagtacgtattggtccacgccgagcagtgagccgccgcttgtttacggggacattagcgtagacgacatagagatcttgatttgactattaggcactagttagtagcatagtcatggcagttc

SEQ ID NO: 632 - protein, 249 aa, Zea mays
  G3650,AP2 domain coordinates 75-139
MSTPPAALTLILLVSPHLINTPTSLVSSCAPSQTAKNHQHKCTSHCPSDAQPASPCPDGRPTTMSRAATNSGAERRCRYRGVRRRAWGKWVSEIRVPGTRERLWLGSYAAPEAAAVAHDAAACLLRGCAGRRLNFPGRAACYYACGGQQPLSPRSVQRVASDAGMAADAQIVDARAALASPPPVVQPAALAGIIGGAAREGGGGVRGPACAPAPPSNGAGSSSTYWSTPSSEPPLVYGDISVDDIEILI

SEQ ID NO: 633 - DNA, 702 bp, Oryza sativa (japonica cultivar-group)
  G3651,family:AP2
atggctgacctcccatgcatatatatacgcgtagtacgtacacttgctttcccaacgctcgcgaatcaaatcgagggtgaaattaagtcaagaacggagagagatcacggtgaggttgatctcagctcgccggaggaggcaatgagccgggcggagtgcggcggcggcgaggaggaggagcggtgcaggtacaggggcgtgcggcggcggcggtgggggaagtgggtgtcggagatccgggtgcccggcacgcgggagcggctgtggctggggtcctacgccacgccggaggccgccgccgtcgcgcacgacacggccgtctacttcctccgcggaggcgcgggcgacggcggtggcggcggcgcgaccgctcaacttcccggagcgcgcggcggccaccgtacggcggccgccgtggcgcgcctgtcgccgcggtccgtgcagcgcgtggcgtccgacgcggcatggccgccgacgcgcagctcggcgtgccgggacccggcccggcccgcgccggcgacggcgtacgcgcgcccggatcactgcgccggcgcgacgacggcgcggcacgacgagctggcgcgccgcgggatgtacggcgctcacgcgcatgccgccggcgcgaacgccaggacgagcggcgagcggcagctcgtctgtgccgaggagattagcgtggatgacatggagatcctgatgtaa

SEQ ID NO: 634 - protein, 233 aa, Oryza sativa (japonica cultivar-group)
  G3651,AP2 domain coordinates 60-130
MADLPCIYIRVVRTLAFPTLANQIEGEIKSRTERDHGEVDLSSPEEAMSRAECGGGEEEERCRYRGVRRRRWGKWVSEIRVPGTRERLWLGSYATPEAAAVAHDTAVYFLRGGAGDGGGGGATAQLPGARGGHRTAAAVARLSPRSVQRVASDAAWPPTRSSACRDPARPAPATAYARPDHCAGATTARHDELARRGMYGAHAHAAGANARTSGERQLVCAEEISVDDMEILM

SEQ ID NO: 635 - DNA, 1146 bp, Zea mays
  G3656,family:AP2
ggcggtgaagatggaggcggagcaagcggcgatggcggcgccgcagctgggggcggcgcaccagcagacgcagccgcggcggcagtaccgcggcgtgcgcatgcgcaagtggggcaagtgggtggcggagatccgggagccgcacaagcgcacgcgcccccgcctccggtcctacgccacggccgtggcggcggcgcgcgcctacgacacggccgtgttctacctgcccggcccgtcggcgcggctcaacttccccgaggagatcccctcgttcgggctggcggatggcgtggacgtgggggagcacgcgcgcgacccggccgccgccgccgccggcggcggcggcggctgcacgctgtccgcggcgtccatacggaagaaggccatcgaggtggggtcccgcgtggacgcgctccagaccggcatggtggtcccgccgccgcaccaccgcgagcgccataggcaccacaaccacctgccgcagctgcgggtgcacgcggaggagcagcaggaggaagaggagcagaagccgcagcggcctgcgtggagcgggcgcgtcaagaacccggatctgaaccgtgcgccgagccccgagagctccgacgccgagtgacaagcgagcgagagcgcagcagcagccaccgcaaggcgaggttcaacgacgacgtccgttatcggttattcccaatcccacgacgcagcatgccgttgtcgtctccgtccgaccgtccccacgtacgtacgtacgtacgtacacgacgatccagctgaccctgccgcctgcctatcctatccgtcctcgacgacgaccggatggtcggcgggcgggagggagggcggtgcggcgagggttttgggtacgttgtggataagcacgagggcagcagcagcaggggcggcgtgcgcgggcaggcaggcgaagacggagggaggcggccacaagcggcggtctttccaaacgtcaaaaaggacagctgtaacagcgataagaaaaaacaagtcatcatcaccctcgtctcactactagttctactactgttcccgagagtagtagtaacgattagcactccactagcagtatgattattcgaatcggccttgcttgacagcgattaaaaaaaaaaaaaaaaaaaaaaaaaaaaaaaa

SEQ ID NO: 636 - protein, 200 aa, Zea mays
  G3656,AP2 domain coordinates 23-86
MEAEQAAMAAPQLGAAHQQTQPRRQYRGVRMRKWGKWVAEIREPHKRTRPRLRSYATAVAAARAYDTAVFYLPGPSARLNFPEEIPSFGLADGVDVGEHARDPAAAAAGGGGGCTLSAASIRKKAIEVGSRVDALQTGMVVPPPHHRERHRHHNHLPQLRVHAEEQQEEEEQKPQRPAWSGRVKNPDLNRAPSPESSDAE

SEQ ID NO: 637 - DNA, 1286 bp, Zea mays
  G3680,family:ZF-HB
tgggggcgccgcatggaagccatggacgtcaagtacaagcccgtcatgttccccaacggcgccggcctcaagaagccgaagccggcggcggccgtggcgctggccggggagccgctgtaccgggagtgcctcaagaaccacgccgcgagcctgggcgggcacgccgtcgacggttgcggcgagttcatgccctcgccgggggccaaccccgccgacccgacgtcgctcaagtgcgcggcgtgcgggtgccaccgcaacttccaccgccggacgctggagggttcccctccgccgcccgcgcccgcgccgctggcgctcccgcctccgccgagcgtgatgcacggccagccgcaccgcgcccgggaggagacgcccgaggaccgccacccgggggtcgtcgacgccgacgactccgattccgactcggaaggctcggagtacgacgaggagcggtcggtgtccccgccgccgccgccgcaccacctgctgccggcgccggtggcgcagcagcccccgccaccgtcctacttcccgacggcgccgcacatggtgctctcgctaggttccggcgtgcccgggcccgcggtggcggtatccccggcgcagaggctggccccgacccagctgacgccgtccagcgcgccgccccacgccgggggcgcgatgcccatgcccaggaagcggttccgcaccaagttcaccgccgagcagaagcagcggatgcaggagctgtcggagcggctcgggtggcggctgcagaagcgcgacgaggccatcgtcgacgagtggtgccgcgacatcggcgtcggcaagggcgtcttcaaggtctggatgcacaacaacaagcacaacttcctgggcgggcacagcgcccgccgcagcgcctcctcgcccgcccccgcccccgccgccgcgtcgctccaaaccccagccgccggcgccggcgctgctgcagcaccgtcattccacccgtccaggatcacccctccccctcccgtcctcacctcgtccccgacggccgccaccggcttcaacatcaacggcgccgcctcgtcggcgcccaccgtcgccaccgactacaccacggacaacgccaacggagcttcgtcgccgcactccgcttgaactagagaagggagaagagaggaggggggaagggaagggagagcggagagagagaaacatgtagcttaatttcagtgatcactcgttttttttttctttagacttcttgccatctactaagaaattaaccccaagaaaaagcatgccgctgtgcgccatgc

SEQ ID NO: 638 - protein, 370 aa, Zea mays
  G3680,ZF-HB domain coordinates 34-89,222-285
MEAMDVKYKPVMFPNGAGLKKPKPAAAVALAGEPLYRECLKNHAASLGGHAVDGCGEFMPSPGANPADPTSLKCAACGCHRNFHRRTLEGSPPPPAPAPLALPPPPSVMHGQPHRAREETPEDRHPGVVDADDSDSDSEGSEYDEERSVSPPPPPHHLLPAPVAQQPPPPSYFPTAPHMVLSLGSGVPGPAVAVSPAQRLAPTQLTPSSAPPHAGGAMPMPRKRFRTKFTAEQKQRMQELSERLGWRLQKRDEAIVDEWCRDIGVGKGVFKVWMHNNKHNFLGGHSARRSASSPAPAPAAASLQTPAAGAGAAAAPSFHPSRITPPPPVLTSSPTAATGFNINGAASSAPTVATDYTTDNANGASSPHSA

SEQ ID NO: 639 - DNA, 1098 bp, Zea mays
  G3681,family:ZF-HB
cgtcatgttccccaacggcgccgccttcaagaaggcgaagccggcggccgtggcgccggccggggagccgctgtaccgggagtgcctcaagaaccacgccgcgagcctgggcgggcacgccgtggacgggtgcggcgagttcatgccctcgccgggggccaaccccgccgacccgacgtcgctcaagtgcgcggcgtgcgggtgccaccgcaacttccaccgccggacggtggagggttccccgccgcagcctgcgcccgcgccgctggcgctcccgccgccgccgccgccgccgccgagcgtgctgcacggccagacgcaccgcggcggggaggatacgcccgaggaccgccacccgggggtagtcgacgccgacgaccccgattccgactcggagggctcggagtacgacgaggagcggtcagtgtccccgccaccgccgcaccacgtgccggcgccggtggcgcagcaacccccgccgccgtcatacttcccggcggcggcgccgcaccagcacatgctgctctcgcttggtcctggcgccgcggtggcggccgcggcgcagaggctggccccagcccagctgacgccgtcgagcgcgccgcctcccgggggcgcgatgcccaggaagcggttccgcaccaagttcaccgccgagcagaagcagcggatgcaggagctgtcagagcggctcgggtggcggctgcagaagcgcgacgaggccgtcgtggacgagtggtgccgcgacatgggcgtcggcaagggcgtcttcaaggtctggatgcacaacaacaagcacaacttcttgggcggacacagcgcccgccgcagcgtctctgcctcctcaggcgctgctgcgctcctccaaaccccatgcgccaacgccggcgctgctgcaccgtcattcaacccgtccaggctcacccctccccctcccgtcctcacatcgtccccgaccggcttcaacatcaacggcgccgcctcctcctcgccgcccaccgtcaccgccgaccacacggacaacgccaacggagcttcatcgccgcactccgcttaagctagagaggagagggaagcgagaatggagagacaaacatg

SEQ ID NO: 640 - protein, 350 aa, Zea mays
  G3681,ZF-HB domain coordinates 22-77,208-271
MFPNGAAFKKAKPAAVAPAGEPLYRECLKNHAASLGGHAVDGCGEFMPSPGANPADPTSLKCAACGCHRNFHRRTVEGSPPQPAPAPLALPPPPPPPPSVLHGQTHRGGEDTPEDRHPGVVDADDPDSDSEGSEYDEERSVSPPPPHHVPAPVAQQPPPPSYFPAAAPHQHMLLSLGPGAAVAAAAQRLAPAQLTPSSAPPPGGAMPRKRFRTKFTAEQKQRMQELSERLGWRLQKRDEAVVDEWCRDMGVGKGVFKVWMHNNKHNFLGGHSARRSVSASSGAAALLQTPCANAGAAAPSFNPSRLTPPPPVLTSSPTGFNINGAASSSPPTVTADHTDNANGASSPHSA

SEQ ID NO: 641 - DNA, 1026 bp, Oryza sativa (japonica cultivar-group)
  G3691,family:ZF-HB
atggaggccatggacgtcaagtacaagccgctcgtgttccccaacggcgccatcaagaaggcggcgaagccggcggcggtggcgcctgcggtgggcggcggcggagggggagagacggtgtaccgggagtgcctcaagaaccacgcggcgagcctgggcgggcacgcgctggacgggtgcggggagttcatgccgtcgccggcggcgaaccccgccgacccgacgtcgctcaggtgcgccgcgtgcggctgccaccgcaacttccaccgccggctgccggaggggtcccccccgccgccgccgccgccggcgctgctgcccgcgccgcccatgccgccgcaccgcggggaggagacgcccgaggtccgcctccccggggtggatggcgacgagtccgactccgactcggacgggtcggagtacgacgacgagcggtccgtgtccccgccgccgccgccgctggcggcggcggtggcgcaccaggtgtactacccttcggcgccgcacatgctgctgtcgctggggtcgagcgggcaggcgcagaggctcccgccgcaggtgatgtcgccggcggcggcggccgcgcctccccccggcggcggcggcggcgggatgccgaggaagcggttccgcaccaagttcaccgccgagcagaagcagcggatgcaggagctctcggagcggctcgggtggcgcctccagaagcgcgacgaggccatcgtcgacgagtggtgccgcgacatcggcgtcggcaagggcgtcttcaaggtctggatgcacaacaacaagcacaactacctcggcggccacagcgcccgccgcagcgcctcctcctcctccgccgccgccgccgccgccccgccattcaaccctcccacctcacctcctcctcctcctcctcctcctccacacgccaccgacttcaacatcaacggaacagccaccgccgccaccgccgccgccgccgccaccatcgccgccggcaaccaccaagagaacggagcatcgtcgccgcaatcagcataa

SEQ ID NO: 642 - protein, 341 aa, Oryza sativa (japonica cultivar-group)
  G3691,ZF-HB domain coordinates 39-94,207-270
MEAMDVKYKPLVFPNGAIKKAAKPAAVAPAVGGGGGGETVYRECLKNHAASLGGHALDGCGEFMPSPAANPADPTSLRCAACGCHRNFHRRLPEGSPPPPPPPALLPAPPMPPHRGEETPEVRLPGVDGDESDSDSDGSEYDDERSVSPPPPPLAAAVAHQVYYPSAPHMLLSLGSSGQAQRLPPQVMSPAAAAAPPPGGGGGGMPRKRFRTKFTAEQKQRMQELSERLGWRLQKRDEAIVDEWCRDIGVGKGVFKVWMHNNKHNYLGGHSARRSASSSSAAAAAAPPFNPPTSPPPPPPPPPHATDFNINGTATAATAAAAATIAAGNHQENGASSPQSA

SEQ ID NO: 643 - DNA, 689 bp, Zea mays
  G3719,family:WRKY
ccaccatggccgatgactacttccagttcggattcgacggccaggagatggtgggcgctcccgctcccgcctgcggcggctacgactgctcggcgccggtgttcgccaacagttcttcagacgccgccgccgccgtcggcaatggcatgagcctgctgagctatggcgtcgacggcgacggcgacgggaggaggccgatgagcggaccaccatatggcaccggtgggaacggcggcggccggccgccgtcgtcgtcacggattgggttccggacgcggtcggaggtggacgtgctggacgatggcttcaagtggcgcaagtacggcaaaaagacggtcaagagcagccccaacccgaggaactactaccggtgctcggcggagggctgcggcgttaagaagcgcgtggagcgggacagcgacgacccgcgctacgtcgtcaccacctacgacggcgtccacaaccacgccgcgctgggcccgggcgccgcctcctacctgtgccaaccaccgcctccgcgcggcgcaaccgcaaccgcaaccgtaacgcccttctcgcctccacgctcggcctcggcgccggcgcccctggctgcagcgcccagctggagcgccgcctgtgacgcgtgggaggcgcagctgcacgccgcggcggcggctgctcattcctcggagtcgtcgtactgatcc

SEQ ID NO: 644 - protein, 226 aa, Zea mays
  G3719,WRKY domain coordinates 98-154
MADDYFQFGFDGQEMVGAPAPACGGYDCSAPVFANSSSDAAAAVGNGMSLLSYGVDGDGDGRRPMSGPPYGTGGNGGGRPPSSSRIGFRTRSEVDVLDDGFKWRKYGKKTVKSSPNPRNYYRCSAEGCGVKKRVERDSDDPRYVVTTYDGVHNHAALGPGAASYLCQPPPPRGATATATVTPFSPPRSASAPAPLAAAPSWSAACDAWEAQLHAAAAAAHSSESSY

SEQ ID NO: 645 - DNA, 666 bp, Zea mays
  G3720,family:WRKY
atggcggcagtcggagctcacccagtgctgtaccaccacccggcgccggcgggcgacgcctcctccatgtcctcctacttctcccacggaggcagctccaccacctccagctctgcgtccagcttcaccgccgcgctcgcgccgacgacgacggcgctcgccgagcatttcgacatctccgagttcctcttcgacgacgctgcgggcgctggggtcgccggcgcgccaggtgtgttcgccgatggcgcggcccgccccgtcgtcctgccggtgccggatgccgctggtggtggtgcaattatcggcgcagccgctgggggcgcggctgcggcgtcggaggtgccagagcggccgcggacgacgcggatcgcgttccggacgaggtcggagatcgagatcctggacgacggctacaagtggaggaagtacggcaagaagtccgtcaagaacagccccaacccaaggaactactaccggtgctcgacggaagggtgcaacgtgaagaagcgggtggagcgggacaaggacgaccccagctacgtggtgacgacgtacgaggggatgcacaaccacgtcagccccagtacggtgtactacgccagccaggacgccgcctccggccgcttcttcgtcgccggcacgcagccaccgggctccctcaactga

SEQ ID NO: 646 - protein, 221 aa, Zea mays
  G3720,WRKY domain coordinates 135-191
MAAVGAHPVLYHHPAPAGDASSMSSYFSHGGSSTTSSSASSFTAALAPTTTALAEHFDISEFLFDDAAGAGVAGAPGVFADGAARPVVLPVPDAAGGGAIIGAAAGGAAAASEVPERPRTTRIAFRTRSEIEILDDGYKWRKYGKKSVKNSPNPRNYYRCSTEGCNVKKRVERDKDDPSYVVTTYEGMHNHVSPSTVYYASQDAASGRFFVAGTQPPGSLN

SEQ ID NO: 647 - DNA, 825 bp, Oryza sativa (japonica cultivar-group)
  G3721,family:WRKY
agtggatcccccgggctggaggaaaattcaccggtgaaaaggttcagcactgtgcaatggcggcttccgtaggactgaaccctgaagctttcttcttcagcaactcctactcctactcctcatcccctttcatggccagctacacgccggagttctcggccgccgctatcgacgccaacttattctccggcgagctcgatttcgactgctctctcccagctccggcccaggagtacccggaaaatgaaaacactatgatgaggtacgagagcgaggagaagatgagggcgagggtgaacgggaggatcgggttcaggacgaggtcggaggtggagattcttgatgatggcttcaagtggaggaagtacggcaagaaagctgtcaagaacagcccaaatccaagaaactactaccggtgctcgacggaggggtgcaacgtgaagaagcgagtggagagagaccgggaggaccaccgctacgtcatcaccacctacgacggcgtccacaaccacgcgagccccgccgccgccgccgcggcgctgcagtacgccgccgccgccggcgactactacagcccgccgctcagcagcgccggctcgccgccggccgcctatttcggcaggcggcttcgctgctcttctgagggctgatgaagtttgtctaggactagacacgcccgggagctctagctaggatagaaaactagagaaagtttaattatacctgaattttaattaatcacctcacaaaactctgatgtatcatattatatcgtgatagtgactggttgttaatttaattttggcgatcgatgtgatcttcggt

SEQ ID NO: 648 - protein, 197 aa, Oryza sativa (japonica cultivar-group)
  G3721,WRKY domain coordinates 96-152
MAASVGLNPEAFFFSNSYSYSSSPFMASYTPEFSAAAIDANLFSGELDFDCSLPAPAQEYPENENTMMRYESEEKMRARVNGRIGFRTRSEVEILDDGFKWRKYGKKAVKNSPNPRNYYRCSTEGCNVKKRVERDREDHRYVITTYDGVHNHASPAAAAAALQYAAAAGDYYSPPLSSAGSPPAAYFGRRLRCSSEG

SEQ ID NO: 649 - DNA, 680 bp, Zea mays
  G3722,family:WRKY
agttacttgcagctggccatgcacatggcgctatcgtcccgcagctcattcgccgccgacgtcctcctcccagccaccatgtcgtatcgtcagccgtgcagcggtgcttccagctacttgggctctcagcccgcggcccctttcccgtcggcagcgttcggcgcggtggcgcagctggacgtcttcgactgcctgtcgtcggacgaaggcgttggcgtcccggcagctgtacctggtgcgttcgcgccgccgccgccgcttatgccggccgagcgcgtcgtcccggacgctgctgcaggctacagtagtcatactaggagtgcagcggctgtggcgggtgaggggtcgaggactacgcacagaattgcgttccgagtgaggtcggacgaggacgaggtactcgacgacggctacaaatggaggaagtacggaaagaagtccgtcaagaacagccctaatccgaggaactactaccggtgctcgacggagggctgcaacgtcaagaaaagggtggagcgagacagggacgacccgagatacgttgtgaccatgtacgagggagtgcacaaccatgtgagtcctggtaccgtctattacgccacccacgacgccgcctccggccgcttcttcgtcgccgggatgcatcagccaggccattgatcaacgagcagatcagagag

SEQ ID NO: 650 - protein, 213 aa, Zea mays
  G3722,WRKY domain coordinates 129-185
MHMALSSRSSFAADVLLPATMSYRQPCSGASSYLGSQPAAPFPSAAFGAVAQLDVFDCLSSDEGVGVPAAVPGAFAPPPPLMPAERVVPDAAAGYSSHTRSAAAVAGEGSRTTHRIAFRVRSDEDEVLDDGYKWRKYGKKSVKNSPNPRNYYRCSTEGCNVKKRVERDRDDPRYVVTMYEGVHNHVSPGTVYYATHDAASGRFFVAGMHQPGH

SEQ ID NO: 651 - DNA, 625 bp, Glycine max
  G3723,family:WRKY
acatacctagctatcacctcaatggattactattttggaaaccttaatcctaacccttattaccatcactctgccgtagtgaacatggcatctccctcctccgagttcatgttatctgattatctcgtgttggaagatgctcttgttgttgatcatcatcaagagtcttggtcacaaagcactgaaactgaatcgtcggagaaagcaacctccagcgatgcaagtcatgggttcggtgatgcaacctccaacaccaacatgcatataaagtgccaaaatagtgggattaagggaaagaatgcagaagtgagtcaaaggataacgtttagaaccagatcgcaacttgaggttatggatgatggatataaatggaggaaatacgggaagaaaacagtgaagagcagtcccaacccacggaactactacaagtgttcaggtgaaggatgcgatgtgaagaaaagggtggaaagggatagggatgactccaactatgtgttaacaacgtacgacggtgtccacaatcatcagaccccgtctactgcctactacagccaaatgcccttgctgcattctaatcatgattgggccctccacccttctgcaaactcataatatcctccttaat

SEQ ID NO: 652 - protein, 196 aa, Glycine max
  G3723,WRKY domain coordinates 112-168
MDYYFGNLNPNPYYHHSAVVNMASPSSEFMLSDYLVLEDALVVDHHQESWSQSTETESSEKATSSDASHGFGDATSNTNMHIKCQNSGIKGKNAEVSQRITFRTRSQLEVMDDGYKWRKYGKKTVKSSPNPRNYYKCSGEGCDVKKRVERDRDDSNYVLTTYDGVHNHQTPSTAYYSQMPLLHSNHDWALHPSANS

SEQ ID NO: 653 - DNA, 662 bp, Glycine max
  G3724,family:WRKY
cgcaccatagtctttgttttcatttactaccatatttagttatcagcaatggacttctactttggaaactctcctccttatcccaataattatgctcataattctcttaatatggctctatcttcccctgagattgcactatccgattatctcatgctcgatgactatgttgatcatcaagattctcgatcatcacaaagcaccgagtcatctgaaaaagcaaccttcaatgatgccactcacggattcagtactggtgcaacctctaagaataataacataaactgcaaaaatgggattaatgaaaacaaaggtggagtgggtccaaggatcgcgtttagaaccaaatcagagcttgagatcatggatgatggatacaagtggaggaagtacggcaagaagtccgtgaagagcagtcccaatctaaggaactactacaaatgttcaagtggaggatgcagtgtgaagaaaagggtggaaagggatagagatgactacagctacgtgataacaacatatgaaggtgtgcacaatcatgagagcccatttaccacatactacagccccatctccttcgtacattctgatactactttcaaatgacaccaacttcaaacccttttgggcatttacacctccctagcttaattatgtgccaagaa

SEQ ID NO: 654 - protein, 184 aa, Glycine max
  G3724,WRKY domain coordinates 107-163
MDFYFGNSPPYPNNYAHNSLNMALSSPEIALSDYLMLDDYVDHQDSRSSQSTESSEKATFNDATHGFSTGATSKNNNINCKNGINENKGGVGPRIAFRTKSELEIMDDGYKWRKYGKKSVKSSPNLRNYYKCSSGGCSVKKRVERDRDDYSYVITTYEGVHNHESPFTTYYSPISFVHSDTTFK

SEQ ID NO: 655 - DNA, 831 bp, Oryza sativa (japonica cultivar-group)
  G3725,family:WRKY
gccaacccacatgcacgtgtaccgatgtacatggcggcggcggctgcgggagcaagcacacccttcaatttttgccgccacggctcgcacgccgagtacgacgccgtcttcagcggcagctggatggcgcgccgcccctccgcggcgccgcacggtggcggcgcctccggctccggctccggcagcggctacggcgccgcctcgtacgttgctcccaccttcggcgcggcgtttaggcagcagcatctcgacctcctcgactacctgtccgacgatcagggcgttccggcgccaccaccagcggctgtgcccagcgcgtcgtacgtgacgccggcgccggcgatggcccccgctgaaccggtcgtgccggatgctgttgccgccgccggcggctatccgaggagcgtggctgcggcggcggcggccgtggccggcgagggaagagatcggacgacgacggacaagatcgcattccggacgaggtcggacgatgagatactcgacgacgggtataagtggaggaagtacgggaaaaagtccgttaagaacagccctaatccgaggaactactaccggtgctcgacggaggggtgcaacgtgaagaagagggtggagagagacaagaacgacccgcggtacgtggtgacgatgtacgaggggatccacaaccacgtgtgccccggcactgtctactacgccgcgcaggacgccgcctccggccgctttttcgtcgccgggatcagtcacccagaccttaattaagctaggatatgctttgccggcccagctgtggcttagcttgatgtgcagctctagttattgtatgggctg

SEQ ID NO: 656 - protein, 243 aa, Oryza sativa (japonica cultivar-group)
  G3725,WRKY domain coordinates 158-214
MAAAAAGASTPFNFCRHGSHAEYDAVFSGSWMARRPSAAPHGGGASGSGSGSGYGAASYVAPTFGAAFRQQHLDLLDYLSDDQGVPAPPPAAVPSASYVTPAPAMAPAEPVVPDAVAAAGGYPRSVAAAAAAVAGEGRDRTTTDKIAFRTRSDDEILDDGYKWRKYGKKSVKNSPNPRNYYRCSTEGCNVKKRVERDKNDPRYVVTMYEGIHNHVCPGTVYYAAQDAASGRFFVAGISHPDLN

SEQ ID NO: 657 - DNA, 729 bp, Oryza sativa (japonica cultivar-group)
  G3726,family:WRKY
taaatacggagctttcgcgccggcctcgtactcggccatggcggcagtcggcgcgcacgcagcggtctaccaccacccggtctcgggcctctcggcgccggcgggcgacgccgcctactcgatgtcatcgtacttctcccacgggggaagctcgacctccagctccgcgtccagcttctccgccgccctcgccgccgcaacgacgccgccgcttcccgacccgtcggggtcgcagttcgacatctccgagttcttcttcgacgacgcgcctccggccgccgtgttcaatggcgcgcccaccgccgcgctgccggatggcgccgccgcaaacgcaacaaggagcgcggcggaggcggtgccggcgccggcgccggcggccgtggagaggccgcggacggagcggatcgcgttccggacgaagtcagagatcgagattcttgacgacggctacaagtggcgcaagtacggcaagaagtccgtcaagaacagccccaacccaaggaactactaccggtgctcgacggaagggtgcaacgtgaagaagagggtggagcgggacaaggacgacccgagctacgtggtgacgacgtacgaggggacgcacaaccacgtgagccccagcacggtgtactacgccagccaggacgccgcctccggccgcttcttcgtcgccggcacgcagccgccaggttctctcaattaaccgcgcgcgtacggttaatttgatcg

SEQ ID NO: 658 - protein, 221 aa, Oryza sativa (japonica cultivar-group)
  G3726,WRKY domain coordinates 135-191
MAAVGAHAAVYHHPVSGLSAPAGDAAYSMSSYFSHGGSSTSSSASSFSAALAAATTPPLPDPSGSQFDISEFFFDDAPPAAVFNGAPTAALPDGAAANATRSAAEAVPAPAPAAVERPRTERIAFRTKSEIEILDDGYKWRKYGKKSVKNSPNPRNYYRCSTEGCNVKKRVERDKDDPSYVVTTYEGTHNHVSPSTVYYASQDAASGRFFVAGTQPPGSLN

SEQ ID NO: 659 - DNA, 663 bp, Zea mays
  G3727,family:WRKY
caagcaaggcggctagcggtgcaagtagtgcgaagctagctaggtgctggtgcatgcaatggcggcttcgctgggtctgaaccctgaagctgtcttcacttcctacacctcctcgccgccgttcatgtcggactacgtggcggcgagcttcctgccgccggccgtcgtcgactccacggacttctctgcagagctcgatgatcttcaccaccacttggattactcatcgccggcgccgaccttggccggggctcggagcgatcgcagcgagaagcagatgatcaggtggtgtgagggtggtggtggcgagaagagactcggtaggatcgggttcagaacgagatcagaggtggagatcttggacgatggattcaaatggaggaagtatggcaagaaggctgtcaagagtagcccaaatccaaggaactactaccgctgctcgtcggagggctgcggcgtgaagaagcgggtggagagggaccgcgacgacccccgctacgtcatcaccacctacgacggcgtccacaaccacgcaagccccgcagccgccgccatcatccagtacggcggcggcggcggattctatagcccgccgcacagcggctcgccgtcggccgcctcctactcgggctccttcgtcctctgacttctccgggccttgac

SEQ ID NO: 660 - protein, 195 aa, Zea mays
  G3727,WRKY domain coordinates 102-158
MAASLGLNPEAVFTSYTSSPPFMSDYVAASFLPPAVVDSTDFSAELDDLHHHLDYSSPAPTLAGARSDRSEKQMIRWCEGGGGEKRLGRIGFRTRSEVEILDDGFKWRKYGKKAVKSSPNPRNYYRCSSEGCGVKKRVERDRDDPRYVITTYDGVHNHASPAAAAIIQYGGGGGFYSPPHSGSPSAASYSGSFVL

SEQ ID NO: 661 - DNA, 1663 bp, Zea mays
  G3728,family:WRKY
cattgggaccctcgaggccggccgggtctaattatatgataggtgtcaagtggaagtgcagtgatgtatgcagctgaggcatcctaacagaccccggccgacgggaaacaagaaagaaaaaatcgagaggacgccagggccgattctctgcgtgacttggggcgtcgtcgccgagttttctccggccgagggcggcgcgaccggacaaccagcgtgagcgcgaccggcgacatgactcgcggcaaccagcgtgaccgcgaccgtgagcgcgcggcggcgcggaagcccaacgccaagaactcccaggacgggctcaccccggagcagcgccgcgagagggacaagaaagctctggaggagaaggcggccaagaaggcgcagcaggcagcggccggcggcaccgggacctccacggacaacaacaagaacaaggcaggtggcaagaagtaggaggcagtggcgcgccgccacctctgtacgattaatcgatgccttgagcttgtaacttgttcgcatccttgtaggtgcgatgcttgttgggtcataaactctgatgatatcgagatttggtgatcagaaataatgcgtggttttcgcgcccaaaattgggaaccccgaggccggccggggttattcaggcaggcgcattgactgatacacatatatacaacaagcaaggcggctagctacagcggctagtgcgcgcgtggtgcaggcgcatctagctactacctggtgcttgttgtgcatacaatggcgacttcgctgggactgaaccctgaagatctcttcacttcgtactcgtcttcctactactcctcgccgccgttcatgtccgactacgcggcgagcttcacgccggcggccggggactccacggccttctcctcggagctcgacgaccttcaccacttcgactactcaccggcgccgatcgtcactgctgccggagccggggctgggggcggcgatcgcaacgagaagatgatgtggtgtgagggtggtggtgacgagagaagactcagaagcaacggaaggatcgggttcagaacgaggtcagaggtggagatcttggacgacggattcaagtggaggaagtacgggaagaaggccgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagccccggagccgctgctatcatcgtcccgtacggcagcggcggcggcaatagcggcttctacagcccgccgcacagcggctccccgtcggccacctcctactcgggctccctagccttctgacttttccgggccttgacccatagttacctttacactccagtcgtcggataagaagaatgttcagcggctggctaaacagtctcaactgctgcagctattcaaattagtgttggagatgcaatttatagagataaaatactctagaagctatcgctgtagccggattaaattctgacctacttgtatagttttacacttacacagtgcaagtaataatatttaagggaagcagagagcactctaggcggccgctcaaaaaaaaaaaaaaaaaaaaaaaaaaaaaaaaaaaaag

SEQ ID NO: 662 - protein, 205 aa, Zea mays
  G3728,WRKY domain coordinates 108-164
MATSLGLNPEDLFTSYSSSYYSSPPFMSDYAASFTPAAGDSTAFSSELDDLHHFDYSPAPIVTAAGAGAGGGDRNEKMMWCEGGGDERRLRSNGRIGFRTRSEVEILDDGFKWRKYGKKAVKNSPNPRNYYRCSSEGCGVKKRVERDRDDPRYVITTYDGVHNHASPGAAAIIVPYGSGGGNSGFYSPPHSGSPSATSYSGSLAF

SEQ ID NO: 663 - DNA, 1091 bp, Oryza sativa (japonica cultivar-group)
  G3729,family:WRKY
aaagcgctctgcgtgagctgagctgagctaggcgtcgcgcgcgatgtcgtcgctgtacccgtctctcctctcgctgagcgagagccccgccgagtaccggcaggtcggcggtggccgctacgcgggggaggacgtcgtcgacgacgacgacgacatggctgccgtcgccgacgctgtgtccagctacctctccttcgacatggacgacgtcgagtattacacgccggaggtgggcttccactcaaagcagcacaacccgccgccagttgctgcggcgccactggaagccggaggaggcagggagcaaagccggcgggaagccgccgtcaatcttggcaagatggacaggggaccggcgccggtgagcggcggcgcggcgactggcggcgtgccgaggagcaagaacggcagcaagatcgcgttcaagacgaggtcggaggtggacgtgctggacgacggctaccggtggaggaagtacggcaagaagatggtcaagaacagccccaacccaaggaactactaccggtgctcgagcgaggggtgccgcgtgaagaagcgggtggagcgcgcccgggacgacgcgcgcttcgtcgtcaccacctacgacggcgtccacaaccacccggcgccgctgcacctcaggccgcagctgccgccgcccggcggctactcgatcgccggggcaccggccgtggtggcgccgcacggccgcctcgggctggaggaggccgaggtgatcgctctcttcaggggcaccaccgccacctcgctgctgcttccttgaccggccagtccgacgcggcggcgccggcggcgacaactgactagctagtgtgagtcctgggccgtacaggaatggacaattagtttgtctccgatcgaggaccaaggcgacctgaatcaaaattacggcccatcgatatatagtaggtcgtttaattcatcgaaattagacgaatttcatgtacaattattgcattacagtattatttgaaacagtattgtatatatttgctatacaatttgatggatcgtatgtctttagcagttgtaagtatattaatctatagatctagtagttcagccatgat

SEQ ID NO: 664 - protein, 246 aa, Oryza sativa (japonica cultivar-group)
  G3729,WRKY domain coordinates 137-193
MSSLYPSLLSLSESPAEYRQVGGGRYAGEDVVDDDDDMAAVADAVSSYLSFDMDDVEYYTPEVGFHSKQHNPPPVAAAPLEAGGGREQSRREAAVNLGKMDRGPAPVSGGAATGGVPRSKNGSKIAFKTRSEVDVLDDGYRWRKYGKKMVKNSPNPRNYYRCSSEGCRVKKRVERARDDARFVVTTYDGVHNHPAPLHLRPQLPPPGGYSIAGAPAVVAPHGRLGLEEAEVIALFRGTTATSLLLP

SEQ ID NO: 665 - DNA, 731 bp, Oryza sativa (japonica cultivar-group)
  G3730,family:WRKY
aaacactcaatcagcagcagcagcagctagcttagctaacgcacagtgacgcgagcatggcggcttcgctgggactctgccacgagacgtcgtacgcctactcgtacccggcgtcgaacacctcctcctccttgtgcttccctcctctcatggcggaccacatcgtcgacggcggcggcggcggcggctgttcctttggtgaattcctggagctcggccattccgtgtactcgctgccgcttccgccgccgccgtcgcagccggtggtggtcgccggcgggaacaatgatcagtatggcgtgtcgtcgtcgtcgtcggcggcggcgacgacgagcaggatcgggttcaggacgaggtcggaggtggaggtgctggacgacgggttcaagtggcgaaagtacgggaagaaggcggtgaagagcagcccgaacccgcggaactactaccggtgctcggcggcggggtgcggcgtcaagaagcgggtggagcgcgacggcgacgacccgcgctacgtcgtcaccacctacgacggcgtccacaaccacgcgacccccggctgcgtcggcggcggcggccacctcccgtaccctacttccgctgcgccgccgtggagcgttccggcggcggcggcctcgccgcctcccgcgcacgcgcaggcgtggggggcgccgctgcacgccgccgcggcggcgcactcgtcggaatcgtcgttctgaacgctgaatttactt

SEQ ID NO: 666 - protein, 219 aa, Oryza sativa (japonica cultivar-group)
  G3730,WRKY domain coordinates 107-163
MAASLGLCHETSYAYSYPASNTSSSLCFPPLMADHIVDGGGGGGCSFGEFLELGHSVYSLPLPPPPSQPVVVAGGNNDQYGVSSSSSAAATTSRIGFRTRSEVEVLDDGFKWRKYGKKAVKSSPNPRNYYRCSAAGCGVKKRVERDGDDPRYVVTTYDGVHNHATPGCVGGGGHLPYPTSAAPPWSVPAAAASPPPAHAQAWGAPLHAAAAAHSSESSF

SEQ ID NO: 667 - DNA, 708 bp, Solanum lycopersicum
  G3731,family:WRKY
cgttccgttcaactatggaaaattttccctatagctcatcaaaccctaaccctaattttatcgacgcatcggagaattttgagctctccgattataattatctttttctcgatgatggatcgagtgacgattttttgtcacaaaatgaaattgttcaaagtgtttccgatactagtggttcatattcaaataatcctactccaacaagtcataacataaaatgtatgaaaggtataaagaaggtggatgcaaagtctaaggttgcatttagatttagatcagagttggaggtgttggatgatggatttaaatgtaggaaatatggcaaaaagatggtcaagaataatccaaatccaaggaattactacaaatgttcaagtgggggatgcaatgtgaagaaaagagtagaaagggacaataaagattcaagctatgtcattactacttatgaagggattcacaaccacgagagtcctcatgtgcttcactacacacaattccctcccaacaatattgcccttcacaatcttcacctttagaacctcttaaacgtgtcagtaaagtttagttatatatttgtattatggtaggttctaatggagcactttgattatatgataaagtgtttttattgaacattttcgacatatgttttaaaaaagttgtgcacgaattttcaagtgctaaatatatagataagttaatcgc

SEQ ID NO: 668 - protein, 174 aa, Solanum lycopersicum
  G3731,WRKY domain coordinates 95-151
MENFPYSSSNPNPNFIDASENFELSDYNYLFLDDGSSDDFLSQNEIVQSVSDTSGSYSNNPTPTSHNIKCMKGIKKVDAKSKVAFRFRSELEVLDDGFKCRKYGKKMVKNNPNPRNYYKCSSGGCNVKKRVERDNKDSSYVITTYEGIHNHESPHVLHYTQFPPNNIALHNLHL

SEQ ID NO: 669 - DNA, 743 bp, Solanum tuberosum
  G3732,family:WRKY
tttctatcttttctttcccttcaacaatggaaaattttccatatagctcatcaaaccctaaccctaatttcatcgatgcatcggagaattttgagctctcagattataattatctctttcttgatgatggatcaaatgacgattttttgtcacaaaatgaaattgttcaaagtgtttccgatagtagtggatcatattcaaataatcccactccaacaagtcataacataaaatgtatgaaaggtgtaaagaaggtggatgcaaagtctagggttgcatttagatttagatcagagttggaggtgttggatgatggatttaaatggaggaaatatggcaaaaagatggtcaagaatagttcaaatccaaggaattactacaaatgttcaagtggaggatgcaatgtgaagaaaagagtagaaagggacaatgaagattcaagctatgtcattactacttatgaagggattcacaaccatgagagtccttatgtgtttcactacacacaattccctcccaacaatattgcccttcacaatctttgcctttagaacctcttaaacgtgtcagtaaatttcagttatatatttgtataatggtaggttctaatagagcactttgatcatatgataaagtgtttctattaaacattttcgacttatgttttaaaaaaatgtgtgcacgtgttttcaagtgcccgatatatagataagttaatcacataaaatatgtctctttctttg

SEQ ID NO: 670 - protein, 174 aa, Solanum tuberosum
  G3732,WRKY domain coordinates 95-151
MENFPYSSSNPNPNFIDASENFELSDYNYLFLDDGSNDDFLSQNEIVQSVSDSSGSYSNNPTPTSHNIKCMKGVKKVDAKSRVAFRFRSELEVLDDGFKWRKYGKKMVKNSSNPRNYYKCSSGGCNVKKRVERDNEDSSYVITTYEGIHNHESPYVFHYTQFPPNNIALHNLCL

SEQ ID NO: 671 - DNA, 1387 bp, Hordeum vulgare
  G3733,family:WRKY
gaattcggcaccagggcgctcaccatcgccgaagcttctcagcgcgaagctcaccgggaagccgaccaaaatcccccgggaaaaaaagagagctctcacggccggcgccatctccaactagtacaaatctacccgccaaatccactccccaacccaatccatgcagcagcagcagcagcagcgcaccggcgatttagggggtcttatatattataaataggaagcgctctcgccggtgacaaactcggtcatggcggcagtcggagcggcaccagtgctctaccaacagcaggcgcaggcggtgggcgacgcctgcttcttctcctccatgtcctcctacttctccaacgaggcaatcagctcctcctgctccagcccagcctccagcttctccgccgcgctgggcgccacgccgcccgctgcgccggcgatcagccccgaccccgcgtcgcagttcgacatctccgagtacctctacggcgacggcccgttagccgcgccgctggcgcccgttggcgctgctgttgcaagctcggcgactgcggtgcctgcgaggagcgcggccgagtcggcggcggcggtggagaggccgcggacggagcgcatcgcgttccgcacgaggacggagatcgagatcctcgacgacggctacaagtggcgcaagtacggcaagaagtccgtcaagaacagcccaaacccaaggaactactaccggtgctcgacggaagggtgcagcgtgaagaagcgggtggagcgggaccgggacgacccggcgtacgtggtgaccacgtacgagggcacgcacagccacgccagccccagcaccgtctactacgccagccaggacgccgcctccggccgcttcttcgtcgccggcacgcacccgccgccaggctccctcaactgagtagactagccaccaacgacggagcacgtcgagatcagcacgtacggggcttccatcttgggcaagctagccagctcgggcctcggtgccgtagcagccacaagttcgtagttaaactagtgcactactggttcaggttcggtttcccgactgtagtgttgtgtactgcggtgtgcactgtcggctcgatcaccaggttttatccctcgagcataattagtggatcgaaagagcccggccggggaacgtaactcagtccactactagtgctgcctacttaaccgtgtaataaaaatacccatgtgccgtttccctcagcccataggcctccgagagttccatgtttaagcaccaacatgcatcaaagagcatctaaaaaaagcatcaaagagatccatgtagaaaaagtttgtcgtattacccgacagaaaaaagtttgtagcatttttttggtaaataattttggaaggttttacagtt

SEQ ID NO: 672 - protein, 218 aa, Hordeum vulgare
  G3733,WRKY domain coordinates 131-187
MAAVGAAPVLYQQQAQAVGDACFFSSMSSYFSNEAISSSCSSPASSFSAALGATPPAAPAISPDPASQFDISEYLYGDGPLAAPLAPVGAAVASSATAVPARSAAESAAAVERPRTERIAFRTRTEIEILDDGYKWRKYGKKSVKNSPNPRNYYRCSTEGCSVKKRVERDRDDPAYVVTTYEGTHSHASPSTVYYASQDAASGRFFVAGTHPPPGSLN

SEQ ID NO: 673 - DNA, 653 bp, Medicago truncatula
  misc_feature (605)..(605): n is a, c, g, or t
  misc_feature (610)..(610): n is a, c, g, or t
  misc_feature (615)..(615): n is a, c, g, or t
  misc_feature (625)..(625): n is a, c, g, or t
  misc_feature (647)..(647): n is a, c, g, or t
  misc_feature (652)..(652): n is a, c, g, or t
  G3735,family:AP2
ctaatccttcatactaaagaaaacatagacttataacaaaaatattattatttacttcgtatatttttgtgtttcaaattaatggagggagatcataaattagtttcaaattcaacaaatggaaatggaaatggaaatggaaattcagatcaaataaagtatagaggaattcgtagaagaccatggggaaaatttgcagcagaaattcgtgacccaacaaggaaagggacaagaatatggcttggaacatttgatactgctgaacaagctgcaagagcttatgatgctgctgcttttcattttcgtggtcatagagctattctcaatttccctaatgaatatcaagctcctaattcatcttcttcattacctatgcctcttactatgcctccaccaccttcttctaatccacctccttcttcttcttcttcttcctctttttcttcttacaccgttgatgatggttttgatgagcttgaattcttggataataagttgcttcaagaacttcttcaagatggaacacaatagttaactattgaagatcaagtggcatgaaatgtattggtggtcatttaattttctcttcattaatttattttggnttggntatgnatctcatttntatgaataaatgagaatggggnattana

SEQ ID NO: 674 - protein, 149 aa, Medicago truncatula
  G3735,AP2 domain coordinates 23-87
MEGDHKLVSNSTNGNGNGNGNSDQIKYRGIRRRPWGKFAAEIRDPTRKGTRIWLGTFDTAEQAARAYDAAAFHFRGHRAILNFPNEYQAPNSSSSLPMPLTMPPPPSSNPPPSSSSSSSFSSYTVDDGFDELEFLDNKLLQELLQDGTQ

SEQ ID NO: 675 - DNA, 859 bp, Triticum aestivum
  G3736,family:AP2
gcacgaggcttcattctccctcgttccatccaagctccaccatccatcactgatttgcacttacctagctactccgcaacccccacttccggcttcttcatttctcactactagtacgtagttgagattatggagggcggagaaggatccggtggcggcggcgagccgaccaagtaccgcggggtgcgccgcaggccgtggggcaagttcgccgcggagatccgggactcgagccggcacggcgtgcgcatgtggctcggcaccttcgacaccgccgaggaggccgcggccgcctacgaccgctccgcctactccatgcgcggccgcaacgccgtgctcaacttccccgaccgggcgcacgtctacgaggccgaggccaggcgccagggccagggctcttcgtcgtcggcgaggcagcagaatcagcagcagcagcaggggcagagcggggtgatcgagttcgagtacctggacgacgacgtgctgcagtccatgctccacgaccacgacaaatccaacaagtagatcgatggatcatccatccatccatccatggatcgatccataatacctactgtatcatcccggcccggccggcaacatcgacctgcgtgcatgcgcgggcgcggatgcaatctacactacctacctatgcattccggccatatattaggtacgtagattatatgtgtacgagagcctacgagctcgatgaagatcgtacgtggtgcattctgatgcatgaggattccatcgacacgaccctctaccatatatttgatgggtcgatcgagtaatttgcagccagtaatccaatcgatgatatggggttttcaaaaaaaaaaaaaaaaaaaaaaaa

SEQ ID NO: 676 - protein, 131 aa, Triticum aestivum
  G3736,AP2 domain coordinates 12-76
MEGGEGSGGGGEPTKYRGVRRRPWGKFAAEIRDSSRHGVRMWLGTFDTAEEAAAAYDRSAYSMRGRNAVLNFPDRAHVYEAEARRQGQGSSSSARQQNQQQQQGQSGVIEFEYLDDDVLQSMLHDHDKSNK

SEQ ID NO: 677 - DNA, 882 bp, Oryza sativa (japonica cultivar-group)
  G3737,family:AP2
acacatgcatcgatcattcatggatgccgaattgccgcgatccgggcattatttcgcgccaggagacccaagatcatcgtgtcgcccacgctataaatagctagctagcttgcctttatgttgcatatgccaactgctacatgcaggacgtctgaaactatcattagtgacctgcagcgcctgcagtatatatatacaagtagtagtgagcatggaggacgacaagaaggaggcggcgagcaagtaccgcggcgtacggaggcggccgtggggcaaattcgcggcggagatccgcgacccggagcgcggcggctcacgcgtctggcttggcacgttcgacaccgccgaggaggccgcgcgagcgtacgaccgcgccgcattcgccatgaagggcgctatggccgtgctcaacttcccaggcaggacgagcagcaccggctcttcgtcgtcatcgtcatccacgccgccagctccggtgacgacgagccgccactgcgccgacacgacggagaaggtggagcttgtgtaccttgacgacaaggtgctcgacgagctccttgcggaggactacagctaccgcaacaacaacaactactgatccggccgtcgatgaactgagacggatcgacatggggccggtcgtcggtacgctcgctgaaacgagacccggattgctatcaataagcaagcagaagaaaaccgtctcctatatatagcttcttctgttggcacaagcatatatgggcatgcatgacacatgctactgtgaattgacgggtgtgtgctgtgtgcagactactaaaccacgcttgcaagttgcacgtacgacgtggttgtcaagagcatgcagtccacgaagcagagaaaaacacctggtttatc

SEQ ID NO: 678 - protein, 128 aa, Oryza sativa (japonica cultivar-group)
  G3737,AP2 domain coordinates 8-72
MEDDKKEAASKYRGVRRRPWGKFAAEIRDPERGGSRVWLGTFDTAEEAARAYDRAAFAMKGAMAVLNFPGRTSSTGSSSSSSSTPPAPVTTSRHCADTTEKVELVYLDDKVLDELLAEDYSYRNNNNY

SEQ ID NO: 679 - DNA, 899 bp, Zea mays
  G3739,family:AP2
cgatataattcactcctctcaacgctcgctgcacacacacaccagtgaacctagccagccatttgccgcatcgatcatcagtcgctgtcacgcgcgccaaaccaaaccaaagcccaaacccagctgcaagtgctactgacagcagctagcaaacacacacccgtcgccatcgctatggacggcgactggtccaaggacggcggaggtggagagccgaccaaatatcgcggcgtgcggcggcggccctggggcaagtacgcggccgagatccgcgactcgagccgccacggcgtccgcatctggctgggcaccttcgacaccgccgaggaggccgccagggcgtacgaccggagcgcctactccatgcgcggcgccaacgccgtcctcaacttcccggaggacgcgcacgcctacgccgccgcctgccgcggctccggatcctcctcatcctcgtccaggcataggcagcagcagcagcagggctccggcagggacgtgatcgagctcgagtacctcgacgacgaggtgctgcaggagatgctcaggaaccacgagccgtcgtcgtctgcgaggaagaagatgtaatgcaagacgactggtacacgtggcgaatgcacgttgcacatcagaatgccatgtatgcgtggggggttacgttcaattgtatgcatgcagtgcagtgactaccggccggctctcctggatatgtcggccatctctctctatatattattaaaatgtcagctcccttctctaatttggcgggagttacatcagtggtactatgcagagttgcatacttgcatatatatgcacattattaattaataactcgatctctcgtggacggtggaacagtgataatcatctcattgtcaattaattttgatcaaagaaat

SEQ ID NO: 680 - protein, 136 aa, Zea mays
  G3739,AP2 domain coordinates 13-77
MDGDWSKDGGGGEPTKYRGVRRRPWGKYAAEIRDSSRHGVRIWLGTFDTAEEAARAYDRSAYSMRGANAVLNFPEDAHAYAAACRGSGSSSSSSRHRQQQQQGSGRDVIELEYLDDEVLQEMLRNHEPSSSARKKM

SEQ ID NO: 681 - DNA, 918 bp, Zea mays
  G3794,family:AP2
attacttgtgcacttgggtgcagtgcctgcagtataatcaagttagggtttaaaagaacctcgaccgcgatcgtatatagatccagattatcattagttattagaccactgtgatatcgatggacgacggcggcgagccaaccaagtaccgcggcgtgcggcgccggccgtcggggaagttcgccgccgagatccgcgactccagccggcagagcgtgcgcatgtggctgggcaccttcgacacggccgaggaggccgcaagggcgtacgaccgcgcggcctacgccatgcgcggccaaatcgccgtgctcaacttccccgccgaggcgcgcaactacgtgcgcggcgggtcgtcgtcgtcccgccagcagcagcagggaggaggaggaggaggaggaagtggcggcggcgccggtcagcaggtgatcgagctggagtgcctggacgatcaggtgctgcaggagatgctcaagggcggcgacgggaaaaaatagttgttagcgtatctgatcacaggtgcacgtgttgaaactgattatgaccaggcgatcgatcccatcttgtgcatgcggcctgccaaagttgctgggtcttctcatcgacctatatatatatgcttctcgatccatatatatatcataaatgcatgcagggtgcatgcatgtaccaagtttggaattataatgctcttggtgctgaattgaagtatactagtatatatagtgtgatccatgtattgaaaaggttgttttgcttaatcgcgtcatgattgcacacgtgcttgtttctgcttaaacaacccatatatatagccggctctggcctttgtcaagtctgcaatccttatacatcgttggtaattcatgcatgagttctatgtaactgcaatttagataaattgtagctaatataatagtc

SEQ ID NO: 682 - protein, 124 aa, Zea mays
  G3794,AP2 domain coordinates 6-70
MDDGGEPTKYRGVRRRPSGKFAAEIRDSSRQSVRMWLGTFDTAEEAARAYDRAAYAMRGQIAVLNFPAEARNYVRGGSSSSRQQQQGGGGGGGSGGGAGQQVIELECLDDQVLQEMLKGGDGKK

SEQ ID NO: 683 - DNA, 760 bp, Capsicum annuum
  G3795,family:WRKY
aaataatcccagtgcaaacatgcttgatgggagttttagatcattggactcacctgacagtgatgatttctcaaaccacctaattaactttgagctttctgatattctcgaaatagataattggcccattcaacaagatccgacactcataccccagtactcaaattatgcagcaaaccaagtggttaacaccagcagttaccaggaagaacctagcaacaacattggaagcagcagcagcaagaggaaagaagtaaaggacaaggttgctttcagaacgctatcacagattgaaatactagacgatggctataagtggagaaagtatggaaagaagatggtgaaaaatagtcccaacccgaggaattactataggtgctccgtagaaggttgtccagtgaagaagagagttgaacgagacaaagaggactctcggtatgtgataaccacctacgagggtgtccacaaccatcaaggtctatccccattctgattcctgtaacagagctcgagtttgaaagttactatgactcttgcacggtagctagctaaatcagggttctactgccagtaaattgaatcctgacagcttggcgagttcataaccaaacattgtggggtggtcagacggaggcatcgatctgtaacttaaaagtaatcgttagaacatttcgtgcccttcagttggcatgtagtcttatcctgcttcctacatgatttatatatcctacagcactatcaactaaaaaaaaaaaaaaaa

SEQ ID NO: 684 - protein, 157 aa, Capsicum annuum
  G3795,WRKY domain coordinates 95-151
MLDGSFRSLDSPDSDDFSNHLINFELSDILEIDNWPIQQDPTLIPQYSNYAANQVVNTSSYQEEPSNNIGSSSSKRKEVKDKVAFRTLSQIEILDDGYKWRKYGKKMVKNSPNPRNYYRCSVEGCPVKKRVERDKEDSRYVITTYEGVHNHQGLSPF

SEQ ID NO: 685 - DNA, 712 bp, Lactuca sativa
  G3797,family:WRKY
ggcataccaaaatgaattattatgatcatcaaatgtctaaagcctacagttacagatcagtagactcgcctgacatggactatgatgttccaaaccagcaaacttatgagtttgttgagagctttctcagctttgatgattggataactgaagataaagcatccactgttcctgagtatcaagatcatactcctgtttacccttctgccaccattgaagatggtggtctgtcgatcggaagtagcagcagcaacagccatcttcatgatggaagtagaagcagggccacaggatttgggcaggctcaaaatggcaaaaaagagaaagtcgccttcaaaacaaaatcccaagttgagatcctagatgacggttttaagtggaggaaatatggcaaaaagatggttaaaaacagtccaaacccaaggaattattatcgttgttcagcagcaggatgttcggtgaaaaagagagttgaaagggatgtagaggatgcacgatatgtaatcacaacctacgagggtattcacaaccaccaacgcccttctaactactgatagcttgtactacgatttgttaatgtatgctaaagaatagttgtttttctaagcttactccatcactagcttattgaaaagaaagttgtagttcggttacttattttcttcaaccgaccaaggttatgaatcgttttagaatataattgtttttaact

SEQ ID NO: 686 - protein, 180 aa, Lactuca sativa
  G3797,WRKY domain coordinates 118-174
MNYYDHQMSKAYSYRSVDSPDMDYDVPNQQTYEFVESFLSFDDWITEDKASTVPEYQDHTPVYPSATIEDGGLSIGSSSSNSHLHDGSRSRATGFGQAQNGKKEKVAFKTKSQVEILDDGFKWRKYGKKMVKNSPNPRNYYRCSAAGCSVKKRVERDVEDARYVITTYEGIHNHQRPSNY

SEQ ID NO: 687 - DNA, 866 bp, Sorghum bicolor
  G3802,family:WRKY
gcacgaggctgatacacaagcaaggcggctagctacagctagctggtgcgtgcagtgcatgcaaatggcggcttccctgggactgaaccctgaagctctcttcgcttcatactcgtctgcctactcctcctcctcgccgttcgtgtccgactacgcggcgagcttcccggcggccgtcgactccgccacggccttctccgcggagctcgatgaccttcaccacttcgactactcaccggcgccgatcttcacagctgtcggagccggggctggcggcgatcgcaacgagaagatgatgatgtggtgtgagggcggtggtgatgaaaagagactcagaagcagtggaaggatcgggttcagaacgagatcagaggtggagatcttggacgatggattcaaatggaggaagtatgggaagaaggctgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagtcccggagccgccgccatcatccagtacggcggcggcggcggcaatagcggcttctacagcccgccgcacagtggctcgccgtcggctgcctcatactcgggctccttcgtcttctgacttttccgggccttgaccttgacccagagtgatttacctttaccccagtcgtaggatgagaagagtgttcagagagatcagttcagcggccggctaaattccgacctgcttgtacatttttacacacttgtgcagtacaagtaataatatttaagctagaagcagtgtactctactttatttacctc

SEQ ID NO: 688 - protein, 206 aa, Sorghum bicolor
  G3802,WRKY domain coordinates 110-166
MQMAASLGLNPEALFASYSSAYSSSSPFVSDYAASFPAAVDSATAFSAELDDLHHFDYSPAPIFTAVGAGAGGDRNEKMMMWCEGGGDEKRLRSSGRIGFRTRSEVEILDDGFKWRKYGKKAVKNSPNPRNYYRCSSEGCGVKKRVERDRDDPRYVITTYDGVHNHASPGAAAIIQYGGGGGNSGFYSPPHSGSPSAASYSGSFVF

SEQ ID NO: 689 - DNA, 628 bp, Glycine max
  G3803,family:WRKY
acatatctagctattacctcaatggattactattttggaaaccctaatcctaaaccttatgataaccgtcactctgccgtagtgaacacggaatctccttcctccgagttcatgctatctgattatctcgtgttggaagatgctgtcgataatcaagagtcttggtcacaaagcactgaaactgaatcatcggagaaaggaaactccagcgatgtcagtcatgggtttggtgatgcaaccttcagcaacaccaacatgcatataaagtgcgaaaataatgggataaagcgaaagaaggaagaagtgagtcaaatgatcacgtttagaaccagatcgcagcttgaggttatggatgatggatataaatggaggaaatacggaaagaagacagtgaagaacaatcccaacccaaggaactactacaagtgttcaggtgaaggatgcaatgtgaagaaaagggtggaaagagacagggatgactcgaactatgttttaacaacgtacgacggtgtccacaatcatgagagcccgtcgactgcctactacagccaaattcccttggtgcattctaaccatgattggccccagctgcacccttctgcaaactcatgatcctcttcaatacagt

SEQ ID NO: 690 - protein, 196 aa, Glycine max
  G3803,WRKY domain coordinates 111-167
MDYYFGNPNPKPYDNRHSAVVNTESPSSEFMLSDYLVLEDAVDNQESWSQSTETESSEKGNSSDVSHGFGDATFSNTNMHIKCENNGIKRKKEEVSQMITFRTRSQLEVMDDGYKWRKYGKKTVKNNPNPRNYYKCSGEGCNVKKRVERDRDDSNYVLTTYDGVHNHESPSTAYYSQIPLVHSNHDWPQLHPSANS

SEQ ID NO: 691 - DNA, 823 bp, Zea mays
  misc_feature (9)..(9): n is a, c, g, or t
  misc_feature (802)..(802): n is a, c, g, or t
  G3804,family:WRKY
ccggccggngatattcaggcaggcgcattgactggtacgcatacaactacaagcaaggcggctagctacagcggctagtgcgcgcgtggtgcaggcgcagctagctagtgcgtgcaatggcgacttcgctgggactgaaccctgaagatctcttcacttcgtactcgtcttcctactactcctcgccgccgttcatgtccgactacgcggcgagcttcacgccggcgggcggggactccacggccttctcctcggagctcgacaaccttcaccacttcgactactcaccggcgccgatcgtcactgctgccggagccggggctgggggcggcgatcgcaacgagaagatgatgtggtgtcagggtggtggtgacgagagaagactcagaagcaacggaaggatcgggttcagaacgaggtcacaggtggagatcttggacgacggattcaagtggaggaagtacgggaagaaggccgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagccccgcagccgctgctatcatcgtcccgtacggcaacggcggcggcaatagcggcttctacagcccgccgcacagcggctccccgtcggccacctcctactcgggctccctagtcttctgacttttccgggccttgacccatagttacctttacaccccagtcgtcggatgagaagaatcttcagcggncggctaaacagtctcaactgc

SEQ ID NO: 692 - protein, 205 aa, Zea mays
  G3804,WRKY domain coordinates 108-164
MATSLGLNPEDLFTSYSSSYYSSPPFMSDYAASFTPAGGDSTAFSSELDNLHHFDYSPAPIVTAAGAGAGGGDRNEKMMWCQGGGDERRLRSNGRIGFRTRSQVEILDDGFKWRKYGKKAVKNSPNPRNYYRCSSEGCGVKKRVERDRDDPRYVITTYDGVHNHASPAAAAIIVPYGNGGGNSGFYSPPHSGSPSATSYSGSLVF

SEQ ID NO: 693 - DNA, 1247 bp, Oryza sativa (japonica cultivar-group)
  G3809,family:NAC
tcttcttcttccatcgattgcattcaaatattgatcaatcacgagattaattgattgatatccatatatatatgatgaccatcgacctgcagcttccggcggcggcgtgcggtgatcatcacacagcagcaggggcagggctgccgccgggattccggttccacccgacggacgaggagctcctcctccactacctcggcaagcgcgccgcggcggcgccctgcccggcaccggtgatcgccgaggtggacatttacaagtacaacccgtgggagctgccggccatggcggtgttcggggagtcggatggcgagtggtacttcttcagcccacgcgaccgcaagtaccccaacggcgtccgtcccaaccgcgccgccggctccggctactggaaggccaccggaaccgacaagcccatctccatctcggagacgcagcagacggtactgctgggcgtgaagaaggccctcgtcttctaccgcggtcgcccgcccaagggcaccaagaccagctggatcatgcacgagtaccgcctcgccaacgccgccgcctcctcctcctcctcctatactagtaacatgaagcagctggcctcatcatcatcgtccagctccagcagcgccagcatgagggtacgtacgtgctacggtgctagtgctaactacatatatatatatcctcttccatatactccatccactgatcgatatatatatatgcgcaattatattcatgcgcgtacgcagctggacgagtgggtgctgtgcagaatctacaagaagaaggaggccaaccagcagctgcagcactacatcgacatgatgatggacgacgacaacgatgacgaacacaacctgcaggtgcagcagcagcagcagcagcaggctcaaagccaccggatgccaaggcctccatccatctcagactaccttctcgactactccgacgacctcccgccgtccaccgatcagacgccatctctgcaccttggattcacggcggtgaacgagggcaacaacaagaggcacaaaactatggaggaatattattctatttccatttccactgcagatatgctgcatgcgtcgtcgtccacgtccaacaacaagtcgacgcaaatcaacttctcctccatatttgagccgcagacgcctgcagctgcgggccatcagctgatgtcttctcacaacgacgacacatccatatgaccaacctcccccatcaactatctaaagctaggttagcag

SEQ ID NO: 694 - protein, 378 aa, Oryza sativa (japonica cultivar-group)
  G3809,NAC domain coordinates 25-236
MMTIDLQLPAAACGDHHTAAGAGLPPGFRFHPTDEELLLHYLGKRAAAAPCPAPVIAEVDIYKYNPWELPAMAVFGESDGEWYFFSPRDRKYPNGVRPNRAAGSGYWKATGTDKPISISETQQTVLLGVKKALVFYRGRPPKGTKTSWIMHEYRLANAAASSSSSYTSNMKQLASSSSSSSSSASMRVRTCYGASANYIYIYPLPYTPSTDRYIYMRNYIHARTQLDEWVLCRIYKKKEANQQLQHYIDMMMDDDNDDEHNLQVQQQQQQQAQSHRMPRPPSISDYLLDYSDDLPPSTDQTPSLHLGFTAVNEGNNKRHKTMEEYYSISISTADMLHASSSTSNNKSTQINFSSIFEPQTPAAAGHQLMSSHNDDTSI

SEQ ID NO: 695 - DNA, 819 bp, Solanum lycopersicum
  G3849,family:AP2
ttcacagagacataaacacaaacaccttcactgcaattctcaaaatactgcaaaatgacgaaacaagatgaaggattaacattagaactcatacgacaacatctcctcgaagatttcacaactacagaatcattcatcgacagtctcaattcttgtttttccgatcacatctcctcctccgatgacatctcccctgttttcacttcagtaaaaacagagccatctacatccaattccctctcagattcacccaattcctcatacccaaatgaacccaactccccaatttcccgttacttcaatctccgctccgatttccctgaattcaaaatcgattcagataccatcctcagtccagttttcgacagctccgccggttctaatgaagacaataataagaagaagaattacagaggggtaaggagaaggccatgggggaaatttgcggcggagataagagatccaagtcgaaaaggatcgaggatttggttgggtacttttgatactgatattgatgctgctagagcttatgattgtgcagcgtttaagatgagaggaagaaaagctattctgaattttccgttggatgccggaaaatctggtgctccggcgaatgttggccggaaaaggagaagagagaacaagatggagttggtgtagatgactaatttgtaatttgtgttaaagcatgttaattacttaatcctcttctacatcataattaatagagctttcccccccacatatttattaaagaatatcattccataatgtaaactttgattaacaaatttgaattcctaaaaaaaaaaaaaaaaa

SEQ ID NO: 696 - protein, 201 aa, Solanum lycopersicum
  G3849,AP2 domain coordinates 115-179
MTKQDEGLTLELIRQHLLEDFTTTESFIDSLNSCFSDHISSSDDISPVFTSVKTEPSTSNSLSDSPNSSYPNEPNSPISRYFNLRSDFPEFKIDSDTILSPVFDSSAGSNEDNNKKKNYRGVRRRPWGKFAAEIRDPSRKGSRIWLGTFDTDIDAARAYDCAAFKMRGRKAILNFPLDAGKSGAPANVGRKRRRENKMELV

SEQ ID NO: 697 - DNA, 1364 bp, Flaveria trinervia
  G3859,family:ZF-HB
aagaaaaccctttgaaaatttcaagattctttgtttggaacatcaaattatggacctaaaacaccccaccacccacaccccacctcattcccactcaacaaacctcttaacctccaccaacggcaaacaccaccaccaccaccaccacccgccgccgcacacggcggtggcatacaaacaatgcctcaagaaccacgccgtcggcatcggttgccacgccgtagacggctgcggtgagttcatgccggctccgacgtacaacccatcacagccatcatccttcaaatgcgccgcctgtggctgccaccgcaacttccaccgccgtgaacccaccatcgccaccaggacccacttcatagacttccaccatcaccacccctcaacctccgcctccttatctccgccgtcgccagcgcctgaactgactaacttcgccgtcggaccgcatctgctgctgtcactcggcacggcggcggagcaaaaccacatggtggcgacgccggagacgccggcggcgatcaagattagtgggaggaaacggtttcggactaaattcagtcaagatcaaaaggaaaagatgttaacttttgcagagaaagtggggtggaagttgcagaggtgtgatgataagatggttgcagatttttgcagtgagattggaatcagaagaagagttttgaaagtttggatgcataataataagaacacttcagccaaaaaagaacaagaaaccaccgccaccgccaccgtcgtcaccaccgccatcaccgtcgccaccggcgtcgactccgccggagtacgtagtgatgatcaagaaaacgggtcgtctttttcatcttaactctgtaaaatctccaaattaaccctttttatggtaaatcgagcaaaccccactaattattaatcatctctctccaaattttcagttattttgaggtgaaatcggttgttaatttatgttcttcctgtaaatatggagcctttaaacaatggttgcatttggtcagagaattaaagaccagatgacccaaattttgaaaataaattcttcaattttagctcatcgggtagatgaatttgatgaagtttgactgattcaaagttgagatggtcaaaataagcaattatgtgttctaaagcattaatggaggttttggtactatttgcagagaagtaatgaatacaacaaacttgcttgtggttgttggcatttagattttggagtagcttttgagattaaccctaatctttgttcttcatatactttaatcattgtttattgtttaatatttaattaagtattctatttgtagaaagttgtttaggttatggcttatcgtttatcttaagtcttgcgattaccc

SEQ ID NO: 698 - protein, 263 aa, Flaveria trinervia
  G3859,ZF-HB domain coordinates 40-95,162-225
MDLKHPTTHTPPHSHSTNLLTSTNGKHHHHHHHPPPHTAVAYKQCLKNHAVGIGCHAVDGCGEFMPAPTYNPSQPSSFKCAACGCHRNFHRREPTIATRTHFIDFHHHHPSTSASLSPPSPAPELTNFAVGPHLLLSLGTAAEQNHMVATPETPAAIKISGRKRFRTKFSQDQKEKMLTFAEKVGWKLQRCDDKMVADFCSEIGIRRRVLKVWMHNNKNTSAKKEQETTATATVVTTAITVATGVDSAGVRSDDQENGSSFSS

SEQ ID NO: 699 - DNA, 1320 bp, Flaveria bidentis
  G3860,family:ZF-HB
ctctaacccctttcttccttccatttccatatatggaccactaaccatttccccttaattattattcatggacataccatcaccaccaccaacaaccaccaccaccaccatcaccaccgccaccgccaccagccccgtcaaagatcttgacccagatgcccggatccaacccaatcaacacctcccaccgccgttcaccaacggcgtcctcaagcggctgaagccccgccaccaccagcagcagcagcagcagcagccggtggtggtgagttaccgagagtgtttaaagaaccacgccgcggccatgggcggacatgcggtggatggatgcggtgagtttatgccgtcgccgtcgtcaagtccgaccgacccgacgtcgttaaaatgtgcagcctgcggttgccaccgtaacttccaccgccgtgaccccgacggaccgtttccggccaacccaccggtgcaacacgtgatagaatacaaacctcaccaccgccaccaccctccaccaccgccaccgctaccaattcccctcgccggagttagagaaaacagcgtcagtccggcggattccccatctccaccgccgatctcctcctcctactacccatcagccccacacatgctcttagctctcagctccggcctaccggcaccaccgtcggaaaacgcccaattctccccaattccgatctccggcggcgtaatcgggtcaaactccgccggaaaaaaacgattccgaacgaaattcactcaagatcagaaggagaaaatgcacgagttagcagaacgagttgggtggaagatgcagaagaaagatgaagacttgattatcggattctgcaacgaaatcggagttgataaaggggttttcaaggtgtggatgcataacaacaagatgacgtttggaggtaagaaagattccgacaaccacctagccggaaatgggtcctccggtggtggtcttgatttcttcaacagaaacaaccaccagcaacagcagcagcaacaaccgcagaacaacgacagcgttacgagtggtggtggtgggaatgctatcggaactaatggttcatcatcgtcgtcttaaactcttgattaatcttgattattattatggataataagcctttatttaaatagagatagcaagagagaagaagaatatgaggctgttgtttgttttttcgttttagttaattatatattagaagctttttgttgattaaataattagttaatctttgtttaatccaaatgtggaaagatgtagttgtagtactgctagattttcatgcaataatactatgtttagaaactctc

SEQ ID NO: 700 - protein, 339 aa, Flaveria bidentis
  G3860,ZF-HB domain coordinates 67-122,220-283
MDIPSPPPTTTTTTITTATATSPVKDLDPDARIQPNQHLPPPFTNGVLKRLKPRHHQQQQQQQPVVVSYRECLKNHAAAMGGHAVDGCGEFMPSPSSSPTDPTSLKCAACGCHRNFHRRDPDGPFPANPPVQHVIEYKPHHRHHPPPPPPLPIPLAGVRENSVSPADSPSPPPISSSYYPSAPHMLLALSSGLPAPPSENAQFSPIPISGGVIGSNSAGKKRFRTKFTQDQKEKMHELAERVGWKMQKKDEDLIIGFCNEIGVDKGVFKVWMHNNKMTFGGKKDSDNHLAGNGSSGGGLDFFNRNNHQQQQQQQPQNNDSVTSGGGGNAIGTNGSSSSS

SEQ ID NO: 701 - DNA, 967 bp, Flaveria bidentis
  G3861,family:ZF-HB
gtttatgccgtcgccggcggcaactccggccgaccccacgtcgatcaaatgcgctgcctgcggctgccaccgtaacttccaccgccgtgaacccgacgcatcgtttccgatcaacccatcgccaccggtgcagcacgttatagactaccaaccccaccaccgccaccacccaccgccaccacaaccaccaccaccaccgcggccgatctccgtcgccggagtattggaaaccagtgtaagtccgccggattccccatctccaccgccaatctcctcctcttacatgctgttagccctcagctctggcttatcagccccaccgccggagatcacccacaacccccaaatctccaccggaatcggagcaattggagcaaattccaccggaaaaaagcgatttcggacgaaattcactcaagatcagaagcaaaagatgcacgaattggcggaacgtgtgggatggaagatgcagaagaaagatgaagatctgattatcaatttctgcaacgaaattggggtcgataaaggggttttcaaggtgtggatgcataataacaagatgacgtccgccggaaaaaaagactccgcccaccagctcgttgacagtggatcctccggcgccggcggtggcggcggtggtggtgatttcttgatgagtagaaactaccaccacctacagcagcagcagaataatgatagtggtagcagcggtggtggcggtggtggtggtgatggtggtggtgatgttatcggaactaatggttcatcgtcatcttcttaattaatcatgattatggataataactaataagcgcttgtttaagtagatatagcaagagagaagaacaagggtatgaggctgttgtttttttttatttattaattttggttacttatgttagaatctttttttgttgattatttaattagttgatccttgtttaatccaaataaggaaagttctagt

SEQ ID NO: 702 - protein, 258 aa, Flaveria bidentis
  G3861,ZF-HB domain coordinates 1-31,129-192
MPSPAATPADPTSIKCAACGCHRNFHRREPDASFPINPSPPVQHVIDYQPHHRHHPPPPQPPPPPRPISVAGVLETSVSPPDSPSPPPISSSYMLLALSSGLSAPPPEITHNPQISTGIGAIGANSTGKKRFRTKFTQDQKQKMHELAERVGWKMQKKDEDLIINFCNEIGVDKGVFKVWMHNNKMTSAGKKDSAHQLVDSGSSGAGGGGGGGDFLMSRNYHHLQQQQNNDSGSSGGGGGGGDGGGDVIGTNGSSSSS

SEQ ID NO: 703 - DNA, 1205 bp, Zea mays
  G3866,family:CAAT
cggtccggaattcccgggtcgacccacgcgtccgcgcaccctcccgggccgccttctcttctccagcgtccgatctcccactcccctccctcaccgcagctctcccacctccgccctccccccgcacgcgctcgccacctcgccctcccctccacgttgctcgcacccgcgcttatataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaatggaggtatggaccttttctgcgacagctgctcttacctgaggcgattttttttgtcttagttatttactaagacaccttgcggtgaccattaaagagtaaccaatcgccctcaataggtccgtttttatctgccagaactgatgaggtcgctcactaggagtaagtcgcttccctgggaacggttgtcggctagcaccgctcttgtatgtatattaagagtaacttaatgattggtcttttggctgcgatttgattacatgtatttgtatcgggaggcataaatattgtgtaatttgtgttaaagactggtgtaattgaactatgggaagagctgctttggttgtaaccatattttgatgcccgtatattaggcaaaaatagaaggctgtgggcgtgcacaacaaaaaaaaaaaaaaaaaaaaaaaaagggcggccgctctagaggatcca

SEQ ID NO: 704 - protein, 185 aa, Zea mays
  G3866,CAAT domain coordinates 30-126
MAEAPASPGGGGGSHESGSPRGGGGGGSVREQDRFLPIANISRIMKKAIPANGKTIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGMGQQGAYNQGMGYMQPQYHNGDISN

SEQ ID NO: 705 - DNA, 787 bp, Physcomitrella patens
  G3868,family:CAAT
atcccgggcagcgagcacacagctagcaactctttcggagaatactccaggcgaaattggtcggatggccgatagctacggtcacaacgcaggttcaccagagagcagcccgcattctgataacgagtccgggggtcattaccgagaccaggatgcttctgtacgggaacaggatcggttcctgcccatcgcgaacgtgagccgaatcatgaagaaggcgttgccgtctaatgcaaaaatttcgaaggacgcgaaagagactgtgcaggagtgtgtgtccgagttcatcagcttcatcactggtgaggcgtcagataagtgccagagggagaagagaaagacgatcaacggtgacgacttgctgtgggccatgagtacacttggtttcgaagattacgtggagcctctgaaggtttacctacacaaataccgggagctagagggagagaaggcttccacggccaagggtggtgaccagcaaggagggaaagaagggagtcaaggtgttatggggtccatgggtatgtcgggcggaatgaacggtatgaacggtacgatgaacgggaatatgcatggacatggaatcccggtgtcgatgcagatgctgcagcagtcgtacggacaggaggcacctccagggatgatgtattcccctcatcagatgatgccggaataccagatgccaatgcagtctggtggaaaccagcctcgtggagtgtaggaggttccacggcgaggagaatttgaaattggggagattgtcaagggcgtgagggagtgagctcgc

SEQ ID NO: 706 - protein, 218 aa, Physcomitrella patens
  G3868,CAAT domain coordinates 35-130
MADSYGHNAGSPESSPHSDNESGGHYRDQDASVREQDRFLPIANVSRIMKKALPSNAKISKDAKETVQECVSEFISFITGEASDKCQREKRKTINGDDLLWAMSTLGFEDYVEPLKVYLHKYRELEGEKASTAKGGDQQGGKEGSQGVMGSMGMSGGMNGMNGTMNGNMHGHGIPVSMQMLQQSYGQEAPPGMMYSPHQMMPEYQMPMQSGGNQPRGV

SEQ ID NO: 707 - DNA, 1347 bp, Physcomitrella patens
  G3870,family:CAAT
ggcaccagcgaatccgtctccgcctccgccttctgcacgcgtggttgtggtcgacctctcgccggagcaacaggaaactaatcccttttccagcactaaacgattgaagcaattttttttttcttgtgaactgctcactctctctctgttatgaggggattcgaagcttgaaagttatgagctgaaggttgaggacacgtaagagcgaaggacgatcatactacaattaacccttgcggggaaaagcccaggcaaaataggacggatggccgacagttacggccacaacgcaggttcacccgagagcagcccgcattctgataacgagtccggcggccattaccgtgatcaggacgcttctgtacgggagcaagaccggtttttgcccatcgcaaatgtgagccgaatcatgaagaaagcattgccatctaatgcgaagatatcgaaagacgccaaagagactgtgcaggagtgcgtatccgagttcatcagtttcattactggtgaggcgtccgacaagtgtcagagggaaaagaggaagacgatcaacggggatgacttgctgtgggccatgagtactcttggttttgaagattatgtggaacctctgaaggtgtacctacacaagtatcgtgaactggagggggagaaggcctctatggccaagggtggtgatcagcagggaggaaaagagagcaaccaaggaggtatggggtcgatgggcatggcaggcggaatcaacggcatgaacggaacgatgaacgggaacatgcatgggcatggaattcccgtatcgatgcagatgatgcaacagccgtacgcgcagcaggcacctccggggatgatatattctcctcatcaaatgatgccgcaataccagatgccgatgcagtctggtggaaaccaaccccgcggagtgtaagagttttcactggcaggaggctttggaagtggggatattgtcgacagcgtgatggggtgttttggagcatgggcagggcattatggtgctgttgaaacagtgatgggtgggtcatgtgaagtgttggcgactgttgaatgatgaaaacatagaagtgatgtcgttgaagctcggggagtttcaagtgaaaggaggagcactttttgtttggaaaggagcgtaccgggtctggcagtgtacattctgaatgatagttatctgtgctgatttttcttggccttggcaatacgagggggttgaatattttgctttgaattcgttgacatttcaaccttttctatgtgaaaaggctctgtaggatgcaagataaggaaagacatgcagattgataaaaaaaaaaaaaaaaaaaaaaaaaaaaaaaaaaa

SEQ ID NO: 708 - protein, 218 aa, Physcomitrella patens
  G3870,CAAT domain coordinates 34-128
MADSYGHNAGSPESSPHSDNESGGHYRDQDASVREQDRFLPIANVSRIMKKALPSNAKISKDAKETVQECVSEFISFITGEASDKCQREKRKTINGDDLLWAMSTLGFEDYVEPLKVYLHKYRELEGEKASMAKGGDQQGGKESNQGGMGSMGMAGGINGMNGTMNGNMHGHGIPVSMQMMQQPYAQQAPPGMIYSPHQMMPQYQMPMQSGGNQPRGV

SEQ ID NO: 709 - DNA, 489 bp, Glycine max
  G3873,family:CAAT
atgtccgatgctccggcgagtccatgcggcggcggcggcggaggcagccacgagagcggcgagcacagtccccgctccaatttccgcgagcaggaccgcttcctccccatcgccaacatcagccgcatcatgaagaaagcgcttcctcccaacgggaaaatcgccaaggacgccaaggaaaccgtgcaggaatgcgtctccgagttcatcagcttcgtcaccagcgaagcgagcgataagtgtcagagagagaagaggaagaccatcaacggcgacgatttgctttgggctatgaccactttaggtttcgaggagtatattgatccgctcaaggtttacctcgccgcttacagagagattgagggtgattcaaagggttcggccaagggtggagatgcatctgctaagagagatgtttatcagagtcctaatggccaggttgctcatcaaggttctttctcacaaggtgttaattatacgaattcttag

SEQ ID NO: 710 - protein, 162 aa, Glycine max
  G3873,CAAT domain coordinates 29-118
MSDAPASPCGGGGGGSHESGEHSPRSNFREQDRFLPIANISRIMKKALPPNGKIAKDAKETVQECVSEFISFVTSEASDKCQREKRKTINGDDLLWAMTTLGFEEYIDPLKVYLAAYREIEGDSKGSAKGGDASAKRDVYQSPNGQVAHQGSFSQGVNYTNS

SEQ ID NO: 711 - DNA, 1109 bp, Glycine max
  G3874,family:CAAT
attcggctcgagataatccagagagaggagagagaagtaaaaaggtggaggaagaagcgaaaagcgagtgagggcagtgttgcttaataaaagaaaacgaacggtggtgataggcttcagtctagatctcaatcgtctccaccttgctttcttctccagcgtccgattctctcaccgatctcgcgccaaatacaaattcgtgtcaacccaacccagggttccggcgagcatggccgacggtccggctagcccaggcggcggcagccacgagagcggcgaccacagccctcgctctaacgtgcgcgagcaggacaggtacctccctatcgctaacataagccgcatcatgaagaaggcacttcctgccaacggtaaaatcgcaaaggacgccaaagagaccgttcaggaatgcgtctccgagttcatcagcttcatcaccagcgaggcctctgataagtgtcagagagaaaagagaaagactattaacggcgatgatttgctctgggcgatggccactctcggtttcgaggattatatggatcctcttaaaatttacctcactagataccgagagatggagggtgatacgaagggctctgccaagggtggagactcatctgctaagagagatgttcagccaagtcctaatgctcagcttgctcatcaaggttctttctcacaaaatgttacttacccgaattctcagggtcgacatatgatggttccaatgcaaggcccggagtaggtatcaagtttattattgaccctcttgttgtaacgtatgttttctacgccagttaccaagtgctcacggcatattgaatgtctttttatgttatgtgaatactgacaggagatgttggttcttgtgtccgtttttttttttaaattaaggtttgtatattatctttggattcgaattattatttgaaagttattattatattgtaaatcctagagccctgttgtctgaatccatcaggcggcttggtaaagaccgagattttaggactgattgtaagcataaatccgaatattcttttcctaatttctttgcacaataatgtatgaagaaggctcgagcttcttttataaaaaaaaaaaaaaag

SEQ ID NO: 712 - protein, 171 aa, Glycine max
  G3874,CAAT domain coordinates 25-114
MADGPASPGGGSHESGDHSPRSNVREQDRYLPIANISRIMKKALPANGKIAKDAKETVQECVSEFISFITSEASDKCQREKRKTINGDDLLWAMATLGFEDYMDPLKIYLTRYREMEGDTKGSAKGGDSSAKRDVQPSPNAQLAHQGSFSQNVTYPNSQGRHMMVPMQGPE

SEQ ID NO: 713 - DNA, 818 bp, Glycine max
  G3875,family:CAAT
cttaacatttccctaaacataactcacacacccctcttctctagggtttcaatttcaccatgtttccctttctcaaattagggttccggcgagcatggccgacggtccggcgagtccaggcggcggtagccacgagagcggcgagcacagccctcgctctaacgtgcgcgagcaggacaggtacctccccatcgctaacataagccgcatcatgaagaaggcactacctgcgaacggtaaaatcgccaaggacgccaaagagaccgttcaggaatgcgtatccgagttcatcagtttcatcaccagcgaggcctctgataagtgtcagagggaaaagagaaagactattaacggtgatgatttgctctgggccatggccactcttggttttgaggattatatcgatcctcttaaaatttacctcactagatacagagagatggagggtgatacgaagggttcagccaagggcggagactcatcttctaagaaagatgttcagccaagtcctaatgctcagcttgctcatcaaggttctttctcacaaggtgttagttacacaatttctcagggtcaacatatgatggttccaatgcaaggcccggagtaggtatcaagtttattaaccctcctgttgtaacgtatgttttccacgccagttaccaagtgctcacggcatattgaatgtctttttatgttatgtgaatactgacataggagatggttcttgtgtcctttttttttaaaaaaaaaagtaaggtttgtatattatctttggagtcgaattattatttgaaagttattatattgtaaatcct

SEQ ID NO: 714 - protein, 171 aa, Glycine max
  G3875,CAAT domain coordinates 25-114
MADGPASPGGGSHESGEHSPRSNVREQDRYLPIANISRIMKKALPANGKIAKDAKETVQECVSEFISFITSEASDKCQREKRKTINGDDLLWAMATLGFEDYIDPLKIYLTRYREMEGDTKGSAKGGDSSSKKDVQPSPNAQLAHQGSFSQGVSYTISQGQHMMVPMQGPE

SEQ ID NO: 715 - DNA, 557 bp, Zea mays
  G3876,family:CAAT
tataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaa

SEQ ID NO: 716 - protein, 178 aa, Zea mays
  G3876,CAAT domain coordinates 30-119
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGMGQQGAYNQGMGYMQPQYHNGDISN

SEQ ID NO: 717 - DNA, 806 bp, Zea mays
  G3929,family:AP2
tgggacctcgagcggcggggccggtgcacaggaaatctctatccacagacacacaagcagccagtgcagtagtagcccggtatatagagagtgtagcacgattatacaatatatcacagagctagctagttagtatatacgtactatatatatagtctattgctcgctagcttgctgaatcaagctgaactatatagtaagagactaattaaagagctattagccacagcgcgtgatccacgattaatggaggacgacaagaaggagggcaagtaccgcggcgtgcggaagcggccgtggggcaagttcgccgcggagatccgggacccggagcgcggcggctcccgcgtctggctcggcaccttcgacaccgccgaggaggccgccagggcctacgaccgcgccgcattcaccatgaagggcgccacggccgtgctcaacttccccaccagcggaggatcagctgccgcggctcccggcggccggaccagcggcggcggctcctcctcgtccaccacgtcgtcggctccggccagcagggggagggcccgtgttcccgactcggagaaggtggagctggagtgcctcgacgacagggtcttggaggagctgctcgcggaggacaagtacaacaagaactaatgaaacgctagctgatgcacaacatacatatgttggtagtagccttattagccgccgcaacgcgctgctagctagagctagctcttcgctgccgcttccagtaaattatatttaagggagacagaactatattaactttaatatactatactcactacccaatt

SEQ ID NO: 718 - protein, 131 aa, Zea mays
  G3929,AP2 domain coordinates 6-67
MEDDKKEGKYRGVRKRPWGKFAAEIRDPERGGSRVWLGTFDTAEEAARAYDRAAFTMKGATAVLNFPTSGGSAAAAPGGRTSGGGSSSSTTSSAPASRGRARVPDSEKVELECLDDRVLEELLAEDKYNKN

SEQ ID NO: 719 - DNA, 1556 bp, Glycine max
  G3934,family:ZF-HB
actcaaaaaccatcatcaacatctcttcaattcttcaattcctctattcctctctcctccctctccttcacttgaacaattccttcttcttttccccctcaattttttctcttcttcaattttagccctacacacaacataaactacaacaacaaacacctaaccattcactcactcacacatttctctctcagttttagcaacagtttgatgaagtcgtcacaaaaagcaacggttttggcttaattattagtattattgttgttattattattacaaggatggagataataacacccacagcaaccgccacaaacgcaaccgcaaaatcgccagaacccgacatagagacgatgacccggatccatcaaaacccgaacccgaatccaaagccggtgtctttctccaacggcgtcttgaagcgccaccatgtaaaccaccgcgccgcggtggtttacaaggaatgcctgaagaaccacgtggcgagcttgggtggccacgctttggacggctgcggcgagttcatgccgtcgccggcggccaccgccgacgaccccagctccatcaaatgcgccgcctgcggctgccaccggaacttccaccgccgcgaaccggaggagtcacccatttctccggcgacacatcacgtcctcgagtacaggccacaccaccgccaccaccctccgccgcctcaccggagtcccaactccgcctccccgccgccgatctcatcctacccctcggcgccccacatgctcctcgccctctccggcggggccggcctctccgtcgcgccggaaaacaccgccgcgccggcgccgccgcaccactcgcgtaaacgcttccggacgaagttcacccaagaacaaaaggagaagatgcacgagttcgcggacaaagttggttggaagatgcagaggcgcgacgaggaaatggttatggagttctgcaacgagattggtgtcgacagaggagttctcaaagtgtggatgcacaacaacaagaacactttcgcgaaaaaagacaaccttaacggcaacagtatcggtaacgttgccattgtcagtgccaacggagttgctcccattggcgccgttggcagcgctaccgttagaagcagcgttcatgtccacgaacatgaacacggaggaattaacggtaacggtagcggcgacaacaaccacaaccccctcggttcccgggatgtgaacgagtacgagaatgatagtgggactaacggcggcggcggtactaatgggtcttcttcttcttcttgaaaaaaaaaatatgagagagaataatgatgtgtttagatgatagagtaattaagaggtggtacccgttaattacttaattagtcgttttcttcttctttcttttttattttgatttaattgtttagtttttgttaattaatgagatgagatgagatgacgatgatgtgatcaccttcttaacatgggagagagatttgattttgatgatattgatatccgcagggaatgtagagttcttgtttgattcagctgcttaattatagttaaatgtttagtgtt

SEQ ID NO: 720 - protein, 331 aa, Glycine max
  G3934,ZF-HB domain coordinates 57-112,185-248
MEIITPTATATNATAKSPEPDIETMTRIHQNPNPNPKPVSFSNGVLKRHHVNHRAAVVYKECLKNHVASLGGHALDGCGEFMPSPAATADDPSSIKCAACGCHRNFHRREPEESPISPATHHVLEYRPHHRHHPPPPHRSPNSASPPPISSYPSAPHMLLALSGGAGLSVAPENTAAPAPPHHSRKRFRTKFTQEQKEKMHEFADKVGWKMQRRDEEMVMEFCNEIGVDRGVLKVWMHNNKNTFAKKDNLNGNSIGNVAIVSANGVAPIGAVGSATVRSSVHVHEHEHGGINGNGSGDNNHNPLGSRDVNEYENDSGTNGGGGTNGSSSSS

SEQ ID NO: 721 - DNA, 894 bp, Oryza sativa (japonica cultivar-group)
  G3938,family:CAAT
atgaagagtaggaagagctatgggcacttgctgagcccggtgggcagcccgccgttggacaacgagtccggcgaggcggcggcggcggctgcggctggcggcggcggctgcgggagcagcgccgggtatgtcgtctacggcggcggcggcggtggggactcgccggcgaaggagcaggacaggttcctgccgatcgcgaacgtgagccgcatcatgaagcggtcgctgccggcgaacgccaagatctccaaggagtcgaaggagacggtgcaggagtgcgtgtcggagttcatcagcttcgttacaggcgaggcctccgacaagtgccagcgcgagaagcggaagaccatcaacggcgacgacctcctctgggccatgaccacgctggggttcgaggcctacgtcggcccgctcaagtcctacctcaaccgctaccgcgaggccgagggcgagaaggccgacgtgctcggcggcgccggcggcgccgccgcggcgcgccacggcgagggcggttgctgcggcggcggcggcggcggcgccgatggcgtcgtcatcgacgggcattacccgctcgccggcggcctgtcacactcacaccatggtcatcagcagcaggacggcggcggcgacgtcgggctcatgatgggcggcggcgacgccggcgtcgggtacaacgccggggccgggtcgacgacgacggcgttctacgcgccggcggcgacggcggcgtcagggaacaaggcgtactgcggcggcgacgggtcgagggtgatggagttcgagggcatcggcggcgaggaggagagcggaggcggcggcggcggcggcgagagggggttcgccggccacctccatggcgtgcaatggtttagactaaagaggaatactaattag

SEQ ID NO: 722 - protein, 297 aa, Oryza sativa (japonica cultivar-group)
  G3938,CAAT domain coordinates 58-153
MKSRKSYGHLLSPVGSPPLDNESGEAAAAAAAGGGGCGSSAGYVVYGGGGGGDSPAKEQDRFLPIANVSRIMKRSLPANAKISKESKETVQECVSEFISFVTGEASDKCQREKRKTINGDDLLWAMTTLGFEAYVGPLKSYLNRYREAEGEKADVLGGAGGAAAARHGEGGCCGGGGGGADGVVIDGHYPLAGGLSHSHHGHQQQDGGGDVGLMMGGGDAGVGYNAGAGSTTTAFYAPAATAASGNKAYCGGDGSRVMEFEGIGGEEESGGGGGGGERGFAGHLHGVQWFRLKRNTN

SEQ ID NO: 723 - DNA, 687 bp, Glycine max
  G3980,family:MADS
atggggagaggtaagatcgtgataaggaggatcgacaattccacgagcaggcaagtgacgttctcgaagcgaaggaacggtttgctgaagaaggcgaaggagcttgcgatcttgtgcgatgctgaagtcggagttatgatcttctccagcaccggaaaactctacgatttcgccagctccagcatgaaatcagtaatggaccgatacagcaaatcaaaagaagaaccttgtcaacttgggagttcagcctctgaaattaagttttggcaaagggaggcagcaatgttaaggcaacaattacacaatttgcaagaaagtcaccgcaggaaaatgatgggggaagaactgtcaggcttgacagtcaaagaattacaaaatttggagaaccaattagaaattagccttcatggtgtccgaatgaaaaaggatcaacttttaatgggtgaaatacaagagctaaatcgaaagggaaacctcatacaccaagaaaatgtggaactgtataagaaggtctatggaacacaagatgataacgaaacaaacagagattctgttctgacaaatggtctaggcataggagaggatttgcaagtgcctgtgaatctccagctaagccagccacagcaacagcaacaacactacaaggcatcttcaggaactacaaaattgggattgcaattgcattga

SEQ ID NO: 724 - protein, 228 aa, Glycine max
  G3980,MADS domain coordinates 2-57
MGRGKIVIRRIDNSTSRQVTFSKRRNGLLKKAKELAILCDAEVGVMIFSSTGKLYDFASSSMKSVMDRYSKSKEEPCQLGSSASEIKFWQREAAMLRQQLHNLQESHRRKMMGEELSGLTVKELQNLENQLEISLHGVRMKKDQLLMGEIQELNRKGNLIHQENVELYKKVYGTQDDNETNRDSVLTNGLGIGEDLQVPVNLQLSQPQQQQQHYKASSGTTKLGLQLH

SEQ ID NO: 725 - DNA, 678 bp, Glycine max
  G3981,family:MADS
atggggagaggtaagatcgtgataaggaggatcgacaattccacgagcaggcaagtgacgttctcgaagcgaaggaacggtttgctgaagaaggcgaaggagcttgcgatcttgtgcgatgctgaagtcggagttatgatcttctccagcaccggaaaactctacgatttcgccagctccagcatgaaatcagtaatggaccgatacagcaaatcaaaagaagaaccttgtcaacttgggagttcagcctctgaaattaagttttggcaaagggaggcagcaatgttaaggcaacaattacacaatttgcaagaaagtcaccggaaaatgatgggggaagaactgtcaggcttgacagtcaaagaattacaaaatttggagaaccaattagaaattagccttcgaggtgtccgaatgaaaaaggatcaacttttaatggatgaaatacaagagttaaatcggaagggaaacctcatacaccaagaaaatgtggaactgtatcagaaggtctatggaacaaaagatgataacaaaacaaacagagattctgttctcacaaatggtctaggcataggagaggatttgcaagtgcctgtgaatctccagctaagccagccacagcaacaacactacaaggaaccttcaggaactacaaaattgggattgcaattgcattag

SEQ ID NO: 726 - protein, 225 aa, Glycine max
  G3981,MADS domain coordinates 2-57
MGRGKIVIRRIDNSTSRQVTFSKRRNGLLKKAKELAILCDAEVGVMIFSSTGKLYDFASSSMKSVMDRYSKSKEEPCQLGSSASEIKFWQREAAMLRQQLHNLQESHRKMMGEELSGLTVKELQNLENQLEISLRGVRMKKDQLLMDEIQELNRKGNLIHQENVELYQKVYGTKDDNKTNRDSVLTNGLGIGEDLQVPVNLQLSQPQQQHYKEPSGTTKLGLQLH

SEQ ID NO: 727 - DNA, 936 bp, Antirrhinum majus
  G3982,family:MADS
atttcatttgaagagatgggaagggggaagattgtgatccaaagaatcgacaaatcgacgagtaggcaagtgactttttcgaaaaggaggagtggacttttgaagaaggccaaagagcttgctattctttgtgatgcagaagttggagttgttatattttccagcactgggaagctctacgaattttcaagcaccagcatgaaatcaattattgaacgacacactaaaaccaaagaggaccatcatcagctgcttaatcatggctcggaggtcaagttttggcaaagggaggctgcgactttaaggcaacaattacaggatttgcaagaaaaccatcggaagttgatgggagaagagctacaagggttgaatgttgaagatctacacagattggagaaccaactagagatgagtttgcgaggcgtgcgcatgaaaaaggtacagatgttaaccgatgaggttcatgaacttaggagaaagggacatctcatccatcaagagaacaatgagctctatgagaaggtaaaactccttcaacaagaaaacaaggaattgtgtaaaaaggcttacggcacaagggatgtaagtgcagcaaatggaactgccttggttccatttggtttcgcaattggtagggaacaattcgagccaatccagcttcatttaagccagcctgaaccagaaaatattgaaacatcaagagcctcaggatcaaagtaaattatttttggactaccttacaaaactacatgtgcttgtgtatgtatcatccagcactaggcaattaagtaacttgtattttgaatgcacgcctagacattaatatttccaaattgtcacaatattcgacagagctttcatttggcgatacctgcaagaaaattcactgtactcaatttaagagttcatataatgctatgtgtaattgtttttagc

SEQ ID NO: 728 - protein, 234 aa, Antirrhinum majus
  G3982,MADS domain coordinates 2-57
MGRGKIVIQRIDKSTSRQVTFSKRRSGLLKKAKELAILCDAEVGVVIFSSTGKLYEFSSTSMKSIIERHTKTKEDHHQLLNHGSEVKFWQREAATLRQQLQDLQENHRKLMGEELQGLNVEDLHRLENQLEMSLRGVRMKKVQMLTDEVHELRRKGHLIHQENNELYEKVKLLQQENKELCKKAYGTRDVSAANGTALVPFGFAIGREQFEPIQLHLSQPEPENIETSRASGSK

SEQ ID NO: 729 - DNA, 977 bp, Arabidopsis thaliana
  G399,family:HB
aggaaataaaaaacatgatgatgggcaaagaagatctaggtttgagcctaagcttagggttttcacaaaatcacaatcctcttcagatgaatctgaatcctaactcttcattatcaaacaatctccagagactcccatggaaccaaacattcgatcctacatcagatcttcgcaagatagacgtgaacagttttccatcaacggttaactgcgaggaagacacaggagtttcgtcaccaaacagtacgatctcaagcaccattagcgggaagagaagtgagagagaaggaatctccggaaccggcgttggctccggcgacgatcacgacgagatcactccggatcgagggtactcacgtggaacctcagatgaagaagaagacgggggcgaaacgtcgaggaagaagctcaggttatcaaaagatcagtctgcttttctcgaagagactttcaaagaacacaacactctcaatcccaaacagaagctagctttggctaagaagctgaacttgacggcaagacaagtggaagtgtggttccaaaacagaagagctagaaccaagttaaagcaaacggaggtagattgcgaatacttgaaacggtgcgtagagaagctaacggaagagaaccggagacttcagaaagaggctatggagcttcgaactctcaagctgtctccacaattctacggtcagatgactccaccaactacactcatcatgtgtccttcgtgcgagcgtgtgggtggcccatcatcatcgaaccatcaccacaatcacaggcccgtttctatcaatccgtgggttgcttgtgctggtcaggtggctcatgggctgaattttgaagccttgcgtccacgatcgtgattttttattttagtggtgggaaaagggtgttttggtatttttcgttatcgttatatagtctatctgtgtggggtcattgttattttggatgattggccttctcatgaacta

SEQ ID NO: 730 - protein, 283 aa, Arabidopsis thaliana
  G399,HB domain coordinates 126-186
MMMGKEDLGLSLSLGFSQNHNPLQMNLNPNSSLSNNLQRLPWNQTFDPTSDLRKIDVNSFPSTVNCEEDTGVSSPNSTISSTISGKRSEREGISGTGVGSGDDHDEITPDRGYSRGTSDEEEDGGETSRKKLRLSKDQSAFLEETFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVGGPSSSNHHHNHRPVSINPWVACAGQVAHGLNFEALRPRS

SEQ ID NO: 731 - DNA, 714 bp, Solanum lycopersicum
  G4061,family:MADS
cccggaaaatcggaatttaaatggtgagaggaaaagtagaaatgaaaagaatagaaaattcaacgagcaggcaagtgacgttttcgaaaagacgaaatggacttacgaagaaagcttatgaattatcagttctttgtgatgctgaagttgctttcattattttctcacataaaggaagactttatgaatttgctagctccaacatgcagaagataattgagagataccgaggacgtgcaagagaaacaacgacggtggacaaaagcactgaactcgagcactacatggagaacttgaagcatgaaacagctaatatggcgaagaagatagagatcctcgaaatttctaaacggaagctaatggggcaaggattagggtcatgttcaatggatgaactagaagacattgacagccaactggagaggaccctcaaaattatcagggctagaaagactcaattgttcaaagaggaaatagaaagtctaaaagcaaaggagagactattgctccaacaaaatgcaagtttacgtgaaaagtgcgggcttaggccaatgctatcagagtcagcatctgcacccgaacccataccagcaccaccatcaacaccaccagctcaatcaaaagaaaggggaaattgtagccaaagtacaaagagttgggaagtggagactgaattgtttattggccttcctcaaacgcgctgcttatagtagc

SEQ ID NO: 732 - protein, 229 aa, Solanum lycopersicum
  G4061,MADS domain coordinates 2-57
MVRGKVEMKRIENSTSRQVTFSKRRNGLTKKAYELSVLCDAEVAFIIFSHKGRLYEFASSNMQKIIERYRGRARETTTVDKSTELEHYMENLKHETANMAKKIEILEISKRKLMGQGLGSCSMDELEDIDSQLERTLKIIRARKTQLFKEEIESLKAKERLLLQQNASLREKCGLRPMLSESASAPEPIPAPPSTPPAQSKERGNCSQSTKSWEVETELFIGLPQTRCL

SEQ ID NO: 733 - DNA, 642 bp, Brassica rapa
  G4062,family:MADS
atggtgaggggcaaaactcagatgaagcgaatagagaatgcaacaagcagacaagtgactttctctaagcgaaggaatggtttgctgaaaaaagcctttgagctctcagttctttgtgatgctgaagtttctctgatcatcttctctcctaaggcaaaactttatgaatttgccagctccaatatgcaagataccatagatcgttatctgaggcataccaaggatcgtgtcagcaccaaacctgtttctgaagaaaatttgcagcatttgaaacatgaagcagcaaacatgatgaagaaaattgaacaacttgaagcttccaaacgtaaactcttgggagaaggcataggatcatgttcgatagaggagctgcagcaaattgagcaacaacttgagaaaagtgtcaaatgtatccgagcaagaaagactcaagtgtttaaggtacaaattgagcagctcaagcaaaaggagaaagctctagctgcagaaaacaagaagctcactgaaaagtggggatctcatgaaatcgaagtctggtcgaataagaaccaagaaagtggaagaggtgacgaagagagtagcccaagttctgaagtagagacagagttgttcattgggttaccttgttcttcaagaaagtga

SEQ ID NO: 734 - protein, 213 aa, Brassica rapa
  G4062,MADS domain coordinates 2-57
MVRGKTQMKRIENATSRQVTFSKRRNGLLKKAFELSVLCDAEVSLIIFSPKAKLYEFASSNMQDTIDRYLRHTKDRVSTKPVSEENLQHLKHEAANMMKKIEQLEASKRKLLGEGIGSCSIEELQQIEQQLEKSVKCIRARKTQVFKVQIEQLKQKEKALAAENKKLTEKWGSHEIEVWSNKNQESGRGDEESSPSSEVETELFIGLPCSSRK

SEQ ID NO: 735 - DNA, 976 bp, Glycine max
  G4063,family:MADS
ggctcgaggttttctgttttggaccatggacttggtttttaccaaatcaagaaaaggatgagcttttttgggccttcaaatcttgcttggagaaggctcaattttggtggaaacctctcacacaagaaagcatagtttcttttgggttcattctacttggtgtttagagatggtgagaggaaagactcagctgaggcgcatagagaacgccacaagcaggcaagtcaccttttcaaagcggcgtaatgggttgctgaagaaggcctttgaactttctgttctttgtgatgctgaggttgctctcatcattttctctccaagaggaaagctttatgaatttgcaagctcaagcatgcaggacacaattgaacgataccgcaggcataacaggagtgctcaaacagtgaacagatctgatgaacaaaatatgcagcatttgaagcaagaaacagcaaacttgatgaagaagattgagcttcttgaagcttcaaaacggaagctcttgggagaaggtttggggtcatgctctttagaagaactgcaacagatagaacaacagttggaaaggagtgtaagcagtgttcgtgcaagaaagaatcaggtttacaaggaacaaattgatcaactaaaagagaaggaaagagccctatatgctgaaaatgctaggctgtgtgagcagtatggtggtatccagccacagccagcaacaaaggatccgaaagaaattcaaccctatgcagaaagcagtccaagttcagaagtggagactgaattgttcattggactactcaggtctagctattgaacataatttaatccttgcctatgcaaatatcaaataagaagcccaactgcaatgtataaatatcacatgtttcctaatactgagatgaataatattatcgcttgtattatataaagaactttctagccttatgattagggtttaattattaaaaaaaaaaaaaaaaaaagg

SEQ ID NO: 736 - protein, 211 aa, Glycine max
  G4063,MADS domain coordinates 2-57
MVRGKTQLRRIENATSRQVTFSKRRNGLLKKAFELSVLCDAEVALIIFSPRGKLYEFASSSMQDTIERYRRHNRSAQTVNRSDEQNMQHLKQETANLMKKIELLEASKRKLLGEGLGSCSLEELQQIEQQLERSVSSVRARKNQVYKEQIDQLKEKERALYAENARLCEQYGGIQPQPATKDPKEIQPYAESSPSSEVETELFIGLLRSSY

SEQ ID NO: 737 - DNA, 1367 bp, Glycine max
  G4064,family:MADS
ctgttttggaccatggacttggtttttaccaaatcaagaaaaggatgaggtttcaatttttctattaccataaaacaattttgtttcttaatatggtgaggctgggggaatcaccgggggataggtggatgaataaggaaagcttggtctgattagtctatactatatgccttgctattcccctttttctgagtttctctctgcacttcttgctagctaccctctcttttggggtatttcttttcattctccaaaaactctttaattttccttcccttttctgtgctattctctcctcactggtcaaaaggtttgtgggattttgctaatttggtgcaaatctgattcctttgacaaatccctcttgatctcctggcttattgaaaactactacaattccgagttgctttttttccctagttgcttttctgggccttgaaatcttgcttggagaaggctcaattttggtggaaacctctaccacaagaaagcatagtttttttgggttaatcatacttgaggtgtttagagatggtgagaggaaagactcagatgaggcgcatagagaacgccacaagcaggcaagtcaccttctcaaagcggcgtaatgggttgctgaagaaggcctttgaactttctgttctttgtgatgctgaggttgctctcatcattttctctccaagaggaaagctttatgaatttgcaagctccagcatgcaggacacaattgaacgctaccgcaggcataacaggagtgctcaaacagtgaacagatctgatgaacaaaatatgcagcatttgaagcatgaaacagcaaacttgatgaagaagattgagcttcttgaggcttcaaaacggaagctcttgggagaaggtttggggtcatgctccttagaagaactgcaacagatagaacaacaattggaaaggagtgtaagcaatggtcgtgcaagaaagaatcaagtttacaagggacaaattgatcaactaaaagagaaggaaagagccctatatgctgaaaatgctaggctgtgtgagcagtatggtatccagccacagccagcaacaaaggatccgaaagaaattcaaccctatgcagaaagcagtccaagttcagaagtggagactgaattgttcattggactacccaggtctatctagttgaagataatttaatccttgcctagtatgaaataagaagcccaactgcaatgtataaatatcacatgtttcctaatactttgagatgaataatattatcgcttatattatataaagaactttccgattttatgattaaaaaagaaagaaaaaggactagtgcgctcgagtagctggtctaaccccggatcgattccggaccggta

SEQ ID NO: 738 - protein, 209 aa, Glycine max
  G4064,MADS domain coordinates 2-57
MVRGKTQMRRIENATSRQVTFSKRRNGLLKKAFELSVLCDAEVALIIFSPRGKLYEFASSSMQDTIERYRRHNRSAQTVNRSDEQNMQHLKHETANLMKKIELLEASKRKLLGEGLGSCSLEELQQIEQQLERSVSNGRARKNQVYKGQIDQLKEKERALYAENARLCEQYGIQPQPATKDPKEIQPYAESSPSSEVETELFIGLPRSI

SEQ ID NO: 739 - DNA, 1253 bp, Zea mays
  G4065,family:MADS
cgtgggcgccctcgccccccccccggagatccccgtccccgttttccacttttgcctccgccccaattcggataacaaacccctccgcctcgtcgcgtctcctcccagccgagccgatccggtagagagagggagagggagagggagggactgagggaggaggagctgggttccggtcccggccgcccggccggctgcgcgattcgattgtagctctcgtccccgggcggcgtccaggatggtgcggggcaagacgcagatgaagcgaatagagaacccgaccagccgccaggtcaccttctccaagcgccgcaacggcctgctcaagaaggcgttcgagctctccgtcctctgcgacgccgaggtcgccctcgtcgtcttctccccgcgcggcaagctctacgaattcgccagcggaagtgcgcagaaaacgattgaacgttatagaacatacacaaaggataatgtcagcaacaagacagtgcagcaggatattgagcgagtaaaagctgatgcggatggcctgtcaaagagactcgaagcacttgaagcttacaaaaggaaacttttgggtgagaggttggaagactgctccattgaagagctgcacagtttggaagtcaagcttgagaagagcctgcattgcatcaggggaagaaagactgagctgctggaggagcaagtccgtaagctgaagcagaaggagatgagtctgcgcaagagcaacgaagatttgcgtgaaaagtgcaagaagcagccgcctgtgccgatggcttcggcgccgcctcgtgcgccggcagtcgacaacgtggaggacggtcaccgggagccgaaggacgacgggatggacgtggagacggagctgtacataggattgcccggcagagactaccgctcaagcaaagacaaggctgcagtggcggtcaggtcaggctagcagctacctcagccacgcacaggcccaatcaacgcaagctagctagctgagaataatcttttagatctctggtagtgtggagatcgagatgcaagccaagcaatgtgatatcgcgttgtgtgttaccaacctgtctgtctgtgtatcatcccgtcccgtccgtcagagtctcagagaacgaacacttcttctccttctccctgtagctagctgctcctgcttgtgtccagatcttctgttcgatcgggtttgggaccaaaaaaaaaaaaaaaaaagcggccaaaaaaaaaaaaaaaaaaaaaaaaaaaaaaaaaaa

SEQ ID NO: 740 - protein, 232 aa, Zea mays
  G4065,MADS domain coordinates 2-57
MVRGKTQMKRIENPTSRQVTFSKRRNGLLKKAFELSVLCDAEVALVVFSPRGKLYEFASGSAQKTIERYRTYTKDNVSNKTVQQDIERVKADADGLSKRLEALEAYKRKLLGERLEDCSIEELHSLEVKLEKSLHCIRGRKTELLEEQVRKLKQKEMSLRKSNEDLREKCKKQPPVPMASAPPRAPAVDNVEDGHREPKDDGMDVETELYIGLPGRDYRSSKDKAAVAVRSG

SEQ ID NO: 741 - DNA, 1117 bp, Oryza sativa (japonica cultivar-group)
  G4066,family:MADS
gggggaccaaaaaggaaagccgaggaggagagggaggggagagaagggagagggggtcggggagaaagaagagcgagcgagcagctttggctacggccaaaccctacagcgcctccaccaccactccttgccttttttggccgcagccgctcgtgtggttggttggttcatcggcgatcgaagatggtgcgggggaagacgcagatgaagcggatagagaaccccacgagccgccaggtcaccttctccaagcgccgcaacggcctgctcaagaaggccttcgagctctccgtcctctgcgacgccgaggtcgcgctcatcgtcttctccccgcgcggcaagctctacgaattcgccagcgccagtacgcagaaaacaattgaacgctataggacgtatacaaaggaaaatatcggcaacaagacagtacagcaagatatagagcaagtaaaagctgacgctgatggtttggcaaagaaacttgaagctcttgaaacttacaaaagaaaactgctgggtgaaaagttggatgaatgttctattgaagaactgcatagcctggaggtcaagctggagagaagcctcattagcatcaggggaaggaagacaaagctgcttgaggagcaggttgccaaactgagagagaaggagatgaagctgcgcaaggacaatgaagagttacgcgaaaagtgtaagaatcagcctcccttgtctgctcctttgactgtccgggccgaagatgagaacccggaccgtaacatcaacaccaccaacgacaacatggatgtcgaaactgagctattcatagggctgcctggcagaagtcgctccagcggcggtgctgcagaagatagccaagcgatgccccattcttaagtaacaggccaggaataagctggatctctgcgttgagaaaggagatgatgctaggcatgcaatgacaccaaaccatcctaaaaacagaccacgctgtatattttacttacccgtattgtcgtccatggatgcgaaatgctagacgcatatgcacccacccattcagcaccaccaggcagaaacccttcgatcggcagactccactacccatctaaatctaaatcgagagatctcaagtgcg

SEQ ID NO: 742 - protein, 230 aa, Oryza sativa (japonica cultivar-group)
  G4066,MADS domain coordinates 2-57
MVRGKTQMKRIENPTSRQVTFSKRRNGLLKKAFELSVLCDAEVALIVFSPRGKLYEFASASTQKTIERYRTYTKENIGNKTVQQDIEQVKADADGLAKKLEALETYKRKLLGEKLDECSIEELHSLEVKLERSLISIRGRKTKLLEEQVAKLREKEMKLRKDNEELREKCKNQPPLSAPLTVRAEDENPDRNINTTNDNMDVETELFIGLPGRSRSSGGAAEDSQAMPHS

SEQ ID NO: 743 - DNA, 1724 bp, Oryza sativa (japonica cultivar-group)
  G4067,family:MADS
tggcgattgccggtctcggtcggtcgcactcgcgctcgcgcgcgggcgcctcgtgggtcgcgggtttcccaggacgggaagtcgctcgcgcggtcgccttctttatttggctaccgccgccccccggccccccgcattccgcacgaggctcgtctcgtctcgtctctccactcccccacctcccatccgctactgctagtactactactacccggcctctcgccttctcgcgcggccgcgatttccgttcgcaaatccgcacccacggcggcgcgaggtcgccgtcgtcgtcgagccatttcgggggggtagtttataagggcttgcgcgaggagggggaggagtagcgggtagcggcggctcgagtcgagtcgagtcgccgtcgtcgtcggcggcggcggtcgagagagatcgggatcgatggtgcgggggaggacggagctgaagcggattgagaacccgacgagccggcaggtgaccttctccaagcgccggaatggcctcctcaagaaggcgttcgagctctccgtcctctgcgacgccgaggtcgccctcatcgtcttctccccccgcggccgcctctacgagttcgccagcgcccccagcctacagaaaaccatcgaccgctataaagcatacacaaaggatcatgtcaacaataagacaattcaacaagatatccagcaagtcaaagatgatactttaggtttggccaagaaacttgaagctcttgatgagtccagacggaaaatattgggagaaaatttagaaggatgctctattgaagaactgcgtggtctagaaatgaaacttgagaagagcctccacaacataagactaaagaagaccgagcttctggagcggcagatagccaagctgaaagagaaggagcggactttgcttaaagacaacgaaaatttacgcggaaagcatcgcaaccttgaggctgcggcgctggtggctaaccacatgacgacgacgacggcgccggcggcgtggccgcgggacgtgcctatgacgagcagcacagccggcgccgccgacgccatggacgtggagactgatctgtacattggattgcccggcactgagcgctcctccaaccggtcggagacaggttgaagaaggccagccacagcaacagctgctatatagcatgcagtagcagcaacgacgccagtgacatcctgttcatctcacaagaataaccagagctctacgcatgcgcacatgaaacccaggcatgcagttctcggtgggtaaattattatctcgcattattagctatatgcgtgtccttgtctttttctttaggcaatggaataaaatttccggtaagtacaaacacaaaacggaaacaaagaattaacaaagctgtagcagaccagatcggcaaattgaaatgccaggtaatccagtatatatttcgcttccgttattcagggtggtggtgattgggcctctgacgtgtgggtgcttgggacggaggatttcttgggggttgttttttccccgagccaaatcaatctgctcgtgcccttgagatttcagttccgcccataagaactcccacgcacatttagcattcggagagtaattttgttaggttaaaagtatggtaagttataggtggtatgttatgtttttctttttcttttctcaatgttatctggtacctaagtttgtcaagaaaatcatagtggacacagtcaagtatttggggc

SEQ ID NO: 744 - protein, 233 aa, Oryza sativa (japonica cultivar-group)
  G4067,MADS domain coordinates 2-57
MVRGRTELKRIENPTSRQVTFSKRRNGLLKKAFELSVLCDAEVALIVFSPRGRLYEFASAPSLQKTIDRYKAYTKDHVNNKTIQQDIQQVKDDTLGLAKKLEALDESRRKILGENLEGCSIEELRGLEMKLEKSLHNIRLKKTELLERQIAKLKEKERTLLKDNENLRGKHRNLEAAALVANHMTTTTAPAAWPRDVPMTSSTAGAADAMDVETDLYIGLPGTERSSNRSETG

SEQ ID NO: 745 - DNA, 1405 bp, Solanum lycopersicum
  G4079,family:AP2
tttggctttatacctctaattatattgttctaattatatggtagaaagatctacttcccgccaaaaacaacaaagaaagtaatctctttttctttgttcactcatcaacttgtttctcaaatcatttgtatcactgcaactttttccacacttaaaaactttttatacaataatattggtcactattcactcacttcaaccagttcttgattgttttagtactcctttttgagcttatgatgatttttttttgtgctctttgaaaaaaatatcttttaaatcgaactgtaactttaagtttttggtataccatgacggaaaattcagttccggtgattaaattcactcaacacatagtaactacaaacaagcatgttttttctgagcataacgaaaaatccaattcagagttacaaagagttgtgaggattatacttacagatgccgatgctacagattcttccgatgatgaaggccggaatactgtacggagagtgaagaggcacgtgacggagatcaaccttatgccgtcaaccaaatcgatcggcgacagaaaacgaagatcggtgtctccggattctgacgtcactcgtcggaaaaagtttagaggcgttcgtcaaagaccgtggggtcgttgggctgcagagattcgggacccgacccggggaaaacgggtgtggttgggtacttatgacaccccagaagaagcagctgtcgtttacgataaagctgcagttaagctcaaaggtcctgacgccgttaccaattttccggtatcaacaacggcggaggtaacggtgacggttacggaaaccgaaaccgagtctgttgccgacggtggagataaaagcgaaaacgatgtcgctttgtcacccacctcagttctctgtgacaatgattttgcgccgtttgacaatctagggttctgcgaagtggatgcttttggtttcgacgttgattcacttttccggctgccggattttgctatgacggagaaatactacggcgatgaattcggcgaatttgactttgacgattttgcccttgaagctcgatagtgtacgaggggctatttcgtccatttttgcaaatgggttcactggttagttgactagtgacgtggcatttttggcgggaatatatatatagtgattagcagtctctattcatacgaagactttgtgagagatttttgtttttatttttctgttaattgtgggtgaatattgtaatatgaaaaattttgtatggtgaaattgaattaattaacgatgaagataaggagagtgaagggggatgtgtgtattttatgattgaggtgtgtttttgtgattctgaaaaaataatttattattttacgttggaaatataaagtcaaaattctattgaaaaaaaaaaaaaaaaa

SEQ ID NO: 746 - protein, 248 aa, Solanum lycopersicum
  G4079,AP2 domain coordinates 95-157
MTENSVPVIKFTQHIVTTNKHVFSEHNEKSNSELQRVVRIILTDADATDSSDDEGRNTVRRVKRHVTEINLMPSTKSIGDRKRRSVSPDSDVTRRKKFRGVRQRPWGRWAAEIRDPTRGKRVWLGTYDTPEEAAVVYDKAAVKLKGPDAVTNFPVSTTAEVTVTVTETETESVADGGDKSENDVALSPTSVLCDNDFAPFDNLGFCEVDAFGFDVDSLFRLPDFAMTEKYYGDEFGEFDFDDFALEAR

SEQ ID NO: 747 - DNA, 1147 bp, Nicotiana tabacum
  G4080,family:AP2
cggcacgagaaaatccccctataaattcattccctctttgtctcgaatattactctttttgctgctactaatttcatcttccaaccagttcttgatttctctttaatcttctacgtacaagattaatgttctaaatcctgttttctacaaaacatcaactttatcccatgataagaaatccagtcgtttctctaatggatgaaccaaaaacagttaagttttcccaacacatagtcactaaaaacaaacacgttcctgagcaaaacgaaaactccaatttccactctaagtttttacagagagttgttcgaatcatacttacagatgctgacgcaactgattcctcggacgacgaaggacaagatactgtacggagagtgaagaggcacgtgacggagatcaacctcatgccatcgcccaatttgatatgtgaaaagaaacgaagattggtttcgccggatactgacgtcactcgccggaaaaagtttaggggtgtacgtcaaaggccatggggtcgttgggcagcagagattcgggacccgacccggggaaaacgggtttggttgggaacctatgacaccccggaggaagcagctatcgtttacgacgcagctgctgttaagctcaaaggtcctgatgccgttactaactttccgaaagtattaacggcggatataacggaaatggagtctgttaccgaccgtggagagaaaagcgaaaacgacttcgctttgtcgccgacgtcagttctccgtaacgatgattttacgccgtctgacgatttggggttctgcgaagtggacgcttttgggtttgacgttgactcccttttccggttgccggaatttgggttgtcggagaaatactacggcgatgaattcggcgagtttgactttgacgactttgctctcgaagctcgatagtggggctatttggttgttttagatcaaagttgtggcatttttgtaacttgagtcattgctgatggtgacgtggcatttttgacgggactacacgtgattagtgccgatttatacggcgattttgcgagagatttgtaccttttttaatttaacatgtgatttgtgagggccaattgtgtagtaagaaaattttgtttttgttattccaaaaaaaaaaaaaaaaa

SEQ ID NO: 748 - protein, 251 aa, Nicotiana tabacum
  G4080,AP2 domain coordinates 104-166
MIRNPVVSLMDEPKTVKFSQHIVTKNKHVPEQNENSNFHSKFLQRVVRIILTDADATDSSDDEGQDTVRRVKRHVTEINLMPSPNLICEKKRRLVSPDTDVTRRKKFRGVRQRPWGRWAAEIRDPTRGKRVWLGTYDTPEEAAIVYDAAAVKLKGPDAVTNFPKVLTADITEMESVTDRGEKSENDFALSPTSVLRNDDFTPSDDLGFCEVDAFGFDVDSLFRLPEFGLSEKYYGDEFGEFDFDDFALEAR

SEQ ID NO: 749 - DNA, 1003 bp, Zea mays
  G4240,family:GARP
atctccgacccgatccgacccgacacacaaatatctccacccctgttccggcgacgactacgatttgggaggaaggtaagcgaatgggtgaggaggcggtcgacgactacgagctccacatggtgtgctacggcggcggcggcggcggcagcgaggacgagcgcgtgatggagtgggagtcaggtctcccgggcgcggacgagctgaccccgctgtcgcagccgctggtgccggcgggtctggcagcggcgttccgcatcccgccggaggccgggcggacgctgctggacgtgcaccgcgcgtcggctgccacggtgtcccggctgcgtcgcgcgccgccgccgtcgtcgtcgggcagcggagggagctcctccttcgcgcccttccatccggcggcgaggggggacgaaggggcggactcgtcggcggcgggcggcggggcggcggcgacgacgaacggcaacaataacatgagcagcagcagcaagcggccccggctggtgtggacgccgcagctgcacaagcggttcgtggacgtggtggcgcacctggggatgaagaacgcggtgcccaagaccatcatgcagctgatgaacgtggaagggctgacgcgggagaacgtggccagccacctgcagaagtaccgcctctacgtcaagcggatgcagggcctctccgacgagggcccgtcgccgtccgaccacatcttcgcatccacgccggtgccgcaaagcctggtgcatgaggtgcccatgtacggcaccatggccagcggcggacaggcgtaccacaaccacaacggaatgggaggaggagggtaccagtaccagtaccatcactaccaccacgcccacaaatgactcttctgttggattggatccctcaataatcccatcgatccttttggttttggatctcttgctaattcagttcttcgtgtgagcggtaaatggatctcttttaagaaataaagaaagaaagataagtttcttttcccttttca

SEQ ID NO: 750 - protein, 258 aa, Zea mays
  G4240,GARP domain coordinates 141-189
MGEEAVDDYELHMVCYGGGGGGSEDERVMEWESGLPGADELTPLSQPLVPAGLAAAFRIPPEAGRTLLDVHRASAATVSRLRRAPPPSSSGSGGSSSFAPFHPAARGDEGADSSAAGGGAAATTNGNNNMSSSSKRPRLVWTPQLHKRFVDVVAHLGMKNAVPKTIMQLMNVEGLTRENVASHLQKYRLYVKRMQGLSDEGPSPSDHIFASTPVPQSLVHEVPMYGTMASGGQAYHNHNGMGGGGYQYQYHHYHHAHK

SEQ ID NO: 751 - DNA, 1243 bp, Oryza sativa (japonica cultivar-group)
  G4241,family:GARP
ccacctcgactcaactcaactcgcacaaatatcttctctcttctcacccaccgcccgattcttcgagtccccgatttggttcggcctgaagaagggtctgggtctctctagagagtgagtagccatcgatttgagatttgattagtaattcggaggaggaggaacgagtggtttttttgatttgatttgatttgattgagaagaaaatccgagtattatgggcgaggaggcgccggaggagtacgagctgggcggcggggaggacgagcgggtgatggagtgggaggcggggctgcccggcgccgacgagctgaccccgctgtcgcagccgctggtgccggcggggctggcggcggcgttccgcatcccgccggagcccgggcgcacgctgctcgacgtgcaccgcgcgtcggcggcgacggtgtcccggctgcggcgcgcgtcgtcgtcgtcgtcgagctcgttcccggcgttcgcgtcgaagggagcgggagcgggagcggacgaggcggagtcagggggaggcgcgaatggggggaacgggaacaccaacaacaacagcagcaagagggcgcggctggtgtggaccccgcagctgcacaagaggttcgtggaggtggtggcgcacctggggatgaagaacgcggtgcccaagacgatcatgcagctgatgaacgtggagggcctcacccgggagaacgtcgccagccacctccagaagtatcgcctctacgtgaagcggatgcagggcctctccaacgagggcccttccccctccgaccacatcttcgcctccacccccgtcccccacgcctccctccacgaccaggttccttctccttaccacccccacccccaccaccactcctacaacaacgccgcctatgccgccaccgtctcctcctaccaccactaccaccacgccaaccactgatccattccttctcatcatcatttcatttccacatctatataccacatactactccataacgaaggtgtttcatcaataagagaagagaagagaagagaatgctccctcaactgtaaactcctaattctaattaagggcaaagtgtatccatccatccatccacgctgtttgtttgtagctgttgttaattgagctggatgcatgacatgtatctctatgtacctacctgcgtgacaaaggcatcatgcatatgtatggttcccttgcaatttggggaatccagaaatgattcatacttgtgattcttgc

SEQ ID NO: 752 - protein, 238 aa, Oryza sativa (japonica cultivar-group)
  G4241,GARP domain coordinates 123-171
MGEEAPEEYELGGGEDERVMEWEAGLPGADELTPLSQPLVPAGLAAAFRIPPEPGRTLLDVHRASAATVSRLRRASSSSSSSFPAFASKGAGAGADEAESGGGANGGNGNTNNNSSKRARLVWTPQLHKRFVEVVAHLGMKNAVPKTIMQLMNVEGLTRENVASHLQKYRLYVKRMQGLSNEGPSPSDHIFASTPVPHASLHDQVPSPYHPHPHHHSYNNAAYAATVSSYHHYHHANH

SEQ ID NO: 753 - DNA, 1236 bp, Glycine max
  G4243,family:GARP
atgggggaagaggtgaagacgagcgagtacgacgaagagcgcgtgatggagtgggagatgggtctcccaaccgccaacgatctcacgcctctctcccagccgctgatcccgccggagctcgcttcggccttcagcatctcgccggagccccaccgcaccctcctcgaggtcaaccgcgcctcgcgcaacacgctctccacaatccgcggcggcggtagcgtgcaccaggccttctcatccaacaacaacaacaaccaccactacgacggcgacggagacggcggcgacgaggaggagtacgacgacgccgatcgcgatggctcggggtcggattcccggaagcagcggaagatcgactgcggcgtggcggaggaggcggactcggcggtgcggacagagacctcggcggagcgaacggcggtgaagcggccgcggctggtgtggaccccgcagcttcacaagaggttcgtggacgtggtggcgcacctcgggatcaagaacgcggtgccgaagacgattatgcaattgatgaacgtggaagggttgacccgcgagaatgtcgcgagccatctccagaagtatcgtctctacctgaaacggatgcagggcctttcgaacgagggcccttcttcttcggatcagttattcgcttccacagctgtgcctcagagtttgcatgactctgctcctcccagtgcccatagcaatggccatggtcatctccctgttcccatgatgtccatgccatatccccctcccatgatgtccatgccatacccccctcccatgatgtccggcatgccccatgcccatggccacatgggcatccccatgcctaattcctccgccacctcagcttaccatccttataacatgttgcatcaaagggattggcctcaccttgctcctaatgataaatgaacctccaagattcaaaggcttgattattggtggtgtgtaattcacaccctgtaattcacattgatgattaccttgtaattcacacaaatggattattgaggaagtatatgaacaatactatatggagctagattacaatctgaatcagtagtgtgtaaccctgtgggagatttacaaacatattggtacacatctctaattcctgtcacctaattgtatgacgagaattctggcttatttcttctggtctgcctagacagctgattctaaagttaattcttaactagttctctgattcataaaaaaaaaaaaaaa

SEQ ID NO: 754 - protein, 306 aa, Glycine max
  G4243,GARP domain coordinates 148-196
MGEEVKTSEYDEERVMEWEMGLPTANDLTPLSQPLIPPELASAFSISPEPHRTLLEVNRASRNTLSTIRGGGSVHQAFSSNNNNNHHYDGDGDGGDEEEYDDADRDGSGSDSRKQRKIDCGVAEEADSAVRTETSAERTAVKRPRLVWTPQLHKRFVDVVAHLGIKNAVPKTIMQLMNVEGLTRENVASHLQKYRLYLKRMQGLSNEGPSSSDQLFASTAVPQSLHDSAPPSAHSNGHGHLPVPMMSMPYPPPMMSMPYPPPMMSGMPHAHGHMGIPMPNSSATSAYHPYNMLHQRDWPHLAPNDK

SEQ ID NO: 755 - DNA, 1599 bp, Glycine max
  G4244,family:GARP
tgtttcacacacatatatactctctctctctctctctctctctctctctctgtttgggttagggacatagaagaagagtgtgtgagagagacacggttaaatttgttttgttttatatacggttagaactaactgaatgggggaagaggtgaagacgagcgagtacgacgaagagcgcgtgatggagtgggaggcgggtctcccaactgccaacgatctcacgcctctctctcagccgctgatcccgccggaactcgcgtcggccttcagcatcttgccggagccccaccgcaccctcctcgacgtcaaccgcgcctctcgcaacacgctctccacgctccgcggcggcggagggagcgtgcaccaggccttctcctcctccaacaacaaccacaactacgacggcgacggcgacggaggcgtcgaggaggaggaggaggaggacgacgatcgcgacggctcggggccggattcacggaagcagcggaagatcgactgcggcgcggccgaggaggcggactcggcggttcagacggagacctcggcggagcggacggcggtgaagcggccgcggctggtgtggaccccacagcttcacaagaggttcgttgacgtggtggcgcacctcgggatcaagaacgcggtgccgaagacgattatgcaattgatgaacgtggaagggttgacccgcgagaatgtcgcaagccatctccagaagtatcgtctctacctgaaacggatgcagggtctctccaacgagggtccttctgcttcggatcagttatttgcgtcgacacctgtgcctcagagcttgcatgactctgctcctcccagtaaccatagcaatggtcatgggcatgggcatggccatagcaatggccgtggtcatggtcatggtcatggtcatggtcatctctctgttccgatgatgtccatgccatatccacctcccctgatgtccatgccatatccacctcccatgatgtcgggcatgccccatggccacatgggcatccccatgcctaattcctccgccacctcagcttaccatccttataatatgttgcatcaaagggattggcctcaccttgctcctaatgataaatgaacctataaggtcagccatcaccatcatatgcaaaagattcaaaggcttgattattggtagtatagctttctgagaagggaggagctgcattgatgattaccctgtaattcactcaaaaggattattgaggaagtatatgaagaagagtatatggagctagattacaatcttagtcagtagtgtgtatcctgtgggagatttacaaacttattggtacacatctctaattcctgtcacctaattgtatgacgagaattctggcttatttcttctggtctgcctagacagctgattctaaagtaaattcttaactggttctctgattcataaattatagattcctattatattgtgtaatcctgaatgtgttaactctctttttcagaaccattgaataaaagaaagaccgaacaacagacaggaaacatttattggttgctctggccttaaatgttcttctttttcttatacctcttgatcattatttcctt

SEQ ID NO: 756 - protein, 323 aa, Glycine max
  G4244,GARP domain coordinates 149-197
MGEEVKTSEYDEERVMEWEAGLPTANDLTPLSQPLIPPELASAFSILPEPHRTLLDVNRASRNTLSTLRGGGGSVHQAFSSSNNNHNYDGDGDGGVEEEEEEDDDRDGSGPDSRKQRKIDCGAAEEADSAVQTETSAERTAVKRPRLVWTPQLHKRFVDVVAHLGIKNAVPKTIMQLMNVEGLTRENVASHLQKYRLYLKRMQGLSNEGPSASDQLFASTPVPQSLHDSAPPSNHSNGHGHGHGHSNGRGHGHGHGHGHLSVPMMSMPYPPPLMSMPYPPPMMSGMPHGHMGIPMPNSSATSAYHPYNMLHQRDWPHLAPNDK

SEQ ID NO: 757 - DNA, 1128 bp, Solanum lycopersicum
  G4245,family:GARP
cttcattcaacggcatctctctcaaattcgccggaatatactccaccagcggaagaagattgtagtacttgcaaatactgttaccatgggtgaagaagtgagcctgaccgactatgaatcaagcggtggtaacgatgacagacttctctgggaaattggacttcccgatgtcgatgatctcacaccgttgaatatgcagttgattccgtcggaacttgctgctgcgttcagaatttcgccggaattgtcaaagacgatgaccgatgtaaatcgtgcttcgcagaatacgttttcttctctccagagatggcactcacaggatatggcttcgatgaataactctaatttcaagacgtttagctatgagaggagtagagaagagactgttactgaaagagatgaaacggatctgataagagagggatccgactcgaggaagctccggcgggttgaatccggaggcactgaggaggctgattcatctctgtgtaacgagaattttgcggatgattcgtctgctaagactctgaaacggcccagacttgtttggacgccgcagttacacaagcgctttattgaagtagtggcgcacttaggtatcaaaggggctgtgccgaaaacaattatgcagcttatgaatgtggaaggattgacgagagagaacgtagcaggtcatttacagaaatacagattgtatacgaagagaatgcagccgaacgagggtccttcttcgtctgatcatttgttgacttccacaccggctacagagattatgcgtgagtccagtgagagtggtcacctccgcaatactaatggccacatggcaatgccaactctgatgccgtaccaacaacaaatggtggcgatgccaatgatggggatgccaaatggaggacatgtaggcatgcctgttggttacgggggtggaccgccacttgggtttcatcatcactataatgtggtgcaacagcgggattggtctggaaataattttggttactatcatcctgttgcttctaatgataagtagctccacaagctgggacctggatgatgtcatttgatcgtggaggaatcatggcaggttcatgaagtgttgttctctggtaaaatgtgggacaaatatga

SEQ ID NO: 758 - protein, 314 aa, Solanum lycopersicum
  G4245,GARP domain coordinates 155-203
MGEEVSLTDYESSGGNDDRLLWEIGLPDVDDLTPLNMQLIPSELAAAFRISPELSKTMTDVNRASQNTFSSLQRWHSQDMASMNNSNFKTFSYERSREETVTERDETDLIREGSDSRKLRRVESGGTEEADSSLCNENFADDSSAKTLKRPRLVWTPQLHKRFIEVVAHLGIKGAVPKTIMQLMNVEGLTRENVAGHLQKYRLYTKRMQPNEGPSSSDHLLTSTPATEIMRESSESGHLRNTNGHMAMPTLMPYQQQMVAMPMMGMPNGGHVGMPVGYGGGPPLGFHHHYNVVQQRDWSGNNFGYYHPVASNDK

SEQ ID NO: 759 - DNA, 1069 bp, Zea mays
  G4272,family:CAAT
ttgggtacctcgaggccggccgggagagactcgccaaatttccctccctcctcctagccttctcgtcgctcctgttcttctcgcatcctgctctcccatccccatccccagcccaggtggtgtcccctgtcgcgttgatgcatgctccctcggcggtggccttgagctgaggcggcggagcgatgccggactcggacaacgactccggcgggccgagcaacgccgggggcgagctgtcgtcgccgcgggagcaggaccggttcctgcccatcgccaacgtgagccggatcatgaagaaggcgctcccggccaacgccaagatcagcaaggacgccaaggagacggtgcaggagtgcgtgtccgagttcatctccttcatcaccggcgaggcctccgacaagtgccagcgcgagaagcgcaagaccatcaacggcgacgacctgctgtgggccatgaccacgctcggcttcgaggactacgtcgagccgctcaagcactacctgcacaagttccgcgagatcgagggcgagagggccgccgcgtccgccggcgcctcgggctcgcagcagcagggcgagctgcccagaggcgccgccaatgccgccgggtacgccgggtacggcgcgcctggctccggcggcatgatgatgatgatgatggggcagcccatgtacggcggctcgcagccgcagcaacagccgccgcagcctcagccgccacagcagcagcagcagcaacatcaacagcatcacatggcaatgggaggcagaggaggattcggccaacaaggcggcggcggtggctcctcgtcgtcgtcagggcttggccggcaagacagggcgtgagttgcgacgatacgttcagaatcagaatcgctgatactcctacgtagaattatacctacctaattgatgacaccgcaccgcacctcgttgtgctgcctgtccttgtacgtttactaattactgctgcctgtatgtaaatcaaaatctgaggctcccatttcgaaacggacggtgaactactcttcccgtttcgtttcatacgagaatcgaactcgttttcaatt

SEQ ID NO: 760 - protein, 220 aa, Zea mays
  G4272,CAAT domain coordinates 22-118
MPDSDNDSGGPSNAGGELSSPREQDRFLPIANVSRIMKKALPANAKISKDAKETVQECVSEFISFITGEASDKCQREKRKTINGDDLLWAMTTLGFEDYVEPLKHYLHKFREIEGERAAASAGASGSQQQGELPRGAANAAGYAGYGAPGSGGMMMMMMGQPMYGGSQPQQQPPQPQPPQQQQQQHQQHHMAMGGRGGFGQQGGGGGSSSSSGLGRQDRA

SEQ ID NO: 761 - DNA, 543 bp, Zea mays
  G4276,family:CAAT
ctcctcttctccagcgtccgatccccgtttcccacgaatcccactctactcctccatctgcggcctcctccattctcctgcccccttctctctcctccttgcttccccgcgcgcacgtttttacaagggtttcggcggaggcgaccggtcgccgacgatggcggacgacagcggcagccacgagggcggcggcggcggcggcgacgacgtccgggagcaggacatgttcttgcctattaccaacatcacccggatcatgaagaaggccgtcccggccaatgccaagatcactaaggacgctaaggagataatgcagtactgcgtctccgagttcatattctttgtgacgagcgaggcgagggagaaaagcaaaaaggaggagcgtaagagaatcaacgtggacgatttgctctggtcagtggatacggcaggattcgagtacgtggagcttctcaggatttgcctacaaaagtacagagagacggggaagtgcacggtgtacacgacgtgatcaggttattaacctgtaacaccttaatgaga

SEQ ID NO: 762 - protein, 117 aa, Zea mays
  G4276,CAAT domain coordinates 19-108
MADDSGSHEGGGGGGDDVREQDMFLPITNITRIMKKAVPANAKITKDAKEIMQYCVSEFIFFVTSEAREKSKKEERKRINVDDLLWSVDTAGFEYVELLRICLQKYRETGKCTVYTT

SEQ ID NO: 763 - DNA, 1379 bp, Arabidopsis thaliana
  G428,family:HB
ttacttttgtgtttcttcatattcttcagaagcaagcacaaggctagggatcgaagaagcggcgatcactgatcgtatctcactacgatcacattaatggatagaatgtgtggtttccgctcgacggaagactattcggagaaagcgacgttgatgatgccgtccgattatcagtctttgatttgttcaaccaccggagacaatcaaagactgtttggatccgacgaactcgctaccgctttgtcctcggagttgcttccgcgtattcgaaaagctgaggataatttctctcttagtgtcatcaaatccaaaatcgcttctcatcctttgtatcctcgcttactccaaacctacatcgattgccaaaaggtgggagcgcctatggaaatagcgtgtatattggaagagattcagcgagagaaccatgtgtacaagagagatgttgctccattatcttgctttggagctgatcctgagcttgatgaattcatggaaacctactgtgatatattggttaaatacaaaaccgatcttgcgaggccgttcgacgaggctacaactttcataaacaagattgaaatgcagcttcagaacttgtgcactggtccagcgtctgctacagctctttcagatgatggtgcggtttcatctgacgaggaactgagagaagatgatgacatagcagcggatgacagccaacaaagaagcaatgaccgcgatctgaaggaccagctactacgcaaatttggtagccatatcagttcattgaaactcgagttctctaaaaagaagaagaaagggaagctaccaagagaagcaagacaagcgttgctcgattggtggaatgttcataataaatggccttaccctactgaaggcgacaaaatagctctggctgaagaaacaggtttggatcaaaaacaaatcaacaattggtttataaaccaaaggaaacgccattggaagccttcggagaacatgccgtttgatatgatggacgattctaatgaaacattctttaccgaggaatgaaaagagagacatgggattgtgcattgtataatttttacactgttttcccaagaaaagaaaacagtaaaaagcttttggtaaatgggacatcatcgcgaatgaatggaaccagttagccaaaacggtcaagggcgtggcgtaacgagacattgtattggaaatagtggcaatattatgtcactaatcttccaatggtccaaaatgatagatttcttatttgtattgaaccttacttagatagctgatgtgtcaactaaataatttattttcatccttatactacttgtatcaatgtctctaattgatcaattgttgcttgctattcaaaaaaaaaaaaaaaaaaaaaa

SEQ ID NO: 764 - protein, 311 aa, Arabidopsis thaliana
  G428,HB domain coordinates 229-292
MDRMCGFRSTEDYSEKATLMMPSDYQSLICSTTGDNQRLFGSDELATALSSELLPRIRKAEDNFSLSVIKSKIASHPLYPRLLQTYIDCQKVGAPMEIACILEEIQRENHVYKRDVAPLSCFGADPELDEFMETYCDILVKYKTDLARPFDEATTFINKIEMQLQNLCTGPASATALSDDGAVSSDEELREDDDIAADDSQQRSNDRDLKDQLLRKFGSHISSLKLEFSKKKKKGKLPREARQALLDWWNVHNKWPYPTEGDKIALAEETGLDQKQINNWFINQRKRHWKPSENMPFDMMDDSNETFFTEE

SEQ ID NO: 765 - DNA, 1232 bp, Zea mays
  G4283,family:AP2
ctcgtctgtctctccttgcctgtgcgcttcggttattagctagctagcttgggtctagtctagtgtaactcccggccgccatctttgctgtacttcgttcgtccatgtcgcgctcgcgcacggtgcggatcttctgggacgatcctgacctgaccgattcctccggcgacgacgagggctgcggagcccggagggtcggcagaatggtgagggagctggcaccagcaccagcaccggcaccagcggctcttcccgtgccggatcagtgcaacgccggggacggcgaccgcgggaggaaggccggcgtcgctggtcccggcgtgtgcagcggggcgcggagacgggtggccaagggcgccggtggcccggcgagcaccaagttccgcggcgtgcggaggaggccgtggggcaagttcgcggcggagatccgcgacccgtggcgcggcgtgcgcgtctggctcggcaccttcgacaccgcggaggaggccgcgcgcgtctacgacaccgccgccgtccagctccgcggggccaacgccaccaccaacttcgccgcgtccgccgccactaacagcggctccggggccggggccgggcaggacccggcgacgacaccggcagcgggctacgagtccggcgcggagtcgtcgccgacgtccgtgctccgcaaggtcccctccctgtcctccctcgccgaggacgactccgacgcgccggccgccgagcgccgcagcctggccgtcctcgaggaggaggagctgggcgagttcgtgccgttcgaggacgcgcccgtctacgccaccagcggcttctgggacttcgagcccgacgcggggttcctctacgccgagccgtcgtcgccggaggcgtcgtggaatgccgccgccgccgtcgccgagcccgcctcgtctgacgacgcgcccagctgggccgcgtcgccggtgcaggagaacgactacttccaggacctgcgcgacctcttcccgctcaaccggcttcccgcgattttctgaacaggtggacggggaacgccggaaccgggaacggcgccgctggttcgtctaccgggatgttattttggacgtcgagagtgcgctgtgtctgtgtctgtgtctgtgtcgtgcctacgcgcaccgtgtacttgtacgcctttccccacgccgtttttgttactatcttcgagtcgatgagaaatgtggaaatatgctgccgaacgatgagcacgtagagttttg

SEQ ID NO: 766 - protein, 301 aa, Zea mays
  G4283,AP2 domain coordinates 90-152
MSRSRTVRIFWDDPDLTDSSGDDEGCGARRVGRMVRELAPAPAPAPAALPVPDQCNAGDGDRGRKAGVAGPGVCSGARRRVAKGAGGPASTKFRGVRRRPWGKFAAEIRDPWRGVRVWLGTFDTAEEAARVYDTAAVQLRGANATTNFAASAATNSGSGAGAGQDPATTPAAGYESGAESSPTSVLRKVPSLSSLAEDDSDAPAAERRSLAVLEEEELGEFVPFEDAPVYATSGFWDFEPDAGFLYAEPSSPEASWNAAAAVAEPASSDDAPSWAASPVQENDYFQDLRDLFPLNRLPAIF

SEQ ID NO: 767 - DNA, 1179 bp, Zea mays
  G4284,family:AP2
acccctcactcagcccgtccccttttcccccattgggtccccggaggccggccggggtcttcccgcttccagcgcacccccatcttgagtctcgccgccgcaagcttgtgtaaggtgtaaccctaaccctaaaacacttaccttcgcctccagcaccacgcttccatggaggggcgcggaggctaagtatagccaacctctacaccatatccccatggattgagcggattcccaaggcatgggtacaaaccctcacctgcaagagctggccgcttcggcggtggcggcttctgaaccaccaccgcgggcgcgcgtggtgcggatcctagtgcacgatgctgacgccaccgattcgtcctccagcgaggatgaggcaccgccacttcttcctcggcggaggtcgaggggtggtagcagcagcctgagcgtgaggcgccgtgttatggaaccggctggggcaagctcggccgttcggttccgtggcgtccgtcgtaggccgtgggggcgctgggctgcggagatccgcgacccgcacaaccgccgcagactgtggctcggcaccttcgacaccgctgaggaggctgccaacgcctacgacgctgcgaacatccgcttccgcggtgtcagcgccactaccaacttccctgcggcccgctactcgccccctccaaagccagcgaagcctatcatctcgctgactcctgaacccggaaaggtgatcaccttgccaccggtacctgtgaagccaaccttccctgttcaggtgaaggaagtgggtgggagctggggcggcctggtcaagggagctaggtcggaggtcaaggcgtttgcaccgaagccagtatggaagatgatccccagggtgcaccagaagtttccgggttgtgccgatggctctggcctgcgtgccgtccatgctgcctccatctacgtggaggaggttggcggtggctgatggtccaagtatctgcaattactatcgctagaggttttattgtctatctccatggcatcattataacctggtactgtattattttggttagtgttaaactgttgatgtggaaacctatgactcttgctgtgttatgatcggtggtaatataatgtgtatatggtgacatttggtaataaaaaaaaaaaaaaaaaaaaaaaaaaaaaaaaaaaaaaagaaaaaaa

SEQ ID NO: 768 - protein, 238 aa, Zea mays
  G4284,AP2 domain coordinates 77-139
MGTNPHLQELAASAVAASEPPPRARVVRILVHDADATDSSSSEDEAPPLLPRRRSRGGSSSLSVRRRVMEPAGASSAVRFRGVRRRPWGRWAAEIRDPHNRRRLWLGTFDTAEEAANAYDAANIRFRGVSATTNFPAARYSPPPKPAKPIISLTPEPGKVITLPPVPVKPTFPVQVKEVGGSWGGLVKGARSEVKAFAPKPVWKMIPRVHQKFPGCADGSGLRAVHAASIYVEEVGGG

SEQ ID NO: 769 - DNA, 1813 bp, Glycine max
  G4285,family:AP2
cccacgcgtccgctctacctcccactctcacaatccctctctctctttctatcttcactccggctattacttattagcataactctcttttgctctgccttcccgccaaaacccttctctgtgatcaccaaggattcaaggttgagcgttgaattcttgaaccttgttgttgttgttgttgttgatgtgagtggagtgagatttcacttgaagcgcatccaaagttggccatattctcttctctctttctctctctctcttggaatatatctctagagacgaaaagcaaaagttgttacccataaaacatcttggtttttctttctgcttcaccaccaccaaaagtgtttccaaacgtctcaattcccccccagcatatacatctacttgtccacttttcccccataccctctaaattcttctcttactctttaaaccccacccttcatgcactccagccaacaccatcacacaacaaccttccctcttccctctctcactcaaacaaaaacatccttaaccactccaaaaacactcttttaggcatgtccgtacacgcaaaactgaagcaccaccccatgaacctagcatccccaagttcccattttgaggacgacccaccatgcaaaaccaagaccaaaacccaaaggaggctccttcggatcataatcaccgaccatgacgccaccgattctgactcctccgacgaagaacaacagcagcagcaacaaaaaacaagaagagtgaacagagaaatcacccaaatcaacatgcaacttcctctatcacataatagttccttttccccttcatcttcttattactcttcagcttccacctcatcggaacaaaacctaaagtgcaagagacccaacaaaaagccgccaccttcctccgccgaggcccgccgccgcaacaagttccgcggcgtccggcagcggccgtgggggcggtgggcggccgagatccgcgaccccacccgccggaaacgcctctggctcggaaccttcgacacggcggaggaagccgccacggagtacgacagagccgccgtcaaactcaagggccccaacgccgtcaccaacttccccctcgcgccggaggctacggcgcagtctccaccgctcgccgcggacaacctcagctccgacggcggcgcgtcgtactcggacctagtggcctcgccgacgtccgtcttggcctacgagtgcgactcgacgccgttcgacggtttccgttatctcgacgttgacgcgttcgggttccacatcgacgcgccgttaagtttgccggaagttaacgttaacgttgcgctgacgtgtcatcacgggaagaagcaggaggaggcgtttgatgaattcgatctggacgagttcatgacgtggccttactagtgataaaaatctcagggacagtttggtaaattacaccctgtttgcattgcggaagtgtgagttggaaatcccgaaattgcccccctccccctctcgttgtccaagtttgaaattttgtcgtactcgttggagctttggaagagtgtagagttgttggtacaaaattttatgtagtcgcattttactaccacctgaaacggcgattctttgtgtcgtatttggtagagtttaatttgtagttattatcatgaaaagaagaaaaaaaaaatgaagtgtcaaaactagtgagtgagaaaaggagaaaaggaaagatggtgttatttgagaaggaaggactatattgtaatttcggtatataaattttgataattatttaaagaaactttggtattgtctatatatagatcatgggttaactt

SEQ ID NO: 770 - protein, 282 aa, Glycine max
  G4285,AP2 domain coordinates 123-185
MSVHAKLKHHPMNLASPSSHFEDDPPCKTKTKTQRRLLRIIITDHDATDSDSSDEEQQQQQQKTRRVNREITQINMQLPLSHNSSFSPSSSYYSSASTSSEQNLKCKRPNKKPPPSSAEARRRNKFRGVRQRPWGRWAAEIRDPTRRKRLWLGTFDTAEEAATEYDRAAVKLKGPNAVTNFPLAPEATAQSPPLAADNLSSDGGASYSDLVASPTSVLAYECDSTPFDGFRYLDVDAFGFHIDAPLSLPEVNVNVALTCHHGKKQEEAFDEFDLDEFMTWPY

SEQ ID NO: 771 - DNA, 1304 bp, Glycine max
  G4286,family:AP2
gaacatctctgtctctctctcttccttaccccttgcaataaccaccctaaaccctcccatcttctcacacctagcaaattactgccatcaacttattttccttcatcacccaccactctctatttctcacttgcttcatgcaattaaaactaccactaccacctttttccatttccttactcttttcttcaataaaatgagtgacacacaccaaactttcatgtccgtacaaccacccctgaatctccaccacccctttaacccacaagcctcaagctcaaattttgacggcgacccaccatgcaaaaccgccgcaaaaaccaaacctccgcgcaagaagctactccgggtaattctcaccgaccatgacgccaccgattctgactcctccggtgacgacgacgacccaaaaaacccaccgaaacacaaaaaggtgaaaagacaaatcacccacatcaccataaaccttccctctttctcagaagccccaactccagcaccaataccaacaccttcttcgtcttcttctattgatccgacccgtttaaccctacccaagaaacgacccgccgtgcctcgccgccgtagcaagttccgcggggtccggcagcggccatggggacggtggaccgcagaaatccgtgacccgaatcagagaaaacgggtctggctcggaacgttcgacacggcggaggaagccgccgccgtgtacgacgacgccgccttgaagctcaagggccccaacgccgtcactaacttccccctctccgccgccggaaaaacggaacatgataccgcgccgccggaggcggctttctccggcgaaggtttttcatctcccacttccgttctcacttactttgacggagactcgacgccactttacggtttccgttacggcgaggtcgacgcgttcgggtttgacatcgatgcgccgtttagtttgacagacgttaacttaggggtgctgagtcagcggttcgggaaggaagatttccgcgaggttgacccggacgagctcttgacgtggccgagttaaggggcgtatttatcatttcgaaaaaaatacagggaatgtttagtaattctaatgaagtttttttgtcgtattctgcattgaattccgaaactaccctcgtgactaagtttttgtgcagcttagtagagtgttagagagcaatagagtgatccaagtagtagtagagaattttgtcctatgttaatttgtgtaattaattgtattgttatggagaaagaggatatgatggaaagtattagaatgattctcttgtagtttcttatat

SEQ ID NO: 772 - protein, 280 aa, Glycine max
  G4286,AP2 domain coordinates 130-192
MSDTHQTFMSVQPPLNLHHPFNPQASSSNFDGDPPCKTAAKTKPPRKKLLRVILTDHDATDSDSSGDDDDPKNPPKHKKVKRQITHITINLPSFSEAPTPAPIPTPSSSSSIDPTRLTLPKKRPAVPRRRSKFRGVRQRPWGRWTAEIRDPNQRKRVWLGTFDTAEEAAAVYDDAALKLKGPNAVTNFPLSAAGKTEHDTAPPEAAFSGEGFSSPTSVLTYFDGDSTPLYGFRYGEVDAFGFDIDAPFSLTDVNLGVLSQRFGKEDFREVDPDELLTWPS

SEQ ID NO: 773 - DNA, 2226 bp, Glycine max
  G4287,family:AP2
ctgaactcttgttcttctttaccgattcaacaacagctcagcagtggtagtacccatgagcctgcagaatctgcactttttttgccttggcttctattctctcctcactttgaatcggaagatatcctttccattcaaggcagcaagcagaagtttcaacgaaagtctcctctcccacacagctactatcttctcaacactattggaatcaccatcatctgaataattcccttttttctttctctttctctcacacacccccatgatgtcaaaagttgttattttctctttattcctatcatcagtcccgaccatgtcttaatatttctttctttcttctttttcaaccttttggaagatttcggtttaaccttccccttcacgattctctctccctctctccctcttattcccaaaccaagcccctatttgtgttcatttcgcgtcacattagaataagaaacgcaatatggaagacagtatcctatgcaaacacacagtgcatcacaccgttaccaagaaactcatctcccccaaaaaatcatcccaaaccaattcgacgacagagcgcagaatagtgcggatttcatacactgatccagacgcaaccgactcctccagcgacgaggaaggtttccccttcgttcgccaaagaatgaagcgctatgttaaccagattgaaatagaaaccgccgccgccgaaaaagttgttcggaaaaggcccgccggtgaggcttgccgccggccggcgaagcttcactccgggaagaagttccgcggcgtccggcagcgaccgtgggggaaatgggcggcggagattcgggatccggcgagaagagtgcgtctctggttgggaacctacgacaccgccgaagaagctgccatggtctacgacaatgccgctattcgtcttcgtggccctgacgcgttaacaaacttcgtaacgccgcctcaaagagattctccgtctccgtctccaccgccggcggcggcggagactccggcggaggtttgcgagatgaaggttgtggtcaccgaagaagcctccggctccggctacgactccagcgaggatcattgccaccacaacctctcctctccgacttcggttctccagttccgaagcaactcgagcgaagaaaattccgagtctcagcagaaagcagaacaagtgttgagagaatgcgagggtgagacagaaacgagtttgttcgaggaaacgggtgagtttttggcgctggataacatgcctttgcctgcctgggatgacgtgttcaatttcgaaacgccagagtaccctcctcttctgtttcaagaggaggagaatctgaatctacttcatcagtcccagatgttgggcgaaacggtgcagttttcctcggaggaagggttcagtgatgaaagcagtatcatgctggccgactcgctcatagatttcgacagagcctgcccttcaccatcctccttgtgccaagtggacgatttcttccaagacattttgtttgcttctgatcctctcgttctgctctgaacactcttaaaacttactaaactgtcattcgttaatcgtcaatcgtccacttcacggcttgcccaatattcatggcagatttttgcttccggtggtaaaaaaaaaatgcctagtttctatttaattaaaatactatatatatatatatatatatatatatatatatatatatatatatatagttttatttgcgtatttatttagatgttttagatgctccgttacaaatagctaacggggggatgagttgagaacttgtgagcgaagttttgtttagtttttggttatatttgtaatctttttgcttaataagtaggatcgtacgttgagacttgagaatgtaatgtatatttgtccagatgttaatctaagtgtaatggcgttcttttctttacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 774 - protein, 353 aa, Glycine max
  G4287,AP2 domain coordinates 99-161
MEDSILCKHTVHHTVTKKLISPKKSSQTNSTTERRIVRISYTDPDATDSSSDEEGFPFVRQRMKRYVNQIEIETAAAEKVVRKRPAGEACRRPAKLHSGKKFRGVRQRPWGKWAAEIRDPARRVRLWLGTYDTAEEAAMVYDNAAIRLRGPDALTNFVTPPQRDSPSPSPPPAAAETPAEVCEMKVVVTEEASGSGYDSSEDHCHHNLSSPTSVLQFRSNSSEENSESQQKAEQVLRECEGETETSLFEETGEFLALDNMPLPAWDDVFNFETPEYPPLLFQEEENLNLLHQSQMLGETVQFSSEEGFSDESSIMLADSLIDFDRACPSPSSLCQVDDFFQDILFASDPLVLL

SEQ ID NO: 775 - DNA, 1817 bp, Oryza sativa (japonica cultivar-group)
  G4288,family:AP2
aacagcaaccaacaaacacacgcgaagaggcacacatctccgccttcgtgttcctcttcttctctcctcctccccccatccatccatctatcgcaccacctcccccgaaaaaatcccaccaatacctcatcgccttcgtccccttcctcgcttccacgccaaaagtcgttcgcttttccctcccttccttcccccccgtctccttgtgggttttgggaggggtggttcctcgaggtgtaggtgggtggcgcgctggcttcttcttggccgcgagggttttaggaggtttcttgagggttttggagtggtggtggtggaggattggagttggggtctgatgcgagtggagtgatgatgatgtggcctttggagatggaggaggggtttgtggctctcaagaggacggagcatgtcgaggtgacgtccttggcggtggcggtcgaggcgacgccgtcggcgaaggggggaaaggggaaggttgtggtgggtggtggtggcgccggcggcggcgttgggccgacgagggtgagggtgttctgtgatgacttcgacgcgacggactcgtcgagcgatgaggatgaggaggaggtgaccgcgcggcggagggtgaagcgctacgtgcaggagattcggttacagcgcgcggcggcggtggccgtgccgccggtgaaggtgaagggcgaggaggtgttcccggccgcggtgtcggcgaagatggcggaggccgcgaaggcgagggtggtgttggcggctgggaggaagaggaaggccggcggggtggacggcgccgagccgcggttccgcggcgtgcggaggcggccgtgggggaagtacgcggcggagatccgcgacccgtggaggcgggtgcgggtgtggctcggcacgttcgacaccgccgaggaggccgccaaggtgtacgacacggcggccatccagctacgcggccgcgacgccaccaccaacttcaaccagtccggggactcggcaagcctcgacgtcccacccgaggtcgccgagcgcgtcccgcagccgccgggggcgtccaagaacgcctccccggccacctcctacgactccggcgaggaatcccacgccgcggcggcctccccaacctccgtcctccgttccttccctccctccgccgtcgtcgcgaccgccgacacggccaacaagaagcagccgccgccgccgcctctcgtcgtccgcgagaccgacgagtcggtcgacgtcttcggctgctccttctccgacgacggcggcttcgccggcgagctcccacctctctacaccgacttcgacctcctcgccgacttcccggagcccccgctggacttcttgtccaacctccccgtggagcccttctccctggctcccttctccagcaacaatgggtcaccggacctccacctcgacgacgccccatcgccggcggcggcacaagtggacgacttcttccaagacatcaccgacctgttccagatccccgtcgtctagtgcagcagcaagaactgtaaaacaccggattaggagactaatccggcccaattttgtttgcgttttctctttttttttttcttctttattttttcgtttttagaggagaggagagttgagttaatgattccccgtcagtctagctgcggcagaacacccaccaccgcttcgtcaggggggaaagccttgacgaggcgagagagatgagaaagtcaaaagagaggcataaaacgagatcaatgttgttggggttatggtttttttgtaaaccatcgagaaaattaagttatcggtaattagcaaatactactactagtatcatc

SEQ ID NO: 776 - protein, 380 aa, Oryza sativa (japonica cultivar-group)
  G4288,AP2 domain coordinates 147-209
MMMWPLEMEEGFVALKRTEHVEVTSLAVAVEATPSAKGGKGKVVVGGGGAGGGVGPTRVRVFCDDFDATDSSSDEDEEEVTARRRVKRYVQEIRLQRAAAVAVPPVKVKGEEVFPAAVSAKMAEAAKARVVLAAGRKRKAGGVDGAEPRFRGVRRRPWGKYAAEIRDPWRRVRVWLGTFDTAEEAAKVYDTAAIQLRGRDATTNFNQSGDSASLDVPPEVAERVPQPPGASKNASPATSYDSGEESHAAAASPTSVLRSFPPSAVVATADTANKKQPPPPPLVVRETDESVDVFGCSFSDDGGFAGELPPLYTDFDLLADFPEPPLDFLSNLPVEPFSLAPFSSNNGSPDLHLDDAPSPAAAQVDDFFQDITDLFQIPVV

SEQ ID NO: 777 - DNA, 1029 bp, Oryza sativa (japonica cultivar-group)
  G4289,family:AP2
atggtggaagttatcgtggagaagaaggcgcgaaggattgtgagggggaggtggcatgtggaggcgagcaacgaagcggcggcggcggcgccggctgttgccgcgcccgcgcccagggttgttcgggttctctgcagagaccacgacgccacggactcctccggcgacgacgatggcgaggacgacgcgccgcggcgtgctcgcctcctcgtgcacgagatccacgtcgcgcggcagccggtggccatgtcgccagcggcggcgagctccagccagagacgtcgtgtcggcccgatgaagaggacggaatcggcggtggatgcgacgatggacgcgacggcggcggcgccggagaggaagttccgcggggtgaggaagcggccgtgggggaagtacggggcggagatccgcgtgtcgcagcagagcgcgcgcgtgtggctcggcacgttcgacaccgccgaggaggccgcgcgggtgtacgaccacgccgccctccgcctgcgcgggccgtccgccacgaccaacttccccatgacgccagcggcgccgtcgcctcctccctcgcgcgccacctacgccggcgcggcgtccgggtacgacgagtccagcgacgagtcgcagctcgtcggctcgccggtctccgtgctccgcccaatgccggcgcgcgcaacggccaagaaagaggccaaggaagaagacgactccgcccccgatatcctcggcatctccgccggcgacggcttaatctccccgttcacctgcgacgtcctgaatttcccaccgcccgacgaggacatgttcggcggcggcatctccttcggcgagccgacaccgccacccatggtgttcgacgacgactgcatggcgcgcctcggccacgcccccaacgacgacgagcacccggtgacgagctcgtccttcctcgacggcgatctcggcgacctgccgtcgtggacggaggtggacggcttcttcagcgacgtcggcggcgacgacctgttcgccgccgagccgttcccggcgctctga

SEQ ID NO: 778 - protein, 342 aa, Oryza sativa (japonica cultivar-group)
  G4289,AP2 domain coordinates 118-180
MVEVIVEKKARRIVRGRWHVEASNEAAAAAPAVAAPAPRVVRVLCRDHDATDSSGDDDGEDDAPRRARLLVHEIHVARQPVAMSPAAASSSQRRRVGPMKRTESAVDATMDATAAAPERKFRGVRKRPWGKYGAEIRVSQQSARVWLGTFDTAEEAARVYDHAALRLRGPSATTNFPMTPAAPSPPPSRATYAGAASGYDESSDESQLVGSPVSVLRPMPARATAKKEAKEEDDSAPDILGISAGDGLISPFTCDVLNFPPPDEDMFGGGISFGEPTPPPMVFDDDCMARLGHAPNDDEHPVTSSSFLDGDLGDLPSWTEVDGFFSDVGGDDLFAAEPFPAL

SEQ ID NO: 779 - DNA, 968 bp, Oryza sativa (japonica cultivar-group)
  G4290,family:AP2
aagagaggagcagtaaagcactagttccacccataatcttggtacgtgccatgtcccggtcgcgcacggtgcggatcttctgggacgaccccgacttgacagactcgtccggcgaggacgaggggtgcggcggccggagggtggggagcatggtgcgggagctgccgcctgcccagatgcccgtggcgcaggcagccgctgctgctgctttgccggagcagtgcagcggcggggacggtgatatgggaagaagggtcgttggtggcggatgcactgtgggtgtgggacggaggaggttgacgaaggacggaggggctggcgcgccgagcaccaagttccgcggcgtcaggcggagcccgtggggcaagttcgcggcggagatccgcgacccgtggcgcggcgtgcgcgtctggctcggcaccttcgacaccgccgaggcggccgcgcgcgtgtacgacaacgcggccatccagctccgcggccccagcgccaccaccaacttctccgcctccaccaactccgcgggtgcacaagatcgggtggcagttggctacgagtccggcgcggagtcctcgccggcggtgtcgtccccgacgtctgtgctccgcaaggtcccgtccctgtgctccctggccgaggacaaggacgactatgaggccggcccctgcgagcccgcaactgccgccggttccaacctcaccgttctcgaggaggaggagctcggcgagttcgtgccgttcgaggacgcgccggtctacggcggcagcagcttctgggacttcgagcccgagtccggcttcctgtacgccgagccgtcgtcgcctgagacgccgtgggacgccggcgccacgtcctccggcgaggcccaagactacttccaggacttgcgcgacctgttcccgctcaacccgcttcccgcaattttttaaaaacgggatgggcttcttcaatcacggaaaaaaaaaaaa

SEQ ID NO: 780 - protein, 292 aa, Oryza sativa (japonica cultivar-group)
  G4290,AP2 domain coordinates 93-155
MSRSRTVRIFWDDPDLTDSSGEDEGCGGRRVGSMVRELPPAQMPVAQAAAAAALPEQCSGGDGDMGRRVVGGGCTVGVGRRRLTKDGGAGAPSTKFRGVRRSPWGKFAAEIRDPWRGVRVWLGTFDTAEAAARVYDNAAIQLRGPSATTNFSASTNSAGAQDRVAVGYESGAESSPAVSSPTSVLRKVPSLCSLAEDKDDYEAGPCEPATAAGSNLTVLEEEELGEFVPFEDAPVYGGSSFWDFEPESGFLYAEPSSPETPWDAGATSSGEAQDYFQDLRDLFPLNPLPAIF

SEQ ID NO: 781 - DNA, 1218 bp, Oryza sativa (japonica cultivar-group)
  G4291,family:AP2
ggtcttcccgcttccattgcaaccccaccgcgccgcacgccgccgcatcgatcggaaccaaaccctaaccctaaaccctagcccccccacctcgccttccaccccccacgctcccatggcggggcgcggaggctacgcgtagccacatcgatcgaacaccctgtatggattgaggtgggtttcccgaggcatgggtacaaaccctagcctgcacgagctggcggcgggggcggcgccgcggggacgcgtggtgcgtatcctcgtgcgcgacgccgacgccaccgactcgtcctccagcgaggacgaggcggttgcggtggcgcagcctcggccgcggcggaggggtaaggtgggtggtggtggtggtggtggtgggggcgtgaagcgccgcgtgatggaggcgggggcgggggaggcgaggccgaccgcgcggttccgcggcgtgcggcagcggccgtgggggaggttcgcggcggagatccgcgaccctcacctccgccgccgcctgtggctcggcaccttcgacaccgccgaggaggccgccgccgcatacgacgccgccagcgtccgcctccgcggttccagcgccgccaccaacttcgcctccgtccgctgctgctcgctgccgccggagctacccaagccaactatttcaccgcctgaagcagctgtgaggccaatcaccttgccaattgggacagctaagccgacccttcttccacgggtgaaggaggaaggtgagagctgtggcggtcgggtcaaggaggaggccagtagctgtgaggtccaggtgcttgctccggagccaatgtggacgatgatttcaggcaagcgtaaggagcgatcgggctgtggaacccgtgtccgtgccttccatgctgtgtccgcctgtgtggaagaagttggcggggcctgagggtccaattatccgtaattactatcgttagcagctttattgttatgcatagcatcattggaaacttggtattgtgtaattttggttagtattgaacttatgatgtgaagatgactctgcatgtgacctgatttggtaaggttatgatgtgtatatacggtatggttgctgatatatgtgatgcagtatggtaggcttcgataaggtgttgtggaattagtatgttgcatctaaataagacctttgatgtgagatatagacatgttcttcgattagaataaaatatagtagaaaattattgc

SEQ ID NO: 782 - protein, 241 aa, Oryza sativa (japonica cultivar-group)
  G4291,AP2 domain coordinates 79-141
MGTNPSLHELAAGAAPRGRVVRILVRDADATDSSSSEDEAVAVAQPRPRRRGKVGGGGGGGGGVKRRVMEAGAGEARPTARFRGVRQRPWGRFAAEIRDPHLRRRLWLGTFDTAEEAAAAYDAASVRLRGSSAATNFASVRCCSLPPELPKPTISPPEAAVRPITLPIGTAKPTLLPRVKEEGESCGGRVKEEASSCEVQVLAPEPMWTMISGKRKERSGCGTRVRAFHAVSACVEEVGGA

SEQ ID NO: 783 - DNA, 1206 bp, Oryza sativa (japonica cultivar-group)
  G4292,family:AP2
cttggatgagatttggggtgacgtcctcgtagcgggcggtggatatgcgtcctccggcgatgtctccggcggactccctcgccgccggcaggagccgccgtgttggggctagcatgcctcggcccaagcgtgtccgcgtctacttcgtggacgccgacgccacggacaccgactcctccggggacgagcgctccaggccgcgcgtccgggaggtcatcgacatcgacgtcggggccgcctcgccggcgccggcgccgaagcacccgaggcggctggttccgacggcgacggcggcgctggcccggcggcgcgcggggatggcggcgagccggcggttccgcggcgtgcggcggcggccgtggggcaggttctcggcggagatccgcgacccgagcctgcagaagcggctgtggctcggcaccttcgacaccgccgaggaggccgccgccgtgtacgacgacgccgcgctccgcatcaagggctcccacgccgtcaccaacttcccctccgactccgacaccccctccgccaaggccaagcagatgaagctccaccctcgccgacacaccaccccggacaagaccccaagctcttccaccgccgccgccgccaaggcctccgtccccgatccgacgccggcgccaccggaggaggaccgcgccaacgacagctcgttcaacccgttcgcgtcgccgacctccgtgctccggtacgcggcagcggacgaggtgaccgcgccatccttcgagcacctcctcgtcgagctgggcgacctctcggcgccgccgccttccaccaaggcggcggagttcgactggctgccgtggtgggaaggggaggacttcgtgacggcggggctgacggcgagcaacgccgtcagcgtgaaatgacgccgctgcccccctccacccatttcgcgctctcggggcgggaaaagttggcgggagacggcgcatcagcagcaaccagcagcaatgttattactactagtattatattaattttattattattatttcgtggcagtaaaaaaaaacccagcggagtttgtactccctagtgaagtgagcagtagtagtaaatggtggtggcgtggggcccaaggcgggcgctcgctttgtgcgtgagctgccttgaatggcacgtctcccgcgtggaaacggaacagtgtaattgcgtggcagatatttattttttctttctttt

SEQ ID NO: 784 - protein, 281 aa, Oryza sativa (japonica cultivar-group)
  G4292,AP2 domain coordinates 95-157
MRPPAMSPADSLAAGRSRRVGASMPRPKRVRVYFVDADATDTDSSGDERSRPRVREVIDIDVGAASPAPAPKHPRRLVPTATAALARRRAGMAASRRFRGVRRRPWGRFSAEIRDPSLQKRLWLGTFDTAEEAAAVYDDAALRIKGSHAVTNFPSDSDTPSAKAKQMKLHPRRHTTPDKTPSSSTAAAAKASVPDPTPAPPEEDRANDSSFNPFASPTSVLRYAAADEVTAPSFEHLLVELGDLSAPPPSTKAAEFDWLPWWEGEDFVTAGLTASNAVSVK

SEQ ID NO: 785 - DNA, 882 bp, Oryza sativa (japonica cultivar-group)
  G4293,family:AP2
atgggtggggggaggaggaggaggagcgcggcgatggcgatggagggggaggtggagggtggtgggaggaggcgggtggtgcggatcatcttccgcgacgaggacgcgacggattcgtcgagcagtgaggaggagggggagggggaggtggtggcggcgaggcgggtggtggtgaagcggacgcggctgcggtgccaggaggtggagaggaggttcaccggcgtgcggcggcggccgtgggggaggtgggcggcggagatccgcgaccccaaggagaacgggcggcgcgtgtggctcggcaccttcgacaccgccgaggccgccgccgccgcctacgacgacgcctgcctccgcctccgcggccccggcgccgccctcaacctcccctcccgccgctgcgtcgctcccgctccgcctccaccgcctcctccgccgccgccgacggccgaggagaagaagctgctgctgttcccgccgccgctgcctccgaggaagaaggcgatgctattcccgctgccgctgccgccgaggaagaagccgctgctgtacccgccgccgctgccgccgaagaagaagccgctaccaccaccatcaccaccgccacagccgccgctgccggagaaggagaacaccccgctcccgccgctgctgctgcctccaaagaagaagccgcttccgccgccgtcaccgacagcggcagcgaaggaggagcccatcgagctcgagcatgcggcgccgccgccgcctttcgtgccccggccggtgtggcccctcctggccagcggcggcggcgggaagcggaagaagcagtcgggctgcggcggccgcatccccgccctcaacaccgccgccgccgccgtcgaggagaccggccgcgcctga

SEQ ID NO: 786 - protein, 293 aa, Oryza sativa (japonica cultivar-group)
  G4293,AP2 domain coordinates 69-132
MGGGRRRRSAAMAMEGEVEGGGRRRVVRIIFRDEDATDSSSSEEEGEGEVVAARRVVVKRTRLRCQEVERRFTGVRRRPWGRWAAEIRDPKENGRRVWLGTFDTAEAAAAAYDDACLRLRGPGAALNLPSRRCVAPAPPPPPPPPPPTAEEKKLLLFPPPLPPRKKAMLFPLPLPPRKKPLLYPPPLPPKKKPLPPPSPPPQPPLPEKENTPLPPLLLPPKKKPLPPPSPTAAAKEEPIELEHAAPPPPFVPRPVWPLLASGGGGKRKKQSGCGGRIPALNTAAAAVEETGRA

SEQ ID NO: 787 - DNA, 732 bp, Oryza sativa (japonica cultivar-group)
  G4294,family:AP2
atgggacagtcgaagaagaagttccgcggagtcaggcagcgccactggggctcctgggtctccgagatcaggcaccctctccttaagaggagggtgtggctgggtacctttgagacggcggaggaggcggcgcgggcgtacgacgaggccgccatcctgatgagcggccgcaacgccaagaccaacttcccagtcgcgaggaacgccacgggggagctcacaccggcggctgcggtggcagggcgggatggccgtgtcggcggcggcagcggcagctcgtcctcaatgacggccaacggcggcgggaacagcctgtctcagatcctcagcgccaagctccgcaagtgctgcaagacgccgtcgccgtcgctcacctgcctccgccttgacccggagaagtcccacattggcgtctggcagaagcgcgccggcgcacgcgctgactccagctgggtcatgaccgtcgagctcaacaaggacacggccgtgtcgtcggctgcgacggtggcagcagcaacagcagtgtcgtccagcgaccagccgactccgagtgacagcacagtcacaacgacgtccacgtccaccacgggctcgccgtcgccaccacctccggcaatggacgacgaggagaggatcgcgctgcagatgatcgaggagctgctgggcaggagcggcccgggctcgccgtcacatgggctgctgcacggtggtgaaggtagcctcgtcatctga

SEQ ID NO: 788 - protein, 243 aa, Oryza sativa (japonica cultivar-group)
  G4294,AP2 domain coordinates 5-72
MGQSKKKFRGVRQRHWGSWVSEIRHPLLKRRVWLGTFETAEEAARAYDEAAILMSGRNAKTNFPVARNATGELTPAAAVAGRDGRVGGGSGSSSSMTANGGGNSLSQILSAKLRKCCKTPSPSLTCLRLDPEKSHIGVWQKRAGARADSSWVMTVELNKDTAVSSAATVAAATAVSSSDQPTPSDSTVTTTSTSTTGSPSPPPPAMDDEERIALQMIEELLGRSGPGSPSHGLLHGGEGSLVI

SEQ ID NO: 789 - DNA, 909 bp, Arabidopsis thaliana
  G43,family:AP2
ctcctgtcttgtctaaagaaaaaagagagaggaagaaatggagacttttgaggaaagctctgatttggatgttatacagaaacatctatttgaagacttgatgatccctgatggtttcattgaagattttgtctttgatgatactgcttttgtctccggactctggtctctagaaccctttaacccagttccgaaactggaacctagttcacctgttcttgatccagattcctatgtccaagagattctgcaaatggaagcagaatcatcatcatcatcatcaacaacaacgtcacctgaggttgagactgtctcaaaccggaaaaaaacaaagaggtttgaagaaacgagacattacagaggcgtgagaaggaggccatgggggaaatttgcagcagagattcgagatccggcaaagaaaggatccaggatttggttaggcacttttgagagtgatattgatgctgcaagggcttacgactatgcagcttttaagctcaggggaagaaaagctgttctcaactttcctttggatgccggaaagtatgatgctccggtcaattcatgccgaaaaaggaggagaaccgatgtaccacagcctcaaggaacaacaacaagtacttcatcatcgtcatcaaactaatgggggaatagtgatgtttaattagtatatataggttaatatcttaagtatgtgaagcatcatgtatagagccaagaacctgttagactagtgtactgaaaagaactcttgcaaaatatgtactaaagagttcctgtaacaatggaacttctgcgttttctcttgtcttaaagagcttaaggttctagaaacaaagttcttgtcctttcggtttaaaaaaaaaaaaaaaaaaaaaaaaaaaaaaaaaaaaaaaaaaaaaaaaaaaa

SEQ ID NO: 790 - protein, 201 aa, Arabidopsis thaliana
  G43,AP2 domain coordinates 104-172
METFEESSDLDVIQKHLFEDLMIPDGFIEDFVFDDTAFVSGLWSLEPFNPVPKLEPSSPVLDPDSYVQEILQMEAESSSSSSTTTSPEVETVSNRKKTKRFEETRHYRGVRRRPWGKFAAEIRDPAKKGSRIWLGTFESDIDAARAYDYAAFKLRGRKAVLNFPLDAGKYDAPVNSCRKRRRTDVPQPQGTTTSTSSSSSN

SEQ ID NO: 791 - DNA, 703 bp, Solanum tuberosum
  G4328,family:AP2
tcttcatcttcttctaaaggaaaaaaagtcatgcaattagagaaagaaaatggcaaggatagtaatgatttgatcaaatatcgaggcgttcggaagcgtacgtggggtaaatttgcagcggagatacgtgacccaacgagacaaggcgctcgccaatggctcgggacgtttgatacggccgaggacgcggcgagggcctatgacaaggcagcatttaacctaaggggacatcttgctactttgaatttcccaaatgagtattattctaagcttaatgatccacattattataattatcgtacttcattaaatgttaatactccaagtagaagtatagagaggggaatctcatcaattggtcatcaagacaaagatatcattgagtttgagtatcttgatgaaagtgtgctagaggaacttcttggagcagaagacccaaaaaagatgataagaaagtgaggtttatatgttttgtaatttttaaattttaagttatcatcgtgtcgagatgaacctttattactggaggaaaggaaaaacgatgaattcctatatagagtatctaggaaaaaaccttcgagtttcccttcatctttgttttcttcttattcatcatcgttgtcgtttttaatttccttttttataaacatatttggtattaattaagaacttatttgtataatataatgtttgccttaagagt

SEQ ID NO: 792 - protein, 142 aa, Solanum tuberosum
  G4328,AP2 domain coordinates 13-77
MQLEKENGKDSNDLIKYRGVRKRTWGKFAAEIRDPTRQGARQWLGTFDTAEDAARAYDKAAFNLRGHLATLNFPNEYYSKLNDPHYYNYRTSLNVNTPSRSIERGISSIGHQDKDIIEFEYLDESVLEELLGAEDPKKMIRK

SEQ ID NO: 793 - DNA, 621 bp, Petunia x hybrida
  G4329,family:AP2
catggaacaagagcctagccagggaagaaacatgaaggacaacaaaaatagtggtggcggagagatcaaatatcgaggcgtccgaaggcggccgtgggggaagtttgcggcggagattcgcgactcggctcgacagggtgcacgtgtatggttagggacatataacacagctgaagaagctgcaagagcttatgacagggcagcttattccatgaggggtcatctagctatacttaattttcctgaagaatataatttacctagtagctcttctcatttctatactggttcttcttcatcatcaaggcaagttcttgaatttgaatgcttggatgattcgttgctggaggaacttcttgattgtgatgaggaatccaacaagaggaaataaagatcctactgtaatttcactttcaaaaaattgtgatttattgccttaaaatcatctaattcttgggatggggttgtgactttttttctttttattatttcaccttttttcctttttctttctttgggtttcggtttttgaacggagctatttgcactctgctgatgcaatgcttgtaacactattgtactatttggtgatgaacatgctgaagggtcaagaagaaaggc

SEQ ID NO: 794 - protein, 129 aa, Petunia x hybrida
  G4329,AP2 domain coordinates 20-84
MEQEPSQGRNMKDNKNSGGGEIKYRGVRRRPWGKFAAEIRDSARQGARVWLGTYNTAEEAARAYDRAAYSMRGHLAILNFPEEYNLPSSSSHFYTGSSSSSRQVLEFECLDDSLLEELLDCDEESNKRK

SEQ ID NO: 795 - DNA, 570 bp, Populus trichocarpa x Populus nigra
  G4330,family:AP2
agacgttcgttactgggctcctcttcacttcaaacacagaatggaaacacatcaaggagagaagaacacaaagaagcaagagaaaggaaggggggagaatgcgtataggggaattcgcaggcgaccttggggtaagtttgctgccgagatacgtgacccaacaaagaatggggcacgtcgttggctaggaacatatgacacggcggaggaggcggctcgggcatatgaccgagctgcttttgccttccggggtcatttagccattctcaatttcccgaatgaataccaacatcaggatccaagctctgccatgtcatttgcttcttcatcttcattctccactgccaatcctgtgaattatggccatgaagtttcctctcctggcggacaagaagttatagagttcgagtatttggataacaaattgttggaggagttgctgggaacgaatgatcccagcaggcagcattaggcccattgatgaatgtggattgtcactttgtcatgtcacccttcaatgcaattcttttattttgtccgttgtttgaatccaaaaaaaaaaaaaaaaaa

SEQ ID NO: 796 - protein, 143 aa, Populus trichocarpa x Populus nigra
  G4330,AP2 domain coordinates 18-82
METHQGEKNTKKQEKGRGENAYRGIRRRPWGKFAAEIRDPTKNGARRWLGTYDTAEEAARAYDRAAFAFRGHLAILNFPNEYQHQDPSSAMSFASSSSFSTANPVNYGHEVSSPGGQEVIEFEYLDNKLLEELLGTNDPSRQH

SEQ ID NO: 797 - DNA, 642 bp, Glycine max
  G4371,family:HB
atggcggttttaccaagtagctcctcaagcttggaattgaccatatctgtacctggttttgcttcttcaccaacccttcttccctcatcatctgtgaaagaattggacataaatcaagtacctcttgaagaagattggatggcatcaaacatggaagatgaagaagaaagcagcaatggagaacctcctcgaaagaaactccgtctcacaaaggaacaatctcttctccttgaagaaagctttagacaaaaccacacgttgaacccaaagcagaaagagtctttggcaatgcaactgaagctgcgaccaaggcaagtggaggtgtggtttcagaaccgtagggccaggagcaagctgaagcagacagagatggagtgcgagtacctcaagaggtggttcggttccctcacagagcagaaccggaggctccagagggaagtggaggagctgcgagccattaaggtgggcccacccaccgtgatctcccctcactcctgcgaaccgctcccggcctccacactttccatgtgtccccgctgcgagcgtgtcacctccaccgccgacaaaccgccctccgccgcggccactttgtccgctaaagtgccgccaactcaatcccgccaaccctccgcggcctgttag

SEQ ID NO: 798 - protein, 213 aa, Glycine max
  G4371,HB domain coordinates 62-122
MAVLPSSSSSLELTISVPGFASSPTLLPSSSVKELDINQVPLEEDWMASNMEDEEESSNGEPPRKKLRLTKEQSLLLEESFRQNHTLNPKQKESLAMQLKLRPRQVEVWFQNRRARSKLKQTEMECEYLKRWFGSLTEQNRRLQREVEELRAIKVGPPTVISPHSCEPLPASTLSMCPRCERVTSTADKPPSAAATLSAKVPPTQSRQPSAAC

SEQ ID NO: 799 - DNA, 1507 bp, Arabidopsis thaliana
  G440,family:AP2
aaaaaatcactgtttcataacacgtttttctctctcacccaccaaaaaaaaatcttttgttcttgttaccaaaaaatctcgtgataaatctcttcaaactttgttttattttcttcttgattctctcgaaatctctctcaacaaacccagaaactttccttgattcgcaagcttttcttccttttatattcttcattttgatgcgaatatagagagagtccataaaagaaacagtaatggacgaatatattgatttccgaccattgaagtacacagagcacaagacttcaatgactaaatacaccaaaaagtcatcggaaaaactttccggtggtaagtcattgaaaaaggttagtatttgttatactgatcctgacgcaacagattcatcaagtgacgaagacgaagaagatttcttgtttcctcgccggagagtcaaaagattcgttaacgagatcactgttgagcctagctgtaacaacgtcgtcaccggagtttcgatgaaagatagaaagagactctcttcttcctccgatgaaactcaatctccggcgtcgagtcgtcaacgtcctaataacaaagtttcagtctccggtcagataaagaagttccgtggtgttagacaacggccatgggggaaatgggcggcggagattagagatccggagcaacgtcggaggatttggctcgggacttttgagacggcggaggaagctgccgtggtttatgataacgccgctataagactccgtggaccggacgctttaactaatttctccataccgcctcaagaagaggaagaagaagaagaaccggaaccggttattgaggagaaaccggttattatgacgacgccaacaccaacaacatcgagttctgaatcaactgaagaagatttacaacatctctcatctcctacttcggttctcaatcaccggtcagaagagattcaacaagtacaacaaccgtttaaatcagctaaacccgaaccgggggtttcaaatgcaccatggtggcataccgggtttaataccggtttaggtgaatcagacgattcatttcctttggatactccgtttcttgacaactatttcaatgaatcaccaccagagatgtcaatatttgaccaaccaatggatcaaattttctgtgaaaatgatgatatcttcaatgatatgttgttcttgggtggtgaaactatgaacattgaagatgagttaacaagttctagtatcaaagatatgggttcaacgtttagtgattttgatgattcattgatatcagatctattagttgcttaatatgatgatgagagtgaagaagaaaccatcaagcaaatatctatggtgtgactgaaaaattttggtgttacttttttttctttcataagttcatgagcttttttgtttcttttttttaataatttatttagttttgtcaggagcttgtaaaacagttttggagaaatagtggaaaaatagtttaattaaaaaaaaaaaaaaaaaaa

SEQ ID NO: 800 - protein, 354 aa, Arabidopsis thaliana
  G440,AP2 domain coordinates 122-184
MDEYIDFRPLKYTEHKTSMTKYTKKSSEKLSGGKSLKKVSICYTDPDATDSSSDEDEEDFLFPRRRVKRFVNEITVEPSCNNVVTGVSMKDRKRLSSSSDETQSPASSRQRPNNKVSVSGQIKKFRGVRQRPWGKWAAEIRDPEQRRRIWLGTFETAEEAAVVYDNAAIRLRGPDALTNFSIPPQEEEEEEEPEPVIEEKPVIMTTPTPTTSSSESTEEDLQHLSSPTSVLNHRSEEIQQVQQPFKSAKPEPGVSNAPWWHTGFNTGLGESDDSFPLDTPFLDNYFNESPPEMSIFDQPMDQIFCENDDIFNDMLFLGGETMNIEDELTSSSIKDMGSTFSDFDDSLISDLLVA

SEQ ID NO: 801 - DNA, 988 bp, Arabidopsis thaliana
  G450,family:IAA
gagttatcgagagagagagaaaacatattctgatttaagacatatatagacagcaagaagagatatgaaccttaaggagacggagctttgtcttggcctccccggaggcactgaaaccgttgaaagtccggccaagtcgggtgttgggaacaagagaggcttctccgagaccgttgatctcaaacttaatcttcaatctaacaaacaaggacatgtggatctcaacactaatggagctcccaaggagaagaccttccttaaagacccttctaagcctcctgctaaagcacaagtggtgggttggccaccggtgaggaactaccggaaaaatgttatggctaatcagaagagcggcgaagcagaggaggcaatgagtagtggtggaggaaccgtcgcctttgtgaaggtttccatggatggagctccttatcttcggaaggttgacctcaagatgtacaccagctacaaggatctctctgatgccttggccaaaatgttcagctcctttaccatggggagttatggagcacaagggatgatagatttcatgaacgagagtaaagtgatggatctgttgaacagttctgagtatgttccaagctacgaggacaaagatggtgactggatgctcgttggtgatgtcccctggccgatgtttgtcgagtcatgcaaacgtttgcgcataatgaaaggatccgaagcaattggacttgctccaagagcaatggagaagttcaagaacagatcatgaacaaaaaaaaaagaggacaatatgcattgatttttttttttttggtattgttatgatcatgtgttttaatttaaaatataggaaggatataggaaaatataattgtttacaaaaaaataactttaaatatgtcttttttttttttttgaaattagtctgtgtttttgttttcatctcttaattagtagaaatcattttttaatatgtaattgtgatagtaaatctatagagttcgta

SEQ ID NO: 802 - protein, 228 aa, Arabidopsis thaliana
  G450,IAA domain coordinates 6-14,78-89,112-128,180-217
MNLKETELCLGLPGGTETVESPAKSGVGNKRGFSETVDLKLNLQSNKQGHVDLNTNGAPKEKTFLKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSSEYVPSYEDKDGDWMLVGDVPWPMFVESCKRLRIMKGSEAIGLAPRAMEKFKNRS

SEQ ID NO: 803 - DNA, 899 bp, Arabidopsis thaliana
  G455,family:IAA
tttctaatctattacaagtaacatgatcggccaacttatgaacctcaaggccacggagctctgtctcggcctccccggcggcgctgaagcagttgagagtcctgccaaatcggcggtgggaagcaagagaggcttctccgaaaccgttgatctcatgctcaatcttcaatctaacaaagaaggctccgttgatctcaaaaacgtttctgctgttcccaaggagaagactacccttaaagatccttctaagcctcctgctaaagcacaagtggtgggatggccacctgtgaggaactacaggaagaacatgatgactcagcagaagaccagtagtggtgcggaggaggccagcagtgagaaggccgggaactttggtggaggagcagccggagccggcttggtgaaggtctccatggacggtgctccatatctgaggaaagttgacctcaagatgtacaaaagctaccaggatctttctgatgcattggccaaaatgttcagctcctttactatgggaaactatggagcacaaggaatgatagatttcatgaacgagagcaagctaatgaatctgctgaatagctctgagtatgtgccaagctacgaggacaaagatggtgactggatgctcgttggcgatgtcccatgggaaatgtttgtcgagtcttgcaaacgtttgcgcattatgaagggatctgaagcagttggacttgctccgagagcaatggagaagtactgcaagaacagatcttgaattaataataaaaaaaaagaagcatcaatgatcaacaatatgacgggttcttgattttatatgtatttttatgattgtatgtggctatcacctatatatgtgtgttgtaattttaaatacttgatgggtatatagggcagtattt

SEQ ID NO: 804 - protein, 243 aa, Arabidopsis thaliana
  G455,IAA domain coordinates 11-19,84-95,126-142,194-227
MIGQLMNLKATELCLGLPGGAEAVESPAKSAVGSKRGFSETVDLMLNLQSNKEGSVDLKNVSAVPKEKTTLKDPSKPPAKAQVVGWPPVRNYRKNMMTQQKTSSGAEEASSEKAGNFGGGAAGAGLVKVSMDGAPYLRKVDLKMYKSYQDLSDALAKMFSSFTMGNYGAQGMIDFMNESKLMNLLNSSEYVPSYEDKDGDWMLVGDVPWEMFVESCKRLRIMKGSEAVGLAPRAMEKYCKNRS

SEQ ID NO: 805 - DNA, 1169 bp, Arabidopsis thaliana
  G456,family:IAA
cacacatctcacatccccctatctctctctctcttcaaacgttttagttccccaaaaaaatatcaaaagaactaaaagaaaaaccctagaagccgaagaatctcctactcgttgtcgatcggatcacctaactaattactcgttgataatcattatatcgagaaatatgattaattttgaggccacggagctgagattagggctaccgggtgggaatcacggaggagaaatggctggaaaaaataatggtaaaagaggattttctgagactgttgatctcaaactgaatctttcatcgacggctatggattcagtttccaaagtcgatttagagaatatgaaggagaaggtcgtaaaaccaccagccaaggcacaagttgtgggatggccaccggtacgatctttccgcaagaacgtcatgtccggccaaaaaccgaccaccggagatgccaccgaaggaaacgataagacttctggcagcagtggagccacctcatccgcctccgcatgtgccaccgtggcttatgtgaaggttagcatggacggtgcaccgtacctacggaaaattgacttgaaactctacaaaacttaccaagatctctccaacgccttaagcaaaatgtttagctcttttaccataggcaactatggaccacaaggaatgaaagatttcatgaatgagagtaaattgatcgatcttctaaacggatcagattatgttccaacatatgaagataaagatggcgactggatgcttgtaggagacgtaccgtgggagatgtttgttgattcatgcaaacgtatacgaataatgaagggatcagaagcaatcggacttgctccaagggcattagaaaagtgcaagaacagaagttgagttctcgacgacatttcgtgttcttacctaaaaaaggaagaaagcctgtttcgatcggttggatatctcgaaccgagaaagctaaaccggctcgaaactattgttccgagcaaggagtttgcttataatattaattaataataatattaatattgtggtgtattacattttaaaaaattaaatcgtttttgttatatgtattatatacatatattaatatgtatatttaattaggttgcatctatttccgttaaaaccaacttttgtttttacgcaaaaaaaaagagttcac

SEQ ID NO: 806 - protein, 236 aa, Arabidopsis thaliana
  G456,IAA domain coordinates 7-14,71-81,120-153,185-221
MINFEATELRLGLPGGNHGGEMAGKNNGKRGFSETVDLKLNLSSTAMDSVSKVDLENMKEKVVKPPAKAQVVGWPPVRSFRKNVMSGQKPTTGDATEGNDKTSGSSGATSSASACATVAYVKVSMDGAPYLRKIDLKLYKTYQDLSNALSKMFSSFTIGNYGPQGMKDFMNESKLIDLLNGSDYVPTYEDKDGDWMLVGDVPWEMFVDSCKRIRIMKGSEAIGLAPRALEKCKNRS

SEQ ID NO: 807 - DNA, 818 bp, Arabidopsis thaliana
  G46,family:AP2
ttctctctttcgtaaaaatggcgagttttgaggaaagctctgatttggaagctatacagagccatctcttagaagacttgttggtttgtgatggtttcatgggagattttgacttcgatgcttcttttgtctcaggactttggtgtatagaaccacacgttcctaaacaagaacctgattctccagttcttgatccggattctttcgtcaacgagttcttgcaagtggaaggggaatcatcatcatcatcatcaccagagctgaattcatcgtcatcaacatatgagactgatcagagtgtgaaaaaggcagagaggttcgaagaagaagtagatgctagacattaccgaggagtgaggcgaaggccgtgggggaaatttgcagcagagattcgagatccagcaaagaaaggatcaagaatctggctaggaacatttgagagtgatgttgatgctgcaagagcctatgactgtgcagctttcaagctccggggaagaaaagccgtgctcaacttccctcttgacgccgggaaatatgaagctccagcgaattcaggaaggaaaaggaagagaagtgatgtgcatgaagagcttcaaagaactcagagcaattcatcttcatcttcctgtgatgcattttagcatattaagagtgtgagcagtttccttaagttgtataaagtaattgtacagaggaaacgaattgtgtaggtttagtgtgcttgcaagttgcaacaaatgtgtatggatgttctgtttcttcatgtccctaagatttagaaacatcttcttatttccaagaaaaaaaaaaaaaaaaaa

SEQ ID NO: 808 - protein, 207 aa, Arabidopsis thaliana
  G46,AP2 domain coordinates 107-175
MASFEESSDLEAIQSHLLEDLLVCDGFMGDFDFDASFVSGLWCIEPHVPKQEPDSPVLDPDSFVNEFLQVEGESSSSSSPELNSSSSTYETDQSVKKAERFEEEVDARHYRGVRRRPWGKFAAEIRDPAKKGSRIWLGTFESDVDAARAYDCAAFKLRGRKAVLNFPLDAGKYEAPANSGRKRKRSDVHEELQRTQSNSSSSSCDAF

SEQ ID NO: 809 - DNA, 612 bp, Oryza sativa (japonica cultivar-group)
  G4627,family:bZIP
atggcggcgcaggagcaggagcaggagaagcagcaggtgaagacgagcacgacgagctcgctgccgtcgagcagcgagcgctcctccagctcagcccccaacaacctcaaggaaggaggaggggtggagagcgacgaggagatacggcgggtgccggagatgggagggggcggcgggtcggcgtcgtcgggggcgggggcggacgagcggcaggggaaggaggacgggaagcagcagggtggtggcggcggcggggcggcggcggcggggggcgggcaggagcaggcgccgccggcgaggaagcgagggcggagcgccggcgacaaggagcagaaccggctgaagcggctgctgcggaaccgcgtgtcggcgcagcaggcgcgggagcggaagaaggcgtacatgacggagctcgaggccaaggccaaggacctcgagctccgcaatgccgagctcgagcagcgcgtctccaccctccagaacgagaacaacacgctccgccagatactcaagaacacgacggcgcacgccggcaagaggggcggcggcggcggaggcaagggcggcgatggcggcggcggcgggaagaagcaccatttcaccaagagctag

SEQ ID NO: 810 - protein, 203 aa, Oryza sativa (japonica cultivar-group)
  G4627,bZIP domain coordinates 43-55,100-179
MAAQEQEQEKQQVKTSTTSSLPSSSERSSSSAPNNLKEGGGVESDEEIRRVPEMGGGGGSASSGAGADERQGKEDGKQQGGGGGGAAAAGGGQEQAPPARKRGRSAGDKEQNRLKRLLRNRVSAQQARERKKAYMTELEAKAKDLELRNAELEQRVSTLQNENNTLRQILKNTTAHAGKRGGGGGGKGGDGGGGGKKHHFTKS

SEQ ID NO: 811 - DNA, 1083 bp, Oryza sativa (japonica cultivar-group)
  G4630,family:bZIP
atggcgacaacacgcgcatctctcaccgatcccctccttccctctcccgcggcacgcgcgccagttaaagccaaaaagctctcatggtccatgcttcacgcaagcagcaaggacgagaggagaggacagagtggggaagctgaagctgaagcaagcggaggagtgcacgcgaatccctcctcgccggcgagaatgcaggagcaggcgacgagctcgcggccgtccagctccgagaggtcgtccagctccggcggccaccacatggagatcaaggaaggcaaggaagcgccacttcgatcccttctccttccctttcttgatttccattttactgttcctctttcgggaatggagagcgacgaggagatagggagagtgccggagctggggctggagccgggcggcgcttcgacgtcggggagggcggccggcggcggcggcggcggggcggagcgcgcgcagtcgtcgacggcgcaggccagcgcgcgccgccgcgggcgcagccccgcggataaggagcacaagcgcctcaaaaggttgctgaggaaccgggtatcagcgcagcaggcaagggagagaaagaaggcatacttgaatgatcttgaggtgaaggtgaaggacttggagaagaagaactcagagttggaagaaagattctccaccctacagaatgagaaccagatgctcagacagatactgaagaatacaactgtgagcagaagagggccagttcttctgaaaatccccaaatcgggtctgcgggaggcggcaccagcgggctgcggaggtttgcgggaggcggagggcgacgagaagtttgtcctcaacgggttcaccgccgcgaatctcagcttcgatggcatggcgacggtgaccccgaacgggctgctcatgttgaccaacggcacgaaccagctcaagggccacgccttcttcccggcgctgctccagttccacaggacgcccaacagcatggcgatgcagtccttctccacggccttcgtcatcggcatcatcagcgcgttcgaggaccagggcagcggcagcccggcggcggcaggtggcagcggcagggcggcataa

SEQ ID NO: 812 - protein, 360 aa, Oryza sativa (japonica cultivar-group)
  G4630,bZIP domain coordinates 118-130,163-242
MATTRASLTDPLLPSPAARAPVKAKKLSWSMLHASSKDERRGQSGEAEAEASGGVHANPSSPARMQEQATSSRPSSSERSSSSGGHHMEIKEGKEAPLRSLLLPFLDFHFTVPLSGMESDEEIGRVPELGLEPGGASTSGRAAGGGGGGAERAQSSTAQASARRRGRSPADKEHKRLKRLLRNRVSAQQARERKKAYLNDLEVKVKDLEKKNSELEERFSTLQNENQMLRQILKNTTVSRRGPVLLKIPKSGLREAAPAGCGGLREAEGDEKFVLNGFTAANLSFDGMATVTPNGLLMLTNGTNQLKGHAFFPALLQFHRTPNSMAMQSFSTAFVIGIISAFEDQGSGSPAAAGGSGRAA

SEQ ID NO: 813 - DNA, 1262 bp, Glycine max
  G4631,family:bZIP
ggtttttgagaagaaagatggaacgaagtggcggaatggtaactgggtcgcatgaaaggaacgaacttgttagagttagacacggctctgatagtaggtctaaacccttgaagaatttgaatggtcagagttgtcaaatatgtggtgataccattggattaacggctactggtgatgtctttgtcgcttgtcatgagtgtggcttcccactttgtcattcttgttacgagtatgagctgaaacatatgagccagtcttgtccccagtgcaagactgcattcacaagtcaccaagagggtgctgaagtggaggagattgatatgatgaccgatgcttatctagataatgagatcaactatggccaaggaaacagttccaaggcggggatgctatgggaagaagatgctgacctctcttcatcttctggacatgattctcaaataccaaacccccatctagcaaacgggcaaccgatgtctggtgagtttccatgtgctacttctgatgctcaatctatgcaaactacatctataggtcaatccgaaaaggttcactcactttcatatgctgatccaaagcaaccaggtcctgagagtgatgaagagataagaagagtgccagagattggaggtgaaagtgccggaacttcggcctctcagccagatgccggttcaaatgctggtacagagcgtgttcaggggacaggggagggtcagaagaagagagggagaagcccagctgataaagaaagtaaacggctaaagaggctactgaggaaccgagtttcagctcagcaagcaagggagaggaagaaggcatacttgattgatttggaaacaagagtcaaagacttagagaagaagaactcagagctcaaagaaagactttccactttgcagaatgagaaccaaatgcttagacaaatattgaagaacacaacagcaagcaggagagggagcaataatggtaccaataatgctgagtgaacataatgtcaaaagatggcagagaaaacttatagatggaatagatttagaaagagagaatacattagccagaaagagaaaaaaaaattggacattagttgatgattctttctaggtgtgcgtttggaatacaatgaagtaaaggatgaaccttaagacatgctttatcctaaaatagtgtgatctgatattccattgttaatgagtaatgtaattatcatacaaacaatttgtagtctcattttaattaataattattaaactacttgattactt

SEQ ID NO: 814 - protein, 322 aa, Glycine max
  G4631,bZIP domain coordinates 192-204,234-313
MERSGGMVTGSHERNELVRVRHGSDSRSKPLKNLNGQSCQICGDTIGLTATGDVFVACHECGFPLCHSCYEYELKHMSQSCPQCKTAFTSHQEGAEVEEIDMMTDAYLDNEINYGQGNSSKAGMLWEEDADLSSSSGHDSQIPNPHLANGQPMSGEFPCATSDAQSMQTTSIGQSEKVHSLSYADPKQPGPESDEEIRRVPEIGGESAGTSASQPDAGSNAGTERVQGTGEGQKKRGRSPADKESKRLKRLLRNRVSAQQARERKKAYLIDLETRVKDLEKKNSELKERLSTLQNENQMLRQILKNTTASRRGSNNGTNNAE

SEQ ID NO: 815 - DNA, 780 bp, Zea mays
  G4632,family:bZIP
atcgcaggcagatagggaaggagaagcggagtgcgcgcggtccaaatctgcggaggcggaggcggaggcggagggcgagcaagaatgcaggagcagccggcgagctcgcggccttccagcagcgagaggtcgtctagctccgcgcaccacatggacatggaggtcaaggaagggatggagagcgacgaggagataaggagagtgccggagctgggcctggagctgccgggagcttccacgtcgggcagggaggttggcccgggcgccgccggcgcagaccgcgccctggcccagtcgtccacggcgcaggccagcgcgcgccgccgcgtccgcagccccgccgacaaggagcacaagcgcctcaaaagattactgaggaaccgggtgtcagctcaacaggcaagagagaggaagaaggcttatttgactgatctggaggtgaaggtgaaggacctggagaagaagaactcggagatggaagagaggctctccaccctccagaacgagaaccagatgctccgacagatactgaagaacaccactgtaagcagaagaggttcaggaagcactgctagtggagagggccaatagttcagaatgacaggaaaatagtaatgcattatatgctaaacatatgtttatgctcagtggatttggtcagtttgctttgtggccaaaggagggaaccccaaaaactgggggtgaaggatttgtgcagacagtcatatatatcactgtattaatacgaatggttcagaaaaagaagaacttatggagtgc

SEQ ID NO: 816 - protein, 168 aa, Zea mays
  G4632,bZIP domain coordinates 32-44,79-158
MQEQPASSRPSSSERSSSSAHHMDMEVKEGMESDEEIRRVPELGLELPGASTSGREVGPGAAGADRALAQSSTAQASARRRVRSPADKEHKRLKRLLRNRVSAQQARERKKAYLTDLEVKVKDLEKKNSEMEERLSTLQNENQMLRQILKNTTVSRRGSGSTASGEGQ

SEQ ID NO: 817 - DNA, 1065 bp, Arabidopsis thaliana
  G482,family:CAAT
tcgacccacgcgtccggacacttaacaattcacaccttctctttttactcttcctaaaaccctaaatttcctcgcttcagtcttcccactcaagtcaaccaccaattgaattcgatttcgaatcattgatggaaatgatttgaaaaaagagtaaagtttatttttttattccttgtaattttcagaaatgggggattccgacagggattccggtggagggcaaaacgggaacaaccagaacggacagtcctccttgtctccaagagagcaagacaggttcttgccgatcgctaacgtcagccggatcatgaagaaggccttgcccgccaacgccaagatctctaaagatgccaaagagacgatgcaggagtgtgtctccgagttcatcagcttcgtcaccggagaagcatctgataagtgtcagaaggagaagaggaagacgatcaacggagacgatttgctctgggctatgactactctaggttttgaggattatgttgagccattgaaagtttacttgcagaggtttagggagatcgaaggggagaggactggactagggaggccacagactggtggtgaggtcggagagcatcagagagatgctgtcggagatggcggtgggttctacggtggtggtggtgggatgcagtatcaccaacatcatcagtttcttcaccagcagaaccatatgtatggagccacaggtggcggtagcgacagtggaggtggagctgcctccggtaggacaaggacttaacaaagattggtgaagtggatctctctctgtatatagatacataaatacatgtatacacatgcctatttttacgacccatataaggtatctatcatgtgatagaacgaacattggtgttggtgatgtaaaatcagatgtgcattaagggtttagattttgaggctgtgtaaaagaagatcaagtgtgctttgttggacaataggattcactaacgaatctgcttcattggatcttgtatgtaactaaagccattgtattgaatgcaaatgttttcatttgggatgctttaaaaaaaaaaaaaaaaa

SEQ ID NO: 818 - protein, 190 aa, Arabidopsis thaliana
  G482,CAAT domain coordinates 26-115
MGDSDRDSGGGQNGNNQNGQSSLSPREQDRFLPIANVSRIMKKALPANAKISKDAKETMQECVSEFISFVTGEASDKCQKEKRKTINGDDLLWAMTTLGFEDYVEPLKVYLQRFREIEGERTGLGRPQTGGEVGEHQRDAVGDGGGFYGGGGGMQYHQHHQFLHQQNHMYGATGGGSDSGGGAASGRTRT

SEQ ID NO: 819 - DNA, 684 bp, Arabidopsis thaliana
  G485,family:CAAT
cctctctgatccaacggacccaaaacatctatctctctttctcgaccttttgtctcctcgatctaaagatggcggattcggacaacgattcaggaggacacaaagacggtggaaatgcttcgacacgtgagcaagataggtttctaccgatcgctaacgttagcaggatcatgaagaaagcacttcctgcgaacgcaaaaatctctaaggatgctaaagaaacggttcaagagtgtgtatcggaattcataagtttcatcaccggtgaggcttctgacaagtgtcagagagagaagaggaagacaatcaacggtgacgatcttctttgggcgatgactacgctagggtttgaggactacgtggagcctctcaaggtttatctgcaaaagtatagggaggtggaaggagagaagactactacggcagggagacaaggcgataaggaaggtggaggaggaggcggtggagctggaagtggaagtggaggagctccgatgtacggtggtggcatggtgactacgatgggacatcaattttcccatcatttttcttaattgtaaaatgataaaagcaaattttcatttttattaattaatgatatatatatatatatgtttaacttttagtataatgtttacagaattttttttttaaaactaggttcaacccactaacgtaacagcg

SEQ ID NO: 820 - protein, 161 aa, Arabidopsis thaliana
  G485,CAAT domain coordinates 20-109
MADSDNDSGGHKDGGNASTREQDRFLPIANVSRIMKKALPANAKISKDAKETVQECVSEFISFITGEASDKCQREKRKTINGDDLLWAMTTLGFEDYVEPLKVYLQKYREVEGEKTTTAGRQGDKEGGGGGGGAGSGSGGAPMYGGGMVTTMGHQFSHHFS

SEQ ID NO: 821 - DNA, 1281 bp, Arabidopsis thaliana
  G502,family:NAC
aattgattaggataggatcaggatcatcctcaacaacctcctcctaattcctcctccattcatagtaacaataatattaagaaagagggtaaactatgtcagaattattacagttgcctccaggtttccgatttcaccctaccgatgaagagcttgtcatgcactatctctgccgcaaatgtgcctctcagtccatcgccgttccgatcatcgctgagatcgatctctacaaatacgatccatgggagcttcctggtttagccttgtatggtgagaaggaatggtacttcttctctcccagggacagaaaatatcccaacggttcgcgtcctaaccggtccgctggttctggttactggaaagctaccggagctgataaaccgatcggactacctaaaccggtcggaattaagaaagctcttgttttctacgccggcaaagctccaaagggagagaaaaccaattggatcatgcacgagtaccgtctcgccgacgttgaccggtccgttcgcaagaagaagaatagtctcaggctggatgattgggttctctgccggatttacaacaaaaaaggagctaccgagaggcggggaccaccgcctccggttgtttacggcgacgaaatcatggaggagaagccgaaggtgacggagatggttatgcctccgccgccgcaacagacaagtgagttcgcgtatttcgacacgtcggattcggtgccgaagctgcatactacggattcgagttgctcggagcaggtggtgtcgccggagttcacgagcgaggttcagagcgagcccaagtggaaagattggtcggccgtaagtaatgacaataacaatacccttgattttgggtttaattacattgatgccaccgtggataacgcgtttggaggaggagggagtagtaatcagatgtttccgctacaggatatgttcatgtacatgcagaagccttactagaagggaattcctttcctgccgccgaaacgcaacgcaaaacgaccctcgtttttgcgtttatggcaacacgagaccgttttatatggtcaatgagtgtgccgattcggccattagatttctgttcagtcttcgtttattctatagaccgtccgatttcagatcatccctaatcggacggtggtcgttggatgtatcagtagtgtattactgtgttaggtagaagaaaatccacttgttcttaaattggcataaaagtcagaagctaatatttatatgtgccgcaatcaatttaatattttctgtctaaaaaaaaaaa

SEQ ID NO: 822 - protein, 289 aa, Arabidopsis thaliana
  G502,NAC domain coordinates 10-155
MSELLQLPPGFRFHPTDEELVMHYLCRKCASQSIAVPIIAEIDLYKYDPWELPGLALYGEKEWYFFSPRDRKYPNGSRPNRSAGSGYWKATGADKPIGLPKPVGIKKALVFYAGKAPKGEKTNWIMHEYRLADVDRSVRKKKNSLRLDDWVLCRIYNKKGATERRGPPPPVVYGDEIMEEKPKVTEMVMPPPPQQTSEFAYFDTSDSVPKLHTTDSSCSEQVVSPEFTSEVQSEPKWKDWSAVSNDNNNTLDFGFNYIDATVDNAFGGGGSSNQMFPLQDMFMYMQKPY

SEQ ID NO: 823 - DNA, 1041 bp, Arabidopsis thaliana
  G506,family:NAC
tttaaatattagctttcgacaactctcttgtgtcgcaagctacaagtgtgaattttgcaaatggggagttcatgtttgcctccaggatttagatttcatccaactgatgaagagctcataggctactacttgagtagaaaaatagaaggtctcgagattgagcttgaagtcattcctgttatcgacttatacaaatttgatccttgggagttgccaggtaaatctttccttccaaatagagatttggaatggttctttttctgtccaagagacaaaaaatatgcaaacggttctcgaaccaatagggctacaaaagcgggttattggaaagcaactggtaaagaccggaaaatcacttgtaaatcatcgcatgttatagctggataccgaaaaaccttagttttctatgaaggtcgtgccccattaggcgacagaactaattggtttatgcatgaatatcgtctatgcgatattgatgatcattcacaaaaatcaccaaatttcaagggagcttttgcgttatgtcgcgtagttaagaagaatgaactgaagaaaaattcgaaaagtttgaaaaataaaaacgaacaagacattggttcttgttactctagcctcgcgacctctccttgtcgcgatgaagcgtcgcagattcaatcgttcaagccttcttctactacaaacgactcttcaagcatttggatttctcctgatttcatccttgattcgtcaaaggattatcctcagattaaggaggttgcttctgagtgctttcccaactaccattttccggtcaccacggcaaaccaccacgtggaatttccggtgagctcttgttatttcaatgtggaccaggacattgatcagtcgatgcaaaccggttattggacaaattatgaaaatgaccaaaccggttcatttgactactcaaaccttttttagctacaagaaatgttggttcgttcttaggacaaaaacgccttttaacgttggtgtcttggaacttggaagaagaagaagaactagttgtgaacgtctatcatt

SEQ ID NO: 824 - protein, 292 aa, Arabidopsis thaliana
  G506,NAC domain coordinates 8-157
MGSSCLPPGFRFHPTDEELIGYYLSRKIEGLEIELEVIPVIDLYKFDPWELPGKSFLPNRDLEWFFFCPRDKKYANGSRTNRATKAGYWKATGKDRKITCKSSHVIAGYRKTLVFYEGRAPLGDRTNWFMHEYRLCDIDDHSQKSPNFKGAFALCRVVKKNELKKNSKSLKNKNEQDIGSCYSSLATSPCRDEASQIQSFKPSSTTNDSSSIWISPDFILDSSKDYPQIKEVASECFPNYHFPVTTANHHVEFPVSSCYFNVDQDIDQSMQTGYWTNYENDQTGSFDYSNLF

SEQ ID NO: 825 - DNA, 1462 bp, Arabidopsis thaliana
  G515,family:NAC
caaccatggcgaaagctctccaatgcatatttttttgatcttttccttttcccttcttttttgatcgctgcagagaaatggaaactcctgtgggtttaagattctgtccgaccgacgaggagatcgtcgtcgattacctttggccgaaaaattccgatagagacacgagccatgtcgatcgattcattaacacagtccctgtctgtagactcgatccttgggagttaccttgccagtcaaggatcaaactgaaagatgtggcttggtgtttcttcagacctaaggagaacaaatatggcagaggtgatcagcagatgagaaaaacgaaatctgggttttggaagagtactggcagaccaaagcctatcatgcgtaatcgccaacagatcggtgagaaaaagattttgatgttttacacgagtaaggaatccaaatccgattgggttatacacgagtaccacggtttctctcataaccagatgatgatgacatacacactctgtaaagttatgtttaatggtggcatgagagagaagtcttcctcttctccttcttcttctggtgttagtggaattgagcagagtcgtcgtgactctttaatccctcagcttgtcaacaattctgagggatcctcacttcacagagaagatccaagtcagtttggtgatgtgctgcaagaagctccaatcgaggatgctaaactgaccgaggaattggtaaaatggctgatgaatgatgaggatgatgctcaaatcgaggatgctataccgattgaggaatgggaaacatggttgaatgatattgatgatgctaaggagaagagtatcatgtttatgcatgataatcgaagtgattacagacctccaaactcattaactggtgtcttcagtgatgatgttagcagtgatgataatgattctgatttgctaactccaaaaacaaactctattcaaacttcgagcacttgtgatagttttggtagctcaaatcatcgcatagaccagatcaaagacctgcaagaatctcctacctcaacaatcaacttagtgtcactaactcaagaggtgagccaagctctaataaccagtattgataccgccgagaagaagaagaatccttatgatgatgcacaagggactgagattggtgagcataaattgggtcaagagacgatcaagaagaaaagagctggtttctttcacaggatgatacaaaaattcgtcaagaaaattcacctatgttcttccatctcaagaacttgataacaataaaagtgatcaataacaccttttctactttccaaattatttacaacagtacaagtgtatgctatgatgtctatcttggtttgtaactttaccatactgtatgtgtgatatgtataaaactggtaaatttgtgaagacaaatttgtatccattgacataataatgtctatcttgttttgttaaaaaaaaaaaaa

SEQ ID NO: 826 - protein, 394 aa, Arabidopsis thaliana
  G515,NAC domain coordinates 6-149
METPVGLRFCPTDEEIVVDYLWPKNSDRDTSHVDRFINTVPVCRLDPWELPCQSRIKLKDVAWCFFRPKENKYGRGDQQMRKTKSGFWKSTGRPKPIMRNRQQIGEKKILMFYTSKESKSDWVIHEYHGFSHNQMMMTYTLCKVMFNGGMREKSSSSPSSSGVSGIEQSRRDSLIPQLVNNSEGSSLHREDPSQFGDVLQEAPIEDAKLTEELVKWLMNDEDDAQIEDAIPIEEWETWLNDIDDAKEKSIMFMHDNRSDYRPPNSLTGVFSDDVSSDDNDSDLLTPKTNSIQTSSTCDSFGSSNHRIDQIKDLQESPTSTINLVSLTQEVSQALITSIDTAEKKKNPYDDAQGTEIGEHKLGQETIKKKRAGFFHRMIQKFVKKIHLCSSISRT

SEQ ID NO: 827 - DNA, 531 bp, Oryza sativa (japonica cultivar-group)
  G5158,family:bZIP
atgacgattaaaaggaaggacgacgggcaggtcgtgaagcaatcagtcaaagcggttggcgggggacttctagaaagggtggatagcgacgacgaggagatagtagggagggtgccggagttcgggctggcgctgccggggacgtcgacgtcgggcagaggtagtgttcgggttgcaggtgacgcggcggcgacggcggccgggacgtcgtcgtcgtcgcccgcggcgcaggccggcgtcgccggcagcagcagcagcgggcgccgccgcggacgcagccccgccgacaaggagcaccggcgcctcaaaagattgctgaggaaccgggtgtcagcgcagcaggctcgggagaggaagaaggcgtacatgagtgagctggaggcgagggtgaaggacctggagaggagcaactcagagctggaggagaggctctctaccctgcaaaacgagaaccagatgcttaggcaggtgctgaagaacacaacagcaaacagaagagggccagacagcagtgccggcggagacagctag

SEQ ID NO: 828 - protein, 176 aa, Oryza sativa (japonica cultivar-group)
  G5158,bZIP domain coordinates 28-42,88-167
MTIKRKDDGQVVKQSVKAVGGGLLERVDSDDEEIVGRVPEFGLALPGTSTSGRGSVRVAGDAAATAAGTSSSSPAAQAGVAGSSSSGRRRGRSPADKEHRRLKRLLRNRVSAQQARERKKAYMSELEARVKDLERSNSELEERLSTLQNENQMLRQVLKNTTANRRGPDSSAGGDS

SEQ ID NO: 829 - DNA, 753 bp, Oryza sativa (japonica cultivar-group)
  G5159,family:Z-CO-like
atgaaggtgcagtgcgacgtgtgcgcggccgaggccgcctcggtcttctgctgcgccgacgaggccgcgctgtgcgacgcgtgcgaccgccgcgtccacagcgcgaacaagctcgccgggaagcaccgccgattctccctcctccaaccgttggcgtcgtcgtcgtccgcccagaagccaccgctctgcgacatctgtcaggagaagagggggttcttgttctgcaaggaggacagggcgatcctgtgccgggagtgcgacgtcacggtgcacaccacgagcgagctgacgaggcggcacggccggttcctcctcaccggcgtgcgcctctcgtcggcgccgatggactcccccgcgccgtcggaggaagaggaggaggaagcaggggaggactacagctgcagccccagcagcgtcgccggcaccgccgcggggagcgcgagcgacgggagcagcatctccgagtacctcaccaagacgctgcccggttggcacgtcgaggacttcctcgtcgacgaggccaccgccggcttctcctcctcagacgggctatttcagggtgggctgctggctcagatcggtggggtgccggacggttacgcggcgtgggccggccgggagcagctgcacagtggcgtcgctgtcgccgccgacgagcgggccagccgcgagcggtgggtgccgcagatgaacgcggagtggggcgccggcagcaagcgacccagggcgtcgcctccctgcttgtactggtga

SEQ ID NO: 830 - protein, 250 aa, Oryza sativa (japonica cultivar-group)
  G5159,Z-CO-like domain coordinates 2-33,63-105
MKVQCDVCAAEAASVFCCADEAALCDACDRRVHSANKLAGKHRRFSLLQPLASSSSAQKPPLCDICQEKRGFLFCKEDRAILCRECDVTVHTTSELTRRHGRFLLTGVRLSSAPMDSPAPSEEEEEEAGEDYSCSPSSVAGTAAGSASDGSSISEYLTKTLPGWHVEDFLVDEATAGFSSSDGLFQGGLLAQIGGVPDGYAAWAGREQLHSGVAVAADERASRERWVPQMNAEWGAGSKRPRASPPCLYW

SEQ ID NO: 831 - DNA, 1053 bp, Arabidopsis thaliana
  G516,family:NAC
atggcgaatccggtgggttttagattccgtccgactgacggggagatcgtcgacatttacctccgaccgaaaaatctcgaaagtaacacgagccatgtcgatgaagtcattagcacagttgatatttgtagcttcgacccttgggacttaccttcccattctaggatgaaaacaagagatcaggtttggtatttcttcggccgtaaggagaacaaatatggtaaaggtgatcgacagataagaaaaaccaagtctggtttttggaagaaaactggcgttaccatggatataatgcgcaaaacgggagatcgtgagaagatcggtgagaaaagggttttggtgtttaagaatcacggtggttccaagtccgattgggctatgcatgagtatcacgctacgttctcgtctcctaatcagggtgaaaggagagaattttcagttgctactggtagtggaattaagcatactcactctttaatccctcctaccaacaattctggagttttgagtgtagagacagagggatcgttgtttcacagccaagaatcacagaatccaagtcagttttctggctttcttgatgtggatgcactagatagggacttctgcaatattttgagtgatgatttcaaaggcttctttaatgatgacgatgagcagagtaagattgtttctatgcaagatgatcgcaacaaccacacacctcaaaagccattgaccggtgtcttcagtgatcatagcaccgatggtagtgattctgatccgatttctgcaacaactatttccattcaaactttaagcacttgtcctagttttggtagctcaaatcctctataccaaatcactgacttgcaggaatctcctaactcaatcaagttagtgtcattagctcaagaggtgagcaaaacaccgggaaccggtattgataatgatgcacaagggactgagattggtgagcataaattgggtcaagagacgatcaagaacaaaagagctggtttctttcacaggatgatacaaaaattcgtcaagaaaattcacctaagaacatga

SEQ ID NO: 832 - protein, 350 aa, Arabidopsis thaliana
  G516,NAC domain coordinates 6-141
MANPVGFRFRPTDGEIVDIYLRPKNLESNTSHVDEVISTVDICSFDPWDLPSHSRMKTRDQVWYFFGRKENKYGKGDRQIRKTKSGFWKKTGVTMDIMRKTGDREKIGEKRVLVFKNHGGSKSDWAMHEYHATFSSPNQGERREFSVATGSGIKHTHSLIPPTNNSGVLSVETEGSLFHSQESQNPSQFSGFLDVDALDRDFCNILSDDFKGFFNDDDEQSKIVSMQDDRNNHTPQKPLTGVFSDHSTDGSDSDPISATTISIQTLSTCPSFGSSNPLYQITDLQESPNSIKLVSLAQEVSKTPGTGIDNDAQGTEIGEHKLGQETIKNKRAGFFHRMIQKFVKKIHLRT

SEQ ID NO: 833 - DNA, 1254 bp, Arabidopsis thaliana
  G519,family:NAC
cacaaagatcctccgattcgaaggtttataaaaactcaaaatcgaatcttatccacaagaaaacaacaaggtacttttccaaaaatgaaggcggagttgaatttgccggcgggattccgatttcatccgacggacgaagagcttgtcaagttctatctttgccggagatgtgcgtcagaaccgattaacgttccggttatcgcagagattgacttgtacaaattcaatccatgggagcttccagaaatggcgttgtacggtgagaaagaatggtacttcttctcgcatagagaccggaaatacccaaacgggtcgagaccaaaccgggcagctggaaccggttattggaaagcgactggagctgataaaccgatcggaaaaccgaagacgttagggattaagaaagcactcgtcttctacgcaggaaaagctccgaaagggattaaaacgaattggattatgcacgagtatcgtctcgctaatgtcgatcgatctgcttctaccaacaagaagaacaacttaagacttgatgattgggttttgtgtcggatatacaataagaaaggaacaatggagaagtatttaccggcggcggctgagaaaccgacggaaaagatgagtacgtcggactcaagatgctcaagtcacgtgatttcaccggacgtcacgtgttctgataactgggaggttgagagtgagcccaaatggattaatctggaagacgcgttagaggcatttaatgatgacacgtccatgtttagttccattggtttgttgcaaaatgacgcctttgttcctcagtttcagtaccagtcctccgatttcgtcgattcgtttcaggacccgttcgagcagaaaccgttcttgaattggaattttgctcctcaagggtaaaaataatcggcaaaaagttgaagcttttcagagtcttcgatcaccggcattgtgtcggatcctgacccggagaccaagtcgggtcatacgattacataatcgggttattgagatttccacatttggatttccgagactaaccaacttaacggattctggggtaattggggggttttgcacaggtgaatcacactgagtcagcaagtttcgattttttggttttgttttgtaatgattgattaaatgtctaaagatatcacgaagtagattcagaagaactgtaaaagcaattgtgaccacccgttatgaatcataaatatattcaatgaagcatgagcttattttttttttaaaaaaaaa

SEQ ID NO: 834 - protein, 269 aa, Arabidopsis thaliana
  G519,NAC domain coordinates 10-131
MKAELNLPAGFRFHPTDEELVKFYLCRRCASEPINVPVIAEIDLYKFNPWELPEMALYGEKEWYFFSHRDRKYPNGSRPNRAAGTGYWKATGADKPIGKPKTLGIKKALVFYAGKAPKGIKTNWIMHEYRLANVDRSASTNKKNNLRLDDWVLCRIYNKKGTMEKYLPAAAEKPTEKMSTSDSRCSSHVISPDVTCSDNWEVESEPKWINLEDALEAFNDDTSMFSSIGLLQNDAFVPQFQYQSSDFVDSFQDPFEQKPFLNWNFAPQG

SEQ ID NO: 835 - DNA, 890 bp, Arabidopsis thaliana
  G545,family:Z-C2H2
gcaaccttcaaactaaaactcgagagacaagaaatcctcagaatctttaacttaatggcgctcgaggctcttacatcaccaagattagcttctccgattcctcctttgttcgaagattcttcagtcttccatggagtcgagcactggacaaagggtaagcgatctaagagatcaagatccgatttccaccaccaaaacctcactgaggaagagtatctagctttttgcctcatgcttctcgctcgcgacaaccgtcagcctcctcctcctccggcggtggagaagttgagctacaagtgtagcgtctgcgacaagacgttctcttcttaccaagctctcggtggtcacaaggcaagccaccgtaagaacttatcacagactctctccggcggaggagatgatcattcaacctcgtcggcgacaaccacatccgccgtgactactggaagtgggaaatcacacgtttgcaccatctgtaacaagtcttttccttccggtcaagctctcggcggacacaagcggtgccactacgaaggaaacaacaacatcaacactagtagcgtgtccaactccgaaggtgcggggtccactagccacgttagcagtagccaccgtgggtttgacctcaacatccctccgatccctgaattctcgatggtcaacggagacgacgaagtcatgagccctatgccggcgaagaagcctcggtttgactttccggtcaaacttcaactttaaggaaatttacttagacgataagatttcgtttgtatactgttgagagttgtgtaggaatttgttgactgtacataccaaattggactttgactgattccaattcttcttgttctttcattttaaaaattattaaaccgattctttaccacaaa

SEQ ID NO: 836 - protein, 227 aa, Arabidopsis thaliana
  G545,Z-C2H2 domain coordinates 82-102,136-154
MALEALTSPRLASPIPPLFEDSSVFHGVEHWTKGKRSKRSRSDFHHQNLTEEEYLAFCLMLLARDNRQPPPPPAVEKLSYKCSVCDKTFSSYQALGGHKASHRKNLSQTLSGGGDDHSTSSATTTSAVTTGSGKSHVCTICNKSFPSGQALGGHKRCHYEGNNNINTSSVSNSEGAGSTSHVSSSHRGFDLNIPPIPEFSMVNGDDEVMSPMPAKKPRFDFPVKLQL

SEQ ID NO: 837 - DNA, 1832 bp, Arabidopsis thaliana
  G554,family:bZIP
ccttccaaacactattggggaaatggcttcttctcttttttccggtgtaggtttaaggttttagatttgaaggcggatggtgaggagtttgtgttgatgaaatgggtgatttgaagttaaatacctttaagttcttttagccttaagttcttttagcctgtcattacaatatatgtttcagttgtgatcttttggtgctctccaaggtcttagggaatctccgtgtcccctctggtttctttctttgtataaagtctctggaatttaaagatgattttgtcctgttttcttcgaagaatttggcgaagaaacatcaaaagttcactatttgctttacgtgttatgcttgtttgactttgtgtgatctaacttttggttgaaaactaatgctcatcttttgttctttggaatgtcttgatctgcttgattttgaatgctttgtcacattgtttaaacaatttgttctttgttttcagttgaggaaaacatgaattcgacatcgacacattttgtgccaccgagaagagttggtatatacgaacctgtccatcaattcggtatgtggggggagagtttcaaaagcaatattagcaatgggactatgaacacaccaaaccacataataataccgaataatcagaaactagacaacaacgtgtcagaggatacttcccatggaacagcaggaactcctcacatgttcgatcaagaagcttcaacgtctagacatcccgataagatacaaagacggcttgctcaaaaccgcgaggctgctaggaaaagtcgcttgcgcaagaaggcttatgttcagcaactggaaacaagcaggttgaagctaattcaattagagcaagaactcgatcgtgctagacaacagggattctatgtaggaaacggaatagatactaattctctcggtttttcggaaaccatgaatccagggattgctgcatttgaaatggaatatggacattgggttgaagaacagaacagacagatatgtgaactaagaacagttttacacggacacattaacgatatcgagcttcgttcgctagtcgaaaacgccatgaaacattactttgagcttttccggatgaaatcgtctgctgccaaagccgatgtcttcttcgtcatgtcagggatgtggagaacttcagcagaacgattcttcttatggattggcggatttcgaccctccgatcttctcaaggttcttttgccacattttgatgtcttgacggatcaacaacttctagatgtatgcaatctaaaacaatcgtgtcagcaagcagaagacgcgttgactcaaggtatggagaagctgcaacacaccttgcggaccgttgcagcgggacaactcggtgaaggaagttacattcctcaggtgaattctgctatggatagattagaagctttggtcagtttcgtaaatcaggctgatcacttgagacatgaaacattgcaacaaatgtatcggatattgacaacgcgacaagcggctcgaggattattagctcttggtgagtattttcaacggcttagagccttgagctcaagttgggcaactcgacatcgtgaaccaacgtaggtttgagttattttgtaacaaccaaatgaagaaaatggaaagacctcaaaaatgaagaatgagtgcatctgaaaacagaggactactctgaataaatagaggggttgctgctgatatttatttttactctgcggcggaattagaaaatttgaaaaacatcatgtattgataagttgtaaatatcagaaaaaggtgggggtgcaaaaatttgtactttttagcttttgaaagaggcaagttt

SEQ ID NO: 838 - protein, 367 aa, Arabidopsis thaliana
  G554,bZIP domain coordinates 82-142
MNSTSTHFVPPRRVGIYEPVHQFGMWGESFKSNISNGTMNTPNHIIIPNNQKLDNNVSEDTSHGTAGTPHMFDQEASTSRHPDKIQRRLAQNREAARKSRLRKKAYVQQLETSRLKLIQLEQELDRARQQGFYVGNGIDTNSLGFSETMNPGIAAFEMEYGHWVEEQNRQICELRTVLHGHINDIELRSLVENAMKHYFELFRMKSSAAKADVFFVMSGMWRTSAERFFLWIGGFRPSDLLKVLLPHFDVLTDQQLLDVCNLKQSCQQAEDALTQGMEKLQHTLRTVAAGQLGEGSYIPQVNSAMDRLEALVSFVNQADHLRHETLQQMYRILTTRQAARGLLALGEYFQRLRALSSSWATRHREPT

SEQ ID NO: 839 - DNA, 1360 bp, Arabidopsis thaliana
  G555,family:bZIP
caaaagtagtaacctttgttggtgattgatactatatctgttgtgggttttagacaaagaccacgtctttgcagttgtagattggaattttccggatctttctctaaatcgctttttctccgagcaacttttgtttggggttaagctcaaagaatccgttcttttcagtctttactccatctagggtaccacgattggatcggtttttatctgatgatttagtaacagagattttgaagaaaaagaaaaatgggagatactagtccaagaacatcagtctcaacagatggagacactgatcataataacctaatgttcgatgaagggcatttgggtatcggtgcttctgattctagtgaccgttcaaagagtaaaatggatcaaaagacgcttcgtaggctcgctcaaaaccgtgaggctgcaaggaaaagcagattgaggaagaaagcatatgttcagcagctagagaacagtcgattgaagctaacacaacttgagcaggagctacaaagagcacggcaacagggtgtctttatctcaagctctggagaccaagcccattctaccgctggagatggggcaatggcatttgatgtagaatacagacgatggcaggaagataaaaacagacagatgaaggagctgagttctgctatagattctcacgcgactgattctgagcttcggataattgtagatggagtaatagctcactatgaggagctttacaggataaaaggcaacgcagctaagagtgatgtcttccatttattatcagggatgtggaaaaccccagctgagagatgtttcttgtggctcggcggtttccgttcatcagaacttctcaagcttatagcgtgtcagttggagcccttgacagaacaacaatcgctagacataaataacttgcaacagtcaactcagcaagcagaagatgctttgtctcaagggatggacaacttacagcaatcactcgctgatactttatcgagtgggactctcggttcaagttcatcagggaatgtagctagctacatgggtcagatggccatggcgatggggaagttaggtacccttgaaggatttatccgccaggctgataacttaaggctacaaacatatcaacagatggtgagactattaacaacccgacaatcggctcgtgctctccttgcagtacacaattatacattgcggttacgtgctcttagctctctatggcttgccagaccaagagagtgaaccatgactctattatacttcaacgaaggtccagaaaatttgagattcttagcataagatttgacgactttagacacgtagctcgtatacaagattatgattatactgttttgtgttg

SEQ ID NO: 840 - protein, 330 aa, Arabidopsis thaliana
  G555,bZIP domain coordinates 38-110
MGDTSPRTSVSTDGDTDHNNLMFDEGHLGIGASDSSDRSKSKMDQKTLRRLAQNREAARKSRLRKKAYVQQLENSRLKLTQLEQELQRARQQGVFISSSGDQAHSTAGDGAMAFDVEYRRWQEDKNRQMKELSSAIDSHATDSELRIIVDGVIAHYEELYRIKGNAAKSDVFHLLSGMWKTPAERCFLWLGGFRSSELLKLIACQLEPLTEQQSLDINNLQQSTQQAEDALSQGMDNLQQSLADTLSSGTLGSSSSGNVASYMGQMAMAMGKLGTLEGFIRQADNLRLQTYQQMVRLLTTRQSARALLAVHNYTLRLRALSSLWLARPRE

SEQ ID NO: 841 - DNA, 1457 bp, Arabidopsis thaliana
  G556,family:bZIP
cttttttgaagcccttttgacacaaaagaccagaacaagttgaagaaatatgaatacaacctcgacacattttgttccaccgagaaggtttgaagtttacgagcctctcaaccaaatcggtatgtgggaagaaagtttcaagaacaatggagacatgtatacgcctggctctatcataatcccgactaacgaaaaaccagacagcttgtcagaggatacttctcatgggacagaaggaactcctcacaagtttgaccaagaggcttccacatctagacatcctgataagatacagagaaggctagcacagaatcgagaggcagctaggaaaagtcgtttgcgcaagaaagcttatgttcagcagctagagactagccggttaaagctaattcatttagagcaagaactcgatcgtgctagacaacagggtttctatgtggggaacggagtagataccaatgctcttagtttctcagataacatgagctcagggattgttgcatttgagatggaatatggacattgggtggaagaacagaacaggcaaatatgtgaactaagaacggttttacatggacaagttagtgatatagagcttcgttctctagtcgagaatgccatgaaacattactttcaactcttccgaatgaagtcagccgctgcaaaaatcgatgttttctatgtcatgtccggaatgtggaaaacttcagcagagcggtttttcttgtggataggcggatttagaccctcagagcttctcaaggttctgttaccgcattttgatcctttgacggatcaacaacttttggatgtatgtaatctgaggcaatcatgtcaacaatcagaagatgcgttatcccaaggtatggagaaactgcaacatacattagcagagagtgtagcagccgggaaacttggtgaaggaagttatattcctcaaatgacttgtgctatggagagattggaggctttggtcagctttgtaaatcaagctgatcatctgagacatgagacattgcaacagatgcatcggatcttaaccacgcgacaagcggctagaggtttgttagcattaggggagtatttccaaaggcttcgagctttgagttcgagttgggcggctaggcaacgtgaaccaacgtaattaaggtgtttagatgtcaagaaaggtttgagaccttaacaatcaagaatggagtttgctggtgagtggatttttgggtcaagaacaagagcaataacacaagctgctgtgtgatgatgaatcttgtcttgcggctaaaggaaatgtttgaggaaagttgtacatatgatcagcaacgtaaagtttatagctttttagaaaccaacttttcgatggttgttcttttttttttgtatgtaatattatagataagcttgtggtatatatgattttaatgtgacattacgaacttgatttataaccatggtaaaat

SEQ ID NO: 842 - protein, 364 aa, Arabidopsis thaliana
  G556,bZIP domain coordinates 83-143
MNTTSTHFVPPRRFEVYEPLNQIGMWEESFKNNGDMYTPGSIIIPTNEKPDSLSEDTSHGTEGTPHKFDQEASTSRHPDKIQRRLAQNREAARKSRLRKKAYVQQLETSRLKLIHLEQELDRARQQGFYVGNGVDTNALSFSDNMSSGIVAFEMEYGHWVEEQNRQICELRTVLHGQVSDIELRSLVENAMKHYFQLFRMKSAAAKIDVFYVMSGMWKTSAERFFLWIGGFRPSELLKVLLPHFDPLTDQQLLDVCNLRQSCQQSEDALSQGMEKLQHTLAESVAAGKLGEGSYIPQMTCAMERLEALVSFVNQADHLRHETLQQMHRILTTRQAARGLLALGEYFQRLRALSSSWAARQREPT

SEQ ID NO: 843 - DNA, 842 bp, Arabidopsis thaliana
  G557,family:bZIP
cagagatctgacggcggtagcagagtaatctattccttcccaaaatgtctcgcaattagattctttccaagttcttctgtaaatcccaagtcccgctcttttcctctttatccttttcaccagcttcgctactaagacaacaaatctttccctctctctctcgcctgatcgatcttcaaagagtaagaaaaatgcaggaacaagcgactagctctttagctgcaagctctttaccatcaagcagcgagaggtcatcaagctctgctccacatttggagatcaaagaaggaattgaaagcgatgaggagatacggcgagtgccggagtttggaggagaagctgtcggaaaagaaacttccggtagagaatctggatcggcgaccggtcaggagcggacacaggcgactgtcggagaaagtcaaaggaagcgagggaggacaccggcggagaaagagaacaagcggctgaagaggttgttgaggaacagagtttcagctcagcaagcaagagagaggaaaaaggcttacttgagcgagttggaaaacagagtgaaagacttggagaacaaaaactctgaacttgaagagcgactctctactcttcagaacgagaaccagatgcttagacatattctgaagaacacaacaggaaacaagagaggaggtggtggtggttctaatgctgatgcaagcctttgatctccttcttcttcttgtgttatatttttgtggataaaatttacagagaattgtatcaataattatcatgttaaaattatatgggatgtgagagctaatattgcaattgtagaccaagttctcttaaaaaaaaaaaaaaaaaaa

SEQ ID NO: 844 - protein, 168 aa, Arabidopsis thaliana
  G557,bZIP domain coordinates 35-47,78-157
MQEQATSSLAASSLPSSSERSSSSAPHLEIKEGIESDEEIRRVPEFGGEAVGKETSGRESGSATGQERTQATVGESQRKRGRTPAEKENKRLKRLLRNRVSAQQARERKKAYLSELENRVKDLENKNSELEERLSTLQNENQMLRHILKNTTGNKRGGGGGSNADASL

SEQ ID NO: 845 - DNA, 1638 bp, Arabidopsis thaliana
  G558,family:bZIP
ggaatttcggatcgtgtctctctctgtttctttgtttcaatccgatttcgaatcaagccctttacttgtgcaccttcaagatttcgttttttccagcgcccagaatgctccgggtgaccaacatttgttcctgattcatttcctattggttcgtattgtctgtgcacacaagagaaatttcaagaagttgttactaaaagagaggccacaagtggatattgtctttgttatcaagtgttagtacagaaaagtggtgagaaagtaatatggctgataccagtccgagaactgatgtctcaacagatgacgacacagatcatcctgatcttgggtcggagggagcactagtgaatactgctgcttctgattcgagtgaccgatcgaagggaaagatggatcaaaagactcttcgtaggcttgctcaaaaccgtgaggcagcaaggaaaagcagattgaggaagaaggcttatgttcagcagctagagaacagccgcttgaaactaacccagcttgagcaggagctgcaaagagcaagacagcagggcgtcttcatttcaggcacaggagaccaggcccattctactggtggaaatggtgctttggcgtttgatgctgaacattcacggtggttggaagaaaagaacaagcaaatgaacgagctgaggtctgctctgaatgcgcatgcaggtgattctgagcttcgaataatagtcgatggtgtgatggctcactatgaggagcttttcaggataaagagcaatgcagctaagaatgatgtctttcacttgctatctggcatgtggaaaacaccagctgagagatgtttcttgtggctcggtggatttcgttcatccgaacttctaaagcttctggcgaatcagttggagccaatgacagagagacagttgatgggcataaataacctgcaacagacatcgcagcaggctgaagatgctttgtctcaagggatggagagcttacaacagtcactagctgatactttatcgagcgggactcttggttcaagttcatcagggaatgtcgcaagctacatgggtcagatggccatggcaatgggaaagttaggtacactcgaaggatttatccgccaggctgataatttgagactacaaacattgcaacagatgataagagtattaacaacgagacagtcagcacgtgctctacttgcaatacacgattacttctcacggctacgagctctaagctccttatggcttgctcgacccagagagtgaaactgtattttggtcacatgtcagctgtacaaaatccatatggacacaaaaccaggagagactattaatcaacacttgtcagattcttcttaccaaatccatcaacaaataagcaaatttctgggaaacaaaagactctttgtatgtaggtttcttctacatggttgtggtaattcatgttgttttagttgtagtcatcagtttttaatttagcatttgaaaagttcaatgttgtttatatagcatcttcgattatcttagaaaggttattgaattttgtttttttttgttacttttgtgtgtggtaaaggtgttttaaccttgcaacttctgtactgtaatcatttaacaatattaagatgttctatttgagttttgt

SEQ ID NO: 846 - protein, 330 aa, Arabidopsis thaliana
  G558,bZIP domain coordinates 45-105
MADTSPRTDVSTDDDTDHPDLGSEGALVNTAASDSSDRSKGKMDQKTLRRLAQNREAARKSRLRKKAYVQQLENSRLKLTQLEQELQRARQQGVFISGTGDQAHSTGGNGALAFDAEHSRWLEEKNKQMNELRSALNAHAGDSELRIIVDGVMAHYEELFRIKSNAAKNDVFHLLSGMWKTPAERCFLWLGGFRSSELLKLLANQLEPMTERQLMGINNLQQTSQQAEDALSQGMESLQQSLADTLSSGTLGSSSSGNVASYMGQMAMAMGKLGTLEGFIRQADNLRLQTLQQMIRVLTTRQSARALLAIHDYFSRLRALSSLWLARPRE

SEQ ID NO: 847 - DNA, 2707 bp, Arabidopsis thaliana
  G576,family:BZIPT2
ttcctttccacttaaaaacctcaactttgatttctgtacgaacattctgattcttcgaatctcaaagaaatttcaaaactttttgattttgatgggttgttcaacctcaaagctcgacgatcttccagcggtggcgctttgtcgtgaccgttgtagcttccttgaagcagcgattcatcaacgttacgctttatcagaagctcacgtatcctacacacaatccttaaaagcaatctctcactctcttcaccaattcatcaatcaccaccaccgttacaacgattccgattcacccaaaaaagctaaacccaagatggattctgggtcgggtcatctcgatttcgattcggattctgactctgacgacgatgatgatattgattcgttgcattcatctcctctccatcatcatctagaagatgatgactcgaatccgaaatcgtatttgcatatgaattatatgaagaatagttatatgcctccttctttggtttatgagcagagaccttcgagtcctcagagagttcatttcggtgaatcatcatcatcatcaacctctgagtataatccatatctgaattcgaactacggatcgaaattgcctccgccgccaccgtcgccgccgagggaaaaggtttgggatttcttagacccttttgatacgtattatactccgtatactcctagtcgtgatacgagagagttaagagatgaattgggtgttccggatttagaggaagatgatgtagttgttaaggaagtacatgggaaacagaaatttgtagctgcagtttctgtggaagagccgttaggtaactccggtgctagcactagcggaggaggaggaggaggaggtaaggcttctttgtatcagactaggccaagtgtgtcagttgagaaagaagaaatggagcatgaggttcatattgtggagaaaaaaattgttgaggatagtggtggggatgaggtgaggaagagtaaggctgcggtggcacgtggtggtggcggtgtcagacgtggggttcctgaggttgcgaaagagatagaagctcagttcttgagagctgcagagtcaggaaatgagatcgcagtgatgcttgaagtggggaaacatccatatggtcgcaaaaatgtttcttcgaagaagctatatgaggggaccccatcaccgtctgtggtttcgtcagctcaatcatcaacctccaaaaaagctaaagctgaagcctcttcttcagtgactgctcctacttatgcagacattgaggcagagcttgctttaaagtctcgtaatctttcttcgacattgcacaagctccacctttgggagaagaagctttacgatgaggtcaaggccgaggaaaaaatgcgtgtaaaccatgagaaaaagttaaggaagcttaagcgtatggatgaaagaggtgccgagaatcaaaaagtagattcaacacgaaaattagttagaagtttgtccacaaagataaggattgcgattcaagttgttgacaaaatatcagttacaattaacaagataagagacgaagagctatggctgcaactcaatgaattgatccaagggcttagcaaaatgtggaaatccatgcttgagtgccataaaagtcagtgtgaggctattaaggaagccagaggtttaggccccattagagcaagcaaaaattttggtggggagcatctcgaggtaacaaggacgcttggatatgaacttataaattggattgtgggattttcgagttgggttagtgcgcaaaagggttttgtaagagagctgaatagttggcttatgaagtgtcttttctatgaacctgaggaaactccagatggaatcgttcctttttctcctggtcgtattggggctccaatgattttcgtgatctgtaaccagtgggaacaagctctagatagaatatcagaaaaggaagttatcgaggctatacgccgtttcacaacgagtgtgcttcatctttgggaacaagataggttagcaacccgggagaggattatagggcatggtgatcctaggaatatggaccgagaggaacagagaatacagaaagagattcaagaattggaaatgaaaatggttctggttggtccaggggaagataacattgtctaccaaagcgacactagtaacgagagtttacagggtagtcttcaacgtatatttgaagctatggagaggtttacagaggaatctctgaaagcttatgtagatctcttacatcgtgctgaagaagaagaatgcgactctcgggaaacagatgaagaagactaatggaaaaccgtggaggaaagtatcgcataaccaaaaaaactcatcagagttgtgaggcttaagacagctaattttgtgcttggccatggttgcatgatcagccattactcagctctgcgtggtttatagaccggagtaccgggccagatttatatatgactggtatttaatgggaagttacacataatcttccctaggcacgggcactaactgctccctccggagacattggataaagagatgggtcaaatgctcggttaacggaagaaggtgcttgccctattgaagaactggatggttagttaccatggttggatagaaatgtaagagaatttgccacacatcatgcaagttactggtgtagctcaagctacgataaatacaagagttcgttgatccaaaggataaccaaaa

SEQ ID NO: 848 - protein, 733 aa, Arabidopsis thaliana
  G576,BZIPT2 domain coordinates 1-34,400-510
MGCSTSKLDDLPAVALCRDRCSFLEAAIHQRYALSEAHVSYTQSLKAISHSLHQFINHHHRYNDSDSPKKAKPKMDSGSGHLDFDSDSDSDDDDDIDSLHSSPLHHHLEDDDSNPKSYLHMNYMKNSYMPPSLVYEQRPSSPQRVHFGESSSSSTSEYNPYLNSNYGSKLPPPPPSPPREKVWDFLDPFDTYYTPYTPSRDTRELRDELGVPDLEEDDVVVKEVHGKQKFVAAVSVEEPLGNSGASTSGGGGGGGKASLYQTRPSVSVEKEEMEHEVHIVEKKIVEDSGGDEVRKSKAAVARGGGGVRRGVPEVAKEIEAQFLRAAESGNEIAVMLEVGKHPYGRKNVSSKKLYEGTPSPSVVSSAQSSTSKKAKAEASSSVTAPTYADIEAELALKSRNLSSTLHKLHLWEKKLYDEVKAEEKMRVNHEKKLRKLKRMDERGAENQKVDSTRKLVRSLSTKIRIAIQVVDKISVTINKIRDEELWLQLNELIQGLSKMWKSMLECHKSQCEAIKEARGLGPIRASKNFGGEHLEVTRTLGYELINWIVGFSSWVSAQKGFVRELNSWLMKCLFYEPEETPDGIVPFSPGRIGAPMIFVICNQWEQALDRISEKEVIEAIRRFTTSVLHLWEQDRLATRERIIGHGDPRNMDREEQRIQKEIQELEMKMVLVGPGEDNIVYQSDTSNESLQGSLQRIFEAMERFTEESLKAYVDLLHRAEEEECDSRETDEED

SEQ ID NO: 849 - DNA, 978 bp, Arabidopsis thaliana
  G578,family:bZIP
atgcatagtttgaatgaaacagtaattcctgatgttgattacatgcagtctgatagagggcatatgcatgctgctgcctctgattccagtgatcgatcaaaggataagttggatcaaaagacccttcgtaggcttgctcaaaatcgtgaggcagcaagaaaaagcagattgaggaagaaggcgtatgttcagcagctggaagatagtcgattaaagctgactcaagttgagcaggagctgcaaagagcaagacagcagggagttttcatctcaagttcaggagaccaagctcattctactggtggcaatggtggggctttggcatttgatgcagaacactcacgatggcttgaagaaaagaacaggcaaatgaacgagctgagatctgccctgaatgctcatgcaggtgatactgagctccggataattgtggatggagtgatggctcactatgaggagcttttcaggattaagagcaatgcatctaagaatgatgtcttccacttgttatctggaatgtggaaaacaccagctgagcgatgtttcttgtggcttggcgggttcccgtcatccgaacttctcaagcttcttgcgaatcagctagagcccatgacagaacgacaggtaatgggcatcaatagcttgcagcagacgtcgcagcaggcagaagatgctttatctcaagggatggagagtttacagcaatccctagctgatactttatccagtggaactcttggttccagttcatcggataatgtcgcgagctacatgggtcagatggccatggcaatgggcaagttaggcaccctcgaaggattcatacgccaggctgataacttgaggctgcaaacactacaacagatgcttcgagtattaacaacacgtcagtcagctcgtgctcttcttgctatacacgattattcatctcgattacgtgctcttagttccttgtggcttgcccggccaagagagtga

SEQ ID NO: 850 - protein, 325 aa, Arabidopsis thaliana
  G578,bZIP domain coordinates 36-96
MHSLNETVIPDVDYMQSDRGHMHAAASDSSDRSKDKLDQKTLRRLAQNREAARKSRLRKKAYVQQLEDSRLKLTQVEQELQRARQQGVFISSSGDQAHSTGGNGGALAFDAEHSRWLEEKNRQMNELRSALNAHAGDTELRIIVDGVMAHYEELFRIKSNASKNDVFHLLSGMWKTPAERCFLWLGGFPSSELLKLLANQLEPMTERQVMGINSLQQTSQQAEDALSQGMESLQQSLADTLSSGTLGSSSSDNVASYMGQMAMAMGKLGTLEGFIRQADNLRLQTLQQMLRVLTTRQSARALLAIHDYSSRLRALSSLWLARPRE

SEQ ID NO: 851 - DNA, 1023 bp, Arabidopsis thaliana
  G6,family:AP2
tatctatccgagaatggccaagatgggcttgaaacccgacccggctactactaaccagacccacaataatgccaaggagattcgttacagaggcgttaggaagcgtccttggggccgttatgccgccgagatccgagatccgggcaagaaaacccgcgtctggcttggcactttcgatacggctgaagaggcggcgcgtgcttacgatacggcggcgcgtgattttcgtggtgctaaggctaagaccaatttcccaacttttctcgagctgagtgaccagaaggtccctaccggtttcgcgcgtagccctagccagagcagcacgctcgactgtgcttctcctccgacgttagttgtgccttcagcgacggctgggaatgttcccccgcagctcgagcttagtctcggcggaggaggcggcggctcgtgttatcagatcccgatgtcgcgtcctgtctactttttggacctgatggggatcggtaacgtaggtcgtggtcagcctcctcctgtgacatcggcgtttagatcgccggtggtgcatgttgcgacgaagatggcttgtggtgcccaaagcgactctgattcgtcatcggtcgttgatttcgaaggtgggatggagaagagatctcagctgttagatctagatcttaatttgcctcctccatcggaacaggcctgagcttttaacggtgtcgtttcaattcgaagcgcatgcgtttcttcttctttttgagctgtgaaaattcgttttctcatagtttttcctctctctctctctcagtctaaatttattaccagtttttagaaagaaaaaacagattaaatctgagagagaaaaatataattttagctgacatggatcgttatgtacatattattacataaccggagatctgaacttttgttgtgtgcttttaattttttgcgacttggtttcaccccatgttgtttctctattttttttactactttttttttttttgttcttccaaattttcaatcaataatttggtaatcttc

SEQ ID NO: 852 - protein, 222 aa, Arabidopsis thaliana
  G6,AP2 domain coordinates 22-89
MAKMGLKPDPATTNQTHNNAKEIRYRGVRKRPWGRYAAEIRDPGKKTRVWLGTFDTAEEAARAYDTAARDFRGAKAKTNFPTFLELSDQKVPTGFARSPSQSSTLDCASPPTLVVPSATAGNVPPQLELSLGGGGGGSCYQIPMSRPVYFLDLMGIGNVGRGQPPPVTSAFRSPVVHVATKMACGAQSDSDSSSVVDFEGGMEKRSQLLDLDLNLPPPSEQA

SEQ ID NO: 853 - DNA, 1263 bp, Arabidopsis thaliana
  G605,family:AT-hook
aattccatcctaataattttcaaagctttaattctaagaaataatatctacaagaaaatattatctcatgtatggagactaccggagaagttgttaaaacaaccaccgggagcgacggaggcgttacggtggtgagatccaacgcgccgtcagacttccacatggctccgaggtcagaaacttcaaacacacctcccaactccgtcgctcctcctcctcctccaccgccgcaaaactcctttactccgtcggcggctatggatggtttctcaagcggaccgataaagaagagacgtgggcgccctaggaagtacggacacgacggagcagcggtgacgctatctccgaatccgatatcatcagccgcaccaacgacttctcacgtcatcgatttctcgacgacatcggagaaacgtggcaaaatgaaaccagcaactccaactccaagctcattcatcaggccaaagtaccaggtcgagaatttaggtgaatggtctccttcctctgccgccgctaatttcacgccgcatattattacggtgaatgcaggcgaggacgttacgaagaggataatatcattttctcaacaagggtctctagctatttgcgttttatgcgcaaacggtgtcgtttcgagcgttacacttcgtcagcctgattcatctggtggtacattgacctatgagggtcggtttgagatattgtcactatctggaacattcatgcctagtgactcagacgggacacgaagcagaacaggcgggatgagcgtgtcgcttgctagccctgatggacgtgtagtaggtggtggtgttgctggcttgctggttgcagccactcctattcaagtggttgtaggaactttcttaggtggaacaaaccagcaagaacagacaccgaagccgcataaccacaacttcatgtcttctccattaatgccaacttcttcgaatgtagctgatcatcgaaccatccgtcccatgacatctagtctcccgatcagtacatggacaccgtcttttccttctgattcacgacacaagcattctcatgactttaatatcactttgacgtgatttcttccttgaagaactcgtagatcctctgtattttggtttccagtttagggctctacatgttagactctcaaagtctaggtgttatgttggtctgtcacttaggattgtcacttaggattgttagaccatctccatcaatggtttctcattgagaaactgttcaatataaaaataaaatataatc

SEQ ID NO: 854 - protein, 334 aa, Arabidopsis thaliana
  G605,AT-hook domain coordinates 132-143
METTGEVVKTTTGSDGGVTVVRSNAPSDFHMAPRSETSNTPPNSVAPPPPPPPQNSFTPSAAMDGFSSGPIKKRRGRPRKYGHDGAAVTLSPNPISSAAPTTSHVIDFSTTSEKRGKMKPATPTPSSFIRPKYQVENLGEWSPSSAAANFTPHIITVNAGEDVTKRIISFSQQGSLAICVLCANGVVSSVTLRQPDSSGGTLTYEGRFEILSLSGTFMPSDSDGTRSRTGGMSVSLASPDGRVVGGGVAGLLVAATPIQVVVGTFLGGTNQQEQTPKPHNHNFMSSPLMPTSSNVADHRTIRPMTSSLPISTWTPSFPSDSRHKHSHDFNITLT

SEQ ID NO: 855 - DNA, 699 bp, Arabidopsis thaliana
  G627,family:MADS
atggtgaggggcaaaacggagatgaagaggatagagaacgcaacaagcaggcaagtgacgttttcgaagagaagaaatggactcttgaagaaagccttcgaattatcggtcctttgtgatgctgaagttgctttggttatcttctctccaagatccaaactctatgagttctctagctctagtatagcagcaacaattgaacgctatcagagacgaataaaagaaattgggaataatcataagagaaatgataattctcagcaagcgagagacgaaacatctggattgacaaaaaagattgaacagctagagatatctaaacgaaaattgcttggagaaggcattgatgcatgttccatcgaggagctgcaacagttagagaatcagttggaccgaagcttgagcaggataagagccaagaagtaccaattactccgtgaagaaattgagaagttgaaggcagaggagaggaatctcgttaaggaaaataaagatctgaaggagaagtggcttggaatgggaacagcaacaatagcatcatcacaatcaacgttatcatcatcagaagtgaacatagatgacaatatggaagtggagactggtttgttcattggacctcctgagacaagacaatccaaaaaattccctcctcaaaattaatcttacaacttcttcaaaaagaatgttttaactatatga

SEQ ID NO: 856 - protein, 219 aa, Arabidopsis thaliana
  G627,MADS domain coordinates 1-57
MVRGKTEMKRIENATSRQVTFSKRRNGLLKKAFELSVLCDAEVALVIFSPRSKLYEFSSSSIAATIERYQRRIKEIGNNHKRNDNSQQARDETSGLTKKIEQLEISKRKLLGEGIDACSIEELQQLENQLDRSLSRIRAKKYQLLREEIEKLKAEERNLVKENKDLKEKWLGMGTATIASSQSTLSSSEVNIDDNMEVETGLFIGPPETRQSKKFPPQN

SEQ ID NO: 857 - DNA, 1557 bp, Arabidopsis thaliana
  G629,family:bZIP
cgaaatgaaaaaattctctgtattaccagaaacgtgtttcataagcatctttaactcttcagctctcaaattcttcatgaatatctctgcttatcggatcaagtgagagcaaatgcaatttttaagagccagctattggatctataactgaagaggatatatatagagatgatgagttcttcttctccaacacaacttgcatctttaagagacatgggaatctatgagccatttcaacaaattgtcggttggggaaatgttttcaaatctgatatcaatgatcatagtcccaatactgctacttcctctattattcaggttgatcctagaattgatgatcacaacaacaacatcaagataaattatgattcttctcataaccagatcgaagcagaacaaccttctagtaatgataatcaagatgatgatggcaggattcatgataagatgaaacggcgtttagcgcagaaccgagaagcggctcgcaaaagtcgtttgagaaagaaggcttatgttcagcagttagaggaaagccggttaaagttatcgcagttagagcaagaactcgaaaaggttaagcagcagggccatttaggaccatctgggagtattaacacagggattgcatcatttgagatggaatattcacactggctacaagaacaaagcagaagagttagcgaactacgaacagcgcttcaatctcatataagcgacatagaactcaagatgctagtagagagttgcttgaaccattacgctaatcttttccgaatgaaatccgatgcagcaaaagccgatgttttctacttgatatcgggaatgtggcgaacttcaaccgaaagattcttccaatggattggagggtttcgtccatccgaacttttaaacgttgtgatgccttatcttcaaccattaacggatcaacaaatcttggaagtgagaaacctccaacaatcatcacaacaagcagaggatgctctgtctcaagggattgataaacttcaacagagtttagctgaaagcattgtgattgatgcggttatcgagtccacgcattatcccactcacatggctgcagctatagagaatcttcaagcattagaaggatttgtgaatcaagcagatcatctgaggcaacaaactttgcaacaaatggcgaagatcttaacgacaagacaatcggctcgaggtttactagctttaggagagtatcttcatagacttcgtgctcttagttctctttgggcagctcgtccacaagaaccaacttaaaagaggaacttattaaaactttaaaaacaagaaacagcagaatcaaaagtcttgaagaagcatactcatcacaaagcttggaaggatgttttaaaaaagatctttgttaattaagtagagtgagattctcttgattagaactttatggtttttgctttatgaagtatctctccagagaagattgtaaatttgggttgaaactttgtaatatattaagatccaccaaataagtttgaaatctgagcaatttgataataaaaaaaaaaaaaaaaaaaaaaaaaa

SEQ ID NO: 858 - protein, 368 aa, Arabidopsis thaliana
  G629,bZIP domain coordinates 92-152
MMSSSSPTQLASLRDMGIYEPFQQIVGWGNVFKSDINDHSPNTATSSIIQVDPRIDDHNNNIKINYDSSHNQIEAEQPSSNDNQDDDGRIHDKMKRRLAQNREAARKSRLRKKAYVQQLEESRLKLSQLEQELEKVKQQGHLGPSGSINTGIASFEMEYSHWLQEQSRRVSELRTALQSHISDIELKMLVESCLNHYANLFRMKSDAAKADVFYLISGMWRTSTERFFQWIGGFRPSELLNVVMPYLQPLTDQQILEVRNLQQSSQQAEDALSQGIDKLQQSLAESIVIDAVIESTHYPTHMAAAIENLQALEGFVNQADHLRQQTLQQMAKILTTRQSARGLLALGEYLHRLRALSSLWAARPQEPT

SEQ ID NO: 859 - DNA, 1661 bp, Arabidopsis thaliana
  G631,family:bZIP
cttcttcttcttcttcttcttcttcttcctcctctctcgtcggatctctctgatttagtgatttttcaaatttcaagttttcttcacctttaattttgtgtctcgttgatctctctttggacattctgctttggattctggaggcttctcattagatctctattagtgggtttaggtcaagttcttgaaatggataaggagaaatctcctgcaccaccacctagtggaggtcttcctccaccatcgggtcgttactctgcgttttcacctaatggaagtagctttgcaatgaaagctgaatcatcttttcctcctttgactccaagtggaagcaatagctcagatgctaaccgattcagccatgatattagccgaatgccggataatccacctaagaacctaggccatcgccgagctcattcagagattcttactcttcctgatgacttaagctttgatagtgatcttggtgtggttggtgctgctgatggaccttctttctctgatgatactgacgaggacttactctatatgtatcttgatatggaaaaattcaattcttctgctacatcgacttctcaaatgggtgagccatcagaaccgacttggaggaatgaattagcctcgacttctaaccttcagagtacacccggtagctctagtgaaagaccgagaattagacaccaacacagccaatcgatggatggttcaacaactatcaagcctgagatgcttatgtcagggaatgaagatgtgtctggagttgactctaagaaagccatctctgctgctaaactttctgagcttgctctcattgatccaaaacgcgccaagaggatatgggcaaacaggcagtctgctgcgaggtcaaaagaaaggaagatgagatacattgcagagctcgagagaaaagtacagactttacaaacagaggccacatctctctcagcccagttgactctcttacagagagatacaaatggcctgggtgttgaaaacaatgagcttaaactgcgagtacaaactatggagcaacaggtccacctacaggatgctttaaatgatgcactaaaggaggaagtccagcatcttaaggtattgacggggcaaggtccatcaaatggtacatcaatgaactacggttcttttggatcaaaccagcaattctatcccaataatcagtcgatgcacactatcttagccgcacaacagttacagcagctccagatccagtcacagaaacagcaacaacaacaacagcaacaccagcaacaacaacagcagcagcagcagcaatttcactttcaacagcagcaactgtaccagcttcagcagcagcaacggcttcaacaacaggaacaacaaagcggggcttcagagctaagaagacccatgccttctcctggtcagaaagagagtgtgacatcgcctgatcgtgaaactcccttgacaaaagactgagtctagactgtgctaatgtccaatttagtaagttactcttggaaaatcttctttttcatcgcaggctcatggatttgggatttactgcattatagagttaaaaacaagacagcttagaagttgcggatttagaagttgttagtgaagcttttgttctcgtctgttggtagtttacaatcttctctttgtatgatcctaag

SEQ ID NO: 860 - protein, 423 aa, Arabidopsis thaliana
  G631,bZIP domain coordinates 212-282
MDKEKSPAPPPSGGLPPPSGRYSAFSPNGSSFAMKAESSFPPLTPSGSNSSDANRFSHDISRMPDNPPKNLGHRRAHSEILTLPDDLSFDSDLGVVGAADGPSFSDDTDEDLLYMYLDMEKFNSSATSTSQMGEPSEPTWRNELASTSNLQSTPGSSSERPRIRHQHSQSMDGSTTIKPEMLMSGNEDVSGVDSKKAISAAKLSELALIDPKRAKRIWANRQSAARSKERKMRYIAELERKVQTLQTEATSLSAQLTLLQRDTNGLGVENNELKLRVQTMEQQVHLQDALNDALKEEVQHLKVLTGQGPSNGTSMNYGSFGSNQQFYPNNQSMHTILAAQQLQQLQIQSQKQQQQQQQHQQQQQQQQQQFHFQQQQLYQLQQQQRLQQQEQQSGASELRRPMPSPGQKESVTSPDRETPLTKD

SEQ ID NO: 861 - DNA, 891 bp, Arabidopsis thaliana
  G648,family:Z-Dof
atggatgctacgaagtggactcagggttttcaagaaatgataaacgtaaagccaatggagcaaatgatttctagcaccaacaacaacacaccgcaacaacaaccaacattcatcgccaccaacacaaggccaaacgccaccgcatccaatggtggctccggaggaaataccaacaacacggctacgatggaaactagaaaggcgaggccacaagagaaagtaaattgtccaagatgcaactcaacaaacacaaagttctgttattacaacaactacagtctcacgcaaccaagatacttctgcaaaggttgtcgaaggtattggaccgaaggtggctctcttcgtaacgtcccagtcggaggtagctcaagaaagaacaagagatcctctacacctttagcttcaccttctaatcccaaacttccagatctaaacccaccgattcttttctcaagccaaatccctaataagtcaaataaagatctcaacttgctatctttcccggtcatgcaagatcatcatcatcatgctcttgagcttctaagatccaatggagtctcttcaagaggcatgaacacgttcttgcctggtcaaatgatggattcaaactcagtcctgtactcatctttagggtttccaacaatgcctgattacaaacagagtaataacaacctttcattctccattgatcatcatcaagggattggacataacaccatcaacagtaaccaaagagctcaagataacaatgatgacatgaatggagcaagtagggttttgttccctttttcagacatgaaagagctttcaagcacaacccaagagaagagtcatggtaataatacatattggaatgggatgttcagtaatacaggaggatcttcatggtga

SEQ ID NO: 862 - protein, 296 aa, Arabidopsis thaliana
  G648,Z-Dof domain coordinates 76-104
MDATKWTQGFQEMINVKPMEQMISSTNNNTPQQQPTFIATNTRPNATASNGGSGGNTNNTATMETRKARPQEKVNCPRCNSTNTKFCYYNNYSLTQPRYFCKGCRRYWTEGGSLRNVPVGGSSRKNKRSSTPLASPSNPKLPDLNPPILFSSQIPNKSNKDLNLLSFPVMQDHHHHALELLRSNGVSSRGMNTFLPGQMMDSNSVLYSSLGFPTMPDYKQSNNNLSFSIDHHQGIGHNTINSNQRAQDNNDDMNGASRVLFPFSDMKELSSTTQEKSHGNNTYWNGMFSNTGGSSW

SEQ ID NO: 863 - DNA, 1310 bp, Arabidopsis thaliana
  G666,family:MYB-(R1)R2R3
attagatccatttcagagctaagcgtactaattagtgtactaagggtagtgtgactcattaccacctaaagtagtttcaattttcttctatttttcttggcaaagagttatagtgggaaacaaagggagtggttaataaagaattaattagttaattaagggagttcaagatcataatggtgaggcctccttgttgtgacaaaggaggagtgaagaaagggccatggactcctgaagaagatatcattttagtcacttacatccaagaacatggtcctggtaattggagagctgttcctaccaatactgggctgcttagatgcagtaagagttgtagacttagatggacaaactatttaaggccaggaatcaaaagaggcaatttcacagaacatgaagaaaagatgattgttcatctccaagccctcttaggaaatagatgggctgcaattgcgtcatatcttccacaaaggacagacaatgacattaagaactattggaacactcatttgaagaagaaactcaacaaagtcaatcaagattctcatcaagaacttgaccgttcctcgctctcatcttcaccatcgtcttcttctgctaattccaactcaaacatctcaagaggccaatgggaaaggcgacttcaaaccgatatccacttggcgaaaaaggctctctctgaggctttatctcctgccgttgcaccaatcattacatctacagtgacaacaacgtcttcctctgctgaatcaagacgctctacttcctcagctagcgggtttcttaggacgcaagaaacatctacaacttatgcctcaagcaccgaaaatatcgcgaaattgctcaaagggtgggtgaaaaactcgccgaagactcaaaactccgcggatcaaatcgcttctacagaggtaaaagaagtgatcaagagtgatgatgggaaggagtgtgcaggggcatttcagtcattttctgagtttgatcactcatatcaacaggctggtgtttcacctgatcatgagaccaaaccagacataactggatgctgcagtaaccaaagtcaatggtctttgtttgagaagtggttgtttgaggattctggtggacagattggtgatattctattggatgaaaacactaatttcttctgaagagtttgctttaatcacatggttctaattttaggatcctcatctctattttttttttgggttttccaaattaactcgcttagattatcgtgagataaatcagtaataattttatttattttccctctttaatttacaattaatgatggggttgcttttaaa

SEQ ID NO: 864 - protein, 323 aa, Arabidopsis thaliana
  G666,MYB-(R1)R2R3 domain coordinates 14-116
MVRPPCCDKGGVKKGPWTPEEDIILVTYIQEHGPGNWRAVPTNTGLLRCSKSCRLRWTNYLRPGIKRGNFTEHEEKMIVHLQALLGNRWAAIASYLPQRTDNDIKNYWNTHLKKKLNKVNQDSHQELDRSSLSSSPSSSSANSNSNISRGQWERRLQTDIHLAKKALSEALSPAVAPIITSTVTTTSSSAESRRSTSSASGFLRTQETSTTYASSTENIAKLLKGWVKNSPKTQNSADQIASTEVKEVIKSDDGKECAGAFQSFSEFDHSYQQAGVSPDHETKPDITGCCSNQSQWSLFEKWLFEDSGGQIGDILLDENTNFF

SEQ ID NO: 865 - DNA, 1182 bp, Arabidopsis thaliana
  G730,family:GARP
ctttttgaaataaataacattatacccctcctttttcccataaaattcatcaagattatctcaaaatcattcaccaattctctcttcttatggagcttttcccttcacaacctgacttgtacttgaagatcagccgaagaagagaagaagaacaagaaaaagaaagtcaagaactacaagaacaagaagtcgaaaggagattagggtttcagagtaaagcctcagatttagacaacaagtcttcaaataatctcatccacactctccagttcacttcaaacaatgaagccaccaagattaatagtaatcaagaacacaaggaatctctcgatcaagacttgagatctatttttatgatgagaccaataagaggaatccctctttaccagaatcaagtccttgaccactactactactcatctacctctcccaatcctttcttcttcagtgaagtcaacggtcaacatgctagtcgtcgcttaatcacaaaccctaattgtagttttaatctccacaaccgtcatcggcgtcaagctcaaccgcagccgccaagattcaccgccaaaagaggagtaagggctccaaggatgcggtggacgacgaccctccacgcccattttgtacacgctgttcaattattgggtggtcatgaaagagcaaccccaaaatcagtacttgagctgatggatgtgcaagatctcacattggctcatgttaaatcccatctacagatgtatcgaaccatcaagtctactgaaaaacctacaacgtcatcagggcagtcagattgtgagaatggatcacaagtaaacagtgagagagaagcaagaaatctcacgggtctatggaataactcctcaagtgaagctcggttccagttgaaggcaaaggcatcatcaggtgtagacatttcatccaatgagaatgaatggaagaatcgaagatgtccaagcaacgaacggttgtcgtcagattcgtcaagccttacagggacaagaccagagactgaaactcccaatcttgatttcactttagctacaccaaacctctctccctaattttcttatatatactaaaaatacatattatctgttaaaaattatataaatctcaaacttaaaagtttatgcttttgaaaaaatatatatgaaatgacgtttatttcttccttaaaaaaaaaaa

SEQ ID NO: 866 - protein, 322 aa, Arabidopsis thaliana
  G730,GARP domain coordinates 169-217
MELFPSQPDLYLKISRRREEEQEKESQELQEQEVERRLGFQSKASDLDNKSSNNLIHTLQFTSNNEATKINSNQEHKESLDQDLRSIFMMRPIRGIPLYQNQVLDHYYYSSTSPNPFFFSEVNGQHASRRLITNPNCSFNLHNRHRRQAQPQPPRFTAKRGVRAPRMRWTTTLHAHFVHAVQLLGGHERATPKSVLELMDVQDLTLAHVKSHLQMYRTIKSTEKPTTSSGQSDCENGSQVNSEREARNLTGLWNNSSSEARFQLKAKASSGVDISSNENEWKNRRCPSNERLSSDSSSLTGTRPETETPNLDFTLATPNLSP

SEQ ID NO: 867 - DNA, 905 bp, Arabidopsis thaliana
  G767,family:NAC
cgaagtttcaactttcaaacatatctttacagttctttcttgctaaacaacaataaaggggaaaataggttaattatgatgaaatctggggctgatttgcaatttccaccaggatttagatttcatcctacggatgaggagctagtcctcatgtatctctgtcgtaaatgcgcgtcgcagccgatccctgctccgattatcaccgaactcgatttgtaccgatatgatccttgggaccttcccgacatggctttgtacggtgaaaaggagtggtattttttctcaccaagagatcgaaagtatccaaacggttcaagacccaaccgtgcagctggtactggatattggaaagctaccggagctgataaaccaataggtcgtcctaaaccggttggtattaagaaggctctagtgttttactcgggaaaacctccaaatggagagaaaaccaattggattatgcacgaataccggctcgctgacgttgaccggtcggttcgtaagaaaaacagtctaagattggacgattgggtattgtgtcgtatatataacaagaaaggtgtcatcgagaagcgacgaagcgatatcgaggacgggttaaagcctgtgactgacacgtgtccaccggaatctgtggcgagattgatctccggctcggagcaagcggtgtcaccggaattcacgtgtagcaacggtcggttgagtaatgcccttgattttccgtttaattacgtagatgccatcgccgataacgagattgtgtcacggctattgggcgggaatcagatgtggtcgacgacgcttgatccacttgtggttaggcagggaactttctgagttgtcacgtgcgattagagttagtggaaagtggaaactatcactgtctgttttcgcacgtgtcgggc

SEQ ID NO: 868 - protein, 253 aa, Arabidopsis thaliana
  G767,NAC domain coordinates 8-158
MMKSGADLQFPPGFRFHPTDEELVLMYLCRKCASQPIPAPIITELDLYRYDPWDLPDMALYGEKEWYFFSPRDRKYPNGSRPNRAAGTGYWKATGADKPIGRPKPVGIKKALVFYSGKPPNGEKTNWIMHEYRLADVDRSVRKKNSLRLDDWVLCRIYNKKGVIEKRRSDIEDGLKPVTDTCPPESVARLISGSEQAVSPEFTCSNGRLSNALDFPFNYVDAIADNEIVSRLLGGNQMWSTTLDPLVVRQGTF

SEQ ID NO: 869 - DNA, 1036 bp, Arabidopsis thaliana
  misc_feature (1012)..(1012): n is a, c, g, or t
  G859,family:MADS
gatttgtcattttttgtctagccaaaaaaaaaaaaaaaaaaggagagagagagagagagagagagagagagaaacgaagaaaaaaaaagaagcaaaaaacattgtgggtctccggtgattaggatcaaattagggcaccagccttatcggaggaagaagccatgggtagaaaaaaagtcgagatcaagcgaatcgagaacaaaagtagtcgacaagtcactttctccaaacgacgcaatggtctcatcgagaaagctcgacaactttcaattctctgtgaatcttccatcgctgttctcgtcgtctccggctccggaaaactctacaagtctgcctccggtgacaacatgtcaaagatcattgatcgttacgaaatacatcatgctgatgaacttgaagccttagatcttgcagaaaaaactcggaattatctgccactcaaagagttactagaaatagtccaaagcaagcttgaagaatcaaatgtcgataatgcaagtgtggatactttaatttctctggaggaacagctcgagactgctctgtccgtaactagagctaggaagacagaactaatgatgggggaagtgaagtcccttcaaaaaacggagaacttgctgagagaagagaaccagactttggctagccaggtggggaagaagacgtttctggttatagaaggtgacagaggaatgtcatgggaaaatggctccggcaacaaagtacgggagactcttccgctgctcaagtaatcaccatcatcaacggctgagctttcaccttaaacttacagcctgattcagaagtttttacaaatttgtaaattataaaaagcttcataataatctcaacctttttatcttcctcgcgccaatgtggaaattaaggttaaaaataaaataaaacagaagctcatgcgaaagaattgtaaaactaagataaagctatagtagatctttattgtaccttcgtagacgatataagatttattcgtgtgtttgtcttcccctcnaaaaaaaaaaaaaaaaaaaaaaaa

SEQ ID NO: 870 - protein, 196 aa, Arabidopsis thaliana
  G859,MADS domain coordinates 1-57
MGRKKVEIKRIENKSSRQVTFSKRRNGLIEKARQLSILCESSIAVLVVSGSGKLYKSASGDNMSKIIDRYEIHHADELEALDLAEKTRNYLPLKELLEIVQSKLEESNVDNASVDTLISLEEQLETALSVTRARKTELMMGEVKSLQKTENLLREENQTLASQVGKKTFLVIEGDRGMSWENGSGNKVRETLPLLK

SEQ ID NO: 871 - DNA, 1747 bp, Arabidopsis thaliana
  G864,family:AP2
tgcaaaaacattttcttgtctctcctctgcccaaattttttttctttccaggaatatttcctagaaaaacccaagcaaagctttaaccccttcctcctccaaaagtagcatcttcctctttttctatttctcctttcctcttcttatctctctctcgtttgtgaacgattccttaagaatataaccaaaagcccttttctcctttcttcaactttccgggaaaaatcttcacgcagcaaggtttctctctcggctctcgcagtgtttttcgggccttttgttctttctataaaaaaaaaattcgcgtcctttaagaaaactttttccacctagagaagaagaagagtatcactcttgttgttcaagtttctctctttaataaaaaatccatctttattctttgtcttctttcctttttgctttccctaatctctatgttataaacacacagagagaaacaaagtcacagtctcgagtcaaaaacagagaatacgaaagaaaaatggaagcggagaagaaaatggttctaccgagaatcaaattcacagagcacaaaaccaacacgacaacaatcgtatcggagttaaccaacactcaccaaaccaggattcttcgtatctcagtcactgacccagacgctactgattcctccagtgacgacgaagaagaagaacatcaacgctttgtctctaaacgccgtcgtgttaagaagtttgtcaacgaagtctatctcgattccggtgctgttgttactggtagttgtggtcaaatggagtcgaagaagagacaaaagagagcggttaaatcggagtctactgtttctccggttgtttcagcgacgacgactacgacgggagagaagaagttccgaggagtgagacagcgtccatggggaaaatgggcggcggagataagagatccgttgaaacgtgtacggctctggttaggtacttacaacacggcggaagaagctgctatggtttacgataacgccgctattcagcttcgtggtcccgacgctctgactaatttctcagtcactccgacaacagcgacggagaagaaagccccaccaccgtctccggtgaagaagaagaagaagaaaaacaacaaaagcaaaaaatccgttactgcttcttcctccatcagcagaagcagcagcaacgattgtctctgctctccggtgtctgttctccgatctcctttcgccgtcgacgaattctccggcatttcttcatcaccagtcgcggccgttgtagtcaaggaagagccatccatgacaacggtatctgaaactttctctgatttctcggcgcccttgttctcagatgatgacgtgttcgatttccggagctcagtggttcccgactatctcggcggcgatttatttggggaagatctattcacggcggatatgtgtacggatatgaacttcggattcgatttcggatccggattatccagctggcacatggaggaccattttcaagatatcggggatctattcgggtcggatcctcttttagctgtttaataatattttaaataaataaatagttataccggccgttactaaacggaaccggagaaagttttgtataccggtgacataaaatctcggttatgttcgtaatctttttttctttgttatatataaaaatatgaatgaaactgaattaatgtaagttaatggtgataattattaacgttttaagttttgaaaaaaaaaaaaaaaaaaaaaaaaaaa

SEQ ID NO: 872 - protein, 343 aa, Arabidopsis thaliana
  G864,AP2 domain coordinates 119-181
MEAEKKMVLPRIKFTEHKTNTTTIVSELTNTHQTRILRISVTDPDATDSSSDDEEEEHQRFVSKRRRVKKFVNEVYLDSGAVVTGSCGQMESKKRQKRAVKSESTVSPVVSATTTTTGEKKFRGVRQRPWGKWAAEIRDPLKRVRLWLGTYNTAEEAAMVYDNAAIQLRGPDALTNFSVTPTTATEKKAPPPSPVKKKKKKNNKSKKSVTASSSISRSSSNDCLCSPVSVLRSPFAVDEFSGISSSPVAAVVVKEEPSMTTVSETFSDFSAPLFSDDDVFDFRSSVVPDYLGGDLFGEDLFTADMCTDMNFGFDFGSGLSSWHMEDHFQDIGDLFGSDPLLAV

SEQ ID NO: 873 - DNA, 1281 bp, Arabidopsis thaliana
  G867,family:AP2
cacaacacaaacacatttctgttttctccattgtttcaaaccataaaaaaaaacacagattaaatggaatcgagtagcgttgatgagagtactacaagtacaggttccatctgtgaaaccccggcgataactccggcgaaaaagtcgtcggtaggtaacttatacaggatgggaagcggatcaagcgttgtgttagattcagagaacggcgtagaagctgaatctaggaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattctcattcgaaatctgagatcgttgatatgttgaggaaacatacttataacgaagagttagagcagagtaaacggcgtcgtaatggtaacggaaacatgactaggacgttgttaacgtcggggttgagtaatgatggtgtttctacgacggggtttagatcggcggaggcactgtttgagaaagcggtaacgccaagcgacgttgggaagctaaaccgtttggttataccgaaacatcacgcagagaaacattttccgttaccgtcaagtaacgtttccgtgaaaggagtgttgttgaactttgaggacgttaacgggaaagtgtggaggttccgttactcgtattggaacagtagtcagagttatgttttgactaaaggttggagcaggttcgttaaggagaagaatctacgtgctggtgacgtggttagtttcagtagatctaacggtcaggatcaacagttgtacattgggtggaagtcgagatccgggtcagatttagatgcgggtcgggttttgagattgttcggagttaacatttcaccggagagttcaagaaacgacgtcgtaggaaacaaaagagtgaacgatactgagatgttatcgttggtgtgtagcaagaagcaacgcatctttcacgcctcgtaacaactcttcttctttttttttcttttgttgttttaataatttttaaaaactccattttcgttttctttatttgcatcggtttctttcttcttgtttaccaaaggttcatgagttgtttttgttgtattgatgaactgtaaattttatttataggataaattttaaaaaaaaaaaaaaaaaaaa

SEQ ID NO: 874 - protein, 344 aa, Arabidopsis thaliana
  G867,AP2 domain coordinates 59-124,184-276
MESSSVDESTTSTGSICETPAITPAKKSSVGNLYRMGSGSSVVLDSENGVEAESRKLPSSKYKGVVPQPNGRWGAQIYEKHQRVWLGTFNEEDEAARAYDVAVHRFRRRDAVTNFKDVKMDEDEVDFLNSHSKSEIVDMLRKHTYNEELEQSKRRRNGNGNMTRTLLTSGLSNDGVSTTGFRSAEALFEKAVTPSDVGKLNRLVIPKHHAEKHFPLPSSNVSVKGVLLNFEDVNGKVWRFRYSYWNSSQSYVLTKGWSRFVKEKNLRAGDVVSFSRSNGQDQQLYIGWKSRSGSDLDAGRVLRLFGVNISPESSRNDVVGNKRVNDTEMLSLVCSKKQRIFHAS

SEQ ID NO: 875 - DNA, 1246 bp, Arabidopsis thaliana
  G9,family:AP2
gtgtttcttctttctgctaaaaggttataatttttgtttcttggtttggtgagaatcttcaagaaactgaaacaaagaaaatggattctagttgcatagacgagataagttcctccacttcagaatctttctccgccaccaccgccaagaagctctctcctcctcccgcggcggcgttacgcctctaccggatgggaagcggcgggagcagcgtcgtgttggatcccgagaacggcctagagacggagtcacgaaagctaccatcttcaaaatacaaaggtgttgttcctcagcctaacggaagatggggagctcagatctacgagaagcaccaacgagtatggctcgggactttcaacgagcaagaagaagctgctcgttcctacgacatcgcagcttgtagattccgtggccgcgacgccgtcgtcaacttcaagaacgttctggaagacggcgatttagcttttcttgaagctcactcaaaggccgagatcgtcgacatgttgagaaaacacacttacgccgacgagcttgaacagaacaataaacggcagttgtttctctccgtcgacgctaacggaaaacgtaacggatcgagtactactcaaaacgacaaagttttaaagacgcgtgaagttcttttcgagaaggctgttacacctagcgacgttgggaagctaaaccgtctcgtgatacctaaacaacacgccgagaaacactttccgttaccgtcaccgtcaccggcagtgactaaaggagttttgatcaacttcgaagacgttaacggtaaagtgtggaggttccgttactcatactggaacagtagtcaaagttacgtgttgaccaagggatggagtcgattcgtcaaggagaagaatcttcgagccggtgatgttgttactttcgagagatcgaccggactagagcggcagttatatattgattggaaagttcggtctggtccgagagaaaacccggttcaggtggtggttcggcttttcggagttgatatctttaatgtgaccaccgtgaagccaaacgacgtcgtggccgtttgcggtggaaagagatctcgagatgttgatgatatgtttgcgttacggtgttccaagaagcaggcgataatcaatgctttgtgacatatttccttttccgattttatgctttcgttttttaatttttttttttgtcaagttgtgtaggttgtgattcatgctaggttgtatttaggaaaagagataagacc

SEQ ID NO: 876 - protein, 352 aa, Arabidopsis thaliana
  G9,AP2 domain coordinates 62-127,184-277
MDSSCIDEISSSTSESFSATTAKKLSPPPAAALRLYRMGSGGSSVVLDPENGLETESRKLPSSKYKGVVPQPNGRWGAQIYEKHQRVWLGTFNEQEEAARSYDIAACRFRGRDAVVNFKNVLEDGDLAFLEAHSKAEIVDMLRKHTYADELEQNNKRQLFLSVDANGKRNGSSTTQNDKVLKTREVLFEKAVTPSDVGKLNRLVIPKQHAEKHFPLPSPSPAVTKGVLINFEDVNGKVWRFRYSYWNSSQSYVLTKGWSRFVKEKNLRAGDVVTFERSTGLERQLYIDWKVRSGPRENPVQVVVRLFGVDIFNVTTVKPNDVVAVCGGKRSRDVDDMFALRCSKKQAIINAL

SEQ ID NO: 877 - DNA, 1673 bp, Arabidopsis thaliana
  G903,family:Z-C2H2
cccgggtcgacccacgcgtccgctctctctctctgaactatacaaaaacctacttttaatttctcttccaagaagtcaagaacccagaagaagacatgacaagtgaagttcttcaaacaatctcaagtggatcaggttttgctcagccacagagctcatcaaccctggatcatgatgaatctctcatcaatcctcctcttgttaagaaaaagagaaatctccctggaaatcctgatccggaagctgaagtgatagctttatcccccacgaccttgatggctacgaaccggttcctatgtgaggtatgtggcaaaggtttccaaagagaccaaaacttacagcttcatcggcgaggacataatcttccatggaagttgaagcagaggacaagcaaagaagtgagaaaacgtgtctacgtttgccccgagaagacatgtgtccaccatcactcctctagagctctaggcgatctcactggaatcaaaaagcatttttgccggaaacacggggagaagaagtggacgtgcgagaaatgtgctaagagatacgcagtccaatctgattggaaagctcattccaagacttgtggtactagagagtaccgttgcgattgtggcaccattttctcaaggcgagacagctttatcactcatagagctttctgcgatgccttagcggaagaaaccgctaagataaacgcagtgtctcatctcaacggtttagccgcggctggagccccaggatcagttaatctcaactatcaatatctcatgggaacattcatcccaccgcttcaaccatttgtaccacaaccgcaaacaaatccaaaccatcatcatcaacattttcagccaccaacttcttcgtcgctctctctatggatgggacaagatatcgcgccgcctcaaccgcaaccggactacgattgggtttttggaaacgctaaggcagcgtctgcttgcattgataataataatactcacgatgagcagattacgcaaaacgcaaacgcaagtttgaccactaccactactctctctgccccttctttattcagcagcgaccaaccacaaaacgcaaacgcaaattcaaacgtgaatatgtccgcgacagctttactacagaaagctgctgaaattggcgctacttctacaacaaccgcagcgaccaatgacccatcaacgtttcttcaaagtttcccgcttaaatccaccgatcaaaccaccagttatgacagtggcgaaaagttttttgctttgttcgggtctaacaacaacattgggttaatgagtcgtagtcatgatcatcaagagatcgagaacgctagaaatgacgttacggttgcgtctgccttggatgaattacagaattacccttggaaacgtagaagagttgatggtggaggtgaagtgggtggaggagggcaaactcgggatttcctcggggttggtgtacaaacgttgtgccatccatcgtctatcaatggatggatttgaaagagtttaaaaatttcggggttaatgcataaattacgtaaaagaagaaggaatcttttgtcatttccaccattttctaagataacatatgtatatggtaatggaagttgttttcttttattaattcaatattctaaaacttatgatatatgtataatgaatgtgtttatcttcaaa

SEQ ID NO: 878 - protein, 466 aa, Arabidopsis thaliana
  G903,Z-C2H2 domain coordinates 68-92
MTSEVLQTISSGSGFAQPQSSSTLDHDESLINPPLVKKKRNLPGNPDPEAEVIALSPTTLMATNRFLCEVCGKGFQRDQNLQLHRRGHNLPWKLKQRTSKEVRKRVYVCPEKTCVHHHSSRALGDLTGIKKHFCRKHGEKKWTCEKCAKRYAVQSDWKAHSKTCGTREYRCDCGTIFSRRDSFITHRAFCDALAEETAKINAVSHLNGLAAAGAPGSVNLNYQYLMGTFIPPLQPFVPQPQTNPNHHHQHFQPPTSSSLSLWMGQDIAPPQPQPDYDWVFGNAKAASACIDNNNTHDEQITQNANASLTTTTTLSAPSLFSSDQPQNANANSNVNMSATALLQKAAEIGATSTTTAATNDPSTFLQSFPLKSTDQTTSYDSGEKFFALFGSNNNIGLMSRSHDHQEIENARNDVTVASALDELQNYPWKRRRVDGGGEVGGGGQTRDFLGVGVQTLCHPSSINGWI

SEQ ID NO: 879 - DNA, 1519 bp, Arabidopsis thaliana
  G932,family:MYB-(R1)R2R3
ccacgcgtccgaccacttgtacctctttgtcttaagtactctttaaccctacaatttcctaagctctcaagccacaaaaaaccacaaaccgttcttcaccaatatatatatctgatcatcatcaaagtccttctctctgctcataccacaaaccgttccattcttcccctaatcacaaagtgatatttacatagagaagatagagatgggaagaccaccatgctgtgacaagattggagtgaagaaaggaccatggacaccagaggaagatatcatcttggtttcttacatccaagaacatggtcctggaaactggagatctgtgcctactcacacaggtttgaggagatgtagcaaaagctgtagattgaggtggactaattatcttcgacctgggatcaagcgtggaaatttcaccgagcatgaagagaagatgattctccatcttcaagctcttttgggaaacaggtgggcagctatagcatcatatcttccagaaaggacagacaatgatataaagaactattggaacactcatttgaagaaaaagctcaagaagatgaatgattcttgtgatagtactatcaacaatggccttgataataaagacttctccatatcaaacaaaaacactacctcacatcaaagcagcaactccagtaaaggtcaatgggagagaaggcttcagacagatatcaacatggctaaacaagctctttgtgatgccttgtctattgacaaaccacaaaacccaactaatttttctattcccgatcttggttatggtccatcatcttcttcgtcctctaccaccaccaccaccaccaccaccaccacgagaaacactaatccatacccatctggggtctatgcttcaagtgctgagaacattgctcgtttgcttcagaattttatgaaagacacaccaaagacctcggtgcccttgccggttgcagccaccgagatggctatcaccacggcagcttcgagccctagcacaaccgaaggagacggagaagggattgaccattctttgttcagcttcaactccatagatgaagctgaagagaagcctaaactaatagaccatgacattaatggtctaattacacaaggctctctttctttgttcgagaaatggctctttgatgagcaaagccacgatatgatcatcaataacatgtcactagagggtcaggaagtgttgttctagaaagcattaaagtttgacgatttgcttgaggaaccacgaggcttagttataaacaatttgtataattaagtactctttagttttgttttcaatccttattatgatcatattgcagtaattagggattttagtctttagtagtaactcttaagttttaacacatttttctctatctttttagtagtaactctttattttttccttaaatctttgtcgacgtggagatgatatcttctatgtagtagaaactcaaaagtgtacatcatctttattaatgtaacgtctttttaaaaaaaaaaaaaaaaa

SEQ ID NO: 880 - protein, 335 aa, Arabidopsis thaliana
  G932,MYB-(R1)R2R3 domain coordinates 14-118
MGRPPCCDKIGVKKGPWTPEEDIILVSYIQEHGPGNWRSVPTHTGLRRCSKSCRLRWTNYLRPGIKRGNFTEHEEKMILHLQALLGNRWAAIASYLPERTDNDIKNYWNTHLKKKLKKMNDSCDSTINNGLDNKDFSISNKNTTSHQSSNSSKGQWERRLQTDINMAKQALCDALSIDKPQNPTNFSIPDLGYGPSSSSSSTTTTTTTTTTRNTNPYPSGVYASSAENIARLLQNFMKDTPKTSVPLPVAATEMAITTAASSPSTTEGDGEGIDHSLFSFNSIDEAEEKPKLIDHDINGLITQGSLSLFEKWLFDEQSHDMIINNMSLEGQEVLF

SEQ ID NO: 881 - DNA, 1755 bp, Arabidopsis thaliana
  G938,family:EIL
atgatgatgtttaacgagatgggaatgtatggaaacatggatttcttctcttcctccacatctctcgatgtgtgtccattaccacaagctgaacaagaacctgtagttgaagatgtcgactacaccgatgatgagatggatgtggatgagcttgagaagaggatgtggagagacaaaatgcgtttgaaacgtctcaaggagcaacagagtaagtgtaaagaaggcgtcgatggttcgaaacagaggcagtcgcaagagcaagctaggaggaagaaaatgtctagagcccaagatgggatcttgaagtatatgttgaagatgatggaagtttgtaaagctcaaggctttgtttatggtattattcctgagaagggtaagcctgtgactggtgcttcggataatttgagggaatggtggaaagataaggttaggtttgatcgtaatggtccagctgctattgctaagtatcagtcagagaataatatttctggagggagtaatgattgtaacagcttggttggtccaacaccgcatacgcttcaggagcttcaggacacgactcttggttcgcttttatcggctttgatgcaacattgtgatccaccgcagagacggtttcctttggagaaaggagtttctccaccttggtggcctaatgggaatgaagagtggtggcctcagcttggtttaccaaatgagcaaggtcctcctccttataagaagcctcatgatttgaagaaagcttggaaagtcggtgttttaactgcggtgatcaagcatatgtcgccggatattgcgaagatccgtaagcttgtgaggcaatcaaaatgcttgcaggataagatgacggcgaaagagagtgctacttggcttgccattattaaccaagaagaggttgtggctcgggagctttatcccgagtcatgccctcctctttcttcttcttcatcattaggaagcgggtcgcttctcattaatgattgtagcgagtatgacgttgaaggtttcgagaaggaacaacatggtttcgatgtggaagagcggaaaccagagatagtgatgatgcatcctctagcaagctttggggttgctaaaatgcaacattttcccataaaggaggaggtcgccaccacggtaaacttagagttcacgagaaagaggaagcagaacaatgatatgaatgttatggtaatggacagatcagcaggttacacttgtgagaatggtcagtgtcctcacagcaaaatgaatcttggatttcaagacaggagttcaagggacaaccaccagatggtttgtccatatagagacaatcgtttagcgtatggagcatccaagtttcatatgggtggaatgaaactagtagttcctcagcaaccagtccaaccgatcgacctatcgggcgttggagttccggaaaacgggcagaagatgatcaccgagcttatggccatgtacgacagaaatgtccaaagcaaccaaacgcctcctactttgatggaaaaccaaagcatggtcattgatgcaaaagcagctcagaatcagcagctgaatttcaacagtggcaatcaaatgtttatgcaacaagggacgaacaacggggttaacaatcggttccagatggtgtttgattcgacaccattcgatatggcagcattcgattacagagatgattggcaaaccggagcaatggaaggaatggggaagcagcagcagcagcagcagcagcagcaagatgtatcaatatggttctga

SEQ ID NO: 882 - protein, 584 aa, Arabidopsis thaliana
  G938,EIL domain coordinates 96-104
MMMFNEMGMYGNMDFFSSSTSLDVCPLPQAEQEPVVEDVDYTDDEMDVDELEKRMWRDKMRLKRLKEQQSKCKEGVDGSKQRQSQEQARRKKMSRAQDGILKYMLKMMEVCKAQGFVYGIIPEKGKPVTGASDNLREWWKDKVRFDRNGPAAIAKYQSENNISGGSNDCNSLVGPTPHTLQELQDTTLGSLLSALMQHCDPPQRRFPLEKGVSPPWWPNGNEEWWPQLGLPNEQGPPPYKKPHDLKKAWKVGVLTAVIKHMSPDIAKIRKLVRQSKCLQDKMTAKESATWLAIINQEEVVARELYPESCPPLSSSSSLGSGSLLINDCSEYDVEGFEKEQHGFDVEERKPEIVMMHPLASFGVAKMQHFPIKEEVATTVNLEFTRKRKQNNDMNVMVMDRSAGYTCENGQCPHSKMNLGFQDRSSRDNHQMVCPYRDNRLAYGASKFHMGGMKLVVPQQPVQPIDLSGVGVPENGQKMITELMAMYDRNVQSNQTPPTLMENQSMVIDAKAAQNQQLNFNSGNQMFMQQGTNNGVNNRFQMVFDSTPFDMAAFDYRDDWQTGAMEGMGKQQQQQQQQQDVSIWF

SEQ ID NO: 883 - DNA, 2310 bp, Arabidopsis thaliana
  G941,family:EIL
tcttcttcttcttcctcttcctcatctcgtatctctaacttttgtcgaagttcttttgatgaaactagggtttattatcttctccttctttttcccatcaccatagaaaaggcagagacctttttcttcatcatttttattctccttcttcttctgctgttcatttctccaggttacaatgatgtttaatgagatgggaatgtgtggaaacatggatttcttctcttctggatcacttggtgaagttgatttctgtcctgttccacaagctgagcctgattccattgttgaagatgactatactgatgatgagattgatgttgatgaattggagaggaggatgtggagagacaaaatgcggcttaaacgtctcaaggagcaggataagggtaaagaaggtgttgatgctgctaaacagaggcagtctcaagagcaagctaggaggaagaaaatgtctagagctcaagatgggatcttgaagtatatgttgaagatgatggaagtttgtaaagctcaaggctttgtttatgggattattccggagaatgggaagcctgtgactggtgcttctgataatttaagggagtggtggaaagataaggttaggtttgatcgtaatggtcctgcggctattaccaagtatcaagcggagaataatatcccggggattcatgaaggtaataacccgattggaccgactcctcataccttgcaagagcttcaagacacgactcttggatcgcttttgtctgcgttgatgcaacactgtgatcctcctcagagacgttttcctttggagaaaggagttcctcctccgtggtggcctaatgggaaagaggattggtggcctcaacttggtttgcctaaagatcaaggtcctgcaccttacaagaagcctcatgatttgaagaaggcgtggaaagtcggcgttttgactgcggttatcaagcatatgtttcctgatattgctaagatccgtaagctcgtgaggcaatctaaatgtttgcaggataagatgactgctaaagagagtgctacctggcttgctattattaaccaagaagagtccttggctagagagctttatcccgagtcatgtccacctctttctctgtctggtggaagttgctcgcttctgatgaatgattgcagtcaatacgatgttgaaggtttcgagaaggagtctcactatgaagtggaagagctcaagccagaaaaagttatgaattcttcaaactttgggatggttgctaaaatgcatgactttcctgtcaaagaagaagtcccagcaggaaactcggaattcatgagaaagagaaagccaaacagagatctgaacactattatggacagaaccgttttcacctgcgagaatcttgggtgtgcgcacagcgaaatcagccggggatttctggataggaattcgagagacaaccatcaactggcatgtccacatcgagacagtcgcttaccgtatggagcagcaccatccaggtttcatgtcaatgaagttaagcctgtagttggatttcctcagccaaggccagtgaactcagtagcccaaccaattgacttaacgggtatagttcctgaagatggacagaagatgatctcagagctcatgtccatgtacgacagaaatgtccagagcaaccaaacctctatggtcatggaaaatcaaagcgtgtcactgcttcaacccacagtccataaccatcaagaacatctccagttcccaggaaacatggtggaaggaagtttctttgaagacttgaacatcccaaacagagcaaacaacaacaacagcagcaacaatcaaacgttttttcaagggaacaacaacaacaacaatgtgtttaagttcgacactgcagatcacaacaactttgaagctgcacataacaacaacaataacagtagcggcaacaggttccagcttgtgtttgattccacaccgttcgacatggcgtcattcgattacagagatgatatgtcgatgccaggagtagtaggaacgatggatggaatgcagcagaagcagcaagatgtatccatatggttctaaagtcttggtagtagatttcatcttctcttatttttatcttttgtgttcttacattcactcaaccatgtaatattttttcctgggtctctctgtctctatcgcttgttatgatgtgtctgtaagagtctctaaaaactctctgttactgtgtgtctttgtctcggcttggtgaatctctctgtcatcatcagcttttagttacacacccgacttggggatgaacgaacactaaatgtaagttttca

SEQ ID NO: 884 - protein, 628 aa, Arabidopsis thaliana
  G941,EIL domain coordinates 95-103
MMFNEMGMCGNMDFFSSGSLGEVDFCPVPQAEPDSIVEDDYTDDEIDVDELERRMWRDKMRLKRLKEQDKGKEGVDAAKQRQSQEQARRKKMSRAQDGILKYMLKMMEVCKAQGFVYGIIPENGKPVTGASDNLREWWKDKVRFDRNGPAAITKYQAENNIPGIHEGNNPIGPTPHTLQELQDTTLGSLLSALMQHCDPPQRRFPLEKGVPPPWWPNGKEDWWPQLGLPKDQGPAPYKKPHDLKKAWKVGVLTAVIKHMFPDIAKIRKLVRQSKCLQDKMTAKESATWLAIINQEESLARELYPESCPPLSLSGGSCSLLMNDCSQYDVEGFEKESHYEVEELKPEKVMNSSNFGMVAKMHDFPVKEEVPAGNSEFMRKRKPNRDLNTIMDRTVFTCENLGCAHSEISRGFLDRNSRDNHQLACPHRDSRLPYGAAPSRFHVNEVKPVVGFPQPRPVNSVAQPIDLTGIVPEDGQKMISELMSMYDRNVQSNQTSMVMENQSVSLLQPTVHNHQEHLQFPGNMVEGSFFEDLNIPNRANNNNSSNNQTFFQGNNNNNNVFKFDTADHNNFEAAHNNNNNSSGNRFQLVFDSTPFDMASFDYRDDMSMPGVVGTMDGMQQKQQDVSIWF

SEQ ID NO: 885 - DNA, 1652 bp, Arabidopsis thaliana
  G960,family:NAC
taccgtcgacccacgcgtccgagtgtattcaaagtcggaaagaaaccctaaagaagaggattatgggtgctgtatcgatggagtcgcttcctttaggtttcagattcagacctaccgatgaagagctcgtcaatcactacctccgtctcaagatcaacggacgtcactccgatgtccgtgtcatccctgatatcgatgtctgcaaatgggaaccttgggatcttcctgctctctcggtgattaagacggatgatccagagtggttctttttctgccctcgtgatcggaaataccctaatggtcatcgctctaacagagcaactgactctggctattggaaagctactggtaaagatcgtagcatcaagtctaagaagactttaatcggtatgaagaagactcttgtcttctatcgtggacgagctcctaaaggtgagcggactaattggattatgcacgagtatcgtcccactcttaaggatcttgatggcacttcccctggccaaagcccttacgttctttgtcgcctcttccacaagcctgatgatcgggttaatggtgtcaagtccgatgaagcagcttttacggccagcaacaaatactcacctgatgatacatcatctgatcttgttcaagaaacaccttcctctgatgctgctgttgagaaaccatcagattattcaggtggatgcggttatgctcatagtaatagtaccgcagatgggacaatgattgaggcacctgaagagaatctttggttatcttgtgaccttgaagatcaaaaggcaccactaccgtgtatggattctatatatgctggtgatttcagttacgatgagattggattccaatttcaagatggtaccagcgaaccagatgtatcactaacagaattgttggaggaggtgttcaataaccctgatgacttctcttgcgaggaatcgatcagtcgagagaatccagcagtctcaccaaatgggatattttcatctgctaaaatgctgcagtctgcagcaccagaggatgctttcttcaacgacttcatggctttcactgatacagatgctgagatggcgcaattgcagtatggttcagaaggtggagcttctggttggccaagtgacactaattcatactatagtgatttggttcagcaagagcaaatgatcaatcataacacagagaacaacctcacagaagggagagggataaagatccgggctcgacagcctcagaaccggcagagtacaggattgataaaccagggtattgctccaaggagaatccgtctgcagctgcagtctaactctgaagtaaaagaacgagaggaggtgaatgaaggacacactgttattcccgaggccaaagaagctgcagctaaatactcagagaagagtggttctttggttaaacctcaaataaagctcagggcgcggggaactataggccaagtaaaaggagagagatttgcagacgacgaggtacaggtgcagagcacaaagagagagagagagagaatcaaatgtagtttaatgtaattagggatgatgcaatgttagcatgtttgtgtgttgtaacttaaaaacttatttaggaatctgataaaagttactgttgaaaaaagaaaaaaaaaaaaaaaaaaaaaaaaaaaa

SEQ ID NO: 886 - protein, 491 aa, Arabidopsis thaliana
  G960,NAC domain coordinates 13-156
MGAVSMESLPLGFRFRPTDEELVNHYLRLKINGRHSDVRVIPDIDVCKWEPWDLPALSVIKTDDPEWFFFCPRDRKYPNGHRSNRATDSGYWKATGKDRSIKSKKTLIGMKKTLVFYRGRAPKGERTNWIMHEYRPTLKDLDGTSPGQSPYVLCRLFHKPDDRVNGVKSDEAAFTASNKYSPDDTSSDLVQETPSSDAAVEKPSDYSGGCGYAHSNSTADGTMIEAPEENLWLSCDLEDQKAPLPCMDSIYAGDFSYDEIGFQFQDGTSEPDVSLTELLEEVFNNPDDFSCEESISRENPAVSPNGIFSSAKMLQSAAPEDAFFNDFMAFTDTDAEMAQLQYGSEGGASGWPSDTNSYYSDLVQQEQMINHNTENNLTEGRGIKIRARQPQNRQSTGLINQGIAPRRIRLQLQSNSEVKEREEVNEGHTVIPEAKEAAAKYSEKSGSLVKPQIKLRARGTIGQVKGERFADDEVQVQSTKRERERIKCSLM

SEQ ID NO: 887 - DNA, 1221 bp, Arabidopsis thaliana
  G964,family:HB
atttctcttccacaaagagtcctaacttcgagttgaaacaaacaccatttctcatctctatctcagaaagaacaaaccatttcgtgttctttctttctctattctcataaggaaatataattcctgaaactgttgagttcttgtgaaaggaaataaaaaacatgatgatgggcaaagaagatctaggtttgagcctaagcttagggttttcacaaaatcacaatcctcttcagatgaatctgaatcctaactcttcattatcaaacaatctccagagactcccatggaaccaaacattcgatcctacatcagatcttcgcaagatagacgtgaacagttttccatcaacggttaactgcgaggaagacacaggagtttcgtcaccaaacagtacgatctcaagcaccattagcgggaagagaagtgagagagaaggaatctccggaaccggcgttggctccggcgacgatcacgacgagatcactccggatcgagggtactcacgtggaacctcagatgaagaagaagacgggggcgaaacgtcgaggaagaagctcaggttatcaaaagatcagtctgcttttctcgaagagactttcaaagaacacaacactctcaatcccaaacagaagctagctttggctaagaagctgaacttgacggcaagacaagtggaagtgtggttccaaaacagaagagctagaaccaagttaaagcaaacggaggtagattgcgaatacttgaaacggtgcgtagagaagctaacggaagagaaccggagacttcagaaagaggctatggagcttcgaactctcaagctgtctccacaattctacggtcagatgactccaccaactacactcatcatgtgtccttcgtgcgagcgtgtagctggtccatcatcatcgaaccatcaccacaatcacaggccggtttcgattaacccgtggattgcttgtgctggtcaggtggctcatgggctgaattttgaagccttgcgtccacgatcgtaatttttagtggtgggggaagggtgttttgggttttttcattatcgttatatagtctatctgtgtggggtcattgtaattttggatgattggccttctcatgaactagtcatatgtatgatgcaaccttaaaaatatttcaagtagcaaaacttaattacaaacttgctatattaaccaaaaattatgaaaaaaaaaaaaaaaaaaaaaa

SEQ ID NO: 888 - protein, 283 aa, Arabidopsis thaliana
  G964,HB domain coordinates 126-186
MMMGKEDLGLSLSLGFSQNHNPLQMNLNPNSSLSNNLQRLPWNQTFDPTSDLRKIDVNSFPSTVNCEEDTGVSSPNSTISSTISGKRSEREGISGTGVGSGDDHDEITPDRGYSRGTSDEEEDGGETSRKKLRLSKDQSAFLEETFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVAGPSSSNHHHNHRPVSINPWIACAGQVAHGLNFEALRPRS

SEQ ID NO: 889 - DNA, 963 bp, Arabidopsis thaliana
  G976,family:AP2
cttatatataacaaataaacacataagttgacatatatactatatacaagtatattaattatacatatatggctgaccctaacaatcctatcactgaacctaaagctataatccaatcttctacttcatcgtcagttactattgtgccagttcccacgtgcggtgacagcctctctgactctgccacgtgtgaaaacccttgtccacttgatactatcactactactactactactgtttgttttgcggctccttcttctactgcaagtggtaatgatattaatactttaatggccactgacaccgacatctctcgccggaaaaagaatccggtttatcggggaattcgttgtcggagtggaaaatgggtgtctgaaatccgagagcctaaaaagactacacgtgtctggcttgggacttatccgacgccggagatggctgctgccgcatatgacgtggcggcgttagctcttaaaggtggagacactctcttgaacttcccggattccctgggatcttaccccattcccctttcctcttccgcagctcatatcagatgcgctgcagctgcggctgctgcgactaggggtgcggctggagcggccgtgaaggtaggtcaaaagaaggaagataaagtttatgatacggcggaatcttcaactatggggtttgtggatgaagaagagctattgaacatgcctggtttgctagcggatatggccaaagggatgatggtggctccaccgtggatgggatctccaccgtcagatgattcgccagagaattctgatggagagagcttgtggagctattgatcgattgaaagcagtttaatatcttttttggatcctttgttcacgtttatgctagtcatctttgtttctttatcctatgattgttagagatgatttgttaaatatataatcgtaatgattttcacttttttttattcaaaaaaaaaaa

SEQ ID NO: 890 - protein, 248 aa, Arabidopsis thaliana
  G976,AP2 domain coordinates 87-153
MADPNNPITEPKAIIQSSTSSSVTIVPVPTCGDSLSDSATCENPCPLDTITTTTTTVCFAAPSSTASGNDINTLMATDTDISRRKKNPVYRGIRCRSGKWVSEIREPKKTTRVWLGTYPTPEMAAAAYDVAALALKGGDTLLNFPDSLGSYPIPLSSSAAHIRCAAAAAAATRGAAGAAVKVGQKKEDKVYDTAESSTMGFVDEEELLNMPGLLADMAKGMMVAPPWMGSPPSDDSPENSDGESLWSY

SEQ ID NO: 891 - DNA, 1239 bp, Arabidopsis thaliana
  G993,family:AP2
caaatatggaatacagctgtgtagacgacagtagtacaacgtcagaatctctctccatctctactactccaaagccgacaacgacgacggagaagaaactctcttctccgccggcgacgtcgatgcgtctctacagaatgggaagcggcggaagcagcgtcgttttggattcagagaacggcgtcgagaccgagtcacgtaagcttccttcgtcgaaatataaaggcgttgtgcctcagcctaacggaagatggggagctcagatttacgagaagcatcagcgagtttggctcggtactttcaacgaggaagaagaagctgcgtcttcttacgacatcgccgtgaggagattccgcggccgcgacgccgtcactaacttcaaatctcaagttgatggaaacgacgccgaatcggcttttcttgacgctcattctaaagctgagatcgtggatatgttgaggaaacacacttacgccgatgagtttgagcagagtagacggaagtttgttaacggcgacggaaaacgctctgggttggagacggcgacgtacggaaacgacgctgttttgagagcgcgtgaggttttgttcgagaagactgttacgccgagcgacgtcgggaagctgaaccgtttagtgataccgaaacaacacgcggagaagcattttccgttaccggcgatgacgacggcgatggggatgaatccgtctccgacgaaaggcgttttgattaacttggaagatagaacagggaaagtgtggcggttccgttacagttactggaacagcagtcaaagttacgtgttgaccaagggctggagccggttcgttaaagagaagaatcttcgagccggtgatgtggtttgtttcgagagatcaaccggaccagaccggcaattgtatatccactggaaagtccggtctagtccggttcagactgtggttaggctattcggagtcaacattttcaatgtgagtaacgagaaaccaaacgacgtcgcagtagagtgtgttggcaagaagagatctcgggaagatgatttgttttcgttagggtgttccaagaagcaggcgattatcaacatcttgtgacaaattctttttttttggtttttttcttcaatttgtttctcctttttcaatattttgtattgaaatgacaagttgtaaattaggacaagacaagaaaaaatgacaactagacaaaatagtttttgtttaaaaaaaaaaaaaaaaaaaa

SEQ ID NO: 892 - protein, 361 aa, Arabidopsis thaliana
  G993,AP2 domain coordinates 69-134,191-290
MEYSCVDDSSTTSESLSISTTPKPTTTTEKKLSSPPATSMRLYRMGSGGSSVVLDSENGVETESRKLPSSKYKGVVPQPNGRWGAQIYEKHQRVWLGTFNEEEEAASSYDIAVRRFRGRDAVTNFKSQVDGNDAESAFLDAHSKAEIVDMLRKHTYADEFEQSRRKFVNGDGKRSGLETATYGNDAVLRAREVLFEKTVTPSDVGKLNRLVIPKQHAEKHFPLPAMTTAMGMNPSPTKGVLINLEDRTGKVWRFRYSYWNSSQSYVLTKGWSRFVKEKNLRAGDVVCFERSTGPDRQLYIHWKVRSSPVQTVVRLFGVNIFNVSNEKPNDVAVECVGKKRSREDDLFSLGCSKKQAIINIL

SEQ ID NO: 893 - DNA, 513 bp, Arabidopsis thaliana
  G997,family:MYB-related
tcgacccacgcgtccgatacaaaccaaccttctcaattcctctcttttcatccacattttcactagctaatggcttctagttcaatgagcacctcatcatggacagctagagaggacaagcaattcgaaatggcgttggcgaaattcgacaaggacactcctgaccgttggcaaaaaattgcaagggcagttggtgggaaatcaactgaagaagtaaagcgacactatgaattgctccttagggatgtgaatgacattgagtcaggacgctatccacaacctaggtaccgtaacactaattgaagccattaataaaatgcctttctatcaagaagaggacatttgagagaatctataaagaactaagaatttcgatgtatttcttatattctatttgctttctttttttgtttttttttttaatttctgtttggttttcagatatataataatctctctcaatatccatcctattctaatccaatcaatttaagttcatataaaaaaaaaaaa

SEQ ID NO: 894 - protein, 77 aa, Arabidopsis thaliana
  G997,MYB-related domain coordinates 9-59
MASSSMSTSSWTAREDKQFEMALAKFDKDTPDRWQKIARAVGGKSTEEVKRHYELLLRDVNDIESGRYPQPRYRNTN

SEQ ID NO: 895 - protein, 67 aa, Arabidopsis thaliana
  G2,1st AP2 domain
SSQYRGVTFYRRTGRWESHIWDCGKQVYLGGFDTAHAAARAYDRAAIKFRGVEADINFNIDDYDDDL

SEQ ID NO: 896 - protein, 68 aa, Arabidopsis thaliana
  G2,2nd AP2 domain
SSKYRGVTLHKCGRWEARMGQFLGKKYVYLGLFDTEVEAARAYDKAAIKCNGKDAVTNFDPSIYDEEL

SEQ ID NO: 897 - protein, 68 aa, Arabidopsis thaliana
  G3,AP2 domain
RKPYRGIRRRKWGKWVAEIREPNKRSRLWLGSYTTDIAAARAYDVAVFYLRGPSARLNFPDLLLQEED

SEQ ID NO: 898 - protein, 67 aa, Arabidopsis thaliana
  G8,1st AP2 domain
SSQYRGVTFYRRTGRWESHIWDCGKQVYLGGFDTAHAAARAYDRAAIKFRGVDADINFTLGDYEEDM

SEQ ID NO: 899 - protein, 51 aa, Arabidopsis thaliana
  G8,2nd AP2 domain
SSKYRGVTLHKCGRWEARMGQFLGKKAYDKAAINTNGREAVTNFEMSSYQN

SEQ ID NO: 900 - protein, 68 aa, Arabidopsis thaliana
  G12,AP2 domain
DKPYKGIRMRKWGKWVAEIREPNKRSRIWLGSYSTPEAAARAYDTAVFYLRGPSARLNFPELLAGVTV

SEQ ID NO: 901 - protein, 77 aa, Arabidopsis thaliana
  G15,1st AP2 domain
TSQYRGVTRHRWTGRYEAHLWDNSFKKEGHSRKGRQVYLGGYDMEEKAARAYDLAALKYWGPSTHTNFSAENYQKEI

SEQ ID NO: 902 - protein, 69 aa, Arabidopsis thaliana
  G15,2nd AP2 domain
ASIYRGVTRHHQHGRWQARIGRVAGNKDLYLGTFGTQEEAAEAYDVAAIKFRGTNAVTNFDITRYDVDR

SEQ ID NO: 903 - protein, 68 aa, Arabidopsis thaliana
  G33,AP2 domain
EVRYRGVRRRPWGRYAAEIRDPVKKKRVWLGSFNTGEEAARAYDSAAIRFRGSKATTNFPLIGYYGIS

SEQ ID NO: 904 - protein, 66 aa, Arabidopsis thaliana
  G47,AP2 domain
SQSKYKGIRRRKWGKWVSEIRVPGTRDRLWLGSFSTAEGAAVAHDVAFFCLHQPDSLESLNFPHLL

SEQ ID NO: 905 - protein, 101 aa, Arabidopsis thaliana
  G201,MYB-(R1)R2R3 domain
KGAWTAEEDKKLISYIHEHGGGGWRDIPQKAGLKRCGKSCRLRWANYLKPDIKRGEFSYEEEQIIIMLHASRGNKWSVIARHLPKRTDNEIKNYWNTHLKK

SEQ ID NO: 906 - protein, 104 aa, Arabidopsis thaliana
  G202,MYB-(R1)R2R3 domain
KKGAWTTEEDKKLISYIHDHGEGGWRDIPQKAGLKRCGKSCRLRWTNYLKPEIKRGEFSSEEEQIIIMLHASRGNKWSVIARHLPRRTDNEIKNYWNTHLKKRL

SEQ ID NO: 907 - protein, 47 aa, Arabidopsis thaliana
  G214,MYB-related domain
ERWTEEEHNRFIEALRLYGRAWQKIEEHVATKTAVQIRSHAQKFFSK

SEQ ID NO: 908 - protein, 92 aa, Arabidopsis thaliana
  G261,HS domain
PFLTKTYEMVDDSSSDSIVSWSQSNKSFIVWNPPEFSRDLLPRFFKHNNFSSFIRQLNTYGFRKADPEQWEFANDDFVRGQPHLMKNIHRRK

SEQ ID NO: 909 - protein, 8 aa, Arabidopsis thaliana
  G280,1st AT-hook domain
KRGRGRPP

SEQ ID NO: 910 - protein, 8 aa, Arabidopsis thaliana
  G280,2nd AT-hook domain
PRSRGRPP

SEQ ID NO: 911 - protein, 8 aa, Arabidopsis thaliana
  G280,3rd AT-hook domain
GRPRGRPP

SEQ ID NO: 912 - protein, 8 aa, Arabidopsis thaliana
  G280,4th AT-hook domain
RRGRGRPP

SEQ ID NO: 913 - protein, 23 aa, Arabidopsis thaliana
  G350,1st Z-C2H2 domain
CSVCDKAFSSYQALGGHKASHRK

SEQ ID NO: 914 - protein, 21 aa, Arabidopsis thaliana
  G350,2nd Z-C2H2 domain
CSICHKSFATGQALGGHKRCH

SEQ ID NO: 915 - protein, 21 aa, Arabidopsis thaliana
  G365,Z-C2H2 domain
CNYCQRKFYSSQALGGHQNAH

SEQ ID NO: 916 - protein, 22 aa, Arabidopsis thaliana
  G367,Z-C2H2 domain
CNYCQRTFYSSQALGGHQNAHK

SEQ ID NO: 917 - protein, 21 aa, Arabidopsis thaliana
  G369,Z-C2H2 domain
CLFCSRKFHSSQALGGHQNAH

SEQ ID NO: 918 - protein, 40 aa, Arabidopsis thaliana
  G373,RING/C3HC4 domain
CSICIQLPERPITTPCGHNFCLKCFEKWAVGQGKLTCMIC

SEQ ID NO: 919 - protein, 64 aa, Arabidopsis thaliana
  G398,HB domain
YGGETCRKKLRLSKDQSAVLEDTFKEHNTLNPKQKLALAKKLGLTARQVEVWFQNRRARTKLKQ

SEQ ID NO: 920 - protein, 10 aa, Arabidopsis thaliana
  G448,1st IAA domain
ETELCLGLPG

SEQ ID NO: 921 - protein, 13 aa, Arabidopsis thaliana
  G448,2nd IAA domain
VVGWPPVRSYRKN

SEQ ID NO: 922 - protein, 18 aa, Arabidopsis thaliana
  G448,3rd IAA domain
AFVKVSMDGAPYLRKIDL

SEQ ID NO: 923 - protein, 35 aa, Arabidopsis thaliana
  G448,4th IAA domain
SYEDKDGDWMLVGDVPWPMFVDTCKRLRLMKGSDA

SEQ ID NO: 924 - protein, 10 aa, Arabidopsis thaliana
  G459,1st IAA domain
ITELRLGLPG

SEQ ID NO: 925 - protein, 13 aa, Arabidopsis thaliana
  G459,2nd IAA domain
QVVGWPPVCSYRR

SEQ ID NO: 926 - protein, 17 aa, Arabidopsis thaliana
  G459,3rd IAA domain
YVKVSVDGAAFLRKIDL

SEQ ID NO: 927 - protein, 34 aa, Arabidopsis thaliana
  G459,4th IAA domain
YEDKDGDWMLAGDVPWEMFLGSCKRLRIMKRSCN

SEQ ID NO: 928 - protein, 90 aa, Arabidopsis thaliana
  G481,CAAT domain
REQDRYLPIANISRIMKKALPPNGKIGKDAKDTVQECVSEFISFITSEASDKCQKEKRKTVNGDDLLWAMATLGFEDYLEPLKIYLARYR

SEQ ID NO: 929 - protein, 64 aa, Arabidopsis thaliana
  G486,CAAT domain
DEDRLLPIANVGRLMKQILPSNAKISKEAKQTVQECATEFISFVTCEASEKCHRENRKTVNGDD

SEQ ID NO: 930 - protein, 122 aa, Arabidopsis thaliana
  G501,NAC domain
GFRFHPTDEELVKFYLCRKCASEQISAPVIAEIDLYKFNPWELPEMSLYGEKEWYFFSPRDRKYPNGSRPNRAAGTGYWKATGADKPIGKPKTLGIKKALVFYAGKAPKGIKTNWIMHEYRL

SEQ ID NO: 931 - protein, 163 aa, Arabidopsis thaliana
  G504,NAC domain
LPPGFRFHPTDEELVVHYLKKKADSVPLPVSIIAEIDLYKFDPWELPSKASFGEHEWYFFSPRDRKYPNGVRPNRAATSGYWKATGTDKPIFTCNSHKVGVKKALVFYGGKPPKGIKTDWIMHEYRLTDGNLSTAAKPPDLTTTRKNSLRLDDWVLCRIYKKN

SEQ ID NO: 932 - protein, 146 aa, Arabidopsis thaliana
  G513,NAC domain
GFRFSPTDEELVRYYLRLKINGHDNDVRVIREIDICKWEPWDLPDFSVVKTTDSEWLFFCPLDRKYPSGSRMNRATVAGYWKATGKDRKIKSGKTKIIGVKRTLVFYTGRAPKGTRTCWIMHEYRATEKDLDGTKSGQNPFVVCKL

SEQ ID NO: 933 - protein, 148 aa, Arabidopsis thaliana
  G517,NAC domain
GFRFRPNDEEIVDHYLRPKNLDSDTSHVDEVISTVDICSFEPWDLPSKSMIKSRDGVWYFFSVKEMKYNRGDQQRRRTNSGFWKKTGKTMTVMRKRGNREKIGEKRVLVFKNRDGSKTDWVMHEYHATSLFPNQMMTYTVCKVEFKGE

SEQ ID NO: 934 - protein, 62 aa, Arabidopsis thaliana
  G559,bZIP domain
KRAKRIWANRQSAARSKERKTRYIFELERKVQTLQTEATTLSAQLTLLQRDTNGLTVENNEL

SEQ ID NO: 935 - protein, 61 aa, Arabidopsis thaliana
  G567,bZIP domain
SLKPEDVKKSRRMLSNRESARRSRRRKQEQTSDLETQVNDLKGEHSSLLKQLSNMNHKYDE

SEQ ID NO: 936 - protein, 59 aa, Arabidopsis thaliana
  G594,HLH/MYC domain
RRGEATDRHSLAERARREKISKKMKCLQDIVPGCNKVTGKAGMLDEIINYVQSLQQQVE

SEQ ID NO: 937 - protein, 343 aa, Arabidopsis thaliana
  G619,ARF domain
SELWHACAGPLTCLPKKGNVVVYFPQGHLEQDAMVSYSSPLEIPKFDLNPQIVCRVVNVQLLANKDTDEVYTQVTLLPLQEFSMLNGEGKEVKELGGEEERNGSSSVKRTPHMFCKTLTASDTSTHGGFSVPRRAAEDCFAPLDYKQQRPSQELIAKDLHGVEWKFRHIYRGQPRRHLLTTGWSIFVSQKNLVSGDAVLFLRDEGGELRLGIRRAARPRNGLPDSIIEKNSCSNILSLVANAVSTKSMFHVFYSPRATHAEFVIPYEKYITSIRSPVCIGTRFRMRFEMDDSPERRCAGVVTGVCDLDPYRWPNSKWRCLLVRWDESFVSDHQERVSPWEIDP

SEQ ID NO: 938 - protein, 103 aa, Arabidopsis thaliana
  G663,MYB-(R1)R2R3 domain
RKGAWTAEEDSLLRLCIDKYGEGKWHQVPLRAGLNRCRKSCRLRWLNYLKPSIKRGRLSNDEVDLLLRLHKLLGNRWSLIAGRLPGRTANDVKNYWNTHLSKK

SEQ ID NO: 939 - protein, 102 aa, Arabidopsis thaliana
  G668,MYB-(R1)R2R3 domain
KGPWTPEEDIILVSYIQEHGPGNWRSVPTHTGLRCSKSCRLRWTNYLRPGIKRGNFTEHEEKTIVHLQALLGNRWAAIASYLPERTDNDIKNYWNTHLKKKL

SEQ ID NO: 940 - protein, 101 aa, Arabidopsis thaliana
  G674,MYB-(R1)R2R3 domain
KGLWSPEEDEKLRSHVLKYGHGCWSTIPLQAGLQRNGKSCRLRWVNYLRPGLKKSLFTKQEETILLSLHSMLGNKWSQISKFLPGRTDNEIKNYWHSNLKK

SEQ ID NO: 941 - protein, 47 aa, Arabidopsis thaliana
  G680,MYB-related domain
ERWTEDEHERFLEALRLYGRAWQRIEEHIGTKTAVQIRSHAQKFFTK

SEQ ID NO: 942 - protein, 49 aa, Arabidopsis thaliana
  G729,GARP domain
WTSSLHARFVHAVELLGGHERATPKSVLELMDVKDLTLAHVKSHLQMYR

SEQ ID NO: 943 - protein, 58 aa, Arabidopsis thaliana
  G779,HLH/MYC domain
NVRISDDPQTVVARRRRERISEKIRILKRIVPGGAKMDTASMLDEAIRYTKFLKRQVR

SEQ ID NO: 944 - protein, 58 aa, Arabidopsis thaliana
  G786,HLH/MYC domain
QSLSGSASSSNNDGKGRKKMKKMMGVLRRIVPGGEQMNTACVLDEAVQYLKSLKIEAQ

SEQ ID NO: 945 - protein, 92 aa, Arabidopsis thaliana
  G812,HS domain
PFLTKTFEMVDDPNTDHIVSWNRGGTSFVVWDLHSFSTILLPRHFKHSNFSSFIRQLNTYGFRKIEAERWEFANEEFLLGQRQLLKNIKRRN

SEQ ID NO: 946 - protein, 56 aa, Arabidopsis thaliana
  G860,MADS domain
GRGKIAIKRINNSTSRQVTFSKRRNGLLKKAKELAILCDAEVGVIIFSSTGRLYDF

SEQ ID NO: 947 - protein, 42 aa, Arabidopsis thaliana
  G904,RING/C3H2C3 domain
CAVCLSKFEPEDQLRLLPLCCHAFHADCIDIWLVSNQTCPLC

SEQ ID NO: 948 - protein, 67 aa, Arabidopsis thaliana
  G913,AP2 domain
HSIFRGIRLRNGKWVSEIREPRKTTRIWLGTYPVPEMAAAAYDVAALALKGPDAVLNFPGLALTYVA

SEQ ID NO: 949 - protein, 49 aa, Arabidopsis thaliana
  G936,GARP domain
WTPDLHLRFVRAVERLGGQERATPKLVRQMMNIKGLSIAHVKSHLQMYR

SEQ ID NO: 950 - protein, 11 aa, Arabidopsis thaliana
  G940,EIL domain
AQDGILKYMLK

SEQ ID NO: 951 - protein, 68 aa, Arabidopsis thaliana
  G975,AP2 domain
TKKFRGVRQRHWGSWVAEIRHPLLKRRIWLGTFETAEEAARAYDEAAVLMSGRNAKTNFPLNNNNTGE

SEQ ID NO: 952 - protein, 68 aa, Arabidopsis thaliana
  G977,AP2 domain
QQRFRGVRQRHWGSWVSEIRHPLLKTRIWLGTFETAEDAARAYDEAARLMCGPRARTNFPYNPNAIPT

SEQ ID NO: 953 - protein, 69 aa, Arabidopsis thaliana
  G1004,AP2 domain
KKHYRGVRQRPWGKFAAEIRDPNKRGSRVWLGTFDTAIEAARAYDEAAFRLRGSKAILNFPLEVGKWKP

SEQ ID NO: 954 - protein, 68 aa, Arabidopsis thaliana
  G1020,AP2 domain
EIRYRGVRKRPWGRYAAEIRDPVKKTRVWLGTFDTAQQAARAYDAAARDFRGVKAKTNFGVIVGSSPT

SEQ ID NO: 955 - protein, 50 aa, Arabidopsis thaliana
  G1038,GARP domain
WSFELHHKFVNAVNQIGCDHKAGPKKILDLMNVPWLTRENVASHLQKYRL

SEQ ID NO: 956 - protein, 52 aa, Arabidopsis thaliana
  G1047,bZIP domain
RKRKRMESNRESAKRSRMRKQRHIDNLKDEANRLGLENRELANRLRIVLYNI

SEQ ID NO: 957 - protein, 58 aa, Arabidopsis thaliana
  G1063,HLH/MYC domain
NVRISKDPQSVAARHRRERISERIRILQRLVPGGTKMDTASMLDEAIHYVKFLKKQVQ

SEQ ID NO: 958 - protein, 9 aa, Arabidopsis thaliana
  G1070,1st AT-hook domain
RRPRGRPAG

SEQ ID NO: 959 - protein, 146 aa, Arabidopsis thaliana
  G1070,2nd AT-hook domain
SKNKPKPPIIITRDSANALRTHVMEIGDGCDLVESVATFARRRQRGVCVMSGTGNVTNVTIRQPGSHPSPGSVVSLHGRFEILSLSGSFLPPPAPPTATGLSVYLAGGQGQVVGGSVVGPLLCAGPVVVMAASFSNAAYERLPLEE

SEQ ID NO: 960 - protein, 9 aa, Arabidopsis thaliana
  G1075,1st AT-hook domain
RRPRGRPAG

SEQ ID NO: 961 - protein, 143 aa, Arabidopsis thaliana
  G1075,2nd AT-hook domain
SKNKPKPPVIVTRESANTLRAHILEVGSGCDVFECISTYARRRQRGICVLSGTGTVTNVSIRQPTAAGAVVTLRGTFEILSLSGSFLPPPAPPGATSLTIFLAGAQGQVVGGNVVGELMAAGPVMVMAASFTNVAYERLPLDE

SEQ ID NO: 962 - protein, 53 aa, Arabidopsis thaliana
  G1082,1st BZIPT2 domain
MGCTSSKLDDLPAVALCRERCAFLEAAIHQRYALAESHVAYTHSLREIGHSLH

SEQ ID NO: 963 - protein, 111 aa, Arabidopsis thaliana
  G1082,2nd BZIPT2 domain
NLSSTLHKLHLWEKKLYHEVKAEEKLRLAHEKKLRKLKRLDQRGAEAIKVDKTRKLVRDMSTKIRIAIQVVDKISVTINKIRDEDLWPQLNALIQGLTRMWKTMLECHQSQ

SEQ ID NO: 964 - protein, 53 aa, Arabidopsis thaliana
  G1084,1st BZIPT2 domain
MGCSHSKLDDEEAVQICKDRKRFIKQAIEHRTKFASGHIAYIHSLRKVSDALH

SEQ ID NO: 965 - protein, 130 aa, Arabidopsis thaliana
  G1084,2nd BZIPT2 domain
SHQTTLDRLFAWEKKLYDEVRVSNKRYKQLSGERVRRAYEKKCMQLRNQDVKGDDPLAVDKTRATIRDLDTQIKVSIHSIESISKRIETLRDQELLPQLLELVEGLTNGNHDHNRLTRMWKVMAESHQIQ

SEQ ID NO: 966 - protein, 68 aa, Arabidopsis thaliana
  G1090,AP2 domain
QLSYRGIRRRKWGKWVSEIREPGKKTRIWLGSYETAEMAAAAYDAAALHLRGRGTNLNFPELVDSFPR

SEQ ID NO: 967 - protein, 42 aa, Arabidopsis thaliana
  G1100,RING/C3H2C3 domain
CAVCICEFEDHETLRLMPECCHVFHADCVSVWLSDHSTCPLC

SEQ ID NO: 968 - protein, 41 aa, Arabidopsis thaliana
  G1108,RING/C3H2C3 domain
CCICLAKYANNEELRELPCSHFFHKECVDKWLKINASCPLC

SEQ ID NO: 969 - protein, 58 aa, Arabidopsis thaliana
  G1137,HLH/MYC domain
STKEDTGSGLSNEQSKKDKIRTALKILESVVPGAKGNEALLLLDEAIDYLKLLKRDLI

SEQ ID NO: 970 - protein, 44 aa, Arabidopsis thaliana
  G1145,bZIP domain
RRQKRMIKNRESAARSRARKQAYTHELEIKVSRLEEENERLRKQ

SEQ ID NO: 971 - protein, 11 aa, Arabidopsis thaliana
  G1146,PAZ domain
GTSRPAHYHVL

SEQ ID NO: 972 - protein, 51 aa, Arabidopsis thaliana
  G1198,bZIP domain
KQLDAKTLRRLAQNREAARKSRLRKKAYVQQLESSRIKLSQLEQELQRARS

SEQ ID NO: 973 - protein, 60 aa, Arabidopsis thaliana
  G1228,HLH/MYC domain
EIENQRINHIAVERNRRRQMNEHINSLRALLPPSYIQRGDQASIVGGAINYVKVLEQIIQ

SEQ ID NO: 974 - protein, 101 aa, Arabidopsis thaliana
  G1245,MYB-(R1)R2R3 domain
KGPWTQAEDNLLIAYVDKHGDGNWNAVQNNSGLSRCGKSCRLRWVNHLRPDLKKGAFTEKEEKRVIELHALLGNKWARMAEELPGRTDNEIKNFWNTRLKR

SEQ ID NO: 975 - protein, 57 aa, Arabidopsis thaliana
  G1275,WRKY domain
DDGFKWRKYGKKMVKNSPHPRNYYKCSVDGCPVKKRVERDRDDPSFVITTYEGSHNH

SEQ ID NO: 976 - protein, 67 aa, Arabidopsis thaliana
  G1276,1st AP2 domain
SSQYRGVTFYRRTGRWESHIWDCGKQVYLGGFDTAHAAARAYDRAAVKFRGLEADINFVIGDYEEDL

SEQ ID NO: 977 - protein, 56 aa, Arabidopsis thaliana
  G1276,2nd AP2 domain
NSRYQGVALQKIGGWGAQMEQLHGNMGCDKAAVQWKGREAASLIEPHASRMIPEAA

SEQ ID NO: 978 - protein, 97 aa, Arabidopsis thaliana
  G1290,AKR domain
IYKALDSDDVELVKMLLLEGHTNLDEAYALHFAIAHCAVKTAYDLLELELADVNLRNPRGYTVLHVAAMRKEPKLIISLLMKGANILDTTLDGRTAL

SEQ ID NO: 979 - protein, 128 aa, Arabidopsis thaliana
  G1308,MYB-(R1)R2R3 domain
MGRTPCCDKIGLKKGPWTPEEDEVLVAHIKKNGHGSWRTLPKLAGLLRCGKSCRLRWTNYLRPDIKRGPFTADEEKLVIQLHAILGNRWAAIAAQLPGRTDNEIKNLWNTHLKKRLLSMGLDPRTHEP

SEQ ID NO: 980 - protein, 104 aa, Arabidopsis thaliana
  G1326,MYB-(R1)R2R3 domain
QRGHWRPVEDDNLRQLVEQYGPKNWNFIAQHLYGRSGKSCRLRWYNQLDPNITKKPFTEEEEERLLKAHRIQGNRWASIARLFPGRTDNAVKNHFHVIMARRKR

SEQ ID NO: 981 - protein, 142 aa, Arabidopsis thaliana
  G1361,NAC domain
LPAGVKFDPTDQEVLEHLEGKVRDDAKKLHPLIDEFIRTIDGENGICYTHPEKLPGVNKDGTVRHFFHRPSKAYTTGTRKRRKVHTDSDVGGETRWHKTGKTRPVLAGGRVRGYKKILVLYTNYGKQKKPEKTNWVMHQYHL

SEQ ID NO: 982 - protein, 63 aa, Arabidopsis thaliana
  G1421,AP2 domain
TRKFRGVRQRPWGKWAAEIRDPSRRVRVWLGTFDTAEEAAIVYDNAAIQLRGPNAELNFPPPP

SEQ ID NO: 983 - protein, 148 aa, Arabidopsis thaliana
  G1463,NAC domain
PLFLGRFSFVMADTLLNAEDEVIISRYLKPMIVNRVSWPDLFIEDADVFNKDPYVKFHAEIPSFVIVKPRTKACGKTDGCDSGCWRIIGRDKLIKSEETGKILGFKKILKFCLKWKPREYKRSLVMEEYRLTNNFNWKQDHVICKIRL

SEQ ID NO: 984 - protein, 149 aa, Arabidopsis thaliana
  G1464,NAC domain
KSELLNSEDEVIISRYLKPMVVNGDSWPDHFIEDANVFTKNPNEVFNSERPRFVIVKPRTEACGKTDGCESGCWRTMGRDKLIKSEETGKILGFKKILKFCIKWKPIEYKRSWVMEEYRLTNNLNWKQDHVICKIRLLFEAEISFLLAK

SEQ ID NO: 985 - protein, 21 aa, Arabidopsis thaliana
  G1476,Z-C2H2 domain
CTFCKRGFTNAQALGGHMNIH

SEQ ID NO: 986 - protein, 32 aa, Arabidopsis thaliana
  G1482,1st Z-CO-like domain
KIRCDVCDKEEASVFCTADEASLCGGCDHQVH

SEQ ID NO: 987 - protein, 43 aa, Arabidopsis thaliana
  G1482,2nd Z-CO-like domain
CDICQDKKALLFCQQDRAILCKDCDSSIHAANEHTKKHDRFLL

SEQ ID NO: 988 - protein, 50 aa, Arabidopsis thaliana
  G1492,GARP domain
WTPDLHRCFVHAVEILGGQHRATPKLVLKMMDVKGLTISHVKSHLQMYRG

SEQ ID NO: 989 - protein, 61 aa, Arabidopsis thaliana
  G1537,HB domain
RWNPTKDQITLLENLYKEGIRTPSADQIQQITGRLRAYGHIEGKNVFYWFQNHKARQRQKQ

SEQ ID NO: 990 - protein, 61 aa, Arabidopsis thaliana
  G1539,HB domain
RWNPTPDQLRVLEELYRQGTRTPSADHIQQITAQLRRYGKIEGKNVFYWFQNHKARERQKR

SEQ ID NO: 991 - protein, 61 aa, Arabidopsis thaliana
  G1543,HB domain
APPRKKLRLTREQSRLLEDSFRQNHTLNPKQKEVLAKHLMLRPRQIEVWFQNRRARSKLKQ

SEQ ID NO: 992 - protein, 150 aa, Arabidopsis thaliana
  G1555,GARP domain
WTADLHDRFVDAVAKLGGADKATPKSVLKLMGLKGLTLYHLKSHLQKYRLGQQQGKKQNRTEQNKENAGSSYVHFDNCSQGGISNDSRFDNHQRQSGNVPFAEAMRHQVDAQQRFQEQLEVQKKLQMRMEAQGKYLLTLLEKAQKSLPCG

SEQ ID NO: 993 - protein, 92 aa, Arabidopsis thaliana
  G1560,HS domain
PFLTKTYDLVEDSRTNHVVSWSKSNNSFIVWDPQAFSVTLLPRFFKHNNFSSFVRQLNTYGFRKVNPDRWEFANEGFLRGQKHLLKNIRRRK

SEQ ID NO: 994 - protein, 61 aa, Arabidopsis thaliana
  G1584,HB domain
SPEPKPRWNPKPEQIRILEAIFNSGMVNPPREEIRLQEYGQVGDANVFYWFQNRKSRSKHK

SEQ ID NO: 995 - protein, 20 aa, Arabidopsis thaliana
  G1594,HB domain
SENMPFAMMDDSSGSFFTEE

SEQ ID NO: 996 - protein, 47 aa, Arabidopsis thaliana
  G1635,MYB-related domain
ERWTDEEHKKFVEALKLYGRAWRRIEEHVGSKTAVQIRSHAQKFFSK

SEQ ID NO: 997 - protein, 58 aa, Arabidopsis thaliana
  G1655,HLH/MYC domain
GNCKSRKGLTETNRIKLPAVERKLKILGRLVPGCRKVSVPNLLDEATDYIAALEMQVR

SEQ ID NO: 998 - protein, 26 aa, Arabidopsis thaliana
  G1662,1st DBP domain
PQTPKEPMEFLSRSWSLSTSEISKAL

SEQ ID NO: 999 - protein, 36 aa, Arabidopsis thaliana
  G1662,2nd DBP domain
TKRVCVYINKKSQVMIKLKSKHVGGAFSKKIKCVVY

SEQ ID NO: 1000 - protein, 158 aa, Arabidopsis thaliana
  G1671,NAC domain
MNLPPGFRFFPTDEELVVHFLHRKASLLPCHPDVIPDLDLYHYDPWDLPGKALGEGRQWYFYSRKTQERVTSNGYWGSMGMDEPIYTSSTHKKVGIKKYLTFYLGDSQTNWIMQEYSLPDSSSSSSRSSKRSSRASSSSHKPDYSKWVICRVYEQNCS

SEQ ID NO: 1001 - protein, 104 aa, Arabidopsis thaliana
  G1747,MYB-(R1)R2R3 domain
KGPWTEQEDILLVNFVHLFGDRRWDFIAKVSGLNRTGKSCRLRWVNYLHPGLKRGKMTPQEERLVLELHAKWGNRWSKIARKLPGRTDNEIKNYWRTHMRKKAQ

SEQ ID NO: 1002 - protein, 69 aa, Arabidopsis thaliana
  G1753,AP2 domain
HPLYRGVRQRKNSNKWVSEIREPRKPNRIWLGTFSTPEMAAIAYDVAALALKGSQAELNFPNSVSSLPA

SEQ ID NO: 1003 - protein, 63 aa, Arabidopsis thaliana
  G1755,AP2 domain
ICDYTGVRQRTWGKWVAEIREPGRGAKLWLGTFSSSYEAALAYDEASKAIYGQSARLNLPLLP

SEQ ID NO: 1004 - protein, 63 aa, Arabidopsis thaliana
  G1756,WRKY domain
LLSDAWAWRKYGQKPIKGSPYPRSYYRCSSSKGCLARKQVERNPQNPEKFTITYTNEHNHELP

SEQ ID NO: 1005 - protein, 61 aa, Arabidopsis thaliana
  G1757,WRKY domain
DDVFSWRKYGQKDILGAKFPRSYYRCTHRSTQNCWATKQVQRSDGDATVFEVTYRGTHTCS

SEQ ID NO: 1006 - protein, 56 aa, Arabidopsis thaliana
  G1760,MADS domain
GRGKIVIQRIDDSTSRQVTFSKRRKGLIKKAKELAILCDAEVGLIIFSSTGKLYDF

SEQ ID NO: 1007 - protein, 65 aa, Arabidopsis thaliana
  G1795,AP2 domain
EHGKYRGVRRRPWGKYAAEIRDSRKHGERVWLGTFDTAEEAARAYDQAAYSMRGQAAILNFPHEY

SEQ ID NO: 1008 - protein, 57 aa, Arabidopsis thaliana
  G1798,MADS domain
MVRGKIEIKKIENVTSRQVTFSKRRSGLFKKAHELSVLCDAQVAAIVFSQSGRLHEY

SEQ ID NO: 1009 - protein, 13 aa, Arabidopsis thaliana
  G1809,1st bZIP domain
ESDEELLMVPDME

SEQ ID NO: 1010 - protein, 80 aa, Arabidopsis thaliana
  G1809,2nd bZIP domain
RRRGRNPVDKEYRSLKRLLRNRVSAQQARERKKVYVSDLESRANELQNNNDQLEEKISTLTNENTMLRKMLINTRPKTDD

SEQ ID NO: 1011 - protein, 334 aa, Arabidopsis thaliana
  G1812,PCOMB domain
GKKPLYAVVFNFLDARFFDVFVTAGGNRITLYNCLGDGAISALQSYADEDKEESFYTVSWACGVNGNPYVAAGGVKGIIRVIDVNSETIHKSLVGHGDSVNEIRTQPLKPQLVITASKDESVRLWNVETGICILIFAGAGGHRYEVLSVDFHPSDIYRFASCGMDTTIKIWSMKEFWTYVEKSFTWTDDPSKFPTKFVQFPVFTASIHTNYVDCNRWFGDFILSKSVDNEILLWEPQLKENSPGEGASDVLLRYPVPMCDIWFIKFSCDLHLSSVAIGNQEGKVYVWDLKSCPPVLITKLSHNQSKSVIRQTAMSVDGSTILACCEDGTIWRWD

SEQ ID NO: 1012 - protein, 285 aa, Arabidopsis thaliana
  G1817,PMR domain
VLEEIFLRFPVKALIRLKSLSKQWRSTIESRSFEERHLTIAKKAFVDHPKVMLVGEEDPIRGTGIRPDTDIGFRLFCLESASLLSFTRLNFPQGFFNWIYISESCDGLFCIHSPKSHSVYVVNPATRWLRLLPPAGFQILIHKFNPTEREWNVVMKSIFHLAFVKATDYKLVWLYNCDKYIVDASSPNVGVTKCEIFDFRKNAWRYLACTPSHQIFYYQKPASANGSVYWFTEPYNERIEVVAFDIQTETFRLLPKINPAIAGSDPHHIDMCTLDNSLCMSKREK

SEQ ID NO: 1013 - protein, 93 aa, Arabidopsis thaliana
  G1818,CAAT domain
KGMEGDLNVKNHEFPISRIKRIMKFDPDVSMIAAEAPNLLSKACEMFVMDLTMRSWLHAQESNRLTIRKSDVDAVVSQTVIFDFLRDDVPKDE

SEQ ID NO: 1014 - protein, 49 aa, Arabidopsis thaliana
  G1825,GARP domain
WTPDLHLSFVRAVQRLGGPDRATPKLVLEMMNLKGLSIAHVKSHLQMYR

SEQ ID NO: 1015 - protein, 49 aa, Arabidopsis thaliana
  G1826,GARP domain
WTPELHICFLQAVERLGGPDRATPKLVLQLMNVKGLSIAHVKSHLQMYR

SEQ ID NO: 1016 - protein, 87 aa, Arabidopsis thaliana
  G1836,CAAT domain
KEMEGNLDFKNHDLPITRIKKIMKYDPDVTMIASEAPILLSKACEMFIMDLTMRSWLHAQESKRVTLQKSNVDAAVAQTVIFDFLLD

SEQ ID NO: 1017 - protein, 56 aa, Arabidopsis thaliana
  G1844,MADS domain
GRRRVEIKRIENKSSRQVTFCKRRNGLMEKARQLSILCGSSVALFIVSSTGKLYNS

SEQ ID NO: 1018 - protein, 43 aa, Arabidopsis thaliana
  G1883,Z-Dof domain
CPRCNSTNTKFCYYNNYSLTQPRYFCKGCRRYWTEGGSLRNVP

SEQ ID NO: 1019 - protein, 43 aa, Arabidopsis thaliana
  G1895,Z-Dof domain
CPRCNSADTKFCYYNNYNVNQPRHFCRKCQRYWTAGGSMRIVP

SEQ ID NO: 1020 - protein, 29 aa, Arabidopsis thaliana
  G1902,Z-Dof domain
CPRCDSPNTKFCYYNNYNLSQPRHFCKSC

SEQ ID NO: 1021 - protein, 51 aa, Arabidopsis thaliana
  G1911,MYB-related domain
GSWTAKQNKAFEQALATYDQDTPNRWQNVAKVVGGKTTEEVKRHYELLVQD

SEQ ID NO: 1022 - protein, 66 aa, Arabidopsis thaliana
  G1930,1st AP2 domain
SSRFKGVVPQPNGRWGAQIYEKHQRVWLGTFNEEDEAARAYDVAAHRFRGRDAVTNFKDTTFEEEV

SEQ ID NO: 1023 - protein, 95 aa, Arabidopsis thaliana
  G1930,2nd AP2 domain
AELLFEKTVTPSDVGKLNRLVIPKHQAEKHFPLPLGNNNVSVKGMLLNFEDVNGKVWRFRYSYWNSSQSYVLTKGWSRFVKEKRLCAGDLISFKR

SEQ ID NO: 1024 - protein, 57 aa, Arabidopsis thaliana
  G1935,MADS domain
MGRVKLELKRIEKSTNRQITFSKRKKGLIKKAYELSTLCDIDLALLMFSPSDRLCLF

SEQ ID NO: 1025 - protein, 59 aa, Arabidopsis thaliana
  G1942,HLH/MYC domain
RRGQATDNHSLAERARREKINARMKLLQELVPGCDKIQGTALVLDEIINHVQTLQRQVE

SEQ ID NO: 1026 - protein, 14 aa, Arabidopsis thaliana
  G1944,AT-hook domain
LMKKKRGRPRKYGP

SEQ ID NO: 1027 - protein, 21 aa, Arabidopsis thaliana
  G1985,Z-C2H2 domain
CSFCIRGFSNAQALGGHMNIH

SEQ ID NO: 1028 - protein, 152 aa, Arabidopsis thaliana
  G2052,NAC domain
PPGFRFHPTDEELIEYYLKRKVEGLEIELEVIPVIDLYSFDPWELPDKSFLPNRDMEWYFFCSRDKKYPNGFRTNRGTKAGYWKATGKDRKITSRSSSIIGYRKTLVFYKGRAPLGDRSNWIMHEYRLCDDDTSQGSQNLKGAFVLCRVAMK

SEQ ID NO: 1029 - protein, 52 aa, Arabidopsis thaliana
  G2128,GARP domain
KWTPDLHERFIEAVNQLGGADKATPKTIMKVMGIPGLTLYHLKSHLQKYRLS

SEQ ID NO: 1030 - protein, 59 aa, Arabidopsis thaliana
  G2141,HLH/MYC domain
RRGQATNSHSLAERVRREKISERMKFLQDLVPGCNKVTGKAVMLDEIINYVQSLQRQVE

SEQ ID NO: 1031 - protein, 58 aa, Arabidopsis thaliana
  G2146,HLH/MYC domain
LAAAIRGSGGSGRRRKLSAVGNRVRVLGGLVPGCRRTALPELLDETADYIAALEMQVR

SEQ ID NO: 1032 - protein, 58 aa, Arabidopsis thaliana
  G2148,HLH/MYC domain
NRGIASDPQSLYARKRRERINDRLKTLQSLVPNGTKVDISTMLEDAVHYVKFLQLQIK

SEQ ID NO: 1033 - protein, 59 aa, Arabidopsis thaliana
  G2150,HLH/MYC domain
RRGQATDSHSLAERARREKISERMTLLQDLVPGCNRITGKAVMLDEIINYVQSLQRQVE

SEQ ID NO: 1034 - protein, 42 aa, Arabidopsis thaliana
  G2226,RING/C3H2C3 domain
CSVCLSKFQGDSEINKLKCGHLFHKTCLEKWIDYWNITCPLC

SEQ ID NO: 1035 - protein, 44 aa, Arabidopsis thaliana
  G2251,RING/C3H2C3 domain
CAVCLYDFENDDEIRRLTNCRHIFHRGCLDRWMMGYNQMTCPLC

SEQ ID NO: 1036 - protein, 68 aa, Arabidopsis thaliana
  G2291,AP2 domain
TGGFMGVRKRPWGRWSAEIRDRIGRCRHWLGTFDTAEEAARAYDAAARRLRGTKAKTNFVIPPLFPKE

SEQ ID NO: 1037 - protein, 77 aa, Arabidopsis thaliana
  G2346,SBP domain
CQVEGCRMDLSNVKAYYSRHKVCCIHSKSSKVIVSGLHQRFCQQCSRFHQLSEFDLEKRSCRRRLACHNERRRKPQP

SEQ ID NO: 1038 - protein, 108 aa, Arabidopsis thaliana
  G2425,MYB-(R1)R2R3 domain
LRKGEWTAEEDRKLVVYINEHGLGEWGSLPKRAGLQRCGKSCRLRWLNYLRPGIKRGKFTPQEEEEIIKYHALLGNRWAAIAKQMPNRTDNDIKNHWNSCLKKRLAKK

SEQ ID NO: 1039 - protein, 40 aa, Arabidopsis thaliana
  G2454,1st YABBY domain
LCYVQCNFCQTILAVNVPYTSLFKTVTVRCGCCTNLLSVN

SEQ ID NO: 1040 - protein, 48 aa, Arabidopsis thaliana
  G2454,2nd YABBY domain
RPPEKRQRVPSAYNRFIKEEIQRIKAGNPDISHREAFSAAAKNWAHFP

SEQ ID NO: 1041 - protein, 49 aa, Arabidopsis thaliana
  G2484,Z-C4HC3 domain
VCGACGDNYGTDEFWICCDACEKWFHGKCVKITPAKAEHIKHYKCPTCS

SEQ ID NO: 1042 - protein, 67 aa, Arabidopsis thaliana
  G2514,AP2 domain
DPVYRGIRCRSGKWVSEIREPRKTTRIWLGTYPMAEMAAAAYDVAAMALKGREAVLNFPGSVGSYPV

SEQ ID NO: 1043 - protein, 59 aa, Arabidopsis thaliana
  G2520,HLH/MYC domain
RRGQATDSHSLAERARREKISERMKILQDLVPGCNKVIGKALVLDEIINYIQSLQRQVE

SEQ ID NO: 1044 - protein, 68 aa, Arabidopsis thaliana
  G2573,AP2 domain
TCTFRGVRQRTWGKWVAEIREPNRGTRLWLGTFNTSVEAAMAYDEAAKKLYGHEAKLNLVHPQQQQQV

SEQ ID NO: 1045 - protein, 60 aa, Arabidopsis thaliana
  G2574,WRKY domain
TMNDGCQWRKYGQKIAKGNPCPRAYYRCTVAPGCPVRKQVQRCADDMSILITTYEGTHSH

SEQ ID NO: 1046 - protein, 74 aa, Arabidopsis thaliana
  G2577,1st AP2 domain
TSIYRGVTRHRWTGRYEAHLWDNSCKREGQTRKGRQGGYDKEEKAARAYDLAALKYWGTTTTTNFPLSEYEKEV

SEQ ID NO: 1047 - protein, 69 aa, Arabidopsis thaliana
  G2577,2nd AP2 domain
ASIYRGVTRHHQHGRWQARIGRVAGNKDLYLGTFGTQEEAAEAYDIAAIKFRGLSAVTNFDMNRYNVKA

SEQ ID NO: 1048 - protein, 68 aa, Arabidopsis thaliana
  G2583,AP2 domain
SRKFRGVRQRQWGSWVSEIRHPLLKRRVWLGTFETAEAAARAYDQAALLMNGQNAKTNFPVVKSEEGS

SEQ ID NO: 1049 - protein, 56 aa, Arabidopsis thaliana
  G2590,MADS domain
RSKIKLSLIANKTSRRTTFRKRKGGITNKLHELTTLCGVKACAVISSPYENPVVWP

SEQ ID NO: 1050 - protein, 21 aa, Arabidopsis thaliana
  G2606,1st Z-C2H2 domain
CKTCDKSFHSFQALGGHRASH

SEQ ID NO: 1051 - protein, 23 aa, Arabidopsis thaliana
  G2606,2nd Z-C2H2 domain
HECSICKAEFSSGQALGGHMRRH

SEQ ID NO: 1052 - protein, 61 aa, Arabidopsis thaliana
  G2674,HB domain
KRKTKYHRHTSYQIQELESFFKECPHPNEKQRLELGKKLTLESKQIKFWFQNRRTQMKTQL

SEQ ID NO: 1053 - protein, 52 aa, Arabidopsis thaliana
  G2686,WRKY domain
QRCYYRCAYAKDQNCYATKRVQMIQDSPPVYRTTYLGQHTCKAFGVHDNTYG

SEQ ID NO: 1054 - protein, 99 aa, Arabidopsis thaliana
  G2719,MYB-(R1)R2R3 domain
KGPWSTEEDAVLTKLVRKLGPRNWSLIARGIPGRSGKSCRLRWCNQLDPCLKRKPFSDEEDRMIISAHAVHGNKWAVIAKLLTGRTDNAIKNHWNSTLR

SEQ ID NO: 1055 - protein, 49 aa, Arabidopsis thaliana
  G2741,GARP domain
WTPQLHKRFVDVVAHLGIKNAVPKTIMQLMNVEGLTRENVASHLQKYRL

SEQ ID NO: 1056 - protein, 49 aa, Arabidopsis thaliana
  G2742,GARP domain
WTPELHRSFVHAVDLLGGQYKATPKLVLKIMDVKGLTISHVKSHLQMYR

SEQ ID NO: 1057 - protein, 95 aa, Arabidopsis thaliana
  G2747,ABI3/VP-1 domain
REHMFDKVVTPSDVGKLNRLVIPKQHAERYFPLDNSTTNDSNKGLLLNFEDRSGNSWRFRYSYWNSSQSYVMTKGWSRFVKDKKLDAGDIVSFQR

SEQ ID NO: 1058 - protein, 61 aa, Arabidopsis thaliana
  G2763,HLH/MYC domain
GSIRSKKQRATVLRLKAKGLPAVQRKVKVLSRLVPGCRKQSLPVVLEETTDYIAAMEMQIR

SEQ ID NO: 1059 - protein, 21 aa, Arabidopsis thaliana
  G2831,1st Z-C2H2 domain
CEICGKGFQRDQNLQLHRRGH

SEQ ID NO: 1060 - protein, 21 aa, Arabidopsis thaliana
  G2831,2nd Z-C2H2 domain
CEKCAKRYAVQSDWKAHSKTC

SEQ ID NO: 1061 - protein, 21 aa, Arabidopsis thaliana
  G2832,1st Z-C2H2 domain
CKYCYKTFPSGKALGGHIRIH

SEQ ID NO: 1062 - protein, 21 aa, Arabidopsis thaliana
  G2832,2nd Z-C2H2 domain
CRECGRVFVSLKALRGHMACH

SEQ ID NO: 1063 - protein, 21 aa, Arabidopsis thaliana
  G2832,3rd Z-C2H2 domain
CPICFRMFKSGQALGGHKRSH

SEQ ID NO: 1064 - protein, 59 aa, Arabidopsis thaliana
  G2859,HLH/MYC domain
RRGQATDSHSIAERVRRGKINERLKCLQDIVPGCYKTMGMATMLDEIINYVQSLQNQVE

SEQ ID NO: 1065 - protein, 48 aa, Arabidopsis thaliana
  G2885,GARP domain
WSQELHQKFVSAVQQLGLDKAVPKKILDLMSIEGLTRENVASHLQKYR

SEQ ID NO: 1066 - protein, 56 aa, Arabidopsis thaliana
  G2990,1st ZF-HB domain
FTYKECLKNHAAALGGHALDGCGEFMPSPSSISSDPTSLKCAACGCHRNFHRRDPD

SEQ ID NO: 1067 - protein, 64 aa, Arabidopsis thaliana
  G2990,2nd ZF-HB domain
RKRFRTKFSQFQKEKMHEFAERVGWKMQKRDEDDVRDFCRQIGVDKSVLKVWMHNNKNTFNRRD

SEQ ID NO: 1068 - protein, 49 aa, Arabidopsis thaliana
  G3032,GARP domain
WTNRLQLVFDDAVVRLGGLFSATPKAINELISEEGLTGDQIRSHLQVLR

SEQ ID NO: 1069 - protein, 49 aa, Arabidopsis thaliana
  G3034,GARP domain
WTTTLHARFVHAVELLGGHERATPKSVLELMDVKDLTLAHVKSHLQMYR

SEQ ID NO: 1070 - protein, 59 aa, Arabidopsis thaliana
  G3044,HLH/MYC domain
RRGQATNSHSLAERVRREKISERMKFLQDLVPGCDKVTGKAVMLDEIINYVQSLQCQIE

SEQ ID NO: 1071 - protein, 18 aa, Arabidopsis thaliana
  G3061,1st Z-C2H2 domain
CNKGFQREQNLQLHKRGH

SEQ ID NO: 1072 - protein, 20 aa, Arabidopsis thaliana
  G3061,2nd Z-C2H2 domain
CDCGTLFSRKDSFISHRSFC

SEQ ID NO: 1073 - protein, 22 aa, Arabidopsis thaliana
  G3070,Z-C2H2 domain
CQKCHERVRDLDAFEAHYLSNH

SEQ ID NO: 1074 - protein, 31 aa, Arabidopsis thaliana
  G3080,1st bZIP-ZW2 domain
YFAPSWNSPLENGLLWMGGCRPSSFIRVIYS

SEQ ID NO: 1075 - protein, 28 aa, Arabidopsis thaliana
  G3080,2nd bZIP-ZW2 domain
ADKLRFETLRKIVDVVTPVQAAEFLLAG

SEQ ID NO: 1076 - protein, 68 aa, Arabidopsis thaliana
  G10,AP2 domain
EKRYKGIRMRKWGKWVAEIREPNKRSRIWLGSYKTAVAAARAYDTAVFYLRGPSARLNFPEEVFKDGN

SEQ ID NO: 1077 - protein, 90 aa, Arabidopsis thaliana
  G1010,ABI3/VP-1 domain
HMFDKVVTPSDVGKLNRLVIPKQHAERFFPLDSSSNEKGLLLNFEDLTGKSWRFRYSYWNSSQSYVMTKGWSRFVKDKKLDAGDIVSFQR

SEQ ID NO: 1078 - protein, 56 aa, Arabidopsis thaliana
  G1011,MADS domain
VRGKIEMKKIENATSRQVTFSKRRNGLLKKAYELSVLCDAQLSLIIFSQRGRLYEF

SEQ ID NO: 1079 - protein, 50 aa, Arabidopsis thaliana
  G1040,GARP domain
RWTSTLHAHFVHAVQLLGGHERATPKSVLELMNVKDLTLAHVKSHLQMYR

SEQ ID NO: 1080 - protein, 64 aa, Arabidopsis thaliana
  G1056,bZIP domain
GEIVEKTVERRQKRMIKNRESAARSRARKQAYTHELEIKVSRLEEENEKLRRLKEVEKILPSEP

SEQ ID NO: 1081 - protein, 9 aa, Arabidopsis thaliana
  G1076,1st AT-hook domain
RRPRGRPPG

SEQ ID NO: 1082 - protein, 143 aa, Arabidopsis thaliana
  G1076,2nd AT-hook domain
SKNKPKPPVIITRESANTLRAHILEVTNGCDVFDCVATYARRRQRGICVLSGSGTVTNVSIRQPSAAGAVVTLQGTFEILSLSGSFLPPPAPPGATSLTIFLAGGQGQVVGGSVVGELTAAGPVIVIAASFTNVAYERLPLEE

SEQ ID NO: 1083 - protein, 58 aa, Arabidopsis thaliana
  G1133,HLH/MYC domain
SSKQETGSGLSDEQSRKDKIHTALRILESVVPGAKGKEALLLLDEAIDYLKLLKQSLN

SEQ ID NO: 1084 - protein, 11 aa, Arabidopsis thaliana
  G1149,PAZ domain
GTSRPAHYHVL

SEQ ID NO: 1085 - protein, 11 aa, Arabidopsis thaliana
  G1152,PAZ domain
GTSRPAHYHVL

SEQ ID NO: 1086 - protein, 60 aa, Arabidopsis thaliana
  G1227,HLH/MYC domain
EIESQRMTHIAVERNRRRQMNVHLNSLRSIIPSSYIQRGDQASIVGGAIDFVKILEQQLQ

SEQ ID NO: 1087 - protein, 49 aa, Arabidopsis thaliana
  G1232,Z-C4HC3 domain
VCGACGDNYGGDEFWICCDACEKWFHGKCVKITPAKAEHIKHYKCPSCT

SEQ ID NO: 1088 - protein, 124 aa, Arabidopsis thaliana
  G1247,MYB-(R1)R2R3 domain
KSKWKPEEDRILKDYVIQYGDRTWTHVPKRTGLPHNPASCRFRWMNHLKPSLKKGPFTDEEEKRVLQLHAVLGNKWSQMAREVCNSLSFFFHSLHFHLLLLFDLNFCFFKFPGRTDNEIKNFWN

SEQ ID NO: 1089 - protein, 57 aa, Arabidopsis thaliana
  G1274,WRKY domain
DDGFKWRKYGKKSVKNNINKRNYYKCSSEGCSVKKRVERDGDDAAYVITTYEGVHNH

SEQ ID NO: 1090 - protein, 68 aa, Arabidopsis thaliana
  G1277,AP2 domain
ERPFKGIRMRKWGKWVAEIREPNKRSRLWLGSYSTPEAAARAYDTAVFYLRGPTATLNFPELLPCTSA

SEQ ID NO: 1091 - protein, 105 aa, Arabidopsis thaliana
  G1329,MYB-(R1)R2R3 domain
GLRKGAWTTEEDSLLRQCINKYGEGKWHQVPVRAGLNRCRKSCRLRWLNYLKPSIKRGKLSSDEVDLLLRLHRLLGNRWSLIAGRLPGRTANDVKNYWNTHLSKK

SEQ ID NO: 1092 - protein, 90 aa, Arabidopsis thaliana
  G1364,CAAT domain
REQDRFLPIANISRIMKRGLPANGKIAKDAKEIVQECVSEFISFVTSEASDKCQREKRKTINGDDLLWAMATLGFEDYMEPLKVYLMRYR

SEQ ID NO: 1093 - protein, 68 aa, Arabidopsis thaliana
  G1379,AP2 domain
DRPYKGIRMRKWGKWVAEIREPNKRSRLWLGSYSTPEAAARAYDTAVFYLRGPTARLNFPELLPGEKF

SEQ ID NO: 1094 - protein, 68 aa, Arabidopsis thaliana
  G1387,AP2 domain
SKKFRGVRQRQWGSWVSEIRHPLLKRRVWLGTFDTAETAARAYDQAAVLMNGQSAKTNFPVIKSNGSN

SEQ ID NO: 1095 - protein, 67 aa, Arabidopsis thaliana
  G1416,1st AP2 domain
SSQYRGVTFYRRTGRWESHIWDCGKQVYLGGFDTAHAAARAYDRAAIKFRGVDADINFDIEDYLDDL

SEQ ID NO: 1096 - protein, 68 aa, Arabidopsis thaliana
  G1416,2nd AP2 domain
SSKYRGVTLHKCGRWESRLGQFLNKKYVYLGLFDTEIEAARAYDKAAIKCNGKDAVTNFDPKVYEEEE

SEQ ID NO: 1097 - protein, 69 aa, Arabidopsis thaliana
  G1419,AP2 domain
QRHYRGVRRRPWGKYAAEIRDPNKKGVRVWLGTFDTAMEAARGYDKAAFKLRGSKAILNFPLEAGKHED

SEQ ID NO: 1098 - protein, 154 aa, Arabidopsis thaliana
  G1425,NAC domain
GFRFHPTDEELVIHYLKRKADSVPLPVAIIADVDLYKFDPWELPAKASFGEQEWYFFSPRDRKYPNGARPNRAATSGYWKATGTDKPVISTGGGGSKKVGVKKALVFYSGKPPKGVKSDWIMHEYRLTDNKPTHICDFGNKKNSLRLDDWVLCR

SEQ ID NO: 1099 - protein, 129 aa, Arabidopsis thaliana
  G1426,NAC domain
QNLHVLSMDSLPVGLRFRPTDEELIRYYLRRKINGHDDDVKAIREIDICKWEPWDLPDFSVIKTKDSEWLYFCPLDRKYPSGSRQNRATVAGYWKATGKDRKIKSGKTNIIGVKRTLVFHAGRAPRGTR

SEQ ID NO: 1100 - protein, 49 aa, Arabidopsis thaliana; identical to SEQ ID NO: 1055
  G1435,GARP domain

SEQ ID NO: 1101 - protein, 170 aa, Arabidopsis thaliana
  G1454,NAC domain
GPPPPQPNLPPGFRFHPTDEELVVHYLKRKAASAPLPVAIIAEVDLYKFDPWELPAKASFGEQEWYFFSPRDRKYPNGARPNRAATSGYWKATGTDKPVLASDGNQKVGVKKALVFYSGKPPKGVKSDWIMHEYRLIENKPNNRPPGCDFGNKKNSLRLDDWVLCRIYKK

SEQ ID NO: 1102 - protein, 155 aa, Arabidopsis thaliana
  G1455,NAC domain
LPLGFRFRPTDEELINHYLRLKINGRDLEVRVIPEIDVCKWEPWDLPGLSVIKTDDQEWFFFCPRDRKYPSGHRSNRATDIGYWKATGKDRTIKSKKMIIGMKKTLVFYRGRAPRGERTNWIMHEYRATDKELDGTGPGQNPYVLCRLFHKPSDS

SEQ ID NO: 1103 - protein, 127 aa, Arabidopsis thaliana
  G1461,NAC domain
DDVIISRYLKRMIVNGDSWPDHFIEDVDVFNKNPNEEFHSQSPRFVIVKPRTENCGRTDGCQSGCWRIIGRDKLIKSKETGKILGFKKILKFCLKKKPREYKRSWVMEEYRLNNNLNCKQDHVICKI

SEQ ID NO: 1104 - protein, 260 aa, Arabidopsis thaliana
  G1462,NAC domain
ELLYSEDEVIISRYLKGMVVNGDSWPDHFIEDANVFTKNPDKVFNSERPRFVIVKPRTEACGKTDGCDSGCWRIIGRDKLIKSEETGKILGFKKILKFCLKRKPIDYKRSWVMEEYRLTNNLNWKQDHVICKIRFMFEAEISFLLSKHFYTTSESVLENELLPSYGYYLSNTQEEDEFYLDAIMTSEGNEWPSYVTNNVYCLHPLELVDLQDRMFNDYGTCIFANKTCGETDKCDGGYWKILHGDKLIKSNFGKVIGFKK

SEQ ID NO: 1105 - protein, 65 aa, Arabidopsis thaliana
  G1465,NAC domain
KTDRCINGGYWKILHRDRLIKSKSGIVIGFKKVFKFHETEKERYFCGGEDVKVTWTLEEYRLSVK

SEQ ID NO: 1106 - protein, 56 aa, Arabidopsis thaliana
  G149,MADS domain
VRGKTEMKRIENATSRQVTFSKRRNGLLKKAFELSVLCDAEVALIIFSPRGKLYEF

SEQ ID NO: 1107 - protein, 51 aa, Arabidopsis thaliana
  G1491,GARP domain
WTPDLHERFVEAVNQLGGGDKATPKTIMKVMGIPGLTLYHLKSHLQKYRLS

SEQ ID NO: 1108 - protein, 59 aa, Arabidopsis thaliana
  G1496,HLH/MYC domain
RRGQATDRHSLAERARREKISKKMKYLQDIVPGCNKVTGKAGMLDEIINYVQCLQRQVE

SEQ ID NO: 1109 - protein, 56 aa, Arabidopsis thaliana
  G152,MADS domain
GRGKIVIQKIDDSTSRQVTFSKRRKGLIKKAKELAILCDAEVCLIIFSNTDKLYDF

SEQ ID NO: 1110 - protein, 57 aa, Arabidopsis thaliana
  G153,MADS domain
MGRGKIVIRRIDNSTSRQVTFSKRRSGLLKKAKELSILCDAEVGVIIFSSTGKLYDY

SEQ ID NO: 1111 - protein, 56 aa, Arabidopsis thaliana
  G154,MADS domain
VRGKTQMKRIENATSRQVTFSKRRNGLLKKAFELSVLCDAEVSLIIFSPKGKLYEF

SEQ ID NO: 1112 - protein, 56 aa, Arabidopsis thaliana
  G157,MADS domain
GRRKIEIKRIENKSSRQVTFSKRRNGLIDKARQLSILCESSVAVVVVSASGKLYDS

SEQ ID NO: 1113 - protein, 63 aa, Arabidopsis thaliana
  G1750,AP2 domain
QKKYRGVRQRPWGKWAAEIRDPEQRRRIWLGTFATAEEAAIVYDNAAIKLRGPDALTNFTVQP

SEQ ID NO: 1114 - protein, 68 aa, Arabidopsis thaliana
  G1754,AP2 domain
ICDYRGVRQRRWGKWVAEIREPDGGARLWLGTFSSSYEAALAYDEAAKAIYGQSARLNLPEITNRSSS

SEQ ID NO: 1115 - protein, 56 aa, Arabidopsis thaliana
  G1759,MADS domain
GRKKLEIKRIENKSSRQVTFSKRRNGLIEKARQLSVLCDASVALLVVSASGKLYSF

SEQ ID NO: 1116 - protein, 51 aa, Arabidopsis thaliana
  G1789,MYB-related domain
GSWTVKQNKAFERALAVYDQDTPDRWHNVARAVGGKTPEEAKRQYDLLVRD

SEQ ID NO: 1117 - protein, 65 aa, Arabidopsis thaliana
  G1791,AP2 domain
NEMKYRGVRKRPWGKYAAEIRDSARHGARVWLGTFNTAEDAARAYDRAAFGMRGQRAILNFPHEY

SEQ ID NO: 1118 - protein, 65 aa, Arabidopsis thaliana
  G1792,AP2 domain
KQARFRGVRRRPWGKFAAEIRDPSRNGARLWLGTFETAEEAARAYDRAAFNLRGHLAILNFPNEY

SEQ ID NO: 1119 - protein, 57 aa, Arabidopsis thaliana
  G1797,MADS domain
MVRGKIEIKKIENVTSRQVTFSKRRSGLFKKAHELSVLCDAQVAAMIFSQKGRLYEF

SEQ ID NO: 1120 - protein, 61 aa, Arabidopsis thaliana
  G1806,bZIP domain
RTLRRLAQNREAARKSRLRKKAYVQQLENSRIRLAQLEEELKRARQQGSLVERGVSADHTH

SEQ ID NO: 1121 - protein, 61 aa, Arabidopsis thaliana
  G1808,bZIP domain
RKRKRMESNRESAKRSRMRKQSHIDNLREQVNRLDLENRELGNRLRLVLHQLQRVNSDNNR

SEQ ID NO: 1122 - protein, 56 aa, Arabidopsis thaliana
  G1842,MADS domain
GRRKVEIKRIENKSSRQVTFSKRRKGLIEKARQLSILCESSIAVVAVSGSGKLYDS

SEQ ID NO: 1123 - protein, 56 aa, Arabidopsis thaliana
  G1843,MADS domain
GRRKVEIKRIENKSSRQVTFCKRRNGLMEKARQLSILCESSVALIIISATGRLYSF

SEQ ID NO: 1124 - protein, 60 aa, Arabidopsis thaliana
  G1847,WRKY domain
DDIFSWRKYGQKDILGAKFPRSYYRCTFRNTQYCWATKQVQRSDGDPTIFEVTYRGTHTC

SEQ ID NO: 1125 - protein, 32 aa, Arabidopsis thaliana
  G1888,1st Z-CO-like domain
KIWCAVCDKEEASVFCCADEAALCNGCDRHVH

SEQ ID NO: 1126 - protein, 43 aa, Arabidopsis thaliana
  G1888,2nd Z-CO-like domain
CDICGERRALLFCQEDRAILCRECDIPIHQANEHTKKHNRFLL

SEQ ID NO: 1127 - protein, 47 aa, Arabidopsis thaliana
  G1903,Z-Dof domain
CPRCESANTKFCYYNNYNVNQPRYFCRNCQRYWTAGGSMRNVPVGSG

SEQ ID NO: 1128 - protein, 52 aa, Arabidopsis thaliana
  G1959,GARP domain
WTTELHERFVDAVTQLGGPDKATPKTIMRTMGVKGLTLYHLKSHLQKFRLGR

SEQ ID NO: 1129 - protein, 147 aa, Arabidopsis thaliana
  G2053,NAC domain
GLRFRPTDKEIVVDYLRPKNSDRDTSHVDRVISTVTIRSFDPWELPCQSRIKLKDESWCFFSPKENKYGRGDQQIRKTKSGYWKITGKPKPILRNRQEIGEKKVLMFYMSKELGGSKSDWVMHEYHAFSPTQMMMTYTICKVMFKGD

SEQ ID NO: 1130 - protein, 56 aa, Arabidopsis thaliana
  G2058,MADS domain
GRVKLEIKRIENTTNRQVTFSKRRNGLIKKAYELSILCDIDIALLMFSPSDRLSLF

SEQ ID NO: 1131 - protein, 60 aa, Arabidopsis thaliana
  G2110,WRKY domain
NDGCQWRKYGQKIAKGNPCPRAYYRCTIAASCPVRKQVQRCSEDMSILISTYEGTHNHPL

SEQ ID NO: 1132 - protein, 68 aa, Arabidopsis thaliana
  G2133,AP2 domain
DQSKYKGIRRRKWGKWVSEIRVPGTRQRLWLGSFSTAEGAAVAHDVAFYCLHRPSSLDDESFNFPHLL

SEQ ID NO: 1133 - protein, 73 aa, Arabidopsis thaliana
  G2138,AP2 domain
EKKYRGVRQRPWGKWVAEIRCGRGACKGRRDRLWLGTFNTAEEAALAYDNASIKLIGPHAPTNFGLPAENQED

SEQ ID NO: 1134 - protein, 58 aa, Arabidopsis thaliana; identical to SEQ ID NO: 957
  G2143,HLH/MYC domain

SEQ ID NO: 1135 - protein, 59 aa, Arabidopsis thaliana
  G2144,HLH/MYC domain
RRGQATDSHSLAERARREKINARMKLLQELVPGCDKIQGTALVLDEIINHVQSLQRQVE

SEQ ID NO: 1136 - protein, 58 aa, Arabidopsis thaliana
  G2145,HLH/MYC domain
TKGTATDPQSLYARKRREKINERLKTLQNLVPNGTKVDISTMLEEAVHYVKFLQLQIK

SEQ ID NO: 1137 - protein, 103 aa, Arabidopsis thaliana
  G216,MYB-(R1)R2R3 domain
VKGPWLPEQDEALTRLVKMCGPRNWNLISRGIPGRSGKSCRLRWCNQLDPILKRKPFSDEEEHMIMSAQAVLGNKWSVIAKLLPGRTDNAIKNHWNSNLRRKP

SEQ ID NO: 1138 - protein, 187 aa, Arabidopsis thaliana
  G2316,PMR domain
KQWRSTIESRSFEERHLKIVERSRVDFPQVMVMSEEYSLKGSKGNQPRPDTDIGFSTICLESASILSSTLITFPQGFQHRIYASESCDGLFCIHSLKTQAIYVVNPATRWFRQLPPARFQILMQKLYPTQDTWIDIKPVVCYTAFVKANDYKLVWLYNSDASNPNLGVTKCEVFDFRANAWRYLTCT

SEQ ID NO: 1139 - protein, 90 aa, Arabidopsis thaliana
  G2345,CAAT domain
REQDRFLPIANISRIMKRGLPLNGKIAKDAKETMQECVSEFISFVTSEASDKCQREKRKTINGDDLLWAMATLGFEDYIDPLKVYLMRYR

SEQ ID NO: 1140 - protein, 41 aa, Arabidopsis thaliana
  G2394,RING/C3H2C3 domain
CCICLTRYGDDEQVRELPCSHVFHVDCVDKWLKINATCPLC

SEQ ID NO: 1141 - protein, 68 aa, Arabidopsis thaliana
  G24,AP2 domain
LKPYKGIRMRKWGKWVAEIREPNKRSRIWLGSYATPEAAARAYDTAVFYLRGPSARLNFPELLAGLTV

SEQ ID NO: 1142 - protein, 102 aa, Arabidopsis thaliana
  G2421,MYB-(R1)R2R3 domain
RKGAWTAEEDSLLRQCIGKYGEGKWHQVPLRAGLNRCRKSCRLRWLNYLKPSIKRGKFSSDEVDLLLRLHKLLGNRWSLIAGRLPGRTANDVKNYWNTHLSK

SEQ ID NO: 1143 - protein, 102 aa, Arabidopsis thaliana
  G2422,MYB-(R1)R2R3 domain
RKGTWTTEEDILLRQCIDKYGEGKWHRVPLRTGLNRCRKSCRLRWLNYLKPSIKRGKLCSDEVDLVLRLHKLLGNRWSLIAGRLPGRTANDVKNYWNTHLSK

SEQ ID NO: 1144 - protein, 117 aa, Arabidopsis thaliana
  G243,MYB-(R1)R2R3 domain
LKKGAWTTEEDKKLISYIHDHGEGGWRDIPEKAGLKRCGKSCRLRWTNYLKPDIKRGEFSYEEEQIIIMLHASRGNKWSVIARHLPKRTDNEVKNYWNTHLKKRLIDDGIDPVTHKP

SEQ ID NO: 1145 - protein, 39 aa, Arabidopsis thaliana
  G2456,1st YABBY domain
LCYVHCSFCDTVLAVSVPPSSLFKTVTVRCGHCSNLLSV

SEQ ID NO: 1146 - protein, 48 aa, Arabidopsis thaliana; identical to SEQ ID NO: 1040
  G2456,2nd YABBY domain

SEQ ID NO: 1147 - protein, 92 aa, Arabidopsis thaliana
  G2467,HS domain
PFLTKTFEMVGDPNTNHIVSWNRGGISFVVWDPHSFSATILPLYFKHNNFSSFVRQLNTYGFRKIEAERWEFMNEGFLMGQRDLLKSIKRRT

SEQ ID NO: 1148 - protein, 104 aa, Arabidopsis thaliana
  G251,MYB-(R1)R2R3 domain
RKGPWTEQEDILLVNFVHLFGDRRWDFVAKVSGLNRTGKSCRLRWVNYLHPGLKRGKMTPQEERLVLELHAKWGNRWSKIARKLPGRTDNEIKNYWRTHMRKKA

SEQ ID NO: 1149 - protein, 103 aa, Arabidopsis thaliana
  G256,MYB-(R1)R2R3 domain
KGPWTPEEDIILVSYIQQHGPGNWRSVPANTGLLRCSKSCRLRWTNYLRPGIKRGNFTQPEEKMIIHLQALLGNRWAAIASYLPQRTDNDIKNYWNTHLKKKL

SEQ ID NO: 1150 - protein, 57 aa, Arabidopsis thaliana
  G2578,MADS domain
MGRVKLEIKRIENTTNRQVTFSKRRNGLIKKAYELSILCDIDIALIMFSPSDRLSLF

SEQ ID NO: 1151 - protein, 58 aa, Arabidopsis thaliana
  G2586,WRKY domain
DDGFTWRKYGQKTIKTSPYQRCYYRCTYAKDQNCNARKRVQMIQDNPPVYRTTYLGKH

SEQ ID NO: 1152 - protein, 58 aa, Arabidopsis thaliana
  G2587,WRKY domain
NDGFTWRKYGQKTIKASAHKRCYYRCTYAKDQNCNATKRVQKIKDNPPVYRTTYLGKH

SEQ ID NO: 1153 - protein, 92 aa, Arabidopsis thaliana
  G265,HS domain
PFLTKTYEMVDDSSSDSVVAWSENNKSFIVKNPAEFSRDLLPRFFKHKNFSSFIRQLNTYGFRKVDPEKWEFLNDDFVRGRPYLMKNIHRRK

SEQ ID NO: 1154 - protein, 9 aa, Arabidopsis thaliana
  G2657,1st AT-hook domain
RRPRGRPAG

SEQ ID NO: 1155 - protein, 144 aa, Arabidopsis thaliana
  G2657,2nd AT-hook domain
SKNKPKAPIIITRDSANALRTHVMEIGDGCDIVDCMATFARRRQRGVCVMSGTGSVTNVTIRQPGSPPGSVVSLHGRFEILSLSGSFLPPPAPPAATGLSVYLAGGQGQVVGGSVVGPLLCSGPVVVMAASFSNAAYERLPLEE

SEQ ID NO: 1156 - protein, 21 aa, Arabidopsis thaliana
  G2665,Z-C2H2 domain
CNYCQRTFYSSQALGGHQNAH

SEQ ID NO: 1157 - protein, 51 aa, Arabidopsis thaliana
  G2721,MYB-related domain
SPWTFSQNKMFERALAVYDKDTPDRWHNVAKAVGGKTVEEVKRHYDILVED

SEQ ID NO: 1158 - protein, 59 aa, Arabidopsis thaliana
  G2779,HLH/MYC domain
RRGQATDSHSLAERVRRGKINERLRCLQDMVPGCYKAMGMATMLDEIINYVQSLQNQVE

SEQ ID NO: 1159 - protein, 592 aa, Arabidopsis thaliana
  G278,AKR domain
DTTIDGFADSYEISSTSFVATDNTDSSIVYLAAEQVLTGPDVSALQLLSNSFESVFDSPDDFYSDAKLVLSDGREVSFHRCVLSARSSFFKSALAAAKKEKDSNNTAAVKLELKEIAKDYEVGFDSVVTVLAYVYSSRVRPPPKGVSECADENCCHVACRPAVDFMLEVLYLAFIFKIPELITLYQRHLLDVVDKVVIEDTLVILKLANICGKACMKLLDRCKEIIVKSNVDMVSLEKSLPEELVKEIIDRRKELGLEVPKVKKHVSNVHKALDSDDIELVKLLLKEDHTNLDDACALHFAVAYCNVKTATDLLKLDLADVNHRNPRGYTVLHVAAMRKEPQLILSLLEKGASASEATLEGRTALMIAKQATMAVECNNIPEQCKHSLKGRLCVEILEQEDKREQIPRDVPPSFAVAADELKMTLLDLENRVALAQRLFPTEAQAAMEIAEMKGTCEFIVTSLEPDRLTGTKRTSPGVKIAPFRILEEHQSRLKALSKTVELGKRFFPRCSAVLDQIMNCEDLTQLACGEDDTAEKRLQKKQRYMEIQETLKKAFSEDNLELGNSSLTDSTSSTSKSTGGKRSNRKLSHRRR

SEQ ID NO: 1160 - protein, 64 aa, Arabidopsis thaliana
  G29,AP2 domain
KRHYRGVRMRPWGKFAAEIRDPTRRGTRVWLGTFETAIEAARAYDKEAFRLRGSKAILNFPLEV

SEQ ID NO: 1161 - protein, 56 aa, Arabidopsis thaliana
  G2989,1st ZF-HB domain
VTYKECLKNHAAAIGGHALDGCGEFMPSPSSTPSDPTSLKCAACGCHRNFHRRETD

SEQ ID NO: 1162 - protein, 64 aa, Arabidopsis thaliana
  G2989,2nd ZF-HB domain
RKRFRTKFSSNQKEKMHEFADRIGWKIQKRDEDEVRDFCREIGVDKGVLKVWMHNNKNSFKFSG

SEQ ID NO: 1163 - protein, 65 aa, Arabidopsis thaliana
  G30,AP2 domain
EQGKYRGVRRRPWGKYAAEIRDSRKHGERVWLGTFDTAEDAARAYDRAAYSMRGKAAILNFPHEY

SEQ ID NO: 1164 - protein, 31 aa, Arabidopsis thaliana
  G3079,1st bZIP-ZW2 domain
YFAPSWNTPIENSMLWMGGCRPSSFIRLIYA

SEQ ID NO: 1165 - protein, 28 aa, Arabidopsis thaliana
  G3079,2nd bZIP-ZW2 domain
ADKLRFETLRKIVDVVTPLQAVEFLLAG

SEQ ID NO: 1166 - protein, 65 aa, Oryza sativa (japonica cultivar-group)
  G3380,AP2 domain
ETTKYRGVRRRPSGKFAAEIRDSSRQSVRVWLGTFDTAEEAARAYDRAAYAMRGHLAVLNFPAEA

SEQ ID NO: 1167 - protein, 65 aa, Oryza sativa (japonica cultivar-group)
  G3381,AP2 domain
LVAKYRGVRRRPWGKFAAEIRDSSRHGVRVWLGTFDTAEEAARAYDRSAYSMRGANAVLNFPADA

SEQ ID NO: 1168 - protein, 65 aa, Oryza sativa (japonica cultivar-group)
  G3383,AP2 domain
TATKYRGVRRRPWGKFAAEIRDPERGGARVWLGTFDTAEEAARAYDRAAYAQRGAAAVLNFPAAA

SEQ ID NO: 1169 - protein, 105 aa, Oryza sativa (japonica cultivar-group)
  G3384,MYB-(R1)R2R3 domain
KGPWTPEEDLMLVSYIQEHGAGNWRAVPTNTGLMRCSKSCRLRWTNYLRPGIKRGNFTEQEEKLIVHLQALLGNRWAAIASYLPERTDNDIKNYWNTHLKKKLKK

SEQ ID NO: 1170 - protein, 105 aa, Oryza sativa (japonica cultivar-group)
  G3385,MYB-(R1)R2R3 domain
KGPWTPEEDMVLASYVQEHGPGNWRAVPPRTGLLRCSKSCRLRWTNYLRPGIRRGGFSHHEERLILHLQALLGNRWAAIASYLPHRTDNDVKNFWNTHLKKKLAL

SEQ ID NO: 1171 - protein, 105 aa, Oryza sativa (japonica cultivar-group)
  G3386,MYB-(R1)R2R3 domain
KGPWTPEEDLVLVSYVQEHGPGNWRAVPTRTGLMRCSKSCRLRWTNYLRPGIKRGNFTDQEEKLIVHLQALLGNRWAAIASYLPERTDNDIKNYWNTHLKRKLQG

SEQ ID NO: 1172 - protein, 64 aa, Oryza sativa (japonica cultivar-group)
  G3388,1st AP2 domain
SSRYKGVVPQPNGRWGAQIYERHARVWLGTFPDEEAAARAYDVAALRYRGRDAATNFPGAAASA

SEQ ID NO: 1173 - protein, 94 aa, Oryza sativa (japonica cultivar-group)
  G3388,2nd AP2 domain
LFEKAVTPSDVGKLNRLVVPKQHAEKHFPLRRAASSDSASAAATGKGVLLNFEDGEGKVWRFRYSYWNSSQSYVLTKGWSRFVREKGLRAGDTI

SEQ ID NO: 1174 - protein, 66 aa, Oryza sativa (japonica cultivar-group)
  G3389,1st AP2 domain
SSRYKGVVPQPNGRWGAQIYERHARVWLGTFPDEEAAARAYDVAALRFRGRDAVTNRAPAAEGASA

SEQ ID NO: 1175 - protein, 90 aa, Oryza sativa (japonica cultivar-group)
  G3389,2nd AP2 domain
LFEKAVTPSDVGKLNRLVVPKQQAERHFPFPLRRHSSDAAGKGVLLNFEDGDGKVWRFRYSYWNSSQSYVLTKGWSRFVREKGLRPGDTV

SEQ ID NO: 1176 - protein, 66 aa, Oryza sativa (japonica cultivar-group)
  G3390,1st AP2 domain
SSKYKGVVPQPNGRWGAQIYERHQRVWLGTFTGEAEAARAYDVAAQRFRGRDAVTNFRPLAESDPE

SEQ ID NO: 1177 - protein, 103 aa, Oryza sativa (japonica cultivar-group)
  G3390,2nd AP2 domain
LFDKTVTPSDVGKLNRLVIPKQHAEKHFPLQLPPPTTTSSVAAAADAAAGGGDCKGVLLNFEDAAGKVWKFRYSYWNSSQSYVLTKGWSRFVKEKGLHAGDAV

SEQ ID NO: 1178 - protein, 70 aa, Oryza sativa (japonica cultivar-group)
  G3391,1st AP2 domain
SSKFKGVVPQPNGRWGAQIYERHQRVWLGTFAGEDDAARAYDVAAQRFRGRDAVTNFRPLAEADPDAAAE

SEQ ID NO: 1179 - protein, 86 aa, Oryza sativa (japonica cultivar-group)
  G3391,2nd AP2 domain
LFDKTVTPSDVGKLNRLVIPKQHAEKHFPLQLPSAGGESKGVLLNFEDAAGKVWRFRYSYWNSSQSYVLTKGWSRFVKEKGLHADG

SEQ ID NO: 1180 - protein, 89 aa, Oryza sativa (indica cultivar-group)
  G3394,CAAT domain
RQDRFLPIANISRIMKKAIPANGKIAKDAKETVQECVSEFISFITSEASDKCQREKRKTINGDDLLWAMATLGFEDYIEPLKVYLQKYR

SEQ ID NO: 1181 - protein, 90 aa, Oryza sativa (japonica cultivar-group)
  G3395,CAAT domain
REQDRFLPIANISRIMKKAVPANGKIAKDAKETLQECVSEFISFVTSEASDKCQKEKRKTINGEDLLFAMGTLGFEEYVDPLKIYLHKYR

SEQ ID NO: 1182 - protein, 90 aa, Oryza sativa (japonica cultivar-group)
  G3396,CAAT domain
KEQDRFLPIANIGRIMRRAVPENGKIAKDSKESVQECVSEFISFITSEASDKCLKEKRKTINGDDLIWSMGTLGFEDYVEPLKLYLRLYR

SEQ ID NO: 1183 - protein, 90 aa, Oryza sativa (japonica cultivar-group)
  G3397,CAAT domain
REQDRFLPIANVSRIMKKALPANAKISKDAKETVQECVSEFISFITGEASDKCQREKRKTINGDDLLWAMTTLGFEDYVDPLKHYLHKFR

SEQ ID NO: 1184 - protein, 90 aa, Oryza sativa (japonica cultivar-group)
  G3398,CAAT domain
REQDRFLPIANVSRIMKRALPANAKISKDAKETVQECVSEFISFITGEASDKCQREKRKTINGDDLLWAMTTLGFEDYIDPLKLYLHKFR

SEQ ID NO: 1185 - protein, 9 aa, Oryza sativa (japonica cultivar-group)
  G3404,1st AT-hook domain
RRPRGRPAG

SEQ ID NO: 1186 - protein, 144 aa, Oryza sativa (japonica cultivar-group)
  G3404,2nd AT-hook domain
SKNKPKPPVIITRDSASALRAHVLEVASGCDLVDSVATFARRRQVGVCVLSATGAVTNVSVRQPGAGPGAVVNLTGRFDILSLSGSFLPPPAPPSATGLTVYVSGGQGQVVGGTVAGPLIAVGPVVIMAASFGNAAYERLPLED

SEQ ID NO: 1187 - protein, 9 aa, Oryza sativa (japonica cultivar-group)
  G3405,1st AT-hook domain
RRPRGRPAG

SEQ ID NO: 1188 - protein, 143 aa, Oryza sativa (japonica cultivar-group)
  G3405,2nd AT-hook domain
SKNKPKPPIIITRDSANTLRTHVMEVAGGCDISESITTFARRRQRGVCVLSGAGTVTNVTLRQPASQGAVVALHGRFEILSLSGSFLPPPAPPEATGLTVYLAGGQGQVVGGSVVGALTAAGPVVIMAASFANAVYERLPLED

SEQ ID NO: 1189 - protein, 9 aa, Oryza sativa (japonica cultivar-group)
  G3406,1st AT-hook domain
RRPRGRPPG

SEQ ID NO: 1190 - protein, 142 aa, Oryza sativa (japonica cultivar-group)
  G3406,2nd AT-hook domain
SKNKPKPPVIITRESANTLRAHILEVGSGCDVFECVSTYARRRQRGVCVLSGSGVVTNVTLRQPSAPAGAVVSLHGRFEILSLSGSFLPPPAPPGATSLTIFLAGGQGQVVGGNVVGALYAAGPVIVIAASFANVAYERLPL

SEQ ID NO: 1191 - protein, 9 aa, Oryza sativa (japonica cultivar-group)
  G3407,1st AT-hook domain
RRPRGRPPG

SEQ ID NO: 1192 - protein, 149 aa, Oryza sativa (japonica cultivar-group)
  G3407,2nd AT-hook domain
SKNKPKPPVIITRESANALRAHILEVAAGCDVFEALTAYARRRQRGVCVLSAAGTVANVTLRQPQSAQPGPASPAVATLHGRFEILSLAGSFLPPPAPPGATSLAAFLAGGQGQVVGGSVAGALIAAGPVVVVAASFSNVAYERLPLED

SEQ ID NO: 1193 - protein, 85 aa, Oryza sativa (japonica cultivar-group)
  G3429,CAAT domain
ELPMANLVRLIKKVLPGKAKIGGAAKGLTHDCAVEFVGFVGDEASEKAKAEHRRTVAPEDYLGSFGDLGFDRYVDPMDAYIHGYR

SEQ ID NO: 1194 - protein, 66 aa, Zea mays
  G3432,1st AP2 domain
SSRYKGVVPQPNGRWGAQIYERHQRVWLGTFAGEADAARAYDVAAQRFRGRDAVTNFRPLADADPD

SEQ ID NO: 1195 - protein, 88 aa, Zea mays
  G3432,2nd AP2 domain
LFDKTVTPSDVGKLNRLVIPKQHAEKHFPLQLPSAGGESKGVLLNLEDAAGKVWRFRYSYWNSSQSYVLTKGWSRFVKEKGLQAGDVV

SEQ ID NO: 1196 - protein, 72 aa, Zea mays
  G3433,1st AP2 domain
SSRYKGVVPQPNGRWGAQIYERHLRVWLGTFTGEAEAARAYDVAAQRFRGRDAVTNFRPLAESDLDPDAAAE

SEQ ID NO: 1197 - protein, 82 aa, Zea mays
  G3433,2nd AP2 domain
MFDKVLTPSDVGKLNRLVVPKQHAERFFPAAGAGSTQLCFQDRGGALWQFRYSYWGSSQSYVMTKGWSRFVRAARLAAGDTV

SEQ ID NO: 1198 - protein, 90 aa, Zea mays
  G3434,CAAT domain
REQDRFLPIANISRIMKKAVPANGKIAKDAKETLQECVSEFISFVTSEASDKCQKEKRKTINGDDLLWAMATLGFEEYVEPLKIYLQKYK

SEQ ID NO: 1199 - protein, 90 aa, Zea mays
  G3435,CAAT domain
REQDRFLPIANVSRIMKKALPANAKISKDAKETVQECVSEFISFITGEASDKCQREKRKTINGDDLLWAMTTLGFEDYVEPLKHYLHKFR

SEQ ID NO: 1200 - protein, 90 aa, Zea mays
  G3436,CAAT domain
REQDRFLPIANVSRIMKKALPANAKISKDAKETVQECVSEFISFITGEASDKCQREKRKTINGDDLLWAMTTLGFEDYVEPLKLYLHKFR

SEQ ID NO: 1201 - protein, 90 aa, Zea mays
  G3437,CAAT domain
KEQDRFLPIANVSRIMKRSLPANAKISKEAKETVQECVSEFISFVTGEASDKCQREKRKTINGDDLLWAMTTLGFEAYVAPLKSYLNRYR

SEQ ID NO: 1202 - protein, 62 aa, Glycine max
  G3451,1st AP2 domain
SSKYKGVVPQPNGRWGAQIYEKHQRVWLGTFNEEDEAARAYDIAAQRFRGKDAVTNFKPLAG

SEQ ID NO: 1203 - protein, 100 aa, Glycine max
  G3451,2nd AP2 domain
LFEKAVTPSDVGKLNRLVIPKQHAEKHFPLQSSNGVSATTIAAVTATPTAAKGVLLNFEDVGGKVWRFRYSYWNSSQSYVLTKGWSRFVKEKNLKAGDTV

SEQ ID NO: 1204 - protein, 66 aa, Glycine max
  G3452,1st AP2 domain
SSKYKGVVPQPNGRWGAQIYEKHQRVWLGTFNEEDEAARAYDIAALRFRGPDAVTNFKPPAASDDA

SEQ ID NO: 1205 - protein, 96 aa, Glycine max
  G3452,2nd AP2 domain
LFEKTVTPSDVGKLNRLVIPKQHAEKHFPLSGSGDESSPCVAGASAAKGMLLNFEDVGGKVWRFRYSYWNSSQSYVLTKGWSRFVKEKNLRAGDAV

SEQ ID NO: 1206 - protein, 66 aa, Glycine max
  G3453,1st AP2 domain
SSKYKGVVPQPNGRWGAQIYEKHQRVWLGTFNEEDEAVRAYDIVAHRFRGRDAVTNFKPLAGADDA

SEQ ID NO: 1207 - protein, 96 aa, Glycine max
  G3453,2nd AP2 domain
LVEKTVTPSDVGKLNRLVIPKQHAEKHFPLSGSGGGALPCMAAAAGAKGMLLNFEDVGGKVWRFRYSYWNSSQSYVLTKGWSRFVKEKNLRAGDAV

SEQ ID NO: 1208 - protein, 68 aa, Glycine max
  G3454,1st AP2 domain
SSKYKGVVPQPNGRWGSQIYEKHQRVWLGTFNEEDEAARAYDVAVQRFRGKDSVTNFKPLAGADDDDG

SEQ ID NO: 1209 - protein, 100 aa, Glycine max
  G3454,2nd AP2 domain
LFEKAVTPSDVWKLNRLVIPKQHAEKHFPLQSSNGVSATTIAAVTATPTAAKGVLLNFEDVGGKVWRFRYSYWNSSQSYVLTKGWSRFVKEKNLKAGDTV

SEQ ID NO: 1210 - protein, 70 aa, Glycine max
  G3455,1st AP2 domain
SSKYKGVVPQPNGRWGSQIYEKHQRVWLGTFNEEDEAARAYDVAVQRFRGKDAVTNFKPLSGTDDDDGES

SEQ ID NO: 1211 - protein, 100 aa, Glycine max
  G3455,2nd AP2 domain
REQLFQKAVTPSDVGKLNRLVIPKQHAEKHFPLQSAANGVSATATAAKGVLLNFEDVGGKVWRFRYSYWNSSQSYVLTKGWSRFVKEKNLKAGDTVCFQR

SEQ ID NO: 1212 - protein, 9 aa, Glycine max
  G3458,1st AT-hook domain
RRPRGRPPG

SEQ ID NO: 1213 - protein, 143 aa, Glycine max
  G3458,2nd AT-hook domain
SKNKPKPPVIITRESANTLRAHILEVSSGCDVFESVATYARKRQRGICVLSGSGTVTNVTLRQPAAAGAVVTLHGRFEILSLSGSFLPPPAPPGATSLTVFLGGGQGQVVGGNVVGPLVASGPVIVIASSFTNVAYERLPLDE

SEQ ID NO: 1214 - protein, 9 aa, Glycine max
  G3459,1st AT-hook domain
RRPRGRPPG

SEQ ID NO: 1215 - protein, 143 aa, Glycine max
  G3459,2nd AT-hook domain
SKNKPKPPVIITRESANTLRAHILEVGSGSDVFDCVTAYARRRQRGICVLSGSGTVTNVSLRQPAAAGAVVTLHGRFEILSLSGSFLPPPAPPGATSLTIYLAGGQGQVVGGNVIGELTAAGPVIVIAASFTNVAYERLPLEE

SEQ ID NO: 1216 - protein, 9 aa, Glycine max
  G3460,1st AT-hook domain
RRPRGRPSG

SEQ ID NO: 1217 - protein, 143 aa, Glycine max
  G3460,2nd AT-hook domain
SKNKPKPPVIITRESANTLRAHILEVGSGSDVFDCVTAYARRRQRGICVLSGSGTVTNVSLRQPAAAGAVVRLHGRFEILSLSGSFLPPPAPPGATSLTIYLAGGQGQVVGGNVVGELTAAGPVIVIAASFTNVAYERLPLEE

SEQ ID NO: 1218 - protein, 90 aa, Glycine max
  G3470,CAAT domain
REQDRYLPIANISRIMKKALPPNGKIAKDAKDTMQECVSEFISFITSEASEKCQKEKRKTINGDDLLWAMATLGFEDYIEPLKVYLARYR

SEQ ID NO: 1219 - protein, 90 aa, Glycine max; identical to SEQ ID NO: 1218
  G3471,CAAT domain

SEQ ID NO: 1220 - protein, 90 aa, Glycine max
  G3472,CAAT domain
REQDRFLPIANVSRIMKKALPANAKISKEAKETVQECVSEFISFITGEASDKCQKEKRKTINGDDLLWAMTTLGFEEYVEPLKVYLHKYR

SEQ ID NO: 1221 - protein, 91 aa, Glycine max
  G3473,CAAT domain
REQDRFLPIANVSRIMKKALPANAKISKDAKETVQECVSEFISFHSPGGLAGECQKEKRKTINGDDLLWAMTTLGFEEYVEPLKVYLHKYR

SEQ ID NO: 1222 - protein, 90 aa, Glycine max
  G3474,CAAT domain
REQDRFLPIANVSRIMKKALPANAKISKEAKETVQECVSEFISFITGEASDKCQKEKRKTINGDDLLWAMTTLGFEDYVDPLKIYLHKYR

SEQ ID NO: 1223 - protein, 90 aa, Glycine max
  G3475,CAAT domain
REQDRFLPIANVSRIMKKALPANAKISKDAKETVQECVSEFISFITGEASDKCQREKRKTINGDDLLWAMTTLGFEDYVEPLKGYLQRFR

SEQ ID NO: 1224 - protein, 90 aa, Glycine max
  G3476,CAAT domain
REQDRFLPIANVSRIMKKALPANAKISKDAKETVQECVSEFISFITGEASDKCQREKRKTINGDDLLWAMTTLGFEEYVEPLKIYLQRFR

SEQ ID NO: 1225 - protein, 90 aa, Glycine max; identical to SEQ ID NO: 1223
  G3478,CAAT domain

SEQ ID NO: 1226 - protein, 56 aa, Oryza sativa (japonica cultivar-group)
  G3479,MADS domain
GRGKIVIRRIDNSTSRQVTFSKRRNGIFKKAKELAILCDAEVGLVIFSSTGRLYEY

SEQ ID NO: 1227 - protein, 56 aa, Oryza sativa (japonica cultivar-group)
  G3480,MADS domain
GRGKIVIRRIDNSTSRQVTFSKRRNGIFKKAKELAILCDAEVGLMIFSSTGRLYEY

SEQ ID NO: 1228 - protein, 56 aa, Oryza sativa (japonica cultivar-group)
  G3481,MADS domain
GRGKIVIRRIDNSTSRQVTFSKRRNGLLKKAKELSILCDAEVGLVVFSSTGRLYEF

SEQ ID NO: 1229 - protein, 56 aa, Oryza sativa (japonica cultivar-group)
  G3482,MADS domain
RGKGCWSKGEEGQEEKIKIKERMEERKRCSVSRESSFCTSDTHAIGIFLAHFRTTQ

SEQ ID NO: 1230 - protein, 56 aa, Oryza sativa (japonica cultivar-group)
  G3483,MADS domain
GRGKIEIKRIDNATSRQVTFSKRRSGLFKKARELSILCDAEVGLLVFSSTSRLYDF

SEQ ID NO: 1231 - protein, 56 aa, Glycine max
  G3484,MADS domain
GRGKIAIRRIDNSTSRQVTFSKRRNGLLKKARELSILCDAEVGLMVFSSTGKLYDY

SEQ ID NO: 1232 - protein, 56 aa, Glycine max
  G3485,MADS domain
GRGKIVIRRIDNSTSRQVTFSKRRNGLLKKAKELAILCDAEVGVMIFSSTGKLYDF

SEQ ID NO: 1233 - protein, 56 aa, Zea mays
  G3487,MADS domain
GRGKIEIKRIDNATSRQVTFSKRRGGLFKKAKELAILCDAEVGLVVFSSTGRLYHF

SEQ ID NO: 1234 - protein, 56 aa, Zea mays
  G3488,MADS domain
GRGKIVIRRIDNSTSRQVTFSKRRNGIFKKARELAILCDAEVGLVIFSSTGRLYEY

SEQ ID NO: 1235 - protein, 56 aa, Zea mays; identical to SEQ ID NO: 1226
  G3489,MADS domain

SEQ ID NO: 1236 - protein, 61 aa, Zea mays
  G3490,HB domain
PHRAKKLRLSKEQSRLLEESFRLNHTLTPKQKEALAVKLKLRPRQVEVWFQNRRARTKLKQ

SEQ ID NO: 1237 - protein, 105 aa, Solanum lycopersicum
  G3500,MYB-(R1)R2R3 domain
KGPWTPEEDIMLVSYVQQHGPGNWRALPTKTGLRRCSKSCRLRWTNYLRPGIKRGNFTDQEEKMIIQLQALLGNKWAAIASYLPERTDNDIKNYWNTHLKKKMKR

SEQ ID NO: 1238 - protein, 105 aa, Solanum lycopersicum
  G3501,MYB-(R1)R2R3 domain
KGPWTPEEDIILVSYIQEHGPGNWRNIPTNTGLLRCSKSCRLRWTNYLRPGIKRGNFTEHEEKMIIHLQALLGNRWAAIASYLPQRTDNDIKNYWNTHLKKKLNN

SEQ ID NO: 1239 - protein, 106 aa, Oryza sativa (japonica cultivar-group)
  G3502,MYB-(R1)R2R3 domain
KGPWTPEEDLMLVAYVQEHGPGNWRAVPTNTGLMRCSKSCRLRWTNYLRPGIKRGNFTDQEEKLIVHLQALLGNRRWAAIASYLPERTDNDIKNYWNTHLKKKLKK

SEQ ID NO: 1240 - protein, 21 aa, Arabidopsis thaliana
  G351,1st Z-C2H2 domain
CGVCYKTFSSYQALGGHKASH

SEQ ID NO: 1241 - protein, 23 aa, Arabidopsis thaliana
  G351,2nd Z-C2H2 domain
HVCSVCGKSFATGQALGGHKRCH

SEQ ID NO: 1242 - protein, 61 aa, Oryza sativa (japonica cultivar-group)
  G3510,HB domain
PHRPKKLRLSKEQSRLLEESFRLNHTLTPKQKEALAIKLKLRPRQVEVWFQNRRARTKLKQ

SEQ ID NO: 1243 - protein, 65 aa, Oryza sativa (japonica cultivar-group)
  G3515,AP2 domain
SSSSYRGVRKRPWGKFAAEIRDPERGGARVWLGTFDTAEEAARAYDRAAFAMKGATAMLNFPGDH

SEQ ID NO: 1244 - protein, 65 aa, Zea mays
  G3516,AP2 domain
KEGKYRGVRKRPWGKFAAEIRDPERGGSRVWLGTFDTAEEAARAYDRAAFAMKGATAVLNFPASG

SEQ ID NO: 1245 - protein, 65 aa, Zea mays
  G3517,AP2 domain
EPTKYRGVRRRPWGKYAAEIRDSSRHGVRIWLGTFDTAEEAARAYDRSANSMRGANAVLNFPEDA

SEQ ID NO: 1246 - protein, 65 aa, Glycine max
  G3518,AP2 domain
VEVRYRGIRRRPWGKFAAEIRDPTRKGTRIWLGTFDTAEQAARAYDAAAFHFRGHRAILNFPNEY

SEQ ID NO: 1247 - protein, 65 aa, Glycine max
  G3519,AP2 domain
CEVRYRGIRRRPWGKFAAEIRDPTRKGTRIWLGTFDTAEQAARAYDAAAFHFRGHRAILNFPNEY

SEQ ID NO: 1248 - protein, 65 aa, Glycine max
  G3520,AP2 domain
EEPRYRGVRRRPWGKFAAEIRDPARHGARVWLGTFLTAEEAARAYDRAAYEMRGALAVLNFPNEY

SEQ ID NO: 1249 - protein, 61 aa, Glycine max
  G3524,HB domain
GEPPRKKLRLTKEQSRLLEESFRQNHTLNPKQKESLAMQLKLRPRQVEVWFQNRRARSKLK

SEQ ID NO: 1250 - protein, 105 aa, Glycine max
  G3537,MYB-(R1)R2R3 domain
KGPWTPEEDIILVSYIQEHGPGNWRAVPAKTGLSRCSKSCRLRWTNYLRPGIKRGNFTEQEEKMIIHLQDLLGNRWAAIASYLPQRTDNDIKNYWNTHLRKKLKK

SEQ ID NO: 1251 - protein, 105 aa, Glycine max
  G3538,MYB-(R1)R2R3 domain
KGPWTPEEDIILVSYIQEHGPGNWKAVPANTGLSRCSKSCRLRWTNYLRPGIKRGNFTDQEEKMIIHLQALLGNRWAAIAAYLPQRTDNDIKNYWNTYLKKKLNK

SEQ ID NO: 1252 - protein, 105 aa, Glycine max; identical to SEQ ID NO: 1250
  G3539,MYB-(R1)R2R3 domain

SEQ ID NO: 1253 - protein, 105 aa, Zea mays
  G3540,MYB-(R1)R2R3 domain
KGPWTPEEDLMLVSYVQEHGPGNWRAVPTNTGLMRCSKSCRLRWTNYLRPGIKRGNFTEQEEKLIVHLQALLGNRWAAIASYLPKRTDNDIKNYWNTHLKKKLKN

SEQ ID NO: 1254 - protein, 105 aa, Zea mays
  G3541,MYB-(R1)R2R3 domain
KGPWTPEEDIVLVSYVQEHGPGNWRAVPVSTGLMRCSKSCRLRWTNYLRPGIRRGNFTPHEEGIIVHLQALLGNRWAAIASYLPQRTDNDIKNYWNTHLKKKLRK

SEQ ID NO: 1255 - protein, 66 aa, Glycine max
  G3643,AP2 domain
TNNKLKGVRRRKWGKWVSEIRVPGTQERLWLGTYATPEAAAVAHDVAVYCLSRPSSLDKLNFPETL

SEQ ID NO: 1256 - protein, 71 aa, Oryza sativa (japonica cultivar-group)
  G3644,AP2 domain
ERCRYRGVRRRRWGKWVSEIRVPGTRERLWLGSYATPEAAAVAHDTAVYFLRGGAGDGGGGGATLNFPERA

SEQ ID NO: 1257 - protein, 66 aa, Brassica rapa subsp. Pekinensis
  G3645,AP2 domain
TQSKYKGIRRRKWGKWVSEIRVPGTRDRLWLGSFSTAEGAAVAHDVAFYCLHQPNSLESLNFPHLL

SEQ ID NO: 1258 - protein, 68 aa, Brassica oleracea
  G3646,AP2 domain
HQAKYKGIRRRKWGKWVSEIRVPATRERLWLGSFSTAEGAAVAHDVAFYCLHRPSSLDNEAFNFPHLL

SEQ ID NO: 1259 - protein, 66 aa, Zinnia elegans
  G3647,AP2 domain
SQKTYKGVRCRRWGKWVSEIRVPGSRERLWLGTYSTPEGAAVAHDVASYCLKGNTSFHKLNIPSML

SEQ ID NO: 1260 - protein, 73 aa, Oryza sativa (japonica cultivar-group)
  G3649,AP2 domain
EMMRYRGVRRRRWGKWVSEIRVPGTRERLWLGSYATAEAAAVAHDAAVCLLRLGGGRRAAAGGGGGLNFPARA

SEQ ID NO: 1261 - protein, 65 aa, Zea mays
  G3650,AP2 domain
RRCRYRGVRRRAWGKWVSEIRVPGTRERLWLGSYAAPEAAAVAHDAAACLLRGCAGRRLNFPGRA

SEQ ID NO: 1262 - protein, 71 aa, Oryza sativa (japonica cultivar-group)
  G3651,AP2 domain
ERCRYRGVRRRRWGKWVSEIRVPGTRERLWLGSYATPEAAAVAHDTAVYFLRGGAGDGGGGGATAQLPGAR

SEQ ID NO: 1263 - protein, 64 aa, Zea mays
  G3656,AP2 domain
RRQYRGVRMRKWGKWVAEIREPHKRTRPRLRSYATAVAAARAYDTAVFYLPGPSARLNFPEEIP

SEQ ID NO: 1264 - protein, 56 aa, Zea mays
  G3680,1st ZF-HB domain
PLYRECLKNHAASLGGHAVDGCGEFMPSPGANPADPTSLKCAACGCHRNFHRRTLE

SEQ ID NO: 1265 - protein, 64 aa, Zea mays
  G3680,2nd ZF-HB domain
RKRFRTKFTAEQKQRMQELSERLGWRLQKRDEAIVDEWCRDIGVGKGVFKVWMHNNKHNFLGGH

SEQ ID NO: 1266 - protein, 56 aa, Zea mays
  G3681,1st ZF-HB domain
PLYRECLKNHAASLGGHAVDGCGEFMPSPGANPADPTSLKCAACGCHRNFHRRTVE

SEQ ID NO: 1267 - protein, 64 aa, Zea mays
  G3681,2nd ZF-HB domain
RKRFRTKFTAEQKQRMQELSERLGWRLQKRDEAVVDEWCRDMGVGKGVFKVWMHNNKHNFLGGH

SEQ ID NO: 1268 - protein, 56 aa, Oryza sativa (japonica cultivar-group)
  G3691,1st ZF-HB domain
TVYRECLKNHAASLGGHALDGCGEFMPSPAANPADPTSLRCAACGCHRNFHRRLPE

SEQ ID NO: 1269 - protein, 64 aa, Oryza sativa (japonica cultivar-group)
  G3691,2nd ZF-HB domain
RKRFRTKFTAEQKQRMQELSERLGWRLQKRDEAIVDEWCRDIGVGKGVFKVWMHNNKHNYLGGH

SEQ ID NO: 1270 - protein, 57 aa, Zea mays
  G3719,WRKY domain
DDGFKWRKYGKKTVKSSPNPRNYYRCSAEGCGVKKRVERDSDDPRYVVTTYDGVHNH

SEQ ID NO: 1271 - protein, 57 aa, Zea mays
  G3720,WRKY domain
DDGYKWRKYGKKSVKNSPNPRNYYRCSTEGCNVKKRVERDKDDPSYVVTTYEGMHNH

SEQ ID NO: 1272 - protein, 57 aa, Oryza sativa (japonica cultivar-group)
  G3721,WRKY domain
DDGFKWRKYGKKAVKNSPNPRNYYRCSTEGCNVKKRVERDREDHRYVITTYDGVHNH

SEQ ID NO: 1273 - protein, 57 aa, Zea mays
  G3722,WRKY domain
DDGYKWRKYGKKSVKNSPNPRNYYRCSTEGCNVKKRVERDRDDPRYVVTMYEGVHNH

SEQ ID NO: 1274 - protein, 57 aa, Glycine max
  G3723,WRKY domain
DDGYKWRKYGKKTVKSSPNPRNYYKCSGEGCDVKKRVERDRDDSNYVLTTYDGVHNH

SEQ ID NO: 1275 - protein, 57 aa, Glycine max
  G3724,WRKY domain
DDGYKWRKYGKKSVKSSPNLRNYYKCSSGGCSVKKRVERDRDDYSYVITTYEGVHNH

SEQ ID NO: 1276 - protein, 57 aa, Oryza sativa (japonica cultivar-group)
  G3725,WRKY domain
DDGYKWRKYGKKSVKNSPNPRNYYRCSTEGCNVKKRVERDKNDPRYVVTMYEGIHNH

SEQ ID NO: 1277 - protein, 57 aa, Oryza sativa (japonica cultivar-group)
  G3726,WRKY domain
DDGYKWRKYGKKSVKNSPNPRNYYRCSTEGCNVKKRVERDKDDPSYVVTTYEGTHNH

SEQ ID NO: 1278 - protein, 57 aa, Zea mays
  G3727,WRKY domain
DDGFKWRKYGKKAVKSSPNPRNYYRCSSEGCGVKKRVERDRDDPRYVITTYDGVHNH

SEQ ID NO: 1279 - protein, 57 aa, Zea mays
  G3728,WRKY domain
DDGFKWRKYGKKAVKNSPNPRNYYRCSSEGCGVKKRVERDRDDPRYVITTYDGVHNH

SEQ ID NO: 1280 - protein, 57 aa, Oryza sativa (japonica cultivar-group)
  G3729,WRKY domain
DDGYRWRKYGKKMVKNSPNPRNYYRCSSEGCRVKKRVERARDDARFVVTTYDGVHNH

SEQ ID NO: 1281 - protein, 57 aa, Oryza sativa (japonica cultivar-group)
  G3730,WRKY domain
DDGFKWRKYGKKAVKSSPNPRNYYRCSAAGCGVKKRVERDGDDPRYVVTTYDGVHNH

SEQ ID NO: 1282 - protein, 57 aa, Solanum lycopersicum
  G3731,WRKY domain
DDGFKCRKYGKKMVKNNPNPRNYYKCSSGGCNVKKRVERDNKDSSYVITTYEGIHNH

SEQ ID NO: 1283 - protein, 57 aa, Solanum tuberosum
  G3732,WRKY domain
DDGFKWRKYGKKMVKNSSNPRNYYKCSSGGCNVKKRVERDNEDSSYVITTYEGIHNH

SEQ ID NO: 1284 - protein, 57 aa, Hordeum vulgare
  G3733,WRKY domain
DDGYKWRKYGKKSVKNSPNPRNYYRCSTEGCSVKKRVERDRDDPAYVVTTYEGTHSH

SEQ ID NO: 1285 - protein, 65 aa, Medicago truncatula
  G3735,AP2 domain
DQIKYRGIRRRPWGKFAAEIRDPTRKGTRIWLGTFDTAEQAARAYDAAAFHFRGHRAILNFPNEY

SEQ ID NO: 1286 - protein, 65 aa, Triticum aestivum
  G3736,AP2 domain
EPTKYRGVRRRPWGKFAAEIRDSSRHGVRMWLGTFDTAEEAAAAYDRSAYSMRGRNAVLNFPDRA

SEQ ID NO: 1287 - protein, 65 aa, Oryza sativa (japonica cultivar-group)
  G3737,AP2 domain
AASKYRGVRRRPWGKFAAEIRDPERGGSRVWLGTFDTAEEAARAYDRAAFAMKGAMAVLNFPGRT

SEQ ID NO: 1288 - protein, 65 aa, Zea mays
  G3739,AP2 domain
EPTKYRGVRRRPWGKYAAEIRDSSRHGVRIWLGTFDTAEEAARAYDRSAYSMRGANAVLNFPEDA

SEQ ID NO: 1289 - protein, 65 aa, Zea mays
  G3794,AP2 domain
EPTKYRGVRRRPSGKFAAEIRDSSRQSVRMWLGTFDTAEEAARAYDRAAYAMRGQIAVLNFPAEA

SEQ ID NO: 1290 - protein, 57 aa, Capsicum annuum
  G3795,WRKY domain
DDGYKWRKYGKKMVKNSPNPRNYYRCSVEGCPVKKRVERDKEDSRYVITTYEGVHNH

SEQ ID NO: 1291 - protein, 57 aa, Lactuca sativa
  G3797,WRKY domain
DDGFKWRKYGKKMVKNSPNPRNYYRCSAAGCSVKKRVERDVEDARYVITTYEGIHNH

SEQ ID NO: 1292 - protein, 57 aa, Sorghum bicolor; identical to SEQ ID NO: 1279
  G3802,WRKY domain

SEQ ID NO: 1293 - protein, 57 aa, Glycine max
  G3803,WRKY domain
DDGYKWRKYGKKTVKNNPNPRNYYKCSGEGCNVKKRVERDRDDSNYVLTTYDGVHNH

SEQ ID NO: 1294 - protein, 57 aa, Zea mays; identical to SEQ ID NO: 1279
  G3804,WRKY domain

SEQ ID NO: 1295 - protein, 212 aa, Oryza sativa (japonica cultivar-group)
  G3809,NAC domain
PPGFRFHPTDEELLLHYLGKRAAAAPCPAPVIAEVDIYKYNPWELPAMAVFGESDGEWYFFSPRDRKYPNGVRPNRAAGSGYWKATGTDKPISISETQQTVLLGVKKALVFYRGRPPKGTKTSWIMHEYRLANAAASSSSSYTSNMKQLASSSSSSSSSASMRVRTCYGASANYIYIYPLPYTPSTDRYIYMRNYIHARTQLDEWVLCRIYK

SEQ ID NO: 1296 - protein, 65 aa, Solanum lycopersicum
  G3849,AP2 domain
KKKNYRGVRRRPWGKFAAEIRDPSRKGSRIWLGTFDTDIDAARAYDCAAFKMRGRKAILNFPLDA

SEQ ID NO: 1297 - protein, 56 aa, Flaveria trinervia
  G3859,1st ZF-HB domain
VAYKQCLKNHAVGIGCHAVDGCGEFMPAPTYNPSQPSSFKCAACGCHRNFHRREPT

SEQ ID NO: 1298 - protein, 64 aa, Flaveria trinervia
  G3859,2nd ZF-HB domain
RKRFRTKFSQDQKEKMLTFAEKVGWKLQRCDDKMVADFCSEIGIRRRVLKVWMHNNKNTSAKKE

SEQ ID NO: 1299 - protein, 56 aa, Flaveria bidentis
  G3860,1st ZF-HB domain
VSYRECLKNHAAAMGGHAVDGCGEFMPSPSSSPTDPTSLKCAACGCHRNFHRRDPD

SEQ ID NO: 1300 - protein, 64 aa, Flaveria bidentis
  G3860,2nd ZF-HB domain
KKRFRTKFTQDQKEKMHELAERVGWKMQKKDEDLIIGFCNEIGVDKGVFKVWMHNNKMTFGGKK

SEQ ID NO: 1301 - protein, 31 aa, Flaveria bidentis
  G3861,1st ZF-HB domain
MPSPAATPADPTSIKCAACGCHRNFHRREPD

SEQ ID NO: 1302 - protein, 64 aa, Flaveria bidentis
  G3861,2nd ZF-HB domain
KKRFRTKFTQDQKQKMHELAERVGWKMQKKDEDLIINFCNEIGVDKGVFKVWMHNNKMTSAGKK

SEQ ID NO: 1303 - protein, 97 aa, Zea mays
  G3866,CAAT domain
REQDRFLPIANISRIMKKAIPANGKTIPANGKIAKDAKETVQECVSEFISFITSEASDKCQREKRKTINGDDLLWAMATLGFEDYIEPLKVYLQKYR

SEQ ID NO: 1304 - protein, 96 aa, Physcomitrella patens
  G3868,CAAT domain
EQDRFLPIANVSRIMKKALPSNAKISKDAKETVQECVSEFISFITGEASDKCQREKRKTINGDDLLWAMSTLGFEDYVEPLKVYLHKYRELEGEKA

SEQ ID NO: 1305 - protein, 95 aa, Physcomitrella patens
  G3870,CAAT domain
REQDRFLPIANVSRIMKKALPSNAKISKDAKETVQECVSEFISFITGEASDKCQREKRKTINGDDLLWAMSTLGFEDYVEPLKVYLHKYRELEGE

SEQ ID NO: 1306 - protein, 90 aa, Glycine max
  G3873,CAAT domain
REQDRFLPIANISRIMKKALPPNGKIAKDAKETVQECVSEFISFVTSEASDKCQREKRKTINGDDLLWAMTTLGFEEYIDPLKVYLAAYR

SEQ ID NO: 1307 - protein, 90 aa, Glycine max
  G3874,CAAT domain
REQDRYLPIANISRIMKKALPANGKIAKDAKETVQECVSEFISFITSEASDKCQREKRKTINGDDLLWAMATLGFEDYMDPLKIYLTRYR

SEQ ID NO: 1308 - protein, 90 aa, Glycine max
  G3875,CAAT domain
REQDRYLPIANISRIMKKALPANGKIAKDAKETVQECVSEFISFITSEASDKCQREKRKTINGDDLLWAMATLGFEDYIDPLKIYLTRYR

SEQ ID NO: 1309 - protein, 90 aa, Zea mays
  G3876,CAAT domain
REQDRFLPIANISRIMKKAIPANGKIAKDAKETVQECVSEFISFITSEASDKCQREKRKTINGDDLLWAMATLGFEDYIEPLKVYLQKYR

SEQ ID NO: 1310 - protein, 62 aa, Zea mays
  G3929,AP2 domain
KEGKYRGVRKRPWGKFAAEIRDPERGGSRVWLGTFDTAEEAARAYDRAAFTMKGATAVLNFP

SEQ ID NO: 1311 - protein, 56 aa, Glycine max
  G3934,1st ZF-HB domain
VVYKECLKNHVASLGGHALDGCGEFMPSPAATADDPSSIKCAACGCHRNFHRREPE

SEQ ID NO: 1312 - protein, 64 aa, Glycine max
  G3934,2nd ZF-HB domain
RKRFRTKFTQEQKEKMHEFADKVGWKMQRRDEEMVMEFCNEIGVDRGVLKVWMHNNKNTFAKKD

SEQ ID NO: 1313 - protein, 96 aa, Oryza sativa (japonica cultivar-group)
  G3938,CAAT domain
EQDRFLPIANVSRIMKRSLPANAKISKESKETVQECVSEFISFVTGEASDKCQREKRKTINGDDLLWAMTTLGFEAYVGPLKSYLNRYREAEGEKA

SEQ ID NO: 1314 - protein, 56 aa, Glycine max; identical to SEQ ID NO: 1232
  G3980,MADS domain

SEQ ID NO: 1315 - protein, 56 aa, Glycine max; identical to SEQ ID NO: 1232
  G3981,MADS domain

SEQ ID NO: 1316 - protein, 56 aa, Antirrhinum majus
  G3982,MADS domain
GRGKIVIQRIDKSTSRQVTFSKRRSGLLKKAKELAILCDAEVGVVIFSSTGKLYEF

SEQ ID NO: 1317 - protein, 61 aa, Arabidopsis thaliana
  G399,HB domain
ETSRKKLRLSKDQSAFLEETFKEHNTLNPKQKLALAKKLNLTARQVEVWFQNRRARTKLKQ

SEQ ID NO: 1318 - protein, 56 aa, Solanum lycopersicum
  G4061,MADS domain
VRGKVEMKRIENSTSRQVTFSKRRNGLTKKAYELSVLCDAEVAFIIFSHKGRLYEF

SEQ ID NO: 1319 - protein, 56 aa, Brassica rapa
  G4062,MADS domain
VRGKTQMKRIENATSRQVTFSKRRNGLLKKAFELSVLCDAEVSLIIFSPKAKLYEF

SEQ ID NO: 1320 - protein, 56 aa, Glycine max
  G4063,MADS domain
VRGKTQLRRIENATSRQVTFSKRRNGLLKKAFELSVLCDAEVALIIFSPRGKLYEF

SEQ ID NO: 1321 - protein, 56 aa, Glycine max
  G4064,MADS domain
VRGKTQMRRIENATSRQVTFSKRRNGLLKKAFELSVLCDAEVALIIFSPRGKLYEF

SEQ ID NO: 1322 - protein, 56 aa, Zea mays
  G4065,MADS domain
VRGKTQMKRIENPTSRQVTFSKRRNGLLKKAFELSVLCDAEVALVVFSPRGKLYEF

SEQ ID NO: 1323 - protein, 56 aa, Oryza sativa (japonica cultivar-group)
  G4066,MADS domain
VRGKTQMKRIENPTSRQVTFSKRRNGLLKKAFELSVLCDAEVALIVFSPRGKLYEF

SEQ ID NO: 1324 - protein, 56 aa, Oryza sativa (japonica cultivar-group)
  G4067,MADS domain
VRGRTELKRIENPTSRQVTFSKRRNGLLKKAFELSVLCDAEVALIVFSPRGRLYEF

SEQ ID NO: 1325 - protein, 63 aa, Solanum lycopersicum
  G4079,AP2 domain
RKKFRGVRQRPWGRWAAEIRDPTRGKRVWLGTYDTPEEAAVVYDKAAVKLKGPDAVTNFPVST

SEQ ID NO: 1326 - protein, 63 aa, Nicotiana tabacum
  G4080,AP2 domain
RKKFRGVRQRPWGRWAAEIRDPTRGKRVWLGTYDTPEEAAIVYDAAAVKLKGPDAVTNFPKVL

SEQ ID NO: 1327 - protein, 49 aa, Zea mays
  G4240,GARP domain
WTPQLHKRFVDVVAHLGMKNAVPKTIMQLMNVEGLTRENVASHLQKYRL

SEQ ID NO: 1328 - protein, 49 aa, Oryza sativa (japonica cultivar-group)
  G4241,GARP domain
WTPQLHKRFVEVVAHLGMKNAVPKTIMQLMNVEGLTRENVASHLQKYRL

SEQ ID NO: 1329 - protein, 49 aa, Glycine max; identical to SEQ ID NO: 1055
  G4243,GARP domain

SEQ ID NO: 1330 - protein, 49 aa, Glycine max; identical to SEQ ID NO: 1055
  G4244,GARP domain

SEQ ID NO: 1331 - protein, 49 aa, Solanum lycopersicum
  G4245,GARP domain
WTPQLHKRFIEVVAHLGIKGAVPKTIMQLMNVEGLTRENVAGHLQKYRL

SEQ ID NO: 1332 - protein, 97 aa, Zea mays
  G4272,CAAT domain
REQDRFLPIANVSRIMKKALPANAKISKDAKETVQECVSEFISFITGEASDKCQREKRKTINGDDLLWAMTTLGFEDYVEPLKHYLHKFREIEGERA

SEQ ID NO: 1333 - protein, 90 aa, Zea mays
  G4276,CAAT domain
REQDMFLPITNITRIMKKAVPANAKITKDAKEIMQYCVSEFIFFVTSEAREKSKKEERKRINVDDLLWSVDTAGFEYVELLRICLQKYRE

SEQ ID NO: 1334 - protein, 64 aa, Arabidopsis thaliana
  G428,HB domain
SKKKKKGKLPREARQALLDWWNVHNKWPYPTEGDKIALAEETGLDQKQINNWFINQRKRHWKPS

SEQ ID NO: 1335 - protein, 63 aa, Zea mays
  G4283,AP2 domain
STKFRGVRRRPWGKFAAEIRDPWRGVRVWLGTFDTAEEAARVYDTAAVQLRGANATTNFAASA

SEQ ID NO: 1336 - protein, 63 aa, Zea mays
  G4284,AP2 domain
AVRFRGVRRRPWGRWAAEIRDPHNRRRLWLGTFDTAEEAANAYDAANIRFRGVSATTNFPAAR

SEQ ID NO: 1337 - protein, 63 aa, Glycine max
  G4285,AP2 domain
RNKFRGVRQRPWGRWAAEIRDPTRRKRLWLGTFDTAEEAATEYDRAAVKLKGPNAVTNFPLAP

SEQ ID NO: 1338 - protein, 63 aa, Glycine max
  G4286,AP2 domain
RSKFRGVRQRPWGRWTAEIRDPNQRKRVWLGTFDTAEEAAAVYDDAALKLKGPNAVTNFPLSA

SEQ ID NO: 1339 - protein, 63 aa, Glycine max
  G4287,AP2 domain
GKKFRGVRQRPWGKWAAEIRDPARRVRLWLGTYDTAEEAAMVYDNAAIRLRGPDALTNFVTPP

SEQ ID NO: 1340 - protein, 63 aa, Oryza sativa (japonica cultivar-group)
  G4288,AP2 domain
EPRFRGVRRRPWGKYAAEIRDPWRRVRVWLGTFDTAEEAAKVYDTAAIQLRGRDATTNFNQSG

SEQ ID NO: 1341 - protein, 63 aa, Oryza sativa (japonica cultivar-group)
  G4289,AP2 domain
ERKFRGVRKRPWGKYGAEIRVSQQSARVWLGTFDTAEEAARVYDHAALRLRGPSATTNFPMTP

SEQ ID NO: 1342 - protein, 63 aa, Oryza sativa (japonica cultivar-group)
  G4290,AP2 domain
STKFRGVRRSPWGKFAAEIRDPWRGVRVWLGTFDTAEAAARVYDNAAIQLRGPSATTNFSAST

SEQ ID NO: 1343 - protein, 63 aa, Oryza sativa (japonica cultivar-group)
  G4291,AP2 domain
TARFRGVRQRPWGRFAAEIRDPHLRRRLWLGTFDTAEEAAAAYDAASVRLRGSSAATNFASVR

SEQ ID NO: 1344 - protein, 63 aa, Oryza sativa (japonica cultivar-group)
  G4292,AP2 domain
SRRFRGVRRRPWGRFSAEIRDPSLQKRLWLGTFDTAEEAAAVYDDAALRIKGSHAVTNFPSDS

SEQ ID NO: 1345 - protein, 64 aa, Oryza sativa (japonica cultivar-group)
  G4293,AP2 domain
ERRFTGVRRRPWGRWAAEIRDPKENGRRVWLGTFDTAEAAAAAYDDACLRLRGPGAALNLPSRR

SEQ ID NO: 1346 - protein, 68 aa, Oryza sativa (japonica cultivar-group)
  G4294,AP2 domain
KKKFRGVRQRHWGSWVSEIRHPLLKRRVWLGTFETAEEAARAYDEAAILMSGRNAKTNFPVARNATGE

SEQ ID NO: 1347 - protein, 69 aa, Arabidopsis thaliana
  G43,AP2 domain
TRHYRGVRRRPWGKFAAEIRDPAKKGSRIWLGTFESDIDAARAYDYAAFKLRGRKAVLNFPLDAGKYDA

SEQ ID NO: 1348 - protein, 65 aa, Solanum tuberosum
  G4328,AP2 domain
DLIKYRGVRKRTWGKFAAEIRDPTRQGARQWLGTFDTAEDAARAYDKAAFNLRGHLATLNFPNEY

SEQ ID NO: 1349 - protein, 65 aa, Petunia x hybrida
  G4329,AP2 domain
GEIKYRGVRRRPWGKFAAEIRDSARQGARVWLGTYNTAEEAARAYDRAAYSMRGHLAILNFPEEY

SEQ ID NO: 1350 - protein, 65 aa, Populus trichocarpa x Populus nigra
  G4330,AP2 domain
GENAYRGIRRRPWGKFAAEIRDPTKNGARRWLGTYDTAEEAARAYDRAAFAFRGHLAILNFPNEY

SEQ ID NO: 1351 - protein, 61 aa, Glycine max
  G4371,HB domain
PPRKKLRLTKEQSLLLEESFRQNHTLNPKQKESLAMQLKLRPRQVEVWFQNRRARSKLKQT

SEQ ID NO: 1352 - protein, 63 aa, Arabidopsis thaliana
  G440,AP2 domain
IKKFRGVRQRPWGKWAAEIRDPEQRRRIWLGTFETAEEAAVVYDNAAIRLRGPDALTNFSIPP

SEQ ID NO: 1353 - protein, 9 aa, Arabidopsis thaliana
  G450,1st IAA domain
TELCLGLPG

SEQ ID NO: 1354 - protein, 12 aa, Arabidopsis thaliana
  G450,2nd IAA domain
VGWPPVRNYRKN

SEQ ID NO: 1355 - protein, 17 aa, Arabidopsis thaliana
  G450,3rd IAA domain
FVKVSMDGAPYLRKVDL

SEQ ID NO: 1356 - protein, 38 aa, Arabidopsis thaliana
  G450,4th IAA domain
YEDKDGDWMLVGDVPWPMFVESCKRLRIMKGSEAIGLA

SEQ ID NO: 1357 - protein, 9 aa, Arabidopsis thaliana
  G455,1st IAA domain
TELCLGLPG

SEQ ID NO: 1358 - protein, 12 aa, Arabidopsis thaliana
  G455,2nd IAA domain
VGWPPVRNYRKN

SEQ ID NO: 1359 - protein, 17 aa, Arabidopsis thaliana
  G455,3rd IAA domain
LVKVSMDGAPYLRKVDL

SEQ ID NO: 1360 - protein, 34 aa, Arabidopsis thaliana
  G455,4th IAA domain
YEDKDGDWMLVGDVPWEMFVESCKRLRIMKGSEA

SEQ ID NO: 1361 - protein, 8 aa, Arabidopsis thaliana
  G456,1st IAA domain
TELRLGLP

SEQ ID NO: 1362 - protein, 11 aa, Arabidopsis thaliana
  G456,2nd IAA domain
VVGWPPVRSFR

SEQ ID NO: 1363 - protein, 34 aa, Arabidopsis thaliana
  G456,3rd IAA domain
YVKVSMDGAPYLRKIDLKLYKTYQDLSNALSKMF

SEQ ID NO: 1364 - protein, 37 aa, Arabidopsis thaliana
  G456,4th IAA domain
VPTYEDKDGDWMLVGDVPWEMFVDSCKRIRIMKGSEA

SEQ ID NO: 1365 - protein, 69 aa, Arabidopsis thaliana
  G46,AP2 domain
ARHYRGVRRRPWGKFAAEIRDPAKKGSRIWLGTFESDVDAARAYDCAAFKLRGRKAVLNFPLDAGKYEA

SEQ ID NO: 1366 - protein, 13 aa, Oryza sativa (japonica cultivar-group)
  G4627,1st bZIP domain
ESDEEIRRVPEMG

SEQ ID NO: 1367 - protein, 80 aa, Oryza sativa (japonica cultivar-group)
  G4627,2nd bZIP domain
RKRGRSAGDKEQNRLKRLLRNRVSAQQARERKKAYMTELEAKAKDLELRNAELEQRVSTLQNENNTLRQILKNTTAHAGK

SEQ ID NO: 1368 - protein, 13 aa, Oryza sativa (japonica cultivar-group)
  G4630,1st bZIP domain
ESDEEIGRVPELG

SEQ ID NO: 1369 - protein, 80 aa, Oryza sativa (japonica cultivar-group)
  G4630,2nd bZIP domain
RRRGRSPADKEHKRLKRLLRNRVSAQQARERKKAYLNDLEVKVKDLEKKNSELEERFSTLQNENQMLRQILKNTTVSRRG

SEQ ID NO: 1370 - protein, 13 aa, Glycine max
  G4631,1st bZIP domain
ESDEEIRRVPEIG

SEQ ID NO: 1371 - protein, 80 aa, Glycine max
  G4631,2nd bZIP domain
KKRGRSPADKESKRLKRLLRNRVSAQQARERKKAYLIDLETRVKDLEKKNSELKERLSTLQNENQMLRQILKNTTASRRG

SEQ ID NO: 1372 - protein, 13 aa, Zea mays
  G4632,1st bZIP domain
ESDEEIRRVPELG

SEQ ID NO: 1373 - protein, 80 aa, Zea mays
  G4632,2nd bZIP domain
RRRVRSPADKEHKRLKRLLRNRVSAQQARERKKAYLTDLEVKVKDLEKKNSEMEERLSTLQNENQMLRQILKNTTVSRRG

SEQ ID NO: 1374 - protein, 90 aa, Arabidopsis thaliana
  G482,CAAT domain
REQDRFLPIANVSRIMKKALPANAKISKDAKETMQECVSEFISFVTGEASDKCQKEKRKTINGDDLLWAMTTLGFEDYVEPLKVYLQRFR

SEQ ID NO: 1375 - protein, 90 aa, Arabidopsis thaliana
  G485,CAAT domain
REQDRFLPIANVSRIMKKALPANAKISKDAKETVQECVSEFISFITGEASDKCQREKRKTINGDDLLWAMTTLGFEDYVEPLKVYLQKYR

SEQ ID NO: 1376 - protein, 146 aa, Arabidopsis thaliana
  G502,NAC domain
GFRFHPTDEELVMHYLCRKCASQSIAVPIIAEIDLYKYDPWELPGLALYGEKEWYFFSPRDRKYPNGSRPNRSAGSGYWKATGADKPIGLPKPVGIKKALVFYAGKAPKGEKTNWIMHEYRLADVDRSVRKKKNSLRLDDWVLCRI

SEQ ID NO: 1377 - protein, 150 aa, Arabidopsis thaliana
  G506,NAC domain
PGFRFHPTDEELIGYYLSRKIEGLEIELEVIPVIDLYKFDPWELPGKSFLPNRDLEWFFFCPRDKKYANGSRTNRATKAGYWKATGKDRKITCKSSHVIAGYRKTLVFYEGRAPLGDRTNWFMHEYRLCDIDDHSQKSPNFKGAFALCRV

SEQ ID NO: 1378 - protein, 144 aa, Arabidopsis thaliana
  G515,NAC domain
GLRFCPTDEEIVVDYLWPKNSDRDTSHVDRFINTVPVCRLDPWELPCQSRIKLKDVAWCFFRPKENKYGRGDQQMRKTKSGFWKSTGRPKPIMRNRQQIGEKKILMFYTSKESKSDWVIHEYHGFSHNQMMMTYTLCKVMFNGG

SEQ ID NO: 1379 - protein, 15 aa, Oryza sativa (japonica cultivar-group)
  G5158,1st bZIP domain
DSDDEEIVGRVPEFG

SEQ ID NO: 1380 - protein, 80 aa, Oryza sativa (japonica cultivar-group)
  G5158,2nd bZIP domain
RRRGRSPADKEHRRLKRLLRNRVSAQQARERKKAYMSELEARVKDLERSNSELEERLSTLQNENQMLRQVLKNTTANRRG

SEQ ID NO: 1381 - protein, 32 aa, Oryza sativa (japonica cultivar-group)
  G5159,1st Z-CO-like domain
KVQCDVCAAEAASVFCCADEAALCDACDRRVH

SEQ ID NO: 1382 - protein, 43 aa, Oryza sativa (japonica cultivar-group)
  G5159,2nd Z-CO-like domain
CDICQEKRGFLFCKEDRAILCRECDVTVHTTSELTRRHGRFLL

SEQ ID NO: 1383 - protein, 136 aa, Arabidopsis thaliana
  G516,NAC domain
GFRFRPTDGEIVDIYLRPKNLESNTSHVDEVISTVDICSFDPWDLPSHSRMKTRDQVWYFFGRKENKYGKGDRQIRKTKSGFWKKTGVTMDIMRKTGDREKIGEKRVLVFKNHGGSKSDWAMHEYHATFSSPNQGE

SEQ ID NO: 1384 - protein, 122 aa, Arabidopsis thaliana
  G519,NAC domain
GFRFHPTDEELVKFYLCRRCASEPINVPVIAEIDLYKFNPWELPEMALYGEKEWYFFSHRDRKYPNGSRPNRAAGTGYWKATGADKPIGKPKTLGIKKALVFYAGKAPKGIKTNWIMHEYRL

SEQ ID NO: 1385 - protein, 21 aa, Arabidopsis thaliana
  G545,1st Z-C2H2 domain
CSVCDKTFSSYQALGGHKASH

SEQ ID NO: 1386 - protein, 19 aa, Arabidopsis thaliana
  G545,2nd Z-C2H2 domain
HVCTICNKSFPSGQALGGH

SEQ ID NO: 1387 - protein, 61 aa, Arabidopsis thaliana
  G554,bZIP domain
PDKIQRRLAQNREAARKSRLRKKAYVQQLETSRLKLIQLEQELDRARQQGFYVGNGIDTNS

SEQ ID NO: 1388 - protein, 73 aa, Arabidopsis thaliana
  G555,bZIP domain
RSKSKMDQKTLRRLAQNREAARKSRLRKKAYVQQLENSRLKLTQLEQELQRARQQGVFISSSGDQAHSTAGDG

SEQ ID NO: 1389 - protein, 61 aa, Arabidopsis thaliana
  G556,bZIP domain
RRLAQNREAARKSRLRKKAYVQQLETSRLKLIHLEQELDRARQQGFYVGNGVDTNALSFSD

SEQ ID NO: 1390 - protein, 13 aa, Arabidopsis thaliana
  G557,1st bZIP domain
ESDEEIRRVPEFG

SEQ ID NO: 1391 - protein, 80 aa, Arabidopsis thaliana
  G557,2nd bZIP domain
RKRGRTPAEKENKRLKRLLRNRVSAQQARERKKAYLSELENRVKDLENKNSELEERLSTLQNENQMLRHILKNTTGNKRG

SEQ ID NO: 1392 - protein, 61 aa, Arabidopsis thaliana
  G558,bZIP domain
QKTLRRLAQNREAARKSRLRKKAYVQQLENSRLKLTQLEQELQRARQQGVFISGTGDQAHS

SEQ ID NO: 1393 - protein, 34 aa, Arabidopsis thaliana
  G576,1st BZIPT2 domain
MGCSTSKLDDLPAVALCRDRCSFLEAAIHQRYAL

SEQ ID NO: 1394 - protein, 111 aa, Arabidopsis thaliana
  G576,2nd BZIPT2 domain
NLSSTLHKLHLWEKKLYDEVKAEEKMRVNHEKKLRKLKRMDERGAENQKVDSTRKLVRSLSTKIRIAIQVVDKISVTINKIRDEELWLQLNELIQGLSKMWKSMLECHKSQ

SEQ ID NO: 1395 - protein, 61 aa, Arabidopsis thaliana
  G578,bZIP domain
KLDQKTLRRLAQNREAARKSRLRKKAYVQQLEDSRLKLTQVEQELQRARQQGVFISSSGDQ

SEQ ID NO: 1396 - protein, 68 aa, Arabidopsis thaliana
  G6,AP2 domain
EIRYRGVRKRPWGRYAAEIRDPGKKTRVWLGTFDTAEEAARAYDTAARDFRGAKAKTNFPTFLELSDQ

SEQ ID NO: 1397 - protein, 12 aa, Arabidopsis thaliana
  G605,AT-hook domain
KYQVENLGEWSP

SEQ ID NO: 1398 - protein, 57 aa, Arabidopsis thaliana
  G627,MADS domain
MVRGKTEMKRIENATSRQVTFSKRRNGLLKKAFELSVLCDAEVALVIFSPRSKLYEF

SEQ ID NO: 1399 - protein, 61 aa, Arabidopsis thaliana
  G629,bZIP domain
DKMKRRLAQNREAARKSRLRKKAYVQQLEESRLKLSQLEQELEKVKQQGHLGPSGSINTGI

SEQ ID NO: 1400 - protein, 71 aa, Arabidopsis thaliana
  G631,bZIP domain
KRAKRIWANRQSAARSKERKMRYIAELERKVQTLQTEATSLSAQLTLLQRDTNGLGVENNELKLRVQTMEQ

SEQ ID NO: 1401 - protein, 29 aa, Arabidopsis thaliana
  G648,Z-Dof domain
CPRCNSTNTKFCYYNNYSLTQPRYFCKGC

SEQ ID NO: 1402 - protein, 103 aa, Arabidopsis thaliana
  G666,MYB-(R1)R2R3 domain
KGPWTPEEDIILVTYIQEHGPGNWRAVPTNTGLLRCSKSCRLRWTNYLRPGIKRGNFTEHEEKMIVHLQALLGNRWAAIASYLPQRTDNDIKNYWNTHLKKKL

SEQ ID NO: 1403 - protein, 49 aa, Arabidopsis thaliana
  G730,GARP domain
WTTTLHAHFVHAVQLLGGHERATPKSVLELMDVQDLTLAHVKSHLQMYR

SEQ ID NO: 1404 - protein, 151 aa, Arabidopsis thaliana
  G767,NAC domain
LQFPPGFRFHPTDEELVLMYLCRKCASQPIPAPIITELDLYRYDPWDLPDMALYGEKEWYFFSPRDRKYPNGSRPNRAAGTGYWKATGADKPIGRPKPVGIKKALVFYSGKPPNGEKTNWIMHEYRLADVDRSVRKKNSLRLDDWVLCRIY

SEQ ID NO: 1405 - protein, 57 aa, Arabidopsis thaliana
  G859,MADS domain
MGRKKVEIKRIENKSSRQVTFSKRRNGLIEKARQLSILCESSIAVLVVSGSGKLYKS

SEQ ID NO: 1406 - protein, 63 aa, Arabidopsis thaliana
  G864,AP2 domain
EKKFRGVRQRPWGKWAAEIRDPLKRVRLWLGTYNTAEEAAMVYDNAAIQLRGPDALTNFSVTP

SEQ ID NO: 1407 - protein, 66 aa, Arabidopsis thaliana
  G867,1st AP2 domain
SSKYKGVVPQPNGRWGAQIYEKHQRVWLGTFNEEDEAARAYDVAVHRFRRRDAVTNFKDVKMDEDE

SEQ ID NO: 1408 - protein, 93 aa, Arabidopsis thaliana
  G867,2nd AP2 domain
AEALFEKAVTPSDVGKLNRLVIPKHHAEKHFPLPSSNVSVKGVLLNFEDVNGKVWRFRYSYWNSSQSYVLTKGWSRFVKEKNLRAGDVVSFSR

SEQ ID NO: 1409 - protein, 66 aa, Arabidopsis thaliana
  G9,1st AP2 domain
SSKYKGVVPQPNGRWGAQIYEKHQRVWLGTFNEQEEAARSYDIAACRFRGRDAVVNFKNVLEDGDL

SEQ ID NO: 1410 - protein, 94 aa, Arabidopsis thaliana
  G9,2nd AP2 domain
REVLFEKAVTPSDVGKLNRLVIPKQHAEKHFPLPSPSPAVTKGVLINFEDVNGKVWRFRYSYWNSSQSYVLTKGWSRFVKEKNLRAGDVVTFER

SEQ ID NO: 1411 - protein, 25 aa, Arabidopsis thaliana
  G903,Z-C2H2 domain
CEVCGKGFQRDQNLQLHRRGHNLPW

SEQ ID NO: 1412 - protein, 105 aa, Arabidopsis thaliana
  G932,MYB-(R1)R2R3 domain
KGPWTPEEDIILVSYIQEHGPGNWRSVPTHTGLRRCSKSCRLRWTNYLRPGIKRGNFTEHEEKMILHLQALLGNRWAAIASYLPERTDNDIKNYWNTHLKKKLKK

SEQ ID NO: 1413 - protein, 9 aa, Arabidopsis thaliana
  G938,EIL domain
AQDGILKYM

SEQ ID NO: 1414 - protein, 9 aa, Arabidopsis thaliana
  G941,EIL domain
AQDGILKYM

SEQ ID NO: 1415 - protein, 144 aa, Arabidopsis thaliana
  G960,NAC domain
FRFRPTDEELVNHYLRLKINGRHSDVRVIPDIDVCKWEPWDLPALSVIKTDDPEWFFFCPRDRKYPNGHRSNRATDSGYWKATGKDRSIKSKKTLIGMKKTLVFYRGRAPKGERTNWIMHEYRPTLKDLDGTSPGQSPYVLCRL

SEQ ID NO: 1416 - protein, 61 aa, Arabidopsis thaliana; identical to SEQ ID NO: 1317
  G964,HB domain

SEQ ID NO: 1417 - protein, 67 aa, Arabidopsis thaliana
  G976,AP2 domain
NPVYRGIRCRSGKWVSEIREPKKTTRVWLGTYPTPEMAAAAYDVAALALKGGDTLLNFPDSLGSYPI

SEQ ID NO: 1418 - protein, 66 aa, Arabidopsis thaliana
  G993,1st AP2 domain
SSKYKGVVPQPNGRWGAQIYEKHQRVWLGTFNEEEEAASSYDIAVRRFRGRDAVTNFKSQVDGNDA

SEQ ID NO: 1419 - protein, 100 aa, Arabidopsis thaliana
  G993,2nd AP2 domain
REVLFEKTVTPSDVGKLNRLVIPKQHAEKHFPLPAMTTAMGMNPSPTKGVLINLEDRTGKVWRFRYSYWNSSQSYVLTKGWSRFVKEKNLRAGDVVCFER

SEQ ID NO: 1420 - protein, 51 aa, Arabidopsis thaliana
  G997,MYB-related domain
SSWTAREDKQFEMALAKFDKDTPDRWQKIARAVGGKSTEEVKRHYELLLRD

SEQ ID NO: 1421 - DNA, 686 bp, Artificial Sequence
  P3367 (opLexA::G975, G975 is from Arabidopsis thaliana)
attactcatcatcaagttcctactttctctctgacaaacatcacagagtaagtaagaatggtacagacgaagaagttcagaggtgtcaggcaacgccattggggttcttgggtcgctgagattcgtcatcctctcttgaaacggaggatttggctagggacgttcgagaccgcagaggaggcagcaagagcatacgacgaggccgccgttttaatgagcggccgcaacgccaaaaccaactttcccctcaacaacaacaacaccggagaaacttccgagggcaaaaccgatatttcagcttcgtccacaatgtcatcctcaacatcatcttcatcgctctcttccatcctcagcgccaaactgaggaaatgctgcaagtctccttccccatccctcacctgcctccgtcttgacacagccagctcccatatcggcgtctggcagaaacgggccggttcaaagtctgactccagctgggtcatgacggtggagctaggtcccgcaagctcctcccaagagactactagtaaagcttcacaagacgctattcttgctccgaccactgaagttgaaattggtggcagcagagaagaagtattggatgaggaagaaaaggttgctttgcaaatgatagaggagcttctcaatacaaactaaatcttatttgcttatatatatgtacctat

SEQ ID NO: 1422 - DNA, 719 bp, Artificial Sequence
  P3368 (opLexA::G1047, G1047 is from Arabidopsis thaliana)
cattagaaggagcaattttaaaccggtcattatgatgtctactgtaccggcctttacctttactgaaccgggtttggttaaccaattatcggatttccagaccggattcactccttgggaattgaactgctccgatctcttctctacaatccatctcgaaccggtcgtaccgagtccttgttctggtgaatccgatgccggttctgtcaaaattaacaccgattttaacggttttgacgaatcgtgtatcggttccatcaaaactaactccggttctgatgattccaaccttttccacggcgtaccgagtcctcaatccgacgaattggactcaaaaaacacgaaaatccgaagtaacgccacgaatcataaccggaacaaattgaaccggtcggttttgcaggtgactgacgaccgtaaacgcaaacggatggaatcaaaccgagaatcagcgaagcggtcgaggatgcgtaaacaaagacacattgataatttaaaagacgaagcaaatcgtctcggtttagaaaaccgggaactcgcaaaccggcttcgaattgttttgtacaacatcgcattaatgtgtacggacaacaatcagcttttgtcggaacaagagattctcagacggagattcttggagatgaggcagattttgattttcagacagcttcagctgaatccatcattgatcatcaatcatcatcatatgatttgaaagg

SEQ ID NO: 1423 - DNA, 1012 bp, Artificial Sequence
  P3371 (opLexA::G1760, G1760 is from Arabidopsis thaliana)
ccctaaaaaagagaagaaccagaggagattcaattagaggataaaattgatgggaagagggaagattgtgatccaaaggatcgatgattcaacgagtagacaagtcactttctccaaacgaagaaagggccttatcaagaaagccaaagagctagctattctctgtgatgccgaggtcggtctcatcatcttctctagcaccggaaagctctatgactttgcaagctccagcatgaagtcggttattgatagatacaacaagagcaagatcgagcaacaacaactattgaaccccgcatcagaagtcaagttttggcagagagaagctgctgttctaagacaagaactgcatgctttgcaagaaaatcatcggcaaatgatgggagaacagctaaatggtttaagtgttaacgagctaaacagtcttgagaatcaaattgagataagtttgcgtggaattcgtatgagaaaggaacaactgttgactcaagaaatccaagaactaagccaaaagaggaatcttattcatcaggaaaacctcgatttatctaggaaagtacaacggattcatcaagaaaatgtggagctctacaagaaggcttatatggcaaacacaaacgggtttacacaccgtgaagtagctgttgcggatgatgaatcacacactcagattcggctgcaactaagccagcctgaacattccgattatgacactccaccaagagcaaacgaataacagagagattgaagttggaagataccatgatgttgaagaacactccaaaggccttggtttgaataaggttcttgaactggaaacctctatacaccaagccacgtacgataagcagcatggttcttctaacatagtcatattttcaatcctaaatataattaaagcatatataattaaaatccggtgttgttatactcatcttgagtattaatattgtacttgtttataaccatagattcgtcaattaatagagaaaaatcatatgaattattatcc

SEQ ID NO: 1424 - DNA, 1160 bp, Artificial Sequence
  P3373 (opLexA::G1930, G1930 is from Arabidopsis thaliana)
attcacattactaatctctcaagatttcacaattttcttgtgattttctctcagtttcttatttcgtttcataacatggatgccatgagtagcgtagacgagagctctacaactacagattccattccggcgagaaagtcatcgtctccggcgagtttactatatagaatgggaagcggaacaagcgtggtacttgattcagagaacggtgtcgaagtcgaagtcgaagccgaatcaagaaagcttccttcttcaagattcaaaggtgttgttcctcaaccaaatggaagatggggagctcagatttacgagaaacatcaacgcgtgtggcttggtactttcaacgaggaagacgaagcagctcgtgcttacgacgtcgcggctcaccgtttccgtggccgcgatgccgttactaatttcaaagacacgacgttcgaagaagaggttgagttcttaaacgcgcattcgaaatcagagatcgtagatatgttgagaaaacacacttacaaagaagagttagaccaaaggaaacgtaaccgtgacggtaacggaaaagagacgacggcgtttgctttggcttcgatggtggttatgacggggtttaaaacggcggagttactgtttgagaaaacggtaacgccaagtgacgtcgggaaactaaaccgtttagttataccaaaacaccaagcggagaaacattttccgttaccgttaggtaataataacgtctccgttaaaggtatgctgttgaatttcgaagacgttaacgggaaagtgtggaggttccgttactcttattggaatagtagtcaaagttatgtgttgaccaaaggttggagtagattcgttaaagagaagagactttgtgctggtgatttgatcagttttaaaagatccaacgatcaagatcaaaaattctttatcgggtggaaatcgaaatccgggttggatctagagacgggtcgggttatgagattgtttggggttgatatttctttaaacgccgtcgttgtagtgaaggaaacaacggaggtgttaatgtcgtcgttaaggtgtaagaagcaacgagttttgtaataacaatttaacaacttgggaaagaaaaaaaagctttttgattttaatttctcttcaacgttaatcttgctgagattatttat

SEQ ID NO: 1425 - DNA, 505 bp, Artificial Sequence
  P3375 (opLexA::G3, G3 is from Arabidopsis thaliana)
gtttgtcttttatcaatggaaagagaacaagaagagtctacgatgagaaagagaaggcagccacctcaagaagaagtgcctaaccacgtggctacaaggaagccgtacagagggatacggaggaggaagtggggcaagtgggtggctgagattcgtgagcctaacaaacgctcacggctttggcttggctcttacacaaccgatatcgccgccgctagagcctacgacgtggccgtcttctacctccgtggcccctccgcacgtctcaacttccctgatcttctcttgcaagaagaggaccatctctcagccgccaccaccgctgacatgcccgcagctcttataagggaaaaagcggcggaggtcggcgccagagtcgacgctcttctagcttctgccgctccttcgatggctcactccactccgccggtaataaaacccgacttgaatcaaatacccgaatccggagatatatagtcaatttatatacatgtagtttgttttg

SEQ ID NO: 1426 - DNA, 1311 bp, Artificial Sequence; identical to SEQ ID NO: 119
  P3410 (opLexA::G1137, G1137 is from Arabidopsis thaliana)

SEQ ID NO: 1427 - DNA, 1190 bp, Artificial Sequence
  P3411 (opLexA::G1228, G1228 is from Arabidopsis thaliana)
gcatttataattactcactcatcttcttttcattacattacataccaaacaagagctctcaaatggaaaggtttcaaggacacatcaacccctgtttcttcgatcgaaaaccggatgtgagaagcctcgaggttcaaggatttgcagaggctcaaagctttgctttcaaagaaaaagaggaagaaagcttacaagatacagttccatttctacagatgctgcaaagtgaagacccctcatcgtttttttcaatcaaagagccaaactttctgacgctactgtctcttcaaaccctcaaggagccttgggaactcgaaagatatctttcacttgaggattcacaatttcattcaccggtccaatctgagaccaaccgcttcatggaaggagccaatcaagctgtgtcaagccaagaaattccctttagccaagcaaacatgacactcccttcttctacctcatcaccactcagtgcacattcaagacgaaagcgcaaaatcaaccacttgctgcctcaagaaatgactagagaaaagagaaagaggaggaaaacaaaaccaagtaaaaacaatgaagagattgagaatcaaagaataaaccacattgctgttgaacgaaacagaagacgtcaaatgaacgaacatatcaactctctccgggcccttctcccaccttcctacatccaacgaggagaccaagcttccatagtaggaggagcaataaactacgtgaaggtcctcgagcaaatcatacaatctctcgaatcgcaaaagagaacgcaacaacaaagtaacagtgaggtagtagaaaacgcacttaatcatctctcaggcatttcgtcgaacgacctgtggacaactcttgaagatcaaacttgtatccccaaaatcgaagctacagtgatacaaaaccatgtcagccttaaagttcaatgtgagaagaaacaaggacaacttctcaaaggaatcatatcacttgaaaagcttaaactcactgttcttcatctcaatatcactacttcgtctcattcctctgtttcttattccttcaacctcaagatggaagatgagtgcgacttagagtcagccgacgagattacggcggctgttcatcggattttcgatattccgacaatttgattaaacacatataattccaaaaatattaacagctgacaaaatggtatcttt

SEQ ID NO: 1428 - DNA, 748 bp, Artificial Sequence; identical to SEQ ID NO: 133
  P3412 (opLexA::G1275, G1275 is from Arabidopsis thaliana)

SEQ ID NO: 1429 - DNA, 876 bp, Artificial Sequence
  P3417 (opLexA::G1326, G1326 is from Arabidopsis thaliana)
ggtacggtggagatagagatagcatccatggagatgtctagaggaagcaacagttttgacaataagaagcctagttgccaaagaggtcactggagacctgttgaagatgacaatctccggcaactcgttgaacaatacggtcccaagaactggaattttattgctcaacatctctatggaagatcagggaaaagctgtagattaagatggtacaaccaacttgatccaaacatcaccaagaaacccttcaccgaggaggaagaagagagactgcttaaagctcatcggatccaagggaatcgttgggcctccatagcccgactgttccccgggaggaccgacaacgctgtcaaaaaccattttcatgtcatcatggctagacgcaaacgggaaaacttctcttccacagctacttctacgttcaaccaaacttggcatactgttttgagccctagttctagtcttacaaggctaaatagatcccatttcgggctatggaggtatcgaaaggataagagttgcggtctctggccttactcttttgtttcaccacctacgaatggtcaatttggatcttcatctgtctctaacgtacaccacgaaatttatcttgagaggagaaagtcgaaagagttggtggatcctcagaattacacatttcatgcagccacaccagatcataagatgacttcaaatgaagatggaccatccatgggagatgatggtgagaagaacgatgttactttcattgattttcttggtgttggattagcttcttaggttataacatcacaagtcaaagcttttaagggtttctatcattagggttaggcatcattttcagccttttgcttccttaaactctcatatggatct

SEQ ID NO: 1430 - DNA, 1008 bp, Artificial Sequence
  P3424 (opLexA::G1543, G1543 is from Arabidopsis thaliana)
ggttgatgagataccaaacgcatcttaatattttctccttaatttactttggttatgtctttctatgataaaactactatttacgtacatatgcacatacacatataaactatatgctctatatcatatggattacgcatgcgtgtgtatgtataaatataaaggcatcgtcacgcttcaagtttgtctcttttatattaaactgagagttttcctctcaaactttaccttttcttcttcgatcctagctcttaagaaccctaataattcattgatcaaaataatggcgattttgccggaaaactcttcaaacttggatcttactatctccgttccaggcttctcttcatcccctctctccgatgaaggaagtggcggaggaagagaccagctaaggctagacatgaatcggttaccgtcgtctgaagacggagacgatgaagaattcagtcacgatgatggctctgctcctccgcgaaagaaactccgtctaaccagagaacagtcacgtcttcttgaagatagtttcagacagaatcatacccttaatcccaaacaaaaggaagtacttgccaagcatttgatgctacggccaagacaaattgaagtttggtttcaaaaccgtagagcaaggagcaaattgaagcaaaccgagatggaatgcgagtatctcaaaaggtggtttggttcattaacggaagaaaaccacaggctccatagagaagtagaagagcttagagccataaaggttggcccaacaacggtgaactctgcctcgagccttactatgtgtcctcgctgcgagcgagttacccctgccgcgagcccttcgagggcggtggtgccggttccggctaagaaaacgtttccgccgcaagagcgtgatcgttgatttgtgtatcttaattatttgagtatggtttagaagtcaacgaaggtctgctattgagcctacaaaatattaacgatcacatgatttcgtgtaaatactaagagactctgttccgc

SEQ ID NO: 1431 - DNA, 1247 bp, Artificial Sequence
  P3574 (opLexA::G668, G668 is from Arabidopsis thaliana)
ccaacatctctcctccacttcttcagacaaaaccaaacccatttggactttctttgtcttaaccctaagatttccaaaggttttccaacaaacccgcaacgattagcttttgttctaatatctcatcaaaaccctttcaaaaggtgaaaacagaatgggaagaccaccttgctgtgaaaagattggagtgaagaaagggccatggacaccagaggaagacatcatcttggtttcttacatccaagaacatggtcctggaaactggagatctgtcccaacacacacaggtttaagatgtagcaagagctgcagattgagatggactaattatcttcgacccggtattaagcgtggaaattttactgagcatgaagagaagacaattgttcatcttcaagcccttttaggcaacagatgggcagccatagcatcataccttccagaaaggacagacaatgatataaagaactattggaacactcacttgaagaagaagctcaaaaagattaatgaatctggtgaagaagataatgatggtgtctcttcatcaaacactagttcacaaaagaaccatcaaagcactaacaaaggtcaatgggaaagaagacttcagacagacattaacatggcaaaacaagctctttgtgaggccttgtctttagacaaaccatcatccactctttcatcatcttcatcattaccgacaccagtaatcacacaacaaaacatccgtaacttctcatcagctttgcttgaccgttgttatgatccatcctcttcttcttcatctaccacaaccaccactacaagcaacactactaatccatacccatcaggggtatatgcgtcaagtgctgagaacatcgcccggttgcttcaagatttcatgaaagacacacccaaggctttaactttatcatcttcatctccggtttcagagactggaccactcactgctgcagtctcggaagaaggtggagaagggtttgaacaatctttcttcagcttcaattcaatggacgaaactcaaaacttgactcaggagacaagcttcttccatgatcaagtgatcaaaccggaaataacaatggaccaagatcatggtctaatatcacaagggtctctgtctttgtttgagaaatggttatttgatgagcaaagccacgagatggttggtatggcactagcaggacaagaagggatgttctagttctagaagactgtctagaactaacaaagtgggatct

SEQ ID NO: 1432 - DNA, 1773 bp, Artificial Sequence
  P3585 (opLexA::G559, G559 is from Arabidopsis thaliana)
caataatcgtttgcagggtcgttgatttggtgataagtcagtagaaatggataaggagaaatctccagcacctccttgtggaggtcttcctcctccatctccatcaggtcgatgctctgcattctcagaagctggtcccattggtcatggttcagatgctaatcgaatgagtcatgatattagccgtatgcttgataacccacctaagaagattggacatcggcgagctcattctgaaatacttactctccctgatgatttgagctttgatagtgatcttggtgtggttggtaatgctgctgatggagcttctttctctgatgagactgaagaagatttgctctctatgtatcttgatatggataagtttaattcttctgctacatcttctgcccaagttggtgagccatcaggaactgcttggaaaaatgagacaatgatgcagacaggcacaggctcaacttccaatcctcagaatacggttaatagtcttggcgaaaggccaagaatcaggcatcaacatagccaatctatggatggttcaatgaatatcaatgagatgcttatgtcgggaaatgaagatgattctgctattgatgctaagaagtctatgtctgctactaaacttgctgagcttgctctcattgatcctaaacgtgctaagaggtaattggttttcgtttttcttctgtgattctctggtttcttaaatcctgtttatagtgtggatggacacggtgactatttgtgtgcttttggtttgaaccttaatgccaccagtcatttagttgcttcagctgttcccacataacttcagctttttaatgagtggagcaagtgtataatttgtttttgtttcatacaataggatatgggcaaacaggcagtccgcagcacgatcaaaagaaaggaagacgagatacatatttgagcttgagagaaaagtacagactttgcaaacagaggctacaactctctcagcccagttgaccctcttacaggttagttttgactcattgtacggttgttctttcttcatgctaaatgaaactaaatctagccttacaacgtttgttcgtgcattgtgattttttatgggttgaaaacttgtgctcttttcttcctgtttgtatagagagacacaaatggcttgactgttgaaaacaatgagctgaagctgcggttacaaacaatggagcagcaggttcacttgcaggatggtgagtctctcttttatcacaaacaatatccctctgtgccaagactgctatagttggttcatatcatcgaattgaatcttctctattaacagaactaaacgaagcactaaaggaggaaatccagcatctgaaggtgttgactggccaagttgctccatcagcgttgaactatgggtcgtttggatcaaaccagcagcaattctattccaacaatcagtcaatgcaaacaatcttagctgcaaaacagttccagcaacttcagattcattcacagaagcagcaacaacaacaacaacaacaacaacagcaacaccaacagcagcagcagcaacagcaacagtatcagtttcaacagcaacagatgcaacagcttatgcagcagcggcttcaacagcaagaacaacaaaatggagtaagactcaagccttcacaagcccagaaagagaactgaggaatatgaatatgtcccacgtaagtgagaggttctccttctgaacaattcctttctcattcataaattgttgttcatccatcacttgcagtctcttggatg

SEQ ID NO: 1433 - DNA, 768 bp, Artificial Sequence
  P3598 (opLexA::G913, G913 is from Arabidopsis thaliana)
aaaacacattgtaacattagtttaagcattaagcttctttatgtcgaataataataattctccgaccaccgtgaatcaagaaacgacgacgtctcgtgaagtctcaatcacattgcctactgatcaatctcctcaaacctcaccaggatcatcttcttctccttcaccgagaccttccggtggatcaccggcgagaagaacggcgactggattatccggcaagcactctattttcagggggattcgactacgtaacggaaaatgggtatcggagattagagagccacgtaaaacgacaagaatttggctcgggacttatccggtaccggagatggctgccgccgcttacgacgtggctgcgttagctttaaaaggacccgacgccgttttgaattttcctggtttagctttgacttacgtggctccggtttcaaactctgctgcggatataagagcggctgctagtagagcagcggagatgaagcaaccggatcagggtggggatgagaaggtattggaaccggttcaacccggcaaagaggaagaattagaagaagtgtcgtgtaactcgtgttcgttggagtttatggatgaggaagcgatgttgaatatgccgactttgttgacggagatggctgaagggatgttgatgagtccaccgagaatgatgatacatccgacgatggaagatgattcgccggagaatcatgaaggagataatctttggagttataaatgaatccattgaagctgctctcttttttattg

SEQ ID NO: 1434 - DNA, 668 bp, Artificial Sequence; identical to SEQ ID NO: 207
  P3603 (opLexA::G1836, G1836 is from Arabidopsis thaliana)

SEQ ID NO: 1435 - DNA, 1300 bp, Artificial Sequence
  P3606 (opLexA::G1635, G1635 is from Arabidopsis thaliana)
tcaagtctagattcgcgaatttatcttggtgtttccttttctgtgttccacacctttcgagtttttttttgttttcctccgccgagatcttaatccgggaagttatggcgtcgtctccgttgactgcaaatgttcagggtaccaacgcttctttgaggaatagagatgaagaaactgcagacaagcagatacaattcaatgaccaaagttttgggggaaatgactatgcacccaaggtacggaagccatacacgataacaaaagagagagagagatggacagatgaagagcacaagaagtttgttgaagccttgaaattatacgggcgagcttggagacgaatagaagaacatgtgggctcaaagaccgcagttcagattcgaagccatgctcagaagtttttctctaaggttgctcgagaagcaactggaggtgatgggagctcagtagagccgattgtaatacctcctcctcgtcccaagagaaagccagcgcatccgtaccctcgtaagtttgggaacgaggcagatcaaacaagtagatcggtttctccctcagaacgtgatactcaatctccaacctctgtgttgtccactgttggatcagaagcattgtgttcccttgattcgagttcacccaatcgaagcttgtccccagtttcttctgcatcaccaccagctgctcttacaaccactgcaaatgcacctgaagagcttgagactctgaagctggagttgtttcctagtgagagactcttaaacagggagagctcgatcaaggaaccaacgaagcaaagtcttaaactctttgggaagacagttttggtatctgattcaggcatgtcctcttctctaacaacttcaacatattgtaaatccccaattcagccattaccacggaaactctcatcatccaagacactacccataataagaaactcacaagaagaactcttgagctgctggatacaagtccctcttaagcaagaagatgtggaaaatagatgtttggattcaggaaaggctgtccaaaacgaaggatcatcgactggatcaaacactggttcggtggatgatacgggacacacggaaaagaccacagaacccgaaacaatgctatgtcaatgggagtttaaaccaagtgagaggtctgcattttctgagctcagaagaacaaactccgagtcaaattcaagaggatttggtccatacaagaagagaaagatggtaacagaagaagaagagcatgagattcatctccacttataacacattttcttacgtaccctaaagaagagact

SEQ ID NO: 1436 - DNA, 763 bp, Artificial Sequence
  P3623 (opLexA::G779, G779 is from Arabidopsis thaliana)
atgcatgtaagcattcggttaattaatcgagtcaaagatatatatcagtaaatacatatgtgtatatttctggaaaaagaatatatatattgagaaataagaaaagatgaaaatggaaaatggtatgtataaaaagaaaggagtgtgcgactcttgtgtctcgtccaaaagcagatccaaccacagccccaaaagaagcatgatggagcctcagcctcaccatctcctcatggattggaacaaagctaatgatcttctcacacaagaacacgcagcttttctcaatgatcctcaccatctcatgttagatccacctcccgaaaccctaattcacttggacgaagacgaagagtacgatgaagacatggatgcgatgaaggagatgcagtacatgatcgccgtcatgcagcccgtagacatcgaccctgccacggtccctaagccgaaccgccgtaacgtaaggataagcgacgatcctcagacggtggttgctcgtcggcgtcgggaaaggatcagcgagaagatccgaattctcaagaggatcgtgcctggtggtgcgaagatggacacagcttccatgctcgacgaagccatacgttacaccaagttcttgaaacggcaggtgaggattcttcagcctcactctcagattggagctcctatggctaacccctcttacctttgttattaccacaactcccaaccctgatgaactacacagaagctcgctagctagacatttggtgtcatcctctcaaccttt

SEQ ID NO: 1437 - DNA, 624 bp, Artificial Sequence
  P3630 (opLexA::G977, G977 is from Arabidopsis thaliana)
caccaaactcacctgaaaccctatttccatttaccattcacactaatggcacgaccacaacaacgctttcgaggcgttagacagaggcattggggctcttgggtctccgaaattcgtcaccctctcttgaaaacaagaatctggctagggacgtttgagacagcggaggatgcagcaagggcctacgacgaggcggctaggctaatgtgtggcccgagagctcgtactaatttcccatacaaccctaatgccattcctacttcctcttccaagcttctatcagcaactcttaccgctaaactccacaaatgctacatggcttctcttcaaatgaccaagcaaacgcaaacacaaacgcaaacgcagaccgcaagatcacaatccgcggacagtgacggtgtgacggctaacgaaagtcatttgaacagaggagtaacggagacgacagagatcaagtgggaagatggaaatgcgaatatgcaacagaattttaggccattggaggaagatcatatcgagcaaatgattgaggagctgcttcactacggttccattgagctttgctctgttttaccaactcagacgctgtgagaaatggccttgtcgttttagcgtattcttttc

SEQ ID NO: 1438 - DNA, 1149 bp, Artificial Sequence
  P3631 (opLexA::G1421, G1421 is from Arabidopsis thaliana)
ctccttctttagtgtcctccttcaccaaactcttgattccataagcatatattaaaaaagctctctgctttcttcaactttcccgggaaaatcttcttgttacaaagcatcaatctcttgttttaccaattttctctctttattccttttttgccctttacttttcctaactttggtctttatatataaacacacgacacaaagaagaacacacataagttaaaactattacaacagttttaaagagagagatttaaaaaatggagacagagaagaaagtttctctcccaagaatcttacgaatctctgttactgatccttacgcaacagattcgtcaagcgacgaagaagaagaagttgattttgatgcattatctacaaaacgacgtcgtgttaagaagtacgtgaaggaagtggtgcttgattcggtggtttctgataaagagaagccgatgaagaagaagagaaagaagcgcgttgttactgttccagtggttgttacgacggcgacgaggaagtttcgtggagtgaggcaaagaccgtggggaaaatgggcggcggagattagagatccgagtagacgtgttagggtttggttaggtacttttgacacggcggaggaagctgccattgtttacgataacgcagctattcagctacgtggtcctaacgcagagcttaacttccctcctcctccggtgacggagaatgttgaagaagcttcgacggaggtgaaaggagtttcggattttatcattggcggtggagaatgtcttcgttcgccggtttctgttctcgaatctccgttctccggcgagtctactgcggttaaagaggagtttgtcggtgtatcgacggcggagattgtggttaaaaaggagccgtcttttaacggttcagatttctcggcgccgttgttctcggacgacgacgtttttggtttctcgacgtcgatgagtgaaagtttcggcggcgatttatttggagataatctttttgcggatatgagttttggatccgggtttggattcgggtctgggtctggattctccagctggcacgttgaggaccattttcaagatattggggatttattcgggtcggatcctgtcttaactgtttaagaaataactggccgtttaacggcgt

SEQ ID NO: 1439 - DNA, 1289 bp, Artificial Sequence
  P3634 (opLexA::G1070, G1070 is from Arabidopsis thaliana)
cagcttggatttcgttgttcatcattactactctctttcttcttctagctagctagttttgacagcaaaataagaagcaaaaaaaaggtcaactaaaaaagatctgttcttagatcactctcttcttctttttttgatccaattccaccattgaatcatagatcatggatccagtacaatctcatggatcacaaagctctctacctcctcctttccacgcaagagactttcaattacatcttcaacaacagcaacaagagttcttcctccaccatcaccagcaacaaagaaaccaaaccgatggtgaccaacaaggaggatcaggaggaaaccgacaaatcaagatggatcgtgaagagacaagcgacaacatagacaacatagctaacaacagcggtagtgaaggtaaagacatagatatacacggtggttcaggagaaggaggtggtggctccggaggagatcatcagatgacaagaagaccaagaggaagaccagcgggatccaagaacaaaccaaaaccaccgattatcatcacacgggacagcgcaaacgcgcttagaacccacgtgatggagatcggagatggctgcgacttagtcgaaagcgttgccacttttgcacgaagacgccaacgcggcgtttgcgttatgagcggtactggaaatgttactaacgtcactatacgtcagcctggatctcatccttctcctggctcggtagttagtcttcacggaaggttcgagattctatctctctcaggatcttttctccctcctccggctcctcctacagccaccggattgagtgtttacctcgctggaggacaaggacaggtggttggaggaagcgtagttggtccgttgttatgtgctggtcctgtcgttgtcatggctgcgtcttttagcaatgcggcgtacgaaaggttgcctttagaggaagatgagatgcagacgccggttcatggcggaggaggaggaggatcattggagtcgccgccaatgatgggacaacaactgcaacatcagcaacaagctatgtcaggtcatcaagggttaccacctaatcttcttggttcggttcagttgcagcagcaacatgatcagtcttattggtcaacgggacgaccaccgtattgatcaaatatacacacacactcataatcgttgctagctagctaacgatgaatcatgagtttagtggatatatatatgattaaaagaggttagcttatgaacattaataagagtttggattctatcgagcttcattatgtttgggtcaacgtt

SEQ ID NO: 1440 - DNA, 904 bp, Artificial Sequence
  P3643 (opLexA::G33, G33 is from Arabidopsis thaliana)
attctcccccaaccaaaatatgaccacagaaaaagagaatgtcactacggccgtggccgtgaaagacggcggagaaaagagtaaggaagtgagtgacaagggcgtaaagaagagaaagaatgtaactaaggccctggccgtgaatgacggcggagaaaagagtaaggaagtgcgttacaggggtgtaaggaggagaccatgggggagatatgctgcggagatccgtgatccggtaaagaaaaaacgggtctggctcgggtccttcaacacgggggaggaagccgccagagcctacgactccgctgccataaggtttcgaggatcgaaagctactactaacttccctctaatcggatactatgggatttcttcggcgacgccggtgaacaacaacctttccgagacggtgagtgatggaaatgccaacctccctctcgttggagacgatgggaatgctttggcttctccggtgaacaacaccctttccgaaacggcgcgtgatggaacacttccatcggattgtcacgacatgttatctccgggggtggctgaagcggttgctggatttttcttagatctgcctgaagttattgcgttgaaagaggagcttgatcgagtttgtcctgaccagtttgagtccattgatatggggttgactattggtcctcaaaccgccgtggaagagcctgagacttcctccgccgtggattgtaagctgcgaatggaaccggatcttgacctcaacgcaagtccctaaagattgatctgatgttgttgtccttgaataagtttgttatcttgtcgctcttctgattgtctgtacttctattggttgattcgtgcttttggaggacaaaacaaacatttttttatgtattaaaaaaaggtaattgaactattatcg

SEQ ID NO: 1441 - DNA, 953 bp, Artificial Sequence
  P3650 (opLexA::G812, G812 is from Arabidopsis thaliana)
atcgaaatcatcaagaatcttgtctttaatttccaattgggtttttcaaaacccgttacctcaggatgatgaacccgtttctcccggaaggctgcgatccaccaccaccaccacaaccaatggagggtttacacgaaaatgctccacctccatttctgaccaagacatttgagatggtggatgatccaaacactgaccacatcgtatcttggaacagaggaggaacaagttttgtcgtctgggatttgcattctttctccacgattctccttcctcgtcatttcaaacacagcaatttctcaagtttcatcagacaactcaatacttatggtttcagaaagatagaagcagagagatgggaatttgcaaacgaagagtttttgttaggacaaagacagttgttgaagaacatcaagaggagaaacccttttactccatcatcttcaccaagccatgacgcttgcaacgagcttcgcagagagaagcaagtgctaatgatggagatagtgagtctaagacagcagcaacaaacaacgaaaagctacatcaaagctatggaacagaggatagaaggaacagagaggaaacagagacaaatgatgtcgtttctggctagagcaatgcagagtccttcgtttttgcatcagttgttgaaacaaagagataaaaaaattaaggagcttgaggataatgagtcagcaaagaggaaaagaggttcttcttcgatgtcggaattggaagttttggctttggagatgcaagggcatggaaaacagaggaatatgttggaagaagaggatcatcaactggtggtagagagagagttggatgatggtttctgggaagagttgcttagtgatgagagtttggcttccacctcctaactagatggatttctttttggttttgtttttagtttcttctactttcaagctcattttcttctgtcacaa

SEQ ID NO: 1442 - DNA, 1472 bp, Artificial Sequence
  P3761 (opLexA::G202, G202 is from Arabidopsis thaliana)
cctatatcttgagttttgtgagaggttaattatatgaaattttacgcattattgttcatctatatcgaaaaacaatgtcaagaaagccatgttgcgtcggagaaggcttgaagaaaggagcatggaccaccgaggaggacaagaaactcatctcttacatccacgaccacggcgagggaggctggcgcgacattccccaaaaagctggtttatacaaatctatacatacactcatttttgtacttgttgtagaaaattgttctgataaacatattgtgtctgattagggttgaaacggtgtggaaagagttgtagactgcgatggaccaactaccttaaacctgagatcaaaagaggcgagtttagttcagaggaagagcagattatcatcatgcttcatgcttctcgtggcaacaagtacgtttctatgtttctatgtgtgtgcgtggaccctcgaatgtgaaatgaatttcatgaaaaagttttcatataatatttattatgtagacataatcatcattttaatcttggtctccgatctatcttattttctttaggtggtcggtcatagcgagacatttacctagaagaacagacaacgagatcaagaactactggaacacgcatctcaaaaaacgtttgatggaacagggtattgatcccgtgactcacaagccactggcttctagttccaaccctacggtcgatgagaatttgaattccccaaatgcctctagttccgacaagcaatactcccgatcgagctcaatgccttttctgtctcgtcctcctccatccagttgcaacatggtttccaaggtctccgagcttagcagcaatgatgggacaccgattcaaggcagttccttgagttgcaagaaacgtttcaagaaatcaagttctacatcaaggctcttgaacaaagttgcggctaaggccacttccatcaaagatatattgtcggcttccatggaaggtagcttgagtgctactacaatatcacatgcaagcttttttaatggcttcactgagcagattcgcaatgaagaggatagttctaacacatccctgacaaatactcttgctgaatttgatcccttctccccatcatcgttgtaccccgaacatgagatcaatgctacttctgatctcaacatggaccaagattacgatttttcacaatttttcgaaaaattcggaggagataaccacaatgaggagaacagtatgaatgatctccttatgtccgatgtttcccaagaagtctcatcaactagcgttgatgatcaagacaatatggtaggaaacttcgagggatggtcaaattatcttcttgaccataccaattttatgtatgacaccgactcagactcgcttgaaaagcatttcatatgagtcttcatatccaaacagaaaggtttcaaactattcgacgacttaaaataatggttctgtacccaaggttagtcgat

SEQ ID NO: 1443 - DNA, 479 bp, Artificial Sequence
  P3777 (opLexA::G486, G486 is from Arabidopsis thaliana)
agcgagagctgatagattcactgaaacaaaagagaaaaatgacagacgaagatagattgttgccaatagccaatgtagggagacttatgaagcaaatcctaccatcaaatgcaaagatctcaaaagaagcaaaacaaacagttcaagaatgtgcaacagagttcataagctttgttacatgcgaagcatcagagaagtgccacagggagaatcggaagacggtgaatggagacgacatctggtgggctctcagcactctcggcctcgataactatgctgacgccgtgggtaggcatcttcacaagtaccgtgaagccgagagagaaagaactgagcacaacaaaggtagcaatgatagtgggaatgagaaagaaaccaacactagaagtgatgtacagaaccaatcgacaaaatttattagagttgttgagaagggaagcagctcctcggcccgttgaactagacatctaagttctggc

SEQ ID NO: 1444 - DNA, 1061 bp, Artificial Sequence
  P3830 (opLexA::G1308, G1308 is from Arabidopsis thaliana)
tctctgtctctcctattatgagtctaaaagtctactagctgttcaatagttttgtctttctgtgtttctcttcttcaaaaccgaaagaaattcaaaaagagtctttcgctgcttgttagtggggtgaggaacaaatgggaagaacaccttgttgtgacaagattggtttgaagaaaggtccttggacgcctgaagaagatgaggttcttgttgcgcatatcaagaaaaatggacatggaagctggagaacacttcctaaacttgctggtttacttcgctgtgggaagagttgcaggctgagatggacaaactatctgagaccagacataaagagaggtcctttcactgctgatgaagagaaacttgttatccagcttcatgccattctcggcaacaggtgggctgctattgcagcacagcttccaggaagaacagacaacgagatcaagaacttatggaacactcatttgaagaaacgtcttttatctatgggtcttgatcccagaactcatgagccattaccttcatatgggttagctaaacaagctccatcttcaccaacaactcgccacatggctcaatgggaaagtgctagggttgaagctgaggcaaggctttctagagaatcaatgctctttagcccttctttttactctggtgtagtaaaaactgaatgtgatcacttcttacgcatttggaattccgagattggtgaagctttcaggaatctcgctccattagatgaatcaactattactagtcaaagcccttgctcgagggcaacatcgacctcatctgcacttctgaagagctcaacaaattcttggggagggaaagaggttactgtggcgattcatggctcagattattctccatattcaaatgatcttgaagatgattcaacagactctgctcttcaacttctgcttgatttccctataagcgatgatgatatgagcttcttggaagagaacattgacagctactcacaggctcctcctattggtcttgtttccatggtttccaaattctagtcttatgagagcctaatatctaagaaa

SEQ ID NO: 1445 - DNA, 505 bp, Artificial Sequence
  P3853 (opLexA::G47, G47 is from Arabidopsis thaliana)
cttcttcttcacatcgatcatcatacaacaacaaaaaatggattacagagaatccaccggtgaaagtcagtcaaagtacaaaggaatccgtcgtcggaaatggggcaaatgggtatcagagattagagttccgggaactcgtgaccgtctctggttaggttcattctcaacagcagaaggtgccgccgtagcacacgacgttgctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggagatacgacgacgtattacgagaatggagctgatcaagtggagccgttgaatatttcagtgtatgattatctgggcggccacgatcacgtttgatttatctcgacggtcatgatcacgtttgatctt

SEQ ID NO: 1446 - DNA, 727 bp, Artificial Sequence
  P3973 (opLexA::G1902, G1902 is from Arabidopsis thaliana)
gaagttgataaatgttcaaggaaacataaaaaagagaagatttttgaataaaggttgaagaaaaatgcaggatccagcagcatattaccagacgatgatggcgaagcaacaacaacaacaacaaccacagtttgcagagcaagaacagttaaagtgtcctcgttgtgactcaccaaacactaaattctgttactacaacaactacaatctctcacagcctcgtcacttttgcaaaagctgtcgtcgttactggactaaaggcggcgctctccgtaacgttcccgtcggtggtggttctcgtaagaacgcaaccaaacgatccacttcttcttcttcttctgcttcctctccttccaacagtagccaaaacaagaagacgaaaaacccggatccggatcctgatccacgtaattctcaaaaaccggatttggatccgacccggatgctttacgggtttccgatcggtgaccaagacgtgaagggtatggagattggtggaagctttagctcgttgttggcgaataatatgcagcttggtcttggaggaggagggatcatgcttgacgggtcgggttgggatcatccgggtatgggtttgggtttgaggagaaccgaaccgggtaataataataataacccatggaccgatctggctatgaacagagcggagaaaaactgaagaagaaaagaagagaggggtattttggtaaattatagcaacctgatt

SEQ ID NO: 1447 - DNA, 542 bp, Artificial Sequence
  P3982 (opLexA::G1809, G1809 is from Arabidopsis thaliana)
cctattctcgtctttagcaaaatctcaaaagacaaaaagatattgatgtctctccaacgacccaatgggaactcgagttcgtcttcttcccacaagaagcacaaaactgaggaaagtgatgaggagttgttgatggttcctgacatggaagcagctggatcaacatgtgttctaagcagcagcgccgacgatggagtcaacaatccggagcttgaccagactcaaaatggagtctctacagctaaacgccgccgtggaagaaaccctgttgataaagaatatagaagcctcaagagattattgaggaacagagtatcagcgcaacaagcaagagagaggaagaaagtgtatgtgagtgatttggaatcaagagctaatgagttacagaacaacaatgaccagctcgaagagaagatttctactttgacgaacgagaacacaatgcttcgtaaaatgcttattaacacaaggcctaaaactgatgacaatcactaaatatttaccctttaatccattgttcagtgttgtatgattatctttcg

SEQ ID NO: 1448 - DNA, 1561 bp, Artificial Sequence
  P4030 (opLexA::G1145, G1145 is from Arabidopsis thaliana)
ctggctatttatcaaattgagcattagggtttctgatttgtgggttcagaattgtttttatctatctgtcttgttgttttttgtccgctacaaaagcctatggattctcagaggggtattgttgaacaagctaaatctcagtccttgaataggcaaagctctctttacagcttaacacttgatgaggttcaaaatcacttggggagttctggtaaagctctgggaagcatgaaccttgatgagcttttgaagagtgtctgttctgttgaagctaatcagccatcgtctatggctgtcaatggtggagcagctgctcaggagggtctttctcgccaggggagtttgactttgcctcgggatctcagcaaaaagactgttgatgaggtttggaaagacattcagcagaataagaatggaggtagtgctcatgagaggagggataagcagcctacacttggggaaatgacgcttgaagacctgttgttgaaagcaggagtggtcactgagactatccctggttcgaaccatgatggtcctgttggtggtggtagtgctggttcaggtgctggtttagggcaaaacattactcaagttggcccatggattcaatatcatcagctcccatcaatgccacagcctcaagcatttatgccctatccggtttcagatatgcaagcaatggtgtctcagtcttctttgatgggtggtttgtcagatacacaaactcctggaaggaagagggtagcttcaggagaagttgtagagaagactgtagagaggaggcagaagagaatgataaagaacagagagtctgctgctcgttcccgagctaggaaacaggtgagaaacaactaatttgttgttgttattcttcttgtcaagtcatgctcgtttttgttttaacattggatattgatgagcaggcttacactcatgagctagagatcaaagtttcacggttagaagaagaaaacgaaagactcaggaagcaaaaggtaatgcattgtaggtttttctccctttttacaacacatgcattgattaaatttgtgattactagaaacttgtaagagctgatcgttgattagttctggattcatattaaagggaatgatagatgatagaagatgtagtgaagtatagaatagggcacacgcatagtagacaatatatgatagaaaatataaccacgaacaagagacaggaggaataggtttagaccaaacgtcttaggagacatagttttcctttacccggaacaagttggtcttgctggtttctagtcttcatggactttctgttcttcaattttgtctgcgtttatgtgtggccaaagctaatccttacattactttgcaggaggtggaaaaaatcctcccaagtgtaccaccgcctgatcccaagcggcagctccgacggacaagctcggctcctttctgatctctaaactctttttgtctttttctttttttctcttctgtgtcggttcacttataaaaaagagaggaaaacagctttgtttctttgtacattccgtagactttcttgacttggagcaatg

SEQ ID NO: 1449 - DNA, 1080 bp, Artificial Sequence
  P4033 (opLexA::G860, G860 is from Arabidopsis thaliana)
acaaaaccacatctctgaactgaaccaatttctcttctcccccttccggttatcggattaccagatctcgtttcccgcgatctagtttattctttgaaaaagtgatagaagcagaaatgggaaggggcaagatcgcgattaagaggatcaataactctacgagccgtcaggttacgttctcgaagcgaaggaatggattgttgaagaaagctaaggagcttgcgattctctgcgatgctgaggttggtgtcatcatcttctccagcaccggtaggctctacgatttctccagctccagcatgaaatcggtcatagagagatacagcgatgccaaaggagaaaccagttcagaaaatgatcccgcttcagaaattcagttctggcaaaaggaggctgcgattctaaagcgtcagctacataacttgcaagaaaaccaccggcaaatgatgggggaggagctctctggactaagtgtagaagctttacagaatttggaaaatcagcttgaattgagccttcgtggcgttcgaatgaaaaaggatcaaatgttaatcgaagaaatacaagtacttaaccgagaggggaatctcgttcaccaagagaatttagacctccacaagaaagtaaacctaatgcaccaacagaacatggaactacatgaaaaggtttcagaggtcgagggtgtgaaaatcgcaaacaagaattctcttctcacaaatggtctagacatgagagatacctcgaacgaacatgtccatcttcagctcagccaaccgcagcatgatcatgagacgcattcaaaagctatccaactcaactatttttccttcattgcataatataattcggtgtgccaacacacttatgttgacctcgtcggaatcatatcacaattcactgtgtcagcttgcctctgcataagcgaaaataaaaacataaacatgatcagtttgcattccatatctatcaaacaccagctttgtaacttttaaaactttttctccgtgcaaagacctttggtttggcgcttaagcatgtagtttgatgatcaaaggaaatgggtgttttagcataaagttg

SEQ ID NO: 1450 - DNA, 1440 bp, Artificial Sequence
  P4146 (opLexA::G1944, G1944 is from Arabidopsis thaliana)
cttcctaatttccaacctctgttcttagcaatatattttttctccaaaaataattctcagtttgattttcttcttctagctcttaagtatatttctttgttgttatttatcttttaatcctttaatctcatctttgtttatctttaatcaaaacccaaaatttacatgggttcttgaaaatctagaagaaataaaggaaacataacaaaaatagaaagaaaaagaagctaatggtcttaaatatggagtctaccggagaagctgttagatcaaccaccggtaacgacggtggtattacggtggttagatccgacgcgccgtcagatttccacgtagctcaaagatcagaaagctcaaaccaatctcccacctctgtcactcctcctccaccacagccatcgtctcatcacacagctcctccgccgctgcaaatttcgacggtgacgactacgactacgacggccgcgatggaaggtatctccggtggactgatgaagaagaagcgtggacggccaaggaagtatggaccggacgggactgttgtagcgttatctcctaaaccgatttcatcagcgccggcgccgtcgcatcttccgccgccgagttcacacgtcatcgatttctccgcttctgagaaacgtagcaaagtgaaaccaacgaactcgtttaacagaacaaagtatcatcaccaagttgagaatttgggtgaatgggctccttgctccgtcggtggtaatttcacacctcatataatcacagtcaacaccggcgaggatgtaacaatgaagataatctcgttttcgcaacaaggacctcgctctatttgtgttctgtcagcaaacggtgttatttcaagcgttacacttcgtcagccagattcctctggcggcacattgacatacgaaggtcggtttgagatattatcattatccgggtcattcatgcctaatgattcaggcggaacacgaagtagaacgggaggaatgagtgtatcgttagcaagtcccgatggacgtgtagtaggcggtggcctcgccggtttactagtagccgcgagtccggttcaggtggttgtaggaagttttttagcgggcactgaccatcaagatcagaaaccgaaaaagaacaaacatgatttcatgttgtcgagtcctaccgctgcaattcctatctctagtgcagctgatcaccggacaatccattcggtctcgtctcttccggtcaataataatacatggcagacttctttagcttccgatccaagaaacaagcataccgatattaatgtcaatgtaacttgaaatccaatctttctctgtattttctgttaacaagtttgatttggttgtttatctacattaggattttactaaaatggtagtattatttatagggttttagggtctttattttggttccactgttgtcacttgtaggata

SEQ ID NO: 1451 - DNA, 1511 bp, Artificial Sequence
  P4188 (opLexA::G1942, G1942 is from Arabidopsis thaliana)
actccaaatggctcttgtgctctcagaacacacacagatataataaactcttaacgaagaagaagactttttcttttcttgagcaagctctgagaaactcacagagagggacagagagagaaatatttcattcgctactctctttaataccgccattgatgcaacctccttcgcgttaactgtcaaaatactccccaactgacaaaaattaaattcctttttttctctctcgattttaaaagctctaaaaggaacgagttgatcaagtcggtcggttctggttatcactgaatttcattcaactcggtttattccggtttaagtgtgattttcccggctaatggatctgacccaaggtttcagagctagatccggcgttgttgggccggtggccggactagaatctctcaatttcagcgacgaatttcggcacttagtgacgacgatgcctccggagactactggcggctccttcacggctttactcgagatgcctgtgactcaggccatggagcttctccatttcccagattcatcgtcttctcaggccagaaccgttaccagtggtgatatttctcctaccactcttcaccctttcggggctttgacttttccttctaactcgcttctcttggaccgcgccgctcgtttctcggtgattgctacagagcaaaacggtaatttttccggcgagactgctaactctttaccttctaatcccggcgcgaatctggacagagtcaaagccgagcctgctgagaccgattcaatggtggagaatcagaaccagagctactcttctggaaaaaggaaagaacgcgagaagaaggtcaaaagctcgacgaagaagaacaagagctccgtggagtcagacaagttgccatatgttcatgtcagagctcgtcgtggtcaagctactgataaccatagcttagcagagagagcaagaagggagaagataaacgcacgaatgaagctgctacaggaactggtcccaggctgtgataagattcagggcactgcattggttctggatgaaatcattaaccatgtgcaaactttacagcgtcaagtggagatgctatctatgagacttgctgcagtaaaccccagaatcgacttcaatctagacagcatactggcttcagagaacggctctcttatggatggtagcttcaatgcagagtcttatcatcagctgcaacaatggcctttcgacggctaccaccagccggaatggggaagagaagaagatcatcatcaagccaatttctcaatgggttcagctactttacacccaaatcaggtgaaaatggagctctaagttggaaacagtttgacatgcttatgtgtatatataagagttatatatatctactaaagtttcgattgttgaattagaggtagaaaatggttatgattgtttcaggtctttgttcatggcctttctatatttactagattcctcaatgtagaattcagaatgtctaaattgcgtttcccttgagaga

SEQ ID NO: 1452 - DNA, 1109 bp, Artificial Sequence
  P4230 (opLexA::G504, G504 is from Arabidopsis thaliana)
ctcttgacgatcatgagactgatttcgtgaaaatatcgtcattatatcaaattagaagttgatggaaaacatgggggattcgagcatagggccgggccatccgcatctccctcccgggtttcggtttcacccgactgatgaggaactagtagttcattacctcaagaagaaagcagattctgttccacttccagtctcaatcatcgcagagattgatctttacaagtttgatccttgggagcttccaagcaaggcgagttttggagagcacgagtggtacttctttagtcctcgggatcggaagtatccaaatggggttaggccaaaccgggcagcaacttccggttattggaaagcaacgggaaccgataaaccgatatttacgtgcaatagtcacaaggttggtgtcaagaaagcgcttgttttttacggtggaaagcctcctaaagggataaaaacagattggatcatgcatgaatatcgcctcactgatggtaaccttagcactgcggctaagccgcctgacttaaccacgacaaggaaaaactcactacggctagacgattgggttctatgtaggatctataagaagaatagttcacaaagaccaacaatggagagagtattacttagagaggatctaatggaaggcatgctctcaaaatcatctgctaattcttcttctacatcagtactagacaacaacgacaacaataataacaataacgaagaacactttttcgacggtatggtcgtttcttcagacaaacgttccttgtgtggtcaataccgaatgggccacgaggcctcaggatcatcttcattcggatctttcttatcgagcaagaggtttcatcatacaggtgatctcaacaatgataactacaatgtctcttttgtttcgatgcttagtgagattcctcagagttcggggtttcatgcaaatggtgttatggatacgacgtcgtctctagctgatcatggggttttaagacaggcgtttcagcttcctaacatgaactggcactcataatctatatagatatatatgtgtgtatcatatatgtatctatgcaggcctaatatagtttacacataaatcatctggg

SEQ ID NO: 1453 - DNA, 1142 bp, Artificial Sequence; identical to SEQ ID NO: 147
  P4337 (opLexA::G1463, G1463 is from Arabidopsis thaliana)

SEQ ID NO: 1454 - DNA, 1188 bp, Artificial Sequence
  P4338 (opLexA::G1464, G1464 is from Arabidopsis thaliana)
catgagtctcacttcttcttcgctctccaagaaacaaaacactcgatcttgcgtttgatctttctctctctatagatctttttcttgatcgattttatctcattatggaagataacgacgcagcttatgatcaagtcaaatccgaactgttaaactcagaagacgaagtaataatctcacgttatctgaagcctatggtcgttaacggagattcttggccagatcacttcatcgaagacgcaaacgtgttcaccaagaatccaaatgaggtgttcaattctgagagacctagattcgttatcgttaaaccacgaacagaggcttgtggtaagaccgatggatgtgaatctggttgctggaggaccatgggtcgtgataaactgataaagtcggaggagactgggaagattctagggttcaagaagattctcaagttttgcataaagtggaaacctatagaatacaagagaagttgggtaatggaagagtataggcttaccaataacttgaactggaagcaagatcatgtgatttgcaagattcggcttttgtttgaagcagaaattagtttcttgctagccaagcatttctacactacgtcagaatcacttcttcgacatgagctattgccatcttatggatatttatccaatacacaagaggaggatgaattttatctgaagacgataatgacttcggaaggaaacgattggcctagctacgttaccaacaacgtgtactgtcttcatccattggagcttgtggatcttcaagatgtgatgtttcaaagttacggaacctgcatcttcgctaacgggacttgtggtgaatctgataaatgcgatggtggttactggaagatcctgcacggtgataagctgatcaagtcaaatttcgggatggtcactggtttcaagaaggaagaaacagagaggttaggtcatcaacgttgccaaggcttgttgttgccacaccgtcgtggccatgtacaaaccaagagttgcggtgtcgtcaccgtgaaggagaagaggagtttggtagagcaaccggaggagattgtcgctgcacctgagacaccacgccaaggaaaaagtgagcataatgatccactaaagcgaaagaaagcgattggttgcgtgggagagaaagctgagatgtaggcgagacgtcaccactacgaatggagat

SEQ ID NO: 1455 - DNA, 712 bp, Artificial Sequence; identical to SEQ ID NO: 177
  P4341 (opLexA::G1671, G1671 is from Arabidopsis thaliana)

SEQ ID NO: 1456 - DNA, 819 bp, Artificial Sequence
  P4393 (opLexA::G1935, G1935 is from Arabidopsis thaliana)
tttgattattttgcagtgaccatcggatatgggtcgggttaaattggagttaaagcgtatagagaagagcacgaaccgacaaattacgttctcaaaacgtaaaaaaggtttaataaaaaaggcttatgaattgtcaacactttgtgacatcgatcttgccctcctcatgttctctccctctgatcgactatgtctcttttccggtcaaacaaggatcgaggacgttttggcgaggtacatcaatcttcctgatcaagaaagagaaaacgccatagttttccctgatcagagcaagcgccaaggtatccaaaacaaagagtatttgttaaggactttggaaaaactcaaaattgaggatgacatggctctccaaatcaacgaacctcgtccagaagccaccaactccaatgtcgaggaacttgagcaagaagtttgtagattacaacaacagcttcagatatcagaggaagaactcaggaaattcgaaccagatccaatgaggctaacatcaatggaggagattgaagcatgtgaagctaacctcatcaatacgttgacacgtgtcgtccagagaagggaacatttgttgagaaagtcctgcgaagcacaaagtaaccaacaaagcatggacgggatccttctaaatgacatcgtcgaggattggggacctgagcccgagcccaaacaagcccatatgatagctaattcggcccatcattcaaatcagccaagctatgatttactcttacgcaggagtaattcgagttcgaaccaaaatccaaaatgatattaggtgaatcgcaaggcgtcgtcgagccc

SEQ ID NO: 1457 - DNA, 980 bp, Artificial Sequence
  P4396 (opLexA::G2425, G2425 is from Arabidopsis thaliana)
gagatctgattgctcaccggagagaacaaaacaagaaatggggaggacgacgtggttcgacgttgacgggttgaggaaaggagagtggacggcggaggaagaccggaagctcgtggtttacatcaacgaacacggtctaggcgagtggggttcactgcctaagagagccggtctacaaagatgtggaaagagttgtagattaagatggctgaattatttgaggcctgggattaaaagaggcaagttcactcctcaggaagaagaagaaatcatcaaataccatgctcttcttggaaacaggtgggcagcaatagctaagcaaatgccaaacagaacagataatgacataaagaaccattggaactcatgccttaagaaaagacttgctaaaaaaggaatcgatccaatgacccatgagccaacaacaacaacaagcctcaccgtcgatgtcacctcctcatcaactacgtcgtctcctacaccgagccctacttcttcttctttttcctcctgttcctctactggctctgcacgtttccttaacaagctcgctgctggaatctcgtcaagaaaacacggactagagagtatcaagacagtgatattggcagaacaaccaagagaagccgttgatgaagagaagatgatgacaattaacatgaaagagaaggaattgattagttgttacatggagattgatgagacgatgagtattgatgaactaccttgtgatgactcgacgtctggcttcgtggcttttgacgactactcattaatcgacccatacagagacggtgtgtacgtatctgatttctacgatgagactgaacaccttgacctgttccttctttgaatcacatttcctttgtctaaataaatccgtttctttagtgtgacgagagagagacagtggagagagagacagtggagagagatgtctgaaaaaaacaagtgcggattagtactttgaatgacatgcg

SEQ ID NO: 1458 - DNA, 740 bp, Artificial Sequence
  P4399 (opLexA::G1818, G1818 is from Arabidopsis thaliana)
taggttgagattcatatatgtaaagagatcacttcttaatcttatcctaccatatcttatatacgcttaattttcctttatatatgcaaacctccacataaaaatatctcaaacccaaacacttcaaacaaaaaaaaaatggagaacaacaacaacaaccaccaacagccaccgaaagataacgagcaactaaagagtttctggtcaaaggggatggaaggtgacttgaatgtcaagaatcacgagttccccatctctcgtatcaagaggataatgaagtttgatccggatgtgagtatgatcgctgctgaggctccaaatctcttatctaaggcttgtgaaatgtttgtcatggacctcacgatgcgttcatggctccatgctcaagagagcaaccgactcacgatacggaaatctgatgttgatgccgtagtgtctcaaaccgtcatctttgatttcttgcgtgatgatgtccctaaggacgagggagagcccgttgtcgccgctgctgatcctgtggacgatgttgctgatcatgtggctgtgccagatcttaacaatgaagaactgccgccgggaacggtgataggaactccggtttgttacggtttaggaatacacgcgccacacccgcagatgcctggagcttggaccgaggaggatgcgactggggcaaatggaggaaacggtgggaattaatatttggattgggttttgtaaccgctgttgtgagaacaaga

SEQ ID NO: 1459 - DNA, 825 bp, Artificial Sequence
  P4403 (opLexA::G1844, G1844 is from Arabidopsis thaliana)
ggggattagatgtgtcggaagagtgaagccatgggaagaagaagagtagagatcaaacgaattgagaacaaaagcagtagacaagtcactttctgtaagagacgaaatggtctcatggagaaagctcgtcaactctcaattctctgtggatcctccgtcgctcttttcatcgtctcttccaccggcaaactctacaactcctcctccggcgacagcatggccaagatcatcagtcgttttaaaatacaacaagctgatgatcctgaaaccttggatcttgaagacaaaactcaggattatctttcacacaaggagttactagaaatagttcaaagaaagattgaagaagcaaaaggggataatgtaagtatagaatctctaatttccatggaagagcagctcaagagtgctctgtctgtaattagagctaggaagacagagttattgatggagcttgtgaagaaccttcaggataaggagaagttgctgaaagaaaagaacaaggttctagctagcgaggtggggaagctgaagaaaattttggaaacaggggatgaaagagcagtaatgtcaccggaaaatagctctggccacagcccaccggagactctcccgcttctcaagtaaccaccaatcatcaacggctgatttttcatcatcctgattcaaaaaaggtaaaaaaaattcatgtgtaaaaatcataaagaagctacatgttttaaaatcctcttctccccctgcatacggataaatttatagaccaaaaatataatgttttccctcaaataagatatcgacctttgtgttaccttggaagacaggatc

SEQ ID NO: 1460 - DNA, 722 bp, Artificial Sequence
  P4407 (opLexA::G1755, G1755 is from Arabidopsis thaliana)
gccatcttctttgctactactaatctactattacactgaatcgtttgggttcttcttcttcttcagctgctactttgttcgagtgattgctgacatgccgtcagcgtcggagattgttgacaggaaacggaagtctcgtggaacacgagatgtagctgagattctaaggaaatggagagagtacaatgagcagaccgaggcagattcttgcatcgatggtggtggttcaaaaccaatccgaaaggctcctccaaaacgttcgaggaagggttgtatgaaaggtaaaggtggacctgaaaatgggatttgtgactatacaggagttagacagaggacatggggtaaatgggttgctgagatccgtgagccaggccgaggtgctaagttatggctcggtactttctctagttcatatgaagctgcattggcttatgatgaggcttccaaagctatttacggtcagtctgcccgactcaatcttccactgctgccactgtgtcaggctcggttactgcattttctgatgaatctgaagtttgtgcacgtgaggatacaaatgcaagatctggttttggtcaggtcagactagaggattgtattgatgaatatgttctcctagatagttctagtgtattgttaatcgtagttgactattgtgaggtcttaagttgtagattgaaaatgagatagctcatatggagctttattgaaatgcaagaaag

SEQ ID NO: 1461 - DNA, 1149 bp, Artificial Sequence
  P4411 (opLexA::G1063, G1063 is from Arabidopsis thaliana)
gttaaagaagatggatgggccacaagttgctatataaatccttccacttcttgttgtatactattgcttgagttctgattgggcacagtagtaccattgccatttctctcacacataccgtctctttctctcatcatcaatcatcaatcatccaaaagaaaaaaccctaaaatttcacttgtaagcttttcaccagtttctctccatacccattttatcagcttctccatatctttctctatggattctgacataatgaacatgatgatgcatcagatggagaagcttcctgagttttgtaaccctaattcctctttcttctctcccgaccacaacaacacttacccttttctctttaactccactcattaccagtccgatcactcaatgaccaacgaaccaggtttccgctacggttccggtttactcactaacccttcttctatctctcccaacacagcttactcttccgtttttcttgacaaaagaaacaacagtaacaacaacaataatggcacgaacatggcagctatgcgagagatgatcttccgtatcgccgtgatgcaaccgatccatatcgatcccgaggcggttaagccaccgaagaggaggaacgtcaggatctctaaagatcctcaaagcgtggcggctaggcatagaagggagagaataagcgagaggattcggattttgcaacggcttgttcctggtgggacgaagatggatacagcttcgatgctcgatgaagcaattcattatgtgaagtttttaaagaaacaggtgcagtctctggaggagcaggcggtggttactggcggagggggaggaggaggaggaagggttttgatcggtggaggtggaatgacggcggcgagtggtggtggtggcggcgggggagtggttatgaaagggtgtggaacagtggggactcatcagatggtgggcaatgcacagattcttagatgatgatgatttttaattttattattattatattaatgttggagaaaaagagaaaaatgattctggagagggaagccaagtaatttatgtgagagtctttaatttaactttattttcttgtttagataatgtgtaatgatggtttttaaagccaaagactctccatggttgttggagcgagtttgt

SEQ ID NO: 1462 - DNA, 918 bp, Artificial Sequence
  P4423 (opLexA::G2052, G2052 is from Arabidopsis thaliana)
acgtctagcaagtcatcgtattctactttgttgttgcaaatgggaagttcatgtttacctccagggttccggtttcatcctacggatgaagaactcatcgaatattacttgaaaagaaaagtcgaaggtctcgagattgagcttgaagtcattcccgtcatcgatctttatagtttcgatccttgggagttaccagacaagtcgtttctcccaaaccgggacatggaatggtacttcttctgctcaagggacaaaaaatatcctaatggttttcgtacaaatcgaggaacaaaggctggttattggaaagcaaccggaaaagatcgaaaaattacttctcgttcatcttctataattggttatagaaaaactctagttttctacaaaggccgtgccccgttaggcgatagaagcaattggatcatgcatgaatatcgactatgcgatgatgatacatcacaaggatcacaaaatttaaagggagcttttgtgttatgtcgtgttgctatgaagaatgagatcaaaactaatacgaaaatccgaaaaattccaagcgagcaaacaatcggatcaggagaaagctcgggtttatcaagccgagtaacgtctcctagtcgcgatgaaacaatgccgtttcactcatttgccaatcctgtatctactgaaactgattcttccaacatttggatttcacctgaattcatcctcgattcttcaaaggactatcctcaaatccaagatgtcgcatctcagtgcttccaacaagactttgattttccgatcatcggtaaccaaaacatggagtttccagcgagtacaagcttagatcagaacatggatgagtttatgcaaaacggttattggacaaattatggatacgatcaaaccggtttattcggttactcagatttctcctag

SEQ ID NO: 1463 - DNA, 1348 bp, Artificial Sequence
  P4528 (opLexA::G729, G729 is from Arabidopsis thaliana)
aacaacttcagtggcagcaatagcaagagaaaggtttctttaattatgtctatggaaggtgtttttctagagaaaaccaaaacaaacacaacaactactctccctgatctatctctccacatcagtctcccagatattcatcaataccatcacaatgaatcttctaaagaatcttcaagaagatcctcccaactcgaaaacaacaaccgatcgtccaactttgaactctctttatctcatcataaccatccaacagcaagaatcttccattgtcctgatcgaagaacccttaatcttcctcatcagcagcattacaacaaccctatcatcaatggtgttcatcaaagggtcgatgaatccgagattagtaatctccaccgtccaattagaggcatcccggtctatcacaaccgttcattccctttccaccaacaaaactcttcattaccttctcttggaggaggagacatggatcaaatctcaatcttaaactcatcttccggctacaacaacgcttaccgatcattacaatcttccccgaggcttaaaggtgttcctttgcatcatcatcatcatcataatcagtatggagtcgttggatcttcagattcgtcttctcctcatcaccataaccatcatcatcatgggatgatcagatcaagattcttgcctaagatgccgacaaagcgaagcatgagagctccaaggatgcgttggactagtagcctccacgcgcggtttgttcacgctgttgagcttctaggcggccatgaaagagcaactccaaagtcggttcttgagctcatggatgtaaaagacttaactttagcacatgtgaagagccatttgcagatgtatcgaactgttaagaccactaacaagcctgctgcttcatcagatgggtcaggagaagaagaaatgggcataaatggaaacgaagttcatcatcaatcatcgacggatcaaagggcacaatctgatgatacttctcttcatcaagaaactgacatttcttccacacaacctcgttggagtaactcttcacgagagacatggccattaagtaataactgctcaagcgacatagatacaatgatcagaacttcatcaacatcaatgatctctcattatcaaagatccagcattcaaaatcaggagcaaaggtcgaatgatcaagcaaagaggtgtggaaatcttagttgtgaaaatccaagtttggagtttacattaggcagaccagattggcacgagaaatgactttcttgatcaatttggatttttatatatattggattttttatttttttgtttcatctttctctctctatatatactcagaaacatgtat

SEQ ID NO: 1464 - DNA, 866 bp, Artificial Sequence
  P4534 (opLexA::G1492, G1492 is from Arabidopsis thaliana)
gtttaagtaaaaatcgaatctttgtgtcggtttttagggttcttgaaacgatatgggtaagtctagtggtagaaatggtaacggaagctttaacggcaataaatttcacggagttagaccttacgtacggtctccagttccacggcttagatggacgccggatcttcaccgttgtttcgttcacgccgtcgagattctcggtggtcaacaccgagcaacaccaaaacttgttcttaagatgatggatgtgaagggacttaccatttcacatgtcaaaagccaccttcagatgtatagaggaggttcaaagctcactttggagaaaccagaagaaagctcatcatcttcaataagaagaagacaagacagtgaagaagattattatcttcatgacaacttgtctttacacacaaggaatgattgtcttttgggttttcactcttttcctctttcttcacattcttcatttagaggaggaggaggaggaagaacaaaagagcagcagacttcagagtctggtggttatgatgatgatgctgactttcttcacatcaagaagatgaacgatacgacgacgtttttgtcacatcatttccccaagggaacagaggagtggcgggaacaagaacacgaagaagaagaagaagatttgtcgttgtctctgtcgttaaatcatcatcattggagaagcaatggatcatcggtggtgagcgaaacgagtgaagcagcagtctcgacttgttcagcaccattcgtatccaaagattgctttggttcttcaaagattgatcttaatctgtcaatttctctcctcggtagctaaataagttatgcaagatttaggttcagagaaactattcggatgt

SEQ ID NO: 1465 - DNA, 1494 bp, Artificial Sequence
  P4546 (opLexA::G1895, G1895 is from Arabidopsis thaliana)
cacataacacaaatctaatctcatactccatcttcttttctgtcttatgtcttcaaagattggtatgtctcaagttagagatactccggttaaattgtttggctggacaattacaccggtttctcatgatccatactcttcttcgtcccatgttcttcctgattcttcctcgtcttcctcgtcttcttctctatcacttcgaccacacatggtatgtttcatggtcttacctttatttgttaagaaatgctaaagatttaatattttctctagtccttgtatcagtttgaaactagttcatgatgttaatcctaatccaagttccttcaatttttttcagatgaataaccaatctgttactgacaatacaagtcttaagctgtcatctaatcttaacaacgagtcaaaagaaacatctgagaacagtgatgaccaacacagcgagatcacaacaattacatcggaagaagagaaaacaactgaactgaagaaaccagacaagattcttccatgtccgagatgcaacagcgcagacaccaaattctgttactacaacaactacaacgttaaccagccacgtcacttctgtagaaaatgccagaggtattggaccgctggtggatccatgaggatcgtcccggttggctcaggccgtcgcaagaacaagggatgggtttcttcagaccagtacctgcacatcacttccgaggatactgacaattacaatagctcctcaacaaagattctaagcttcgagtcttcggactctttggtaactgagaggcctaagcatcaatcaaacgaagtgaagataaacgctgaacctgtttcacaagaacccaacaacttccaagggttacttcctccccaagcatcccctgtttcgcctccttggccttaccaataccctccaaaccctagtttctaccacatgcccgtctactggggctgcgcgataccggtttggtctaccctcgacacttctacatgtcttgggaaaaggacaagagacgaaacttctcatgaaactgttaaagagagtaaaaatgcttttgagagaacaagcttgcttttggaatctcagagcatcaaaaatgaaacaagtatggctacaaataaccatgtgtggtatccagtaccgatgacccgcgagaagacacaagaattcagctttttcagtaatggagctgaaacaaagagcagcaacaacagattcgtccctgaaacgtatcttaacctgcaagcaaaccctgcagccatggcaagatctatgaacttcagagagagcatataacgttaaaggagaaaagaaactttgtagatacctttttttgtgtgatgaattaacttttaatatctatcttatttatataccacaatccccattttgtagattatccaaacagatggaaatgctgaagtgtaatgtcttttttggtaaatgtggttcgaaaatattgtttactccattatttgtattttgtagtactagtg

SEQ ID NO: 1466 - DNA, 1305 bp, Artificial Sequence
  P4582 (opLexA::G2128, G2128 is from Arabidopsis thaliana)
agtttactctcttggaacttctgagagaagcaaattagatttaaacttacagttgcacagactttatgtattaccaaaaccagcaccaaggaaagaacatcctctcatcttcaagaatgcatataacttctgaaaggcatccattccttagagggaatagtccaggtgattctggacttatcctatcaaccgatgcaaagccacgcctaaaatggactccagatcttcatgagagattcattgaagcagtcaatcaactcggtggagcagataaagctactcctaagacaatcatgaaagtcatggggattccaggccttaccttataccatctcaaaagtcatcttcagaaatacaggctgagcaagaatctcaacggacaagctaacaacagcttcaacaaaataggtataatgaccatgatggaagaaaagactcctgatgcagacgaaattcaaagcgagaatttaagcattggaccacagccaaacaagaattcaccaataggtgaagcactgcaaatgcaaatagaggtccaaagaaggcttcatgagcaacttgagcttaggatagaggctcaagggaagtacctgcaatcggttttggagaaagcacaagagactcttggaagacagaacctcggtgcagctgggatcgaagctgccaaagttcaactctcggaactagtatctaaagtatcagcagagtacccaaactctagtttcctagaaccaaaagaacttcaaaacctatgctcacaacagatgcaaacaaactatccacctgattgctctcttgaaagttgcctgacctcaagcgagggaacgcagaaaaactcgaaaatgctagagaacaacagattaggactaagaacgtatattggtgattcaacatcggagcagaaagagattatggaagaaccattgttccaaagaatggagctcacatggacagaaggtctaagagggaatccatatctttcaacaatggtgagtgaagcagaacaaagaatctcatattcagaaagaagtccaggtagattatcaataggagtaggattgcacggacacaaaagccaacatcaacaaggcaacaatgaggatcataagcttgaaacacgaaaccggaaaggcatggattcaacaacagagctagatctcaacacacatgttgaaaactattgtacaacgcgtacgaaacagttcgacttgaatggtttcagctggaactgagaatagattaaccaaaaagttaaaagagagtttcaatcatttctgagttcacacaggagaagaacccctatta

SEQ ID NO: 1467 - DNA, 1325 bp, Artificial Sequence
  P4598 (opLexA::G2150, G2150 is from Arabidopsis thaliana)
tcttcagaattcccagagaagttgttggaattgaatttttcacttttttgttcataaaagttctagtctttttagatgaacatggacaaggaaacagagcaaaccctaaattacttacctttgggtcagagcgatccctttggcaatggcaatgaaggaacaattggagatttccttggaagatactgcaacaaccctcaggagatttcaccgttaactctacaatccttctctctgaattctcagatctccgagaatttcccaatctctggtggaatcagattccctccatatccaggtcaatttggatccgatcgtgaatttgggtcacaaccaacaacgcaggagagtaacaagagctctttgttggatccagattcagtttcggatcgagttcacaccacgaaatctaactctagaaagaggaagtcgattcctagtggtaatggcaaggagtctccagcttcatcgtctcttacagcttccaattcaaaggtttcaggagagaatggtggatctaaaggtgggaagagaagcaagcaagatgtagctgggagtagtaaaaacggagtagagaagtgcgatagtaaaggcgacaataaggacgatgctaagcctcctgaggcgcctaaagattatattcatgtcagagctagaaggggtcaagcaactgatagccatagtcttgctgaaagagcaagaagagaaaagattagtgagagaatgacgttgcttcaggatctggttcctggttgcaaccggattacagggaaagcagtcatgcttgatgaaattataaattatgtgcagtccttgcagagacaagttgagttcttgtccatgaagctggctaccgtaaatccaaggatggagtttaatgctaatgcttctttatccacagagatgattcaaccgggggagtcgttaacgcagtctctttacgcaatggcttgctcagagcaaagacttccatcagcatactattcacttggcaagaacatgccaagattctcagacacacaattcccctcaaacgatggatttgttcacactgagacaccaggattctgggaaaataatgacctgcaaagcattgttcagatgggttttggagatatcctccagcaacagagcaacaacaacaacaacaactgttctgagccaacgcttcagatgaagcttgaaccatagtccatagctatgattattatctctgttgtacatacagaaaaccaagtagtgatgagtaacggagtgaatcatattggaattttaatgtttacaatcgttgcttctttgcttgtgtctctgttgatttcttctca

SEQ ID NO: 1468 - DNA, 2025 bp, Artificial Sequence
  P4703 (opLexA::G1662, G1662 is from Arabidopsis thaliana)
aactcttgttccaccaggacaataaataccatcttctgatcacacgtcatctttccatattcaagaaaacttcattttccatcggaagattcgtttaggagagaaaatggaaagtggcttttattcagattggaaagatacttcttcttcttcgttctttggatcagagaatatggaggaagagttggaagatggagttcttagagctgaagagcttttctcatcgattcctcaacctcagacacctaaagagccaatggagtttctgtctagatcctggagtctctctacttctgaaatctccaaagcacttgctctcaaacatagacaacaacaagatcagttttgtgttggccagaacagtcctcctgttttgttccctgatgctgctgcagatccactcgtggtacgatccttttatcccttttccaaattccaatgaaaccctttttccaactatttcttagaattatgatgagccttaaaagtcagagacttttcaattgtatatgattgccattgcaccagttcctaacatagttcttgggaattggaatggataataatagtggactcttttcatattttacaactttgggattttgattctaggctgggaagatcatgaactctgttggcacacgtagagcagggacattgtctaaatggtttcaccacaacaaggaacacagcaccagcagtactactaccaatctcaagaagaaagataaagtgcgtgtggagaacgcccacgtgcattctgccgtctctatagcggctctggctgcaggtttagcctctgtgacatctgctagcaattgcaaagggtcaggctccaagatggcactggctttagcctcagccactgaactgttggcctcacactgtgttgagatggctgagcgagccggtgctgaccatgcacgtgttacttccacggttagatcttctgtggatatccacagccccggtgatctcatgactctaacagccgctgctgcaactggtaaggctttgttgcagcttcacaaggctttttcagtttcgttgatatgcatttgatctgactttgtttaaactgacactagctttgagaggagaagcggctctgaaggcgaggcagccaaaggaagcaaggaaaaatgcagctattaccccttttgagagaagtttctctgattctcattggcatgcaaattttcagtatagattggaagaaccaaatcttccatttgaaggcgaactgatgcaatgtgcacgaaatggtaattgtcttctgtcaccgagtctgatcactttaagagttcactggatctgagataagacagagagcttaactcttcttccttgtgctttaacttgcaggagtgcagcgaactaagcgtgtctgtgtctatatcaacaagaagtctcaggtatagcagatttgattagtatctatatataacacataacacaactcagttcacttttgattcaatgcttattatgctacttatgattttgcaggtaatgatcaaactcaaaagcaaacatgttggaggggcattctctaagaaaatcaaatgtaagcatttactaatctttcagtttggataaattacctgaaagacgacactctgaacttgttcttcctttctgaaggcgttgtctatggagtctgcgatgagaaatcagcttggccttacaggaaagagagggaaaattcagaagaagtctacttcggtctgaaaaccggacaaggtcttttggagttcaagtgcaagagcaagattcacaagcagagatgggttgatggggttcagtctcttctccgccaagtaaattgctttgaggctgccaaatgctcgctgggatctctgaatctcactggtcacacgtgatgcaggatcctgtatatatttgattatattcatatatataatatccaaatttttgctgttgtgaggtatttgcaaaacctggcaatgtaacctcagaagacttttggataaaacaaagcaggttgttcaaatgatcacaaca

SEQ ID NO: 1469 - DNA, 1114 bp, Artificial Sequence
  P4704 (opLexA::G1482, G1482 is from Arabidopsis thaliana)
accaccatctctatctctctcttaatcgatcgatgaagatcaggtgcgacgtctgcgataaagaagaagcgtcggtgttttgcacggccgacgaagcatctctctgcggcggctgcgaccaccaagtccaccacgctaacaaactcgcctctaaacatctccgtttctctctcctttatccttcttcttccaacacctcctctcctctctgcgacatctgtcaggataaaaaagctctgttgttctgtcaacaagatagagctattttatgcaaagattgcgattcatcgatccacgctgcgaacgaacacacaaagaaacacgataggtttcttcttacaggggttaagctctctgcaacatcgtctgtttacaaacctacttcgaaatcttcttcttcttcttcaagcaaccaagatttctctgtccctggatcatcaatctctaatcctcctcctctcaagaaacctctctcagctcctcctcagagcaacaagatccaacccttttcgaagatcaacggcggtgatgcgtcggtgaatcagtggggatccacaagcacgatttctgagtatttgatggatacgttacctggttggcacgttgaggatttcctcgattcctctcttcctacttatggtttctctaagagtggtgatgatgatggagtgttaccatatatggaaccagaagatgacaacaacactaagagaaacaacaacaacaacaacaacaacaacaacaatacagtgtcacttccatctaagaatttagggatttgggtccctcagattccacaaactcttccttcttcatacccaaatcaatacttttctcaagacaacaacatacagtttgggatgtacaacaaagaaacatcaccagaagtagtgtcttttgctccaatacaaaacatgaaacaacaaggacagaacaacaagagatggtatgatgatggtggcttcactgtcccacagatcactcctcctcctctttcttctaataaaaagtttagatctttctggtaattttactatctccctaaatgggggagttttttttttgtttgtttgtttctccttcatttctcccaactttgatctcagaattaggc

SEQ ID NO: 1470 - DNA, 1012 bp, Artificial Sequence; identical to SEQ ID NO: 259
  P4715 (opLexA::G2573, G2573 is from Arabidopsis thaliana)

SEQ ID NO: 1471 - DNA, 653 bp, Artificial Sequence; identical to SEQ ID NO: 265
  P4716 (opLexA::G2583, G2583 is from Arabidopsis thaliana)

SEQ ID NO: 1472 - DNA, 1090 bp, Artificial Sequence
  P4719 (opLexA::G2590, G2590 is from Arabidopsis thaliana)
cacacaccaaagaaaagaaaaacaaagataatgaggtcgaaaattaagttatcactcatagctaataagacctcaaggagaaccacattcaggaagaggaagggagggataacgaacaaactccatgagctaacaactctctgcggcgtcaaagcatgtgcggtaatctccagtccgtacgagaatccagtggtgtggccgtcaaccgaaggtgttcaagaggcggtttccatgtttatggagaggccggcgacagaacaatccaagctgatgatgagtcatgagacctacttgcaggacaaaattaccaaagaaacaaagaaactggagagtctacgtcgtgaaaaccgagaatctcagcttaggcaatttatgtttgattgtgttgaaggtaagatgagtgagcatcagtatggtgcaagggaccttcaagatttaagtctttatattgatcactatatcaatcagcttaattcaagtgtcatgctccttacaaacaatggtgcgtcttcttcttcctttcctcctccgcttcatacttcagttgcgggtgcgggtgcgggtgcgggtgctgctcctcttgttgttgcgggtgcgggtgcggctcctcttgctgttgcgggggcgggtgcgagtcctcttgctgttgcgggtgtgggtgcggctcctcttgctgttgcgggtgccggtcctcctatggctcagaatcagtatgagccgattcagccctatatccctactgcttttagtgataatattcaataccaagctcctgtggattttaatcatcagatccaacatggaatctatgataatctcagtttggatccaaatcatcagtatccgtttcaagatgatccattcatggagatgttgatggaatatccttatgaacaagtgggttatgctgcagagcatgcacacatccctttcatgaacggaaactactacaactaccaccaaccaccaaccgttggtcttactaccaccggtcacatgccttccaacaacgccaccaccaccaccaccaccaacaccaccgttgtgtgatgtgtttcagtagtttgcatttgtgttttgtccatttcaa

SEQ ID NO: 1473 - DNA, 1329 bp, Artificial Sequence
  P4723 (opLexA::G2719, G2719 is from Arabidopsis thaliana)
tgcagttaggaaagctggtacaaaccaaatttcattttttttcttttaattaattttggccaaaaagaaaaaaaaatcgaaactttttttgtgtaaatggaaggagaaactcatcaatcggagccgttacctttagcatctggagattccgatgaagggatcagtgctgcgattgaggcggagcttgctgagttagctgctggagattcaagcggcggtggtggttgcggcggcggaggaggagggattaggagtaaagtcaaaggaccttggtctacggaggaagacgcggttcttacgaagcttgtgaggaaactaggaccgaggaattggagtttgatcgctcgtggaatccctggtcgttctggtaaatcttgtcgattgcgttggtgtaatcagcttgacccttgtctcaagcgtaaacctttctctgatgaggaagatcgtatgataatttctgctcacgcggttcacggaaacaaatgggcagtgattgcgaaactgttaactggaagaacagataacgctatcaagaaccattggaactcaactcttagacgtaaatacgcagatctatggaataatggtcaatggatggctaattcagttactaccgcttccgtcaaaaacgaaaatgtcgatgaaacaactaatcctccatcctcaaaacaacagttgcctcaaggagatatcaattcctccccgccaaagcctccacaagtgagtgatgttgtaatggaagaggcagctaatgaacctcaagaacctcaagaacaacaagaacaagctccaccggtagtgagtaacgttccaacagaaaataacgtgtttcgccccgtggctcgcgttggtgcattcagtatctataacccaaccagccagaaaaatggttacagagactacaatatagttccatgtgagggaccgttgattcaagcagctaaacccgattcattggctggtaaatttctacaatctctttgtgatgaacctcaaatcccgtcaaaatgtggtcacggctgctctactcttccagctgaaactaagttctcacgtaactcggtgttgggacctgagtttgtggattatgaagagccttctgcggttttcaaccaagaactaatatctatagcaaccgatttgaacaacattgcatggataaagagtggccttgacaatgctgttgtcagagaagcagaacagagtttgaagatggataattacaattataatgatcctcgaatcaagtttactggaatgatgcctagacaagatttcttctgtgcaagaagctgaaactcaaaagtagggcttgagattcatcaaccc

SEQ ID NO: 1474 - DNA, 1589 bp, Artificial Sequence
  P4734 (opLexA::G2346, G2346 is from Arabidopsis thaliana)
ctattctcctccgtccttactatttccagagttcagtacttagaaagaaagagagtgatgagcagaagcatctctttctctgtctgagtaagaggaagccaaaaccataatggagttgttaatgtgttcgggtcaggccgagtcaggtggttcttcttccaccgagtcttcttcactcagtggtggactcaggtttggtcagaagatctacttcgaggatggatccggatccagaagcaagaaccgggtcaataccgttcgtaagtcgtctaccacggcgaggtgccaagtggaaggttgtagaatggatctaagcaatgttaaagcttattactcgagacacaaagtttgttgcattcactctaaatcatctaaagtcattgtctctggtcttcatcaaaggttttgtcaacaatgtagcaggtttcccccttttttcttcttccttttatttactcattttgccatttccggtgatcggaatagttctaagggaaccatagctttacgcttttttcaggttttatgttccttttgagctttttgagttttggctcttaacgtcattgaagagtcttatcaaaacttaaactttacagctagttattatgtggtcttgtctcttgtcttatgcattatttaggttgcttttctttgaagctttcttttctttatatcaaatcaggtttcaccagctttctgagtttgacttggagaaaagaagttgtcgcagaagactcgcttgtcataacgaacgacgaagaaaaccacaacccacaacggctcttttcacttctcattactctcgaatcgctccatctctttacggttagatcccaatatacacagcccttttcagctcaatgagtctcaaaaacaagttattgaatttcctgtgtgtcaggaaaccccaatgctgcaatgattaaaagcgttttgggagatcctactgcgtggtcaaccgcaagatcagtgatgcagcggcctggaccgtggcagattaatccagttagggaaacccatccacacatgaatgttttatcacatggaagctcaagctttactacatgtccagagatgataaacaacaatagcacagattcaagctgtgctctctctcttctgtcaaactcatacccaattcatcagcagcaacttcagacaccaacaaatacatggcgaccatcttctggtttcgactcgatgatctcattctccgataaggttacaatggctcagccaccgcccatttcaacccatcagccgcccatctcaacacatcagcagtacctcagccaaacttgggaagtcatcgcgggcgaaaagagcaattcacattatatgtctcctgtgagtcaaatctcggagccagcagatttccagataagcaatggcaccacaatgggtggatttgagctgtatcttcatcagcaggttctgaagcaatacatggaacccgagaacacaagagcttatgactcctctcctcaacatttcaattggtctctttgagtctaatctctttcaccttttaagatcttcatcagtttgttactaaaatcttatcaactatctcttgtgtgctactt

SEQ ID NO: 1475 - DNA, 1036 bp, Artificial Sequence
  P4748 (opLexA::G904, G904 is from Arabidopsis thaliana)
ctctcctctcatcaatggaatctctcatcaatcccagccatggcggaggaaaactacgattctcactcttcttctctcgatagtctcaaaccaagcgtactagtcatcattctcattctcctcatgactcttctcatctccgtttccatttgcttcctcctccgctgtctcaatcgctgtagccaccgctccgttctccctctttcatcttcctcttccgtcgcaaccgtaacttccgattcccgacgattctctggacatcgagtctctcccgaaacagaacggtcctccgtgcttgattcgcttccgattttcaaattctcctccgtcactcgccgatctagctccatgaattccggagattgcgccgtttgtttgtcgaaattcgaatcggaggatcagctccgtcttcttcctctctgttgtcacgcttttcacgccgattgtatcgatatctggctagtctctaaccagacttgtcctctctgtcgctctcctctcttcgcttcagaatctgatctcatgaagtctctcgccgtcgtcggctcaaacaacggcggaggagaaaacagcttccgtctcgaaatcggatccatcagccgtcgtcgtcaaacaccgattccagaatccgttgagcagcatcgaacttactcaatcggttcgttcgattacatagtagacgacgtagattcagaaatctcagagtcaaatttcaaccgtggaaaacaggaagacgcgactacaacaactgccacagcaacggcggttacgactaatccgacgtcgtttgaagctagtttagcggcggatataggtaacgatggttctagaagctggctcaaggattacgttgacagactctcacgaggtatatcgtcgcgtgcaatgtcgtttagaagctctggtagattttttactgggagtagtcgtcggagtgaggaattgacggtgatggatttagaagcgaatcatgccggagaagagataagtgagcttttccggtggctctcaggggtgtgagtgacaggtgagttgg

SEQ ID NO: 1476 - DNA, 1520 bp, Artificial Sequence
  P4753 (opLexA::G2141, G2141 is from Arabidopsis thaliana)
ttctgattagtgagtggtgttcatcaagtattagaagaagatggatttaagtgcgaaagatgagttttcagcagagaagaggaatcctgataactatgattctgttaataatccgtctggagattggcgagttgattcatatccttcagagaatctgatttcagctggtcctgcgtcttgttctccttctcagatgatggattcatttgggcaaactctttggtatgatcccacgagtgttcaggctgttggttatgccggttttaatggtggtaatgcttcgtcttcttcgtttaggggtagtattgatagatctcttgaaatgggttggaatctgcctaatttgttgcctcctaaaggcaatggtcttttcttaccgaatgcgagtagtttccttcctccgagtatggctcagttcccggctgattcaggttttatagagcgtgcagcgaggttttcgctctttagcggtgggaattttagtgatatggtgaatcaaccacttgggaattctgaggctattggtttgtttcttcaaggtggtggaacaatgcaagggcagtgtcaaagtaatgaacttaatgttggtgaacctcacaatgatgtatctgtagcagtgaaagaatcaactgttagatctagtgaacaagctaaaccgaatgttcctggatcgggcaatgtatccgaggatactcagtctagtggtggtaatggtcagaaaggcagagaaacctcttccaacacaaagaagaggaaaagaaatgggcagaagaactctgaagcagctcaatcacacagatcccagcagtctgaggaagaaccagacaacaatggtgatgaaaagcgcaatgatgagcaaagtccaaattcacctggaaagaagtcaaacagtgggaaacaacagggcaaacaaagttctgatcctccaaaagatggatatattcatgtacgggcacgaagaggccaggccacaaatagccatagtcttgcagaaagagttaggagagaaaaaattagtgaaaggatgaagtttcttcaagatctagtaccgggttgcaacaaggtgactgggaaggcagttatgcttgacgaaatcataaactacgtacaatcactacaacgccaagttgagtttttatcgatgaaacttgcaactgtgaacccacaaatggactttaaccttgaaggtcttcttgcaaaagatgcacttcaactacgagctggttcttcatctacaacaccattcccaccaaatatgtcaatggcttatcctcctctacctcatggattcatgcaacaaactctttccagcattggaaggaccattacctctccattgtctcctatgaatggtggattcaagcgacaggaaacaaatggatgggagggtgatttgcaaaatgtgatccacattaactatggagctggtgatgtcacacctgaccctcaagcagcagctacagcatctcttccagctgcaaatatgaaggttgagccatgatatttcgtcctgttagata

SEQ ID NO: 1477 - DNA, 1219 bp, Artificial Sequence
  P4755 (opLexA::G2520, G2520 is from Arabidopsis thaliana)
atactcaccaagccacaatcatttctctcttctctatctctctggttttgaatcggcgacgactgagtcaactcggtgttgttactggtttcgtcgtatgtgttgtaactgattaagttgatggatccgagtgggatgatgaacgaaggaggaccgtttaatctagcggagatctggcagtttccgttgaacggagtttcaaccgccggagattcttctagaagaagcttcgttggaccgaatcagttcggtgatgctgatctaaccacagctgctaacggtgatccagcgcgtatgagtcacgcgttgtctcaggcggttattgaaggtatctccggcgcttggaaacggagggaagatgagtctaagtcggcgaagatcgtctccaccattggcgctagtgaaggtgagaacaaaagacagaagatagatgaagtgtgtgatgggaaagcagaagcagaatcgctaggaacagagacggaacaaaagaagcaacagatggaaccaacgaaagattatattcatgttcgagctagaagaggtcaagctactgatagtcacagtttagctgaaagagcgagaagagagaaaataagtgagcggatgaaaatcttgcaagatcttgttccgggatgtaacaaggttattggaaaagcacttgttctagatgagataattaactatatacaatcattgcaacgtcaagttgagttcttatcgatgaagcttgaagcagtcaactcaagaatgaaccctggtatcgaggtttttccacccaaagaggtgatgattctcatgatcatcaactcaatcttctccatttttttcacaaaacaatacatgtttctatcgaggtattctcggggtaggagtctcgatgtttatgcggttcggtcatttaagcattgcaataaacggagtgacctctgtttttgctcctgctccccaaaaacagaacttaagacaactatattttcacaaaacatgacatgtttctgtcgatattctcgagtaggagtcgctattagttcatctaagcattgcaatgaaccgtttggtcagcaagcgtttgagaatccggagatacagttcgggtcgcagtctacgagggaatacagtagaggagcatcaccagagtggttgcacatgcagataggatcaggtggtttcgaaagaacgtcttgataaagaaacaacacttggtcatcatcttactaca

SEQ ID NO: 1478 - DNA, 1418 bp, Artificial Sequence
  P4758 (opLexA::G1817, G1817 is from Arabidopsis thaliana)
ttacgagatccctattatcgatggtttaaatttaggtcatatatacgacgaaagagatttttgttcaacacataggatgaaggacgcagagaagcgagaggtgattgcatcatcatcattacaaagaaagagaaacagaggaagaagactaaggaaaagaagaagaagaaacgagaagcgagtactaatggttccatcatcattaccaaacgacgtgctagaggagatctttttaagatttccggttaaagccctaatccgactcaagtctctctcgaaacaatggagatcgacgatcgaatctcgcagttttgaagagagacacttgacgatcgctaagaaagccttcgtggatcatcccaaggtcatgctcgtaggagaagaagatcccataagaggaaccgggattcgtccagacactgacattggttttaggttattctgcttggaatcggcttctcttctatcctttactcgtctcaatttccctcaagggttcttcaactggatctacatatctgaaagctgtgatggccttttctgcatccattccccaaaatcacattccgtatatgtagtgaatccggctacacggtggctccgcctacttcctccggcagggtttcagattttgatccacaagtttaaccccactgaacgtgagtggaatgtagtgatgaaatcaatctttcatctagcattcgtgaaggccaccgattacaaattagtgtggttgtacaattgtgataagtacattgttgatgcgtcgagtccaaacgtgggagtcacaaagtgcgagatttttgactttaggaaaaatgcttggaggtacttggcttgcactccaagtcatcagatattctattaccaaaagccagcatctgcaaacgggtcggtttattggtttacagaaccatataatgaaagaatcgaagtagtggcttttgatattcagaccgaaacattccggttgctgcctaagattaatccggctattgctggttcagatcctcaccatattgacatgtgcactctggataatagtttgtgtatgtcgaaaagggagaaagatactatgatccaagatatttggaggttgaaaccatcagaagacacatgggaaaagatttttagcatagacttggtttcctgtccttcttctcggactgagaagcgtgatcaatttgattggagcaagaaggatagggttgagccagccacacccgtcgcggtttgtaagaataagaagatccttctctcacatcgctattcccgaggtttggtaaagtacgatcccctaacaaaatctatcgattttttttccggacatcctaccgcttacagaaaagttatttattttcaaagtttgatatctcatctataaaaaaaaaacctactactactactacacctttcaa

SEQ ID NO: 1479 - DNA, 1353 bp, Artificial Sequence
  P4762 (opLexA::G567, G567 is from Arabidopsis thaliana)
cagattcttgaggagcgagcgatgaacagtatcttctccattgacgatttctccgatcctttctgggaaactcctccgattcctctcaatcccgactcttctaagcctgttacggcggatgaagttagccagagtcaaccggaatggactttcgagatgtttctcgaagagatttcttcgtcggcggtgagctctgagccacttggtaacaacaacaacgcgatcgtcggtgtttcttcggcgcaatctcttccttctgtttccggacagaatgatttcgaggatgatagtcgatttcgtgatcgcgattcgggaaatttggattgtgctgctcccatgacgacgaagacggtgaatgttgattccgatgattatcgtcgtgttcttaagaacaagcttgaggctgagtgcgcgactggtgtttctcttcgggttgggtctgtgaagcctgaagattcgactagttctccagaaactcaacttcaaccagttcaatccagtcctcttactcaaggagaacttggtgttacttcttccttaccagctgaggtgaaaaaaactggtgtatcaatgaagcaggttactagtggatcgtcgagagaatattctgatgacgaggaccttgatgaagagaatgaaaccaccggttccttgaagccagaggacgttaaaaaatctagaaggatgctgtcaaatcgtgagtcagctaggcgatctagaaggagaaagcaggagcaaacaagtgacctcgaaacacaggttaatgatctaaaaggtgagcattcatcacttcttaaacaactgagcaacatgaatcacaagtatgacgaggctgctgttggcaatagaatactaaaggctgacattgagacattaagagctaaggtgaaaatggcggaagaaaccgtgaagagagtaacaggaatgaatccgatgcttctcggaagatcaagtggacataacaacaacaacagaatgccaataactggtaacaacaggatggattcttctagcattattccagcttatcaaccacactcaaacctaaaccatatgtcaaaccaaaacatcgggatcccaaccattctacctccaagactcggaaacaatttcgctgctcctccatcccaaaccagctctcccttgcagagaattagaaatgggcaaaatcaccatgttactccaagcgccaacccgtatggctggaataccgaacctcagaacgattcagcatggccgaaaaaatgcgtggactgatcaaacaagaagcgggtttcgcactatattaatgtctatgcatctgtaatttgtaagtgttattaagttacgaatcatgagaaaacatcttgtggt

SEQ ID NO: 1480 - DNA, 975 bp, Artificial Sequence
  P4764 (opLexA::G1004, G1004 is from Arabidopsis thaliana)
cttaagctttttgaaaattttatcaatggcgactcctaacgaagtatctgcactttggttcatcgagaaacatctactcgacgaggcttctcctgtggctacagatccatggatgaagcacgaatcatcatcagcaacagaatctagctctgactcttcttctatcatcttcggatcatcgtcctcttctttcgccccaattgatttctctgaatccgtatgcaaacctgaaatcatcgatctcgatactcccagatctatggaatttcttcgattccatttgaatttgactcagaagtttctgtttctgatttcgattttaaaccttctaatcaaaatcaaaatcagtttgaaccggagcttaaatctcaaattcgtaaaccgccattgaagatttcgcttccagctaaaacagagtggattcaattcgcagctgaaaacaccaaaccggaagttactaaaccggtttcggaagaagagaagaagcattacagaggagtaagacaaagaccgtgggggaaattcgcggcggagattcgtgacccgaataaacgcggatctcgcgtttggcttgggacgtttgatacagcgattgaagcggctagagcttatgacgaagcagcgtttagactacgaggatcgaaagcgattttgaatttccctcttgaagttgggaagtggaaaccacgcgccgatgaaggtgagaagaaacggaagagagacgatgatgagaaagtgactgtggttgagaaagtgttgaagacggaacagagcgttgacgttaacggtggagagacgtttccgtttgtaacgtcgaatttaacggaattatgtgactgggatttaacggggtttcttaactttccgcttctgtcgccgttatctcctcatccaccgtttggttattcccagttgaccgttgtttgattagttttttttgagtttttgaacgatgtgtatgctgacgtggacgta

SEQ ID NO: 1481 - DNA, 1564 bp, Artificial Sequence
  P4766 (opLexA::G1198, G1198 is from Arabidopsis thaliana)
cgagactaatcaagaagagatatcatcaattgaagctgttttcttgagtagagatggcgaaccatagaatgagcgaagctacaaaccataaccacaatcatcatcttccttattcacttattcatggtctcaacaacaatcatccatcttctggtttcattaaccaagatggatcgtccagtttcgattttggagagctagaagaagcaattgttctgcaaggtgtcaagtataggaacgaggaagccaagccacctttattaggaggaggaggaggagctacgactctggagatgttcccttcgtggccaatcagaactcaccaaactcttcctactgagagttccaagtcaggaggagagagcagcgattcaggatcggctaatttctccggcaaagctgaaagtcaacaaccggagtctcctatgagtagcaaacatcatctcatgcttcaacctcatcataataacatggcaaactcaagttcaacatctggacttccttccacttctcgaactttagctcctcctaaaccttcggaagataagaggaaggctacaacttcaggcaaacagcttgatgctaagacgttgagacgtttggcccaaaatagagaagctgctcgcaaaagccgtcttaggaaaaaggcgtatgtgcaacagctagaatcaagtaggataaagctttcccaattggagcaagaacttcagcgagctcgttctcaggggctgttcatgggtggttgtggaccaccaggacctaacatcacttccggagctgcaatatttgacatggaatatgggagatggctagaggatgataaccggcatatgtcggagattcgaaccggtcttcaggctcatttatctgacaatgatttaaggttgatcgttgacggttacattgctcattttgatgagatattccgattaaaagccgtggcagcgaaagccgatgtttttcacctcatcattgggacatggatgtccccagccgaacgttgttttatttggatggctggtttccgtccatccgacctaatcaagatattggtgtcgcaaatggatctattgacggagcaacaactgatgggaatatatagcctacaacactcgtcgcaacaagcagaggaggctctctcgcaaggcctcgaacaacttcagcaatctctcatcgatactctcgccgcatctccagtcattgacggaatgcaacaaatggctgtcgctctcggaaagatctctaatctcgaaggctttatccgccaggctgataacttgaggcagcagaccgttcaccagctgaggcggatcttgaccgtccgacaagctgcacggtgtttcctagtcatcggagagtactatggacggctcagagctcttagctccctttggttgtcacgcccacgagagacactgatgagtgatgaaacctcttgtcaaacgacgacggatttgcagattgttcagtcatctcggaaccacttctccaatttctgaatggaatgaaactttgtataactaaaaggccaagtttcattgtctgtcgtaatttcacctatttc

SEQ ID NO: 1482 - DNA, 2844 bp, Artificial Sequence
  P4779 (opLexA::G1084, G1084 is from Arabidopsis thaliana)
cttgagctctggatttgagcttaggaaagaagagtagagagaaatgggatgttctcattccaagttagatgatgaagaagcagttcagatctgtaaagacaggaaacgtttcatcaaacaagctattgaacatagaactaagtttgcttctggtcacattgcttatattcactctcttagaaaagtctctgatgctctccatgactttatcctccaaggagacaacaacaatgagtttgttcctactctctgtcaagactcattcgtcactccggtcaagagaatgccacagagacgtcgtcgaagcagccgtagtaatagcggtgagttcatctccatttcgccttcttcgattcctccgaaaatgattcaaggtaggccaagatcgaatgtgaaagcgaattatttgatggctaatagaagtagaccggttagagtcgaacagagatctcctgaaacgtttagagttgagacattttctccacctagtagtagtaaccaatatggtgaatcagatggtttctttggaatgaatatgaatatgaatacttctgcgtctacttcatcttcgttttggaatccgttgagctctcctgagcaaaggttaagtagtcataacattcctcctccttcaccgcagaattcgcagtgggatttcttctggaatccgttttcttcgttggattattatggatacaatagttatgaccgaggaagtgttgatagtaggagtggtatagatgatgagattagaggattgagacgtgttagagaggaagaagggattcctgatttggaagaagatgatgaacctcataaacctgaacctgtcgtcaatgtgcggtttcagaatcataatccgaatccgaaagcaacggaagagaatagaggtaaagttgataagagttgttgcaatgaggaagttaaagttgaagatgttgatgaggatgaagacgaggatggagatgaggatgatgatgagtttacggatagcgggtgtgagactgagaatgagggagacgagaaatgcgttgctcctccaacgcaagaacagcgaaaagctgaggtgtgtagaggaggagaagctacagggaatgttgttggagtaggtaaggttcaagagatgaagaatgttgttggtgttagagatgatgcaaagacgacggggttcacggtatatgtgaaccggagaccaactagcatggctgaagtaatcaaagatcttgaagatcagttcacaacaatttgtgatgcggctaaggaagtctcggggctattggaagctggtagagctcaatacacatcatcctttaatgaccatagtggtgagtttatgaacaatgttgcaatatttctctgtttaatgacttcacttataaatatgaagtccttttttatgtgtgtttgtagccaggaaaatgctgaatccagtagcgttgttccgctcgggttcatcaagatcttcctcgtcaagattcttgatcacttcttctggtggttcaagagagagcgggtctgaaagcagaagcgatgtttcagatgaatcttgcatgatttcaggtagccaccaaacaacattggacagacttttcgcgtgggagaagaaactctatgatgaagttagggtaagtaacaagagatataagcaactagtgactacatattaatctctgttggttataactgagccgtctttgtggtgttgtaacagtctggagaacgtgttcgaagagcatatgaaaagaaatgtatgcagctgaggaatcaggacgtgaaaggagatgatccgcttgcggttgataaaactagggctactatcagagatctagatacacagatcaaggtgtcaatacactccattgaatccatctccaaaagaatcgagactcttcgtgaccaagaactgttgcctcagcttcttgagctcgttgaagggtaacaacaccaacaacttctttttccttctcttcggtttcacttttaagcctcagactgacaaatggtaatcatgatcataacagattaacaaggatgtggaaagtaatggcggaaagtcaccagatacagaaacgaacactagacgaagccaaactgttacttgcaggcacaccggtttcaaagcgtcacaagaagagacaacctccaataatgccagaggctattaactctcaaagattagctcaatctgctttgaatcttgaagctcagcttcgaaactggagaacctgttttgaattctggatcacctctcagagatcctacatgaaagcattatctggttggcttctaagatgtttcagatgtgatcctgaccccgaaaaagttagattatcctcatgtcttcacccgatataccgagtctgcattcaatggtcaaggttgcttaacagcttgaatgaaaaaccagttttggacaaacttgagttctttgcctcagggatgggttcaatatatgcaaggcaagttagggaagatccaaactggagtggaagcgggtcaaggagatactccgggtcagaaagcatggagcttgtagtggctgataagggagaagaagatgttgtgatgactgctgagaaacttgcagaggttgctgtgaaggttctctgccatggaatgtctgttgcagttagttcactagctgagttttccatcaactcggccgatgaacactcgaagcttgttagccaaccagcagacgatgcgtcggagcagcagcccccggatgtaaatttcaattcctagtacttgttattaattttgtttggttttagagagtttagaattaggtaggtttttggcatcatcttttgctatcagaagatagtttcttagatggatgag

SEQ ID NO: 1483 - DNA, 433 bp, Artificial Sequence
  P4781 (opLexA::G1911, G1911 is from Arabidopsis thaliana)
atcatcctcttgactcgtaatctccccatacttaaataatctctttctaaccagttatattagtctataactcaacatggcatcaagctcaatgtcttctcagagctctggctcgtggactgctaagcagaacaaagcctttgagcaggctctagcaacctatgaccaggacactcctaaccgttggcaaaatgttgccaaagtcgtgggtggaaaaacaacagaggaggtaaagagacactacgaactcttagtgcaagacatcaacagcatagagaacggtcatgttccattcccaaactacaggactagtggaggctgcactaatggcaggcttagtcaggaggaaaaaaggtatgtattgtcctaaaaaagacacattctgctataattaagaatacaaaacaatccaagccaaagacaccaatctgat

SEQ ID NO: 1484 - DNA, 771 bp, Artificial Sequence
  P4788 (opLexA::G1655, G1655 is from Arabidopsis thaliana)
tcacattgagagagagagagagagaaagagagactctcagaatctgaagaagaagaagagattgttgtttttgccttttatcatcggtttctttgaatctctggttttaaatcggatttaatggtggagtctctgttcccgagcatcgaaaacacaggtgaatcgtctcgaagaaagaagccgaggatatcagagacggcggaggcggagatagaggcacgacgtgtcaacgaagaaagcttgaagagatggaaaacgaatcgtgtgcaacagatctacgcttgtaagctcgtcgaagctttacgccgagttcgtcagagatcttccaccaccagcaacaacgagaccgataaactcgtctccggcgcggcgagggagatacgtgatacggcggatcgagttctagctgcgtccgctcgtggtacgactcggtggagcagagcgattttagcgagtcgcgtccgagcgaagctgaagaaacatagaaaggcgaaaaagtcaacgggaaattgtaaatcgagaaaaggtctcacggagacgaatcggattaagttaccggcggttgagagaaaactgaagattcttggccgtttggttcctggttgccggaaagtctctgtaccgaatcttttagatgaagcgaccgattacatcgcagcgttagagatgcaggttcgagccatggaggctctcgccgaacttttaaccgcagccgcaccacggacgacgttgaccggaacttaacggcggcagttagtttgtcagttgtta

SEQ ID NO: 1485 - DNA, 987 bp, Artificial Sequence
  P5094 (opLexA::G663, G663 is from Arabidopsis thaliana)
gggaagccacaataaccccctattcctcggccttttttaaaaaagttttagaataatccgataaaatacttttatattaatttttctttggtccatggagggttcgtccaaagggttgaggaaaggtgcatggactgctgaagaagatagtctcttgaggctatgtattgataagtatggagaaggcaaatggcatcaagttcctttgagagctgggctaaatcgatgcagaaagagttgtagactaagatggttgaactatttgaagccaagtatcaagagaggaagacttagcaatgatgaagttgatcttcttcttcgccttcataagcttctaggaaataggtggtccttgattgctggtcgattgcctggtcggaccgctaatgatgtcaaaaattactggaacacccatctgagtaaaaaacatgagtcttcgtgttgtaagtctaaaatgaaaaagaaaaacattatttcccctcctacaacaccggtccaaaaaatcggtgtttttaagcctcgacctcgatccttctctgttaacaatggttgcagccatctcaatggtctgccagaagttgatttaattccttcatgccttggactcaagaaaaataatgtttgtgaaaatagtatcacatgtaacaaagatgatgagaaagatgattttgtgaataatctaatgaatggagataatatgtggttggagaatttactgggggaaaaccaagaagctgatgcgattgttcctgaagcgacgacagctgaacatggggccactttggcgtttgacgttgagcaactttggagtctgtttgatggagagactgttgaacttgattagtgtttctcaccgtttgtttaagattgtgggtggcttttctttcgtattttagtaatgtatttttctgtatgaagtaaagaatttcagcattttaagaaaaatggttatgtttctacgtaataaaaaaaaacgttatttataaa

SEQ ID NO: 1486 - DNA, 658 bp, Artificial Sequence
  P5110 (opLexA::G786, G786 is from Arabidopsis thaliana)
gaggatggtggtgattcagaagaagtcagcactgctcgtacttcttccagggattatggaaacaccacagcagaatcttgttgttccagttatggttacaacaacaacaacaacaacaactcaaggaagcagagtttatcgggcagtgctagtagtagtaacaatgatgggaaaggacgtaaaaagatgaagaagatgatgggagtattgaggagaattgtccctggaggagaacagatgaatacagcttgcgttcttgatgaagctgttcagtatctcaagtcacttaaaatcgaagctcagaaacttggcgttggacatttctcaaaccaatcttgaatgctaccgatatttggttcttccatcactattgtttctcgggaggtaaatcatcggtctagcgctatctggacctttctctttattttcctccctctatactcacttccttttgttggcaggatggtatctattttatgtttgaatctctctatgtattttgctttttgtgtgttactgcttcgatgaagaagcaaggtttgaacaagtacttgtggatttgatttgagattttaatttgtatggttttactttcactgtaatcatttgactatgaactacaattatcattatgtatttgcttctacatagttttaaa

SEQ ID NO: 1487 - DNA, 786 bp, Artificial Sequence
  P5130 (opLexA::G35, G35 is from Arabidopsis thaliana)
ggattctaaaagataagagaaacagtaagtcggttaattttggattaagtaacgcacaagccaaagccttctcctgatcgaatcataaaccaaacaaatctttcttttaaaagaagcggacacaaaccctaaccaccaaccctctccgtcgtcaaatttcccggcgaaagatgaaacgaattgttcgaatttcattcacagacatggaagcaaccgattcttcaagcagcgaagacgagtcaccaccgtcatcacgccgtcgaggtaagaagctagtcaaggaaatcgtaatcgatcattctgatcccccggaggtcggaaaaactcggttcaaaatcaggattccggcgagtttacttgctgcgaggaatacgacggcgaataagaagaagttccgtggcgtgaggcagagaccatgggggaagtgggcggctgagattagatgtggtagagttaaaggaagacctgaacgaatttggcttggaacttttgaaacagctgaagaagctgctcttgcttatgataacgctgcgattcagttgattggacctgatgcgccgactaattttggccgtcctgatgttgattctgcggtggtgaaaaagcaagattctgatgctagtggtggtgcttctgaagaagttgtttgattttcttgtttataactaactttgcaaggttacttttgtttatcatcatcttttgtaaatttgatcatcttgctctttgctttttaacttctcttgtacatgtttgaattataaaagttctaatttttcaatcaaa

SEQ ID NO: 1488 - DNA, 1745 bp, Artificial Sequence
  P5145 (opLexA::G261, G261 is from Arabidopsis thaliana)
attttgggcttctgattttgatcgaaacttactgatagtaagttctttgagtcctccttaactgtagtttctgtgtactgaagttattgaattgaaagtttttatcttttttggttattgaaactttcatagtttgatcaaaagagtctcttgctctgtttttggctctgtttttgtgagtgtgattgtaagctttgttgtgagtagattgaatcaaggagtgtgagagttgttaaaagtgttttcagagatggatgagaataatcatggagtttcatcaagctcacttccacctttcctcaccaaaacatatgagatggttgatgattcttcatccgattctatcgtctcttggagtcagagcaataagagtttcatcgtttggaatccgccggagttttctagagatcttcttccgagattcttcaagcacaataacttctctagctttatccgccagcttaacacatatgtaagtgttttcatgctttgtttaaaagtattgactaaatcaatcatcttcttagtggaatttgtttttgtgtgtagggttttagaaaagctgatcctgagcaatgggaatttgcggaatgatgattttgtgagaggtcaacctcatcttatgaagaacattcatagacgcaaaccagttcatagccactctttaccgaatcttcaagctcagttaaacccgttgacggattcagaacgagtgagaatgaataatcagattgagagattgacaaaagagaaagaaggattgcttgaagagttacataaacaagacgaggaacgagaagtgtttgagatgcaagtgaaagaacttaaagaacgattacaacacatggagaagcgtcagaaaacaatggtttcgtttgtttctcaagtattggaaaagccagggcttgctttgaacctatcgccgtgtgttcccgaaacaaacgagaggaaaagaaggttccctaggatcgagttctttcccgatgaaccgatgttggaagagaacaaaacttgtgttgttgtgagagaggaaggttctacaagcccttcttcacacacaagagagcatcaagtggaacagttagagtcatcgatagcgatttgggagaatcttgtatcggattcttgtgagagtatgttacaatcaagaagtatgatgacacttgatgtggatgaatcatctacttttccagagagccctcctctttcttgcatacagttaagtgtcgattcacgtctcaaatctcctccttctccaaggatcatcgatatgaactgtgagcccgatggttcgaaagaacagaacactgttgctgctcctcctcctcctccagtagcaggagcgaatgatggcttctggcagcagtttttctcagagaatcctggctcaaccgagcaacgggaagttcaattagagaggaaagacgataaagataaagccggagtacgtactgagaaatgttggtggaattcgagaaatgttaatgcaattacagaacagcttggacatctgacttcttcagagagaagttgatatgtcaaagattaaatttctagtctgttttagttacttgtaaaatagggtttctcagttttattgttttcgattacagtacttaggtatggttcagctgtttatttatcacttgtatgatctttcacagttcattgtagcagacttcaatggtaatgataagctagagcttatggatagtattcataaaatgagattgaccttcaacaaa

SEQ ID NO: 1489 - DNA, 1031 bp, Artificial Sequence
  P5262 (opLexA::G368, G368 is from Arabidopsis thaliana)
ttgcgtttccacatttgtttaaacataactctctctctctctctctctctctctctctctcagtacctcttattcttatgctcttcttcaccaatcctatctcttctatctgtctttattttctctacatgtgaattgacccatttctggtaaacacatagagtaccacttttcttatttagattcttcttcctcttcatagcttccaagtcaactacttcagcttctgtcggctgtctcttcccagatctcgttaagaccaaaacttggaataaatgacggaatctgatgatgcctcacgagaaacaccagccagcagaggaggagaagcctcgtcaaatcaagatctgtccaaaccagaatcaaaccatgtttcactcgatctcaagctcaacgatactttcaacgatgacacaaagagcacaaagtgtgaagcaaacccaagagtcttctcttgcaactactgcagacgcaagttctatagctctcaagctcttggaggtcaccagaacgcacacaagcgagaaagaacaatggccaaacgagcaatgcacatgggaagaatgtttggtcaccatcacaggccttacacatacacttcttcttcccttgggatgcaagctcactccggtttacttcatcacaccttatctcagcctcagcctcttgtttctaggtttcatcatcaagggtattttggtaacaccgtgccgttgttctttgactatgacgatggtggtagcgacttcttctggcccggcagcttccgtcaggtggttgaggaagctgaggctccggtggttgtggtggctagtactgagtcaggccttgatttgaactcggttgcggcaaatggaggtgtagataataatagctcaaagcctgatcttaccttaagactctaaaaggattaaggagattatatctttattgttatttttctattgttagacattcagaagataagttggagacagttgatagaaattgatgaaaaactttgttgttatattaaatgaggttgttcatta

SEQ ID NO: 1490 - DNA, 1200 bp, Artificial Sequence
  P5272 (opLexA::G501, G501 is from Arabidopsis thaliana)
aaaaatccagatccagctgaaattgaattttcaaccaacgaagaagagatttttccaagagcaacagacaagaagaagagaatgaagtcggagctaaatttaccagctgggttccgattccatccaacggacgaggagcttgtgaaattctacttgtgccggaaatgtgcttccgagcagatctcggctccggttatcgccgagattgatctctacaagttcaatccttgggagcttccagagatgtctctgtacggagagaaagagtggtacttcttctcacctagagatcggaaatacccaaacggttcgcgtcctaaccgggcagcaggaaccggttattggaaagctaccggagcagataaaccgattggtaaaccgaagacgttgggtatcaagaaagcactcgtcttctacgcagggaaagctccaaaagggattaagaccaattggataatgcatgagtatcgtctcgctaatgttgatagatcagcttctgttaacaaaaagaacaacctacgacttgatgattgggttttatgtcgaatatacaacaagaaaggaaccatggagaagtatttccccgcggatgagaagccgaggaccacgacaatggctgaacagtcatcatcaccttttgatacatcagactcgacttacccgacattgcaagaggatgattccagcagctcaggtggtcacggtcacgtggtgtcaccggatgttttggaggttcagagcgagcctaaatggggagagcttgaggatgctttggaagcttttgatacttcaatgtttggtagttccatggagttgttgcagcctgacgcttttgtccctcagttcttgtatcagtctgattatttcacttccttccaggatccgcctgagcagaaaccattcttgaattggagttttgctccacaggggtaaaaacggaagagaccaaaaaaggtgtttgctagtagtactgtgatgtgccagagagaagagtctcatctcaactcatccctggctcttagtagtaaaagaagattgtagaatgttaatagcttttagcatcaatgtctcattagcaggcacattcttgttctttcatgagaagtttatatgaaaactaaaaatttatattcaaattcttcaagatgttgcacttatgtagatactgatattaaataacaacctaacctttatgagaaa

SEQ ID NO: 1491 - DNA, 1798 bp, Artificial Sequence
  P5507 (opLexA::G513, G513 is from Arabidopsis thaliana)
atcgtgtcaaattttagggttttttcttttcgtacttcatcaaattctggaatctggttttttcttagttttcttctatatacctttgaatcgcatctttgatccaaattcattttagatatcaccttgaagtcgaatttgtgattttttcttttcctctcgaattctcaaagtctcacgcaactatgaaagaagacatggaagtactatcgctcgcttcactaccggttgggttcagatttagtccaacggacgaagagttagtccggtactatctccggctcaagatcaacggtcacgataacgacgttagagtaattcgtgagatcgatatctgcaaatgggagccttgggatttgcctgatttttctgtggtgaagacaacagactcagagtggctcttcttttgtcctttggaccggaaatatccgagtggaagtcgaatgaatagagctactgtggctggatactggaaggcgacgggaaaagaccgtaagatcaaatcaggaaagactaagattataggtgttaagaggactctagtgttttatacaggtcgtgctcctaaagggacacgaacttgttggattatgcatgagtatcgtgctactgagaaggatcttgatggaacaaagtctggccagaatccgtttgttgtttgtaagttgtttaagaagcaagatattgtgaacggagctgctgaaccagaagagtcaaagtcatgtgaagttgaaccagcggtatcgtctccaactgttgtggacgaggttgaaatgtctgaggtatctcctgttttccctaaaacagaagagactaatccttgtgacgtcgcagagtcttctcttgtaatccccagcgaatgtcgtagtggatactctgtccctgaggttacaaccaccgggcttgacgatatcgattggctctcgtttatggagtttgattccccgaagctgttctctccgttgcactctcaggtgcaatctgagctcggttcctctttcaatggcttacaatctgagtctagtgaattgttcaaaaaccacaatgaggattacattcagactcagtacggtacaaatgatgcggatgaatatatgtccaagttcttggattcttttcttgacattccctatgagccagaacagatcccatatgagccacagaatcttagctcatgcaacaagatcaatgatgaatctaagagaggaattaagattagagctcgacgagcacaagccccgggttgtgctgagcagtttgtaatgcagggcgatgcctcaagaaggctgcgtcttcaggttaaccttaacagccacaagtcagaaactgacagtacacaacttcaatttatcaagaaagaggttaaggacacaacaacggaaactatgacgaaaggatgtggaaatttcacaagatcaaagagcaggactagtttcatattcaagaaaattgcagccatgggatgttcatacagagggcttttcagagtcggtgtggtagcggttgtgtgtgtgatgtcggtctgcagtctagtcgcataaatccgctgaatgtgatgtttgttccgatcaattcatatagtaagaataaagaaagtggtttttacgggtggagagagcgcggatttgtgtgtataacaggggttttggcctggttctgcatctgttgttattgttgttgtttttgtcggcttaagcttaaccatggtcggtttaggagtgtagtagacttgtagttaacatgtacgacgactcataatattcagatggtaatgtttggaaatttttttattcctaaa

SEQ ID NO: 1492 - DNA, 1066 bp, Artificial Sequence
  P5678 (opLexA::G1197, G1197 is from Arabidopsis thaliana)
cagccgagaaaataaaagaaacgaagaaaagtttgttcctttgtggggatcaaagaagaatgtactcggcgattcggtcttcgcttcctctagatggcagcttgggagactactctgacggaaccaatcttcccatcgacgcttgtctggtcctaaccactgaccccaagcctcgccttcgttggacctctgagctccatgaaagattcgttgacgccgtcactcagctcggcggacccgacaaagcaacgcctaaaactataatgagaacaatgggagtgaagggtctcactctttaccatctcaaatctcatcttcagaaattccgcttggggaggcaatcttgtaaagaatcaattgacaactctaaggatgtttcttgtgttgcggagagtcaggacactggttcatcttcaacatcatccttaagattggctgctcaagaacagaacgagagttaccaggtcactgaagctttgcgtgcccagatggaagtccaaagaagactacacgagcaactagaggtgcaaaggcgactccagttaaggatcgaggcacaagggaagtacctgcaatcaattctagagaaagcttgcaaggctatagaggagcaagctgttgcatttgctgggttagaggcagctagagaagagctttcagagctagccataaaggcctccatcaccaatgggtgccaaggaacaacaagcaccttcgacacaaccaaaatgatgattccatccttatccgagcttgcagtagcaatagagcacaagaacaactgttcagcagagagctctctgacttccagcactgtaggaagtccggtatcagctgcgttgatgaagaagagacaacgaggagtgtttggaaatggagatagtgtggttgttggtcatgatgctggatgggttatgcctagtagtagcattggatgaagttagcaagagagagagagagagcgagaccagattttagcttatttaattttgctatgttgtatttaactctaaactctgtcatcaaacttgtcttagcgtctatgtatatatttgttgaatctaaa

SEQ ID NO: 1493 - DNA, 2990 bp, Artificial Sequence
  P5706 (opLexA::G619, G619 is from Arabidopsis thaliana)
atttttttccaatctgcaaattttagtctatgtctgttccttgtgctccctcttctcagtacctgcaaatggaggaagaagaatccttctctgaaacccttgttctcatttgattcctccttcctctctcttcttctctctctgtctctgattcgttattccacacttatgactcatctttcccgtcaatagctaagtttgcctcttctttgtgaaatttagctgaaaaaggagaggaattccgaattctgtcacttcaaagctcgaattttgcaaactttcctttgatgggttttacttgttttgttgtaatctgattaaaaatagaaactttttgttttcttcttgtctccttttgctcttaaaagagaagctttttcaatggaatttgacttgaatactgagattgcggaggtggaagaggaggagaatgatgatgtaggagtaggagtaggaggaggaacaagaattgacaagggtaggcttggaatttcaccatcttcttcttcttcatgctcttccggatcatcatcgtcatcatcttctacaggctctgcatcttccatttactctgagctttggcatgcttgtgctggtcctctcacttgtcttcccaagaaaggcaatgtagttgtctatttccctcaaggtcatttggagcaagatgctatggtttcatattcgtctcctcttgaaatccccaaatttgaccttaatccccaaatcgtctgcagggtggttaatgtccagttgcttgctaataaggacaccgatgaggtctacactcaagtcactctgcttccacttcaagagttttcgatgctaaatggggaggggaaagaggtcaaggagttaggaggggaggaagagaggaacggaagctcatccgtcaagcggacacctcatatgttctgtaaaaccttaacagcgtctgacacaagcacacatggaggcttctctgtacctagaagagccgctgaagattgttttgctcctcttgactacaaacaacagaggccatctcaagagctcattgcaaaggacctccatggagtagagtggaagtttcgccatatctatagaggtcaaccaaggaggcatctactcaccactggttggagtatctttgtcagtcaaaagaatctcgtctctggtgatgcggttctctttctgagagacgaaggaggagagctgagattaggaatcagaagagcagcacggccaagaaatggacttcctgactcaatcattgagaagaattcatgttcaaacattctgtctcttgtggctaatgctgtatctacaaaaagcatgtttcatgtgttctacagtccacgagcgacgcatgcagagtttgtgattccttatgagaagtatatcacaagcatcaggagtcctgtttgcataggcacaagatttagaatgcgatttgaaatggacgattctcctgagagaagatgcgctggtgtagtgactggagtctgtgacttggacccgtataggtggccaaactctaaatggaggtgcttgttggtgcgatgggatgagtcttttgtgagtgatcatcaagaaagagtttcaccttgggagattgatccctcggtttctctcccacacttgagcattcagtcatctccaaggcctaaaaggccatgggcaggtttactggatactaccccacccggaaaccccataacaaaaaggggtggttttttggactttgaggagtcggttagaccctctaaggtcttgcaaggtcaagaaaatataggttctgcatcaccctcacaggggtttgatgttatgaaccgccggatactggattttgcgatgcagtctcatgcaaatccagtccttgtgtcgagtagagtcaaggatcgatttggtgagtttgtagatgctactggcgtgaacccagcttgttcaggtgttatggacctggataggtttccaagggtcttgcaaggtcaagaaatttgctcgcttaaatcattcccgcaatttgctggtttcagtccagctgctgctcctaatccctttgcttaccaagccaacaagtcaagttactatccgctagctttgcatgggattaggagcactcatgttccgtatcagaatccatacaatgcgggaaaccaatcctcgggtcccccttcacgtgcaataaactttggtgaagagactagaaagtttgatgcacaaaatgaaggtggcctaccaaataatgttacagctgatttgccattcaagattgatatgatgggaaaacagaaaggcagtgagttgaatatgaatgcttcatcaggatgtaaacttttcggattctccttaccagtggagacacctgcatctaagccgcaaagctcgagcaaaagaatctgtacaaaggttcacaagcaaggaagccaagtggggagagctattgatttgtcgcgacttaacgggtatgatgatctccttatggagcttgaacggctgttcaacatggaagggcttctcagggatcctgaaaaaggatggaggatcttatatactgatagtgagaacgatatgatggtcgttggcgatgatccatggcatgatttctgcaatgtggtgtggaagatacacttatacacgaaagaggaagtggagaatgcgaatgacgataacaagagttgtttagagcaagctgctctcatgatggaagcatcaaagtcatcttctgtgagccagcctgattcttctcctacaatcactagggtttgatacccataaagaagcttatttcctatgttttaaagtgtgttttgctcacaaaagaacttcaactttatctttgtctttgaatccatttatgtgtttgtttgtgtttcttctggtctccatggatgtctcatgtgtaccgttttactcgagagatatgtgagtttatgggatgtgtaaagcatgccattggattttaaggttttcaaaattacaatatatatattagttttgaagttaaaaaa

SEQ ID NO: 1494 - DNA, 1833 bp, Artificial Sequence
  P5731 (opLexA::G214, G214 is from Arabidopsis thaliana)
gtgatggagacaaattcgtctggagaagatctggttattaagactcggaagccatatacgataacaaagcaacgtgaaaggtggactgaggaagaacataatagattcattgaagctttgaggctttatggtagagcatggcagaagattgaagaacatgtagcaacaaaaactgctgtccagataagaagtcacgctcagaaatttttctccaaggtagagaaagaggctgaagctaaaggtgtagctatgggtcaagcgctagacatagctattcctcctccacggcctaagcgtaaaccaaacaatccttatcctcgaaagacgggaagtggaacgatccttatgtcaaaaacgggtgtgaatgatggaaaagagtcccttggatcagaaaaagtgtcgcatcctgagatggccaatgaagatcgacaacaatcaaagcctgaagagaaaactctgcaggaagacaactgttcagattgtttcactcatcagtatctctctgctgcatcctccatgaataaaagttgtatagagacatcaaacgcaagcactttccgcgagttcttgccttcacgggaagagggaagtcagaataacagggtaagaaaggagtcaaactcagatttgaatgcaaaatctctggaaaacggtaatgagcaaggacctcagacttatccgatgcatatccctgtgctagtgccattggggagctcaataacaagttctctatcacatcctccttcagagccagatagtcatccccacacagttgcaggagattatcagtcgtttcctaatcatataatgtcaacccttttacaaacaccggctctttatactgccgcaactttcgcctcatcattttggcctcccgattctagtggtggctcacctgttccagggaactcacctccgaatctggctgccatggccgcagccactgttgcagctgctagtgcttggtgggctgccaatggattattacctttatgtgctcctcttagttcaggtggtttcactagtcatcctccatctacttttggaccatcatgtgatgtagagtacacaaaagcaagcactttacaacatggttctgtgcagagccgagagcaagaacactccgaggcatcaaaggctcgatcttcactggactcagaggatgttgaaaataagagtaaaccagtttgtcatgagcagccttctgcaacacctgagagtgatgcaaagggttcagatggagcaggagacagaaaacaagttgaccggtcctcgtgtggctcaaacactccgtcgagtagtgatgatgttgaggcggatgcatcagaaaggcaagaggatggcaccaatggtgaggtgaaagaaacgaatgaagacactaataaacctcaaacttcagagtccaatgcacgccgcagtagaatcagctccaatataaccgatccatggaagtctgtgtctgacgagggtcgaattgccttccaagctctcttctccagagaggtattgccgcaaagttttacatatcgagaagaacacagagaggaagaacaacaacaacaagaacaaagatatccaatggcacttgatcttaacttcacagctcagttaacaccagttgatgatcaagaggagaagagaaacacaggatttcttggaatcggattagatgcttcaaagctaatgagtagaggaagaacaggttttaaaccatacaaaagatgttccatggaagccaaagaaagtagaatcctcaacaacaatcctatcattcatgtggaacagaaagatcccaaacggatgcggttggaaactcaagcttccacatagact

SEQ ID NO: 1495 - DNA, 722 bp, Artificial Sequence
  P5748 (opLexA::G367, G367 is from Arabidopsis thaliana)
ttagctctcatggacgcttcaatagtttcctcatccactgcttttccatatcaagattctctaaaccagagcatcgaagacgaagaaagagacgttcataattctagtcacgaactcaatctcatcgactgcatagacgacacaacgagtatcgttaacgaatctacaacatccacagaacaaaagcttttctcatgcaactattgtcaaagaactttctatagctcacaagcacttggtggtcaccaaaacgcacacaagagagagagaacgttggcgaagagaggacaacgtatggcagcgtcagcctcagcttttggacatccttacggtttctctccacttcctttccacggacagtacaacaaccataggtctttagggatccaagcgcattcgataagccacaagctaagttcttataacgggtttggtggtcactatggtcagatcaactggtcaagacttccatttgatcaacaaccagccataggtaaatttccctcaatggataattttcatcatcatcatcatcagatgatgatgatggctccttcagtaaattcacggtccaataacatcgatagcccaagcaacacaggacgggttctagaagggtcaccgactcttgaacaatggcacggagacaaaggattgttgttaagtacaagtcatcatgaagagcagcagaaacttgacttgtccctcaagctttgagattc

SEQ ID NO: 1496 - DNA, 324 bp, Artificial Sequence
  P5749 (opLexA::G1883, G1883 is from Arabidopsis thaliana)
acacacatcaaccaaacaccacatccaatgcaaggccaaacaccattctcacatctaacggcgtctcaactgctggagcaaccgtctccggcgtaagcaacaacaataacaatacggcggttgtggcggagaggaaagcaagaccacaagagaaactaaattgtccaagatgcaactcaaccaacacaaagttttgttactacaacaactatagtctcacacaaccaagatacttctgcaaaggttgtcgaaggtattggaccgaaggtggatctcttaggaatgttcctgtgggaggaagctcaagaaagaacaagagatcat

SEQ ID NO: 1497 - DNA, 1178 bp, Artificial Sequence
  P5868 (opLexA::G398, G398 is from Arabidopsis thaliana)
tcattttctaccaagagacaatatcatgatgatgggtaaagaggatttgggtttaagtcttagcttgggatttgcacaaaaccatcctctccagctaaatcttaaacccacttcttcaccaatgtccaatctccagatgtttccatggaaccaaacccttgtttcttcctcaggtaagcttcttcttcaacaaagtcttgataacctttttccacaaggaaacaacacagatcctgaaataaccctttttcatttttcagatcaacaaaagcaacagtttcttaggaaaatcgacgtgaacagcttgccaacaacggtggatttggaagaggagacaggagtttcgtctccaaacagtacgatctcgagcacagtgagtggaaagaggaggagtactgaaagagaaggtacctccggtggtggttgcggagatgaccttgacatcactctagatagatcttcctcacgtggaacctccgatgaagaggaagattacggaggtgagacttgtaggaagaagcttagactatccaaagatcaatccgcagttctcgaagacactttcaaagagcacaatactctcaatcccgttagtcattcatccatctctcggagcgtgaaagtattattgtaaatactctgtttttaacaagggctttattgtaaaactacagaaacagaagctggctttggctaagaagctaggtttaacagcaagacaagtggaagtgtggttccaaaacagaagagcaaggtgagagaactagagtgctcattatttttacatattagttgaccattttgcccctaaagagcaatgttatttacaatacaacccatttttgtgcctaataggacaaagttaaagcagaccgaagtggattgcgagtatttgaaaagatgtgttgagaaattaacggaagagaatcggcggctcgagaaagaggcagcggaactaagagcattaaagctttcaccgcggttgtatggtcagatgagtccaccgaccacacttttgatgtgtccatcgtgtgaacgtgtggccggaccatcctcatctaaccacaaccagcgatctgtctcattgagtccatggctccaaatggcccatgggtcaacctttgatgtgatgcgtcctaggtcttaactttaatgctgcttctatgggttgtgtgtgg

SEQ ID NO: 1498 - DNA, 1828 bp, Artificial Sequence
  P6037 (opLexA::G940, G940 is from Arabidopsis thaliana)
cggcgcttcagattatcgttgttaaaggtttttgattgattttgtttaaatgggcgatcttgctatgtccgtagcagacatcaggatggagaatgagcctgatgatttagctagtgataatgttgctgagattgatgtgagtgatgaagagattgatgctgacgaccttgagagacggatgtggaaagatcgtgtcaggcttaaaagaatcaaagagcgacaaaaagctggctctcaaggagctcaaacgaaggagacacctaagaaaatctctgatcaagctcagaggaagaaaatgtctagagctcaagatggtatccttaagtacatgttgaagcttatggaagtctgcaaagttcgcgggtttgtctatggtataataccggaaaagggcaagcctgtgagtggttcctctgacaatataagagcttggtggaaagagaaagtgaagtttgataagaacggtcctgctgctattgctaaatacgaagaggagtgtttagcgtttgggaaatctgatgggaataggaattcacagtttgttctccaggatttgcaagatgctactttagggtctttgttatcttctttgatgcaacattgtgatcctcctcaaaggaagtatccgttggagaaagggacgcctccgccttggtggccaacggggaatgaagaatggtgggtgaaactcggtctgcctaaaagccagagtcctccttaccgaaaacctcatgatctcaagaagatgtggaaggttggagttttaacggcagtgatcaatcatatgttacctgatattgcaaagattaagaggcatgttcgtcagtcgaaatgtttacaggacaagatgacagctaaagagagtgcgatttggttggcggttttgaaccaagaggaatctttgattcagcagcctagcagtgacaatggaaactccaatgtgactgagacacatcgtaggggtaataacgctgacaggaggaaacctgtggtcaacagtgacagtgactatgatgttgatgggacagaggaagcttcaggttcagtttcatctaaagacagtagaagaaatcagattcaaaaagaacaaccaacagccatctcacattcagtaagagatcaagataaagcagagaaacatcgcagaaggaaaagacctcgaattagatccggaactgtcaatcgacaagaggaagaacaacctgaagctcaacaaagaaacatcttacctgatatgaatcatgttgatgcccctctgctagaatataacatcaacggtactcatcaagaggacgatgttgtcgacccaaatattgccttaggaccagaggataatggtctggaactagtggttcctgagttcaataacaactatacttatcttccacttgttaatgaacaaactatgatgcctgtagacgaaaggccaatgctttatggaccaaaccctaaccaagagcttcaatttgggtcagggtacaacttctacaatccctctgcagtgtttgtacataaccaggaagacgacattctccatacacagatagaaatgaatacacaagcaccacctcacaacagtgggttcgaggaggccccaggaggagtacttcaaccccttggtttactcggaaatgaagacggtgtaacagggagtgagttgcctcagtatcagagtggcattctgtctccattgactgacttggactttgactatggtggttttggtgatgatttctcatggtttggagcttagtgtcttgccattttttttgggagattacatagttcaaaaggacatggcaatagtctggctagtacagttactttc

SEQ ID NO: 1499 - DNA, 1460 bp, Artificial Sequence
  P6038 (opLexA::G8, G8 is from Arabidopsis thaliana)
taatcgttgttgctgtagaagacgatctctaacaactgattccttcatcatcaccttcgctagatttgtaattttcagagcttgagatgttggatcttaacctcaacgctgattctcccgagtcgactcagtacggtggtgactcatacttagatcggcagacatcagacaactccgccgggaatcgagtggaagagtccggtacatcgacgtcgtcagttatcaatgccgatggagacgaagactcttgctctactcgagctttcactctcagtttcgatattttaaaagtcggaagtagtagcggcggagacgaaagccccgccgcttcagcttccgttactaaagagttttttccggtgagtggagactgtggacatctacgagatgttgaaggatcatcaagctctagaaactggatagatctttcttttgaccgtattggtgacggagaaacgaaattggtaactccggttccgactccggctccggttccggctcaggttaaaaagagtcggagaggaccaaggtctagaagttcacagtatagaggagttactttttatagaagaactggtcgatgggagtcacatatttgggattgtgggaaacaagtttatttaggtggtttcgacactgctcatgctgcagctagagcttatgatcgagctgctattaaatttagaggtgttgatgctgatatcaactttactcttggtgattatgaggaagatatgaaacaggtacaaaacttgagtaaggaagagtttgtgcatatactgcgtagacagagcacggggttttcgcgggggagttcgaagtatcgaggggttacgttacacaaatgtggtagatgggaagctaggatggggcagtttcttggtaaaaaggcttatgacaaggctgcaatcaacactaatggtagagaagcagtcacgaacttcgagatgagttcataccaaaatgagattaactctgagagcaataactctgagattgacctcaacttgggaatctctttatcgaccggtaatgcgccaaagcaaaatgggaggctctttcacttcccttctaatacttatgaaactcagcgtggagttagcttgaggatagataacgaatacatgggaaagccggtgaatacacctcttccttatggatcctcggatcatcgcctttactggaacggagcatgcccgagttataataatcccgccgagggaagagcaacagaaaagagaagtgaagctgaagggatgatgagtaactggggatggcagagaccggggcaaacaagcgccgtgagaccgcagccaccgggaccacaaccaccaccattgttctcagttgcagcagcatcatcaggattctcacatttccggccacaacctcccaatgacaatgcaacacgtggttacttttatccacacccttaacttgtaaggggacatatgagagtt

SEQ ID NO: 1500 - DNA, 2648 bp, Artificial Sequence
  P6171 (opLexA::G1082, G1082 is from Arabidopsis thaliana)
cgggtttggaatcatattattgagtgttatgggttgtacaagttctaagcttgacgatcttccggcggttgctctttgccgtgaacgctgtgctttcttagaagctgctattcatcaacgttacgctttagctgaatcacacgtggcttacactcattcgcttcgagaaatcggtcactctctccatcttttcatcaatcaccaccaccgtttcgtcgcttccggcggcgctaacgtcggtgattctcctcgacttaatcttcctcctcagagaaaaggtgaccttgacgacgaagcaacaaattccccaaaaaaacaaaagcttgcttcttctcaccacaaccacaaccacgctcactcgggttccggttctgattcgggtcatctcgaattcgattcagattccgacgaagatgaagaagacgacgacgacttggatttggattcgttgcatcaccactctcctccccaccaccatctcggcaatttccctattcccgaatcagcaccaatgggcggatacatggaacaacaaccgggttatataaacccgtacccgaatccagatatgatggggcatccttactctggaggaggaagttatatgcacatgaattacatgaagaacaaatccatgcctccttcagttgtctatgagcaaagaccaactagtcctcaacgagtctacataggcgaatcatcatcttcatatccatatcctcctcaaaattcatattttggatactcaaatccagtacccggacccggaccaggatactacggttcttcttctgcttctacaactgctgcagcaacaaaaccgccaccacctccaccgtcgccgcctaggtctaacggttgggattttttgaatccctttgatacttattatcctccgtatactccgagtcgagattcgagagagttaagagaagaagaaggtataccggatttagaagacgatgattcacattacgaagttgttaaagaagtttacggcaaaccaaaattcgccgccggtggtggtcaccaaccaaatcccgccgccgtacacatgatgagggaagagtccccgtctccgccgcttgataaatccggtgctagtactagcggtggaggtgatgtcggagatgcatctgcgtatcagtctagaccaagtgtgtcggtggagaaagaagggatggagtatgaagttcacgttgttgagaagaaggttgttgaagatgaggaacggcggagtaatgccacggcgacacgtggtggtggtggaggaggagggccacgtgcggtgcctgaagttgcgaaagagattgagaatcaattcgtgaaagctgcagagtcaggaagtgagattgctaagttacttgaagttgggaagcatccttatggtcgtaaacatgctgcttcgaagatgttgcacggtgttactccttcgttaccttctacctctggaggaacttcttcgtctgctgctgctgctgttgtgccacctacttatgcagatattgaagaagagcttgcttcgaggtcgaggaatctttcttcgacgttgcacaagctccatctttgggagaagaagctttatcatgaagtcaaggccgaggagaaactgcgtctagctcacgagaaaaagcttaggaagctaaagcgtttggatcaaagaggtgccgaggctatcaaagtagataaaacgcggaaattagtgagagatatgtccacaaaaatacggattgcgattcaggttgtcgacaaaatatccgtgacgattaataagataagagacgaagacctgtggccgcaactgaatgcattgattcaagggcttacaagaatgtggaaaacaatgcttgaatgtcatcaaagtcaatgtcaagctattagggaagcacaaggtttaggcccgataagagcaagcaagaaactaggcgatgaacatctagaagcgacgagtttgcttggacatgaacttattaattggatattgggattctctagctgggttagtgcgcagaagggttatgtaaaagagttgaataaatggctcatgaaatgtcttctgtatgaacctgaggaaacacctgatgggatagttcccttttcacctggtaggattggggctccacctatctttgtcatctgtaaccaatggtctcaagctctggataggatatctgagaaggaagttattgaggcaatgcgtagtttcactacaagtgtgcttcagctttgggaacaagatcggttagatacgatgatgacggggcatggtgattcagagaagaaagtcaggaacatggacagagaagaacagaggatacagagagagattcaagcattggaaaagaaaatgattcttgtggcaccgggtgatggtaacagtctttcgatatccggcaacgttgtttaccaaagcgatactagcagcgatagtttacaaggtagtttgcaacggatttttgaagctatggagagattcactgctgaatcgatgagagcttatgaggatctcttagagcgcaccaatgaagaaactgcaccacgggaacttgaggaagaagaggaggagtaaaaaagcaaaacaggaagaagaggtttgcttgtcaattcaatttgaatcccatgatcgagctgtttgctgatcttgcaag

SEQ ID NO: 1501 - DNA, 728 bp, Artificial Sequence
  P6197 (opLexA::G350, G350 is from Arabidopsis thaliana)
ttcaagataatggcacttgaaactcttacttctccaagattatcttctccgatgccgactctgtttcaagattcagcactagggtttcatggaagcaaaggcaaacgatctaagcgatcaagatctgaattcgaccgtcagagtctcacggaggatgaatatatcgctttatgtctcatgcttcttgctcgcgacggagatagaaaccgtgaccttgacctgccttcttcttcgtcttcacctcctctgcttcctcctcttcctactccgatctacaagtgtagcgtctgtgacaaggcgttttcgtcttaccaggctcttggtggacacaaggcaagtcaccggaaaagcttttcgcttactcaatctgccggaggagatgagctgtcgacatcgtcggcgataaccacgtctggtatatccggtggcgggggaggaagtgtgaagtcgcacgtttgctctatctgtcataaatcgttcgccaccggtcaagctctcggcggccacaaacggtgccactacgaaggaaagaacggaggcggtgtgagtagtagcgtgtcgaattctgaagatgtggggtctacaagccacgtcagcagtggccaccgtgggtttgacctcaacataccgccgataccggaattctcgatggtcaacggagacgaagaggtgatgagtcctatgccggcgaagaaactccggtttgacttcccggagaaaccctaaac

SEQ ID NO: 1502 - DNA, 1973 bp, Artificial Sequence
  P6409 (opLexA::G680, G680 is from Arabidopsis thaliana)
atagctgcaaccggtcctgttatggatactaatacatctggagaagaattattagctaaggcaagaaagccatatacaataacaaagcagcgagagcgatggactgaggatgagcatgagaggtttctagaagccttgaggctttatggaagagcttggcaacgaattgaagaacatattgggacaaagactgctgttcagatcagaagtcatgcacaaaagttcttcacaaagttggagaaagaggctgaagttaaaggcatccctgtttgccaagctttggacatagaaattccgcctcctcgtcctaaacgaaaacccaatactccttatcctcgaaaacctgggaacaacggtacatcttcctctcaagtatcatcagcaaaagatgcaaaacttgtttcatcggcctcttcttcacagttgaatcaggcgttcttggatttggaaaaaatgccgttctctgagaaaacatcaactggaaaagaaaatcaagatgagaattgctcgggtgtttctactgtgaacaagtatcccttaccaacgaaacaggtaagtggcgacattgaaacaagtaagacctcaactgtggacaacgcggttcaagatgttcccaagaagaacaaagacaaagatggtaacgatggtactactgtgcacagcatgcaaaactacccttggcatttccacgcagatattgtgaacgggaatatagcaaaatgccctcaaaatcatccctcaggtatggtatctcaagacttcatgtttcatcctatgagagaagaaactcacgggcacgcaaatcttcaagctacaacagcatctgctactactacagcttctcatcaagcgtttccagcttgtcattcacaggatgattaccgttcgtttctccagatatcatctactttctccaatcttattatgtcaactctcctacagaatcctgcagctcatgctgcagctacattcgctgcttcggtctggccttatgcgagtgtcgggaattctggtgattcatcaaccccaatgagctcttctcctccaagtataactgccattgccgctgctacagtagctgctgcaactgcttggtgggcttctcatggacttcttcctgtatgcgctccagctccaataacatgtgttccattctcaactgttgcagttccaactccagcaatgactgaaatggataccgttgaaaatactcaaccgtttgagaaacaaaacacagctctgcaagatcaaaccttggcttcgaaatctccagcttcatcatctgatgattcagatgagactggagtaaccaagctaaatgccgactcaaaaaccaatgatgataaaattgaggaggttgttgttactgccgctgtgcatgactcaaacactgcccagaagaaaaatcttgtggaccgctcatcgtgtggctcaaatacaccttcagggagtgacgcagaaactgatgcattagataaaatggagaaagataaagaggatgtgaaggagacagatgagaatcagccagatgttattgagttaaataaccgtaagattaaaatgagagacaacaacagcaacaacaatgcaactactgattcgtggaaggaagtctccgaagagggtcgtatagcgtttcaggctctctttgcaagagaaagattgcctcaaagcttttcgcctcctcaagtggcagagaatgtgaatagaaaacaaagtgacacgtcaatgccattggctcctaatttcaaaagccaggattcttgtgctgcagaccaagaaggagtagtaatgatcggtgttggaacatgcaagagtcttaaaacgagacagacaggatttaagccatacaagagatgttcaatggaagtgaaagagagccaagttgggaacataaacaatcaaagtgatgaaaaagtctgcaaaaggcttcgattggaaggagaagcttctacatgacagacttggaggta

SEQ ID NO: 1503 - DNA, 1106 bp, Artificial Sequence
  P6412 (opLexA::G1757, G1757 is from Arabidopsis thaliana)
cattatacatctttctcatcatagtttgtatcaatttcctagagtaaactacctaaaggaaaaaaaaaatctattttgggaatcatatactaaaaatggaaggaagagatatgttaagttgggagcaaaagacattgctaagcgagcttatcaatggatttgatgcggccaaaaagcttcaggcacgacttagagaagctccgtcgccgtcgtcatcattttcatcaccggcgacggctgttgctgagactaacgagattctggtgaagcagatagtttcttcctacgagagatctcttcttctgctaaactggtcatcctcaccgagcgtacaacttattccgacgccggttactgtagtcccggtggcaaatcccggcagtgttccagaatctccggcatcgataaacggaagtccgagaagtgaagagtttgccgatggaggaggttctagcgagagtcatcatcgccaagattacattttcaattcaaagaaaagaaagatgttaccaaagtggtcagaaaaagtgagaataagcccagagagaggcttagaaggacctcaagatgatgtctttagctggagaaaatatggtcaaaaagacattttaggcgccaaattcccaaggagttattacagatgcacacatcgtagcacacaaaactgttgggcaacgaaacaagtccagagatcagacggggatgctacggttttcgaagtgacgtacagaggaacacacacttgttcgcaggcgatcacaagaacaccaccattagcctcgccggagaagcgacaagacaccagagtcaaaccagccattacccaaaagccaaaggatattctcgagagtcttaaatccaacttaaccgttcgaaccgatgggcttgatgatggtaaagacgttttctcgttccctgatacgccgccgttttacaattacggaactatcaacggcgagttcggccacgtggagagttctccgatcttcgacgttgttgactggttcaatccaacggtcgagattgacacaactttccccgcgtttttacacgagtcgatttattattaattaaaatttgtaacagagaaatagatagtaactagt

SEQ ID NO: 1504 - DNA, 451 bp, Artificial Sequence
  P6424 (opLexA::G1795, G1795 is from Arabidopsis thaliana)
acaaacacgcaaaaagtcattaatatatggatcaaggaggtcgaggtgtcggtgccgagcatggaaagtaccggggagttcggagacgaccttggggaaaatatgcagcagagatacgagattcgaggaagcacggtgaacgtgtgtggcttggaacgttcgatacggcagaggaagcggctagagcctatgaccaagctgcttactccatgagaggccaagcagcaatccttaacttccctcatgagtataacatggggagtggtgtctcttcttccaccgccatggctggatcttcctccgcctccgcctccgcttcttcttcttctaggcaagtttttgaatttgagtacttggatgatagtgttttggaggagctccttgaggaaggagagaaacctaacaagggcaagaagaaatgagcgagatataattcatgattatttctaac

SEQ ID NO: 1505 - DNA, 1438 bp, Artificial Sequence
  P6426 (opLexA::G201, G201 is from Arabidopsis thaliana)
atcctacaacggtcgtctaccacagtttctcagtcagtttcatattcagatgcatcagagttctcatcaagagatctatcagtctattgccttaaactcgacgacattctgttttttttttcttttcttattttttctttttcttatttcttacctataggttgtatgtaaatctatatcaaaaaaagaagaaaaacaagatgtcaagaaagccatgttgtgtgggagaaggactgaagaaaggagcatggactgccgaagaagacaagaaactcatctcttacattcatgaacacggtgaaggaggctggcgtgacattccccaaaaagctggtatatatgtgctttattattatgtatatattttaaaacactttttacatatatataactataattgttgtttttatgacaaatgatggtgtttaggactaaaacgatgtggaaagagttgtagattgcgatgggctaactatttgaaacctgacatcaagagaggagagtttagctatgaggaggaacagattatcatcatgctacacgcttctcgcggcaacaagtaaaatcctagcttgccgaaatccatataaataagggtatatataattaacacattattaaagtttatatatatgttttacttaaaaggtggtcagtcatagcgagacatttgcccaaaagaacagataacgagattaagaactactggaacacgcatctcaaaaagctcctgatcgataagggaatcgatcccgtgacccacaagccacttgcctatgactcaaacccggatgagcaatcgcaatcgggttccatctctccaaagtctcttcctccttcaagctccaaaaatgtaccggagataaccagcagtgacgagacaccgaaatatgatgcttccttgagctccaagaaacgttgttttaagagatcgagttctacatcaaaactgttaaacaaagttgcagctagggcttcttccatgggaactatactaggcgcctccatcgaaggaaccttgatcagctctacaccgttgtcttcatgtctaaatgatgacttttctgaaacaagtcaatttcagatggaagaatttgatccattctatcagtcatctgaacacataattgatcatatgaaagaagatatcagcatcaacaattccgaatacgatttctcgcagtttctcgagcagtttagtaacaacgaaggggaagaagctgacaatactggaggaggatataaccaagatcttcttatgtctgatgtctcatcaacaagcgttgatgaagacgagatgatgcaaaacataactggttggtcaaattatctccttgaccattccgatttcaattatgacacgagccaagattacgacgacaagaacttcatatgatccgttgattgcttaccggactagagttgaccggttaatgtc

SEQ ID NO: 1506 - DNA, 821 bp, Artificial Sequence
  P6456 (opLexA::G1747, G1747 is from Arabidopsis thaliana)
acagagagatgaaaatgatgcaagaggagggaaaccgaaaaggtccatggacagaacaggaagacatacttctggtaaattttgttcacttatttggagatcgacgatgggattttatagcaaaagtatcaggtttgaacagaacaggaaagagttgcaggctaagatgggttaattacctacatcctggtctcaaacgtggcaagatgacgcctcaagaagagcgcctcgtccttgagcttcacgctaagtggggaaacaggtggtcgaaaatagcccgaaaattgccgggacgaacggataacgagataaagaactactggaggactcatatgaggaagaaagctcaagaaaagaagcgtcctgtttccccaacttcctcattttccaactgcagctcgtcatctgtgaccactaccaccaccaatactcaagatacatcgtgccactcgcgtaaatcttcaggggaagtgagcttttacgacactggaggttcccgatccactagagagatgaatcaagaaaacgaagacgtgtactcgttggatgatatatggagagagattgatcactcagcagtaaacataataaaaccggttaaagacatctactcagaacaaagccattgcttaagttacccaaatctagcttcaccatcatgggaaagctcattggattctatatggaacatggatgcagataaaagtaagatatcgtcttactttgcaaatgatcagtttcctttctgtttccaacacagtagatcaccatggtcgtcaggttaaaaattttaagatttaattcattgagataaatctgtt

SEQ ID NO: 1507 - DNA, 1152 bp, Artificial Sequence
  P6459 (opLexA::G1100, G1100 is from Arabidopsis thaliana)
cctcttacaagaattgtgagagtgaatgattacatccttagtttttctaaaccacaaaataaaaactttcgttcatgaaatcttatggtaagttttgagagaaatatccgagtattgcttcagtccgttgcatacgaatcaagcgagacgatggtgcagcctggaaccgagataaaagcaagcgacctaaccctactagtaatcacgattatactcttcgcaatcttcatcgttggcttggcttcggtttgcttccgctggacctctcgccaattttactcacaagaatccatcaaccctttcactgactccgacgttgaatcccgtacgagtattacggcggtgcgtgggctcgacgaggctatcatcaactcatttccgacgtttctctactcggaggtgaaggagcggagaatcgggataggtggcgtcgagtgtgcagtgtgtatctgtgagttcgaagaccatgaaacgctccgtttgatgcctgaatgctgccacgtgtttcatgctgattgtgtaagtgtctggctctctgatcactccacgtgtccactctgtcgtgtggatctttgcttacaaccgggtgagagaagctacttgaatccggaaccggatcttgtagaatctacaaactcgcatttgtttgatggtgtgacgtggaccaataggaacagaccgtctcggtcatggtcaacgagattgtctcaatgtcgagtctcccagatattaatctcgagatcgcattcgaccggacattctgtggttcaaccgctagataatttagaccggtttacgcttcggttaccagaagaagtccggaggcaactgacgaaaaaaacggtggacaacgtggcattttctcaggctaggagctcacggcgtggttacagaagcagaagtgccggaagcgagaggagtgtcttctcgtaccaacggcggatgcattccttctctgattgtgcatggtccacctcctgtggcggagaagcggtggctccgtcaaaggattcccgccgaatatcagttgaacaatcccagctagatgatcgagtgtagtagataggcaattttcttggtgtgtgttttttgctaacaacatttgtgtttgtctgtttgtctgtttgctatcatttgcttttcgaacatgac

SEQ ID NO: 1508 - DNA, 1912 bp, Artificial Sequence
  P6462 (opLexA::G1290, G1290 is from Arabidopsis thaliana)
cggtcgttgtttcttgaaattccactgttattagactcttgactctgttttgtttcccgccgatctcgtgatgatggccaccaccaccaccaccaccaccgctagattctctgattcatacgagttcagcaacacaagcggcaatagcttcttcgccgccgagtcatctcttgattatccgacggaatttctcacgccaccggaggtatcagctcttaaacttctgtctaactgcctcgagtctgttttcgactcgccggagacgttctacagcgatgctaagctagttctcgccggcggccgggaagtttcttttcaccgttgtattctttccgcgagaattcctgtcttcaaaagcgctttagccaccgtgaaggaacaaaaatcctccaccaccgtgaagctccagctgaaagagatcgccagagattacgaagtcggctttgactcggttgtggcggttttggcgtatgtttacagcggcagagtgaggtccccgccgaagggagcttctgcttgcgtagacgacgattgttgccacgtggcttgccggtcaaaggtggatttcatggtggaggttctttatctgtctttcgttttccagattcaagaattagttactctgtatgagaggcagttcttggaaattgtagacaaagttgtagtcgaagacatcttggttatattcaagcttgatactctatgtggtacaacatacaagaagcttttggatagatgcatagaaattatcgtgaagtctgatatagaactagttagtcttgagaagtctttacctcaacacattttcaagcaaatcatagacatccgcgaagcgctctgtctagagccacctaaactagaaaggcatgtcaagaacatatacaaggcgctagactcagatgatgttgagcttgtcaagatgcttttgctagaaggacacaccaatctcgatgaggcgtatgctcttcattttgctatcgctcactgcgctgtgaagaccgcgtatgatctcctcgagcttgagcttgcggatgttaaccttagaaatccgaggggatacactgtgcttcatgttgctgcgatgcggaaggagccgaagttgataatatctttgttaatgaaaggggcaaatattttagacacaacattggatggtagaaccgctttagtgattgtaaaacgactcactaaagcggatgactacaaaactagtacggaggacggtacgccttctctgaaaggcggattatgcatagaggtacttgagcatgaacaaaaactagaatatttgtcgcctatagaggcttcactttctcttccagtaactccagaggagttgaggatgaggttgctctattatgaaaaccgagttgcacttgctcgacttctctttccagtggaaactgaaactgtacagggtattgccaaattggaggaaacatgcgagtttacagcttctagtctcgagcctgatcatcacattggtgaaaagcggacatcactagacctaaatatggcgccgttccaaatccatgagaagcatttgagtagactaagagcactttgtaaaaccgtggaactggggaaacgctacttcaaacgatgttcgcttgatcactttatggatactgaggacttgaatcatcttgctagcgtagaagaagatactcctgagaaacggctacaaaagaagcaaaggtacatggaactacaagagactctgatgaagacctttagtgaggacaaggaggaatgtggaaagtcttccacaccgaaaccaacctctgcggtgaggtctaatagaaaactctctcaccggcgcctaaaagtggacaaacgggattttttgaaacgaccttacgggaacggggattaaggaatgggaaatcatattccatttcactcccacaac

SEQ ID NO: 1509 - DNA, 831 bp, Artificial Sequence
  P6812 (opLexA::G481, G481 is from Arabidopsis thaliana)
agcgtttcgtagaaaaattcgatttctctaaagccctaaaactaaaacgactatccccaattccaagttctagggtttccatcttccccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaataccaaatccttaaattaa

SEQ ID NO: 1510 - DNA, 776 bp, Artificial Sequence
  P6820 (opLexA::G365, G365 is from Arabidopsis thaliana)
tacatggaaccgtccatcaaaggagatcaagaaatgttaaaaatcaagaaacaaggtcatcaagatcttgagttggggttgacccttttgtcacgtggaaccgcgacctcatcagagctcaatctcatcgattctttcaaaaccagctcatcatcgacttctcatcatcagcaccagcaagaacaattggcagatccgagagtgttctcgtgtaattattgtcaaagaaagttctatagttcacaagcgctaggcggtcaccaaaacgctcataaacgtgagcgcaccttagccaaacgtggacagtattacaagatgactctctcctccttgccttcttcagcgtttgcgtttggccacggttcagtcagcagattcgcaagcatggcatcgttaccattacatggctcggtgaataacaggtcaacgttagggattcaagctcattcaacgatccataagcccagcttcttaggaagacaaacgacgagtttaagtcatgttttcaaacagagcattcaccagaaaccgaccataggaaagatgttgccggagaaatttcaccttgaagtcgccggaaataataacagtaacatggttgctgctaagttggagagaattggacatttcaagagcaaccaagaagatcataatcagtttaagaaaattgacttgactcttaagctatgagctctgccatcttctttttagtcttcattataactttttttattctcatctttgtttgatataatgattgacggcagggtgtgtta

SEQ ID NO: 1511 - DNA, 1292 bp, Artificial Sequence; identical to SEQ ID NO: 61
  P6823 (opLexA::G594, G594 is from Arabidopsis thaliana)

SEQ ID NO: 1512 - DNA, 702 bp, Artificial Sequence
  P6838 (opLexA::G12, G12 is from Arabidopsis thaliana)
cgccgtcaatatcacatctttcttcttctttatctttaaaatctctttagatcgattcttttgtggattcttgaaatctccggagaaaaccactatggagacggcgactgaagtggccacggtggtgtcaactccggcggttacggttgcggcggtggcgacgaggaagagagataagccgtataaagggataaggatgaggaagtgggggaagtgggtggcggagataagagagcctaataaaaggtcaaggatctggcttggctcttactctactcctgaagcggcggcgcgtgcttacgacacggcggtgttttatctccgaggtccttctgctcggcttaacttcccggagcttttagccggagtgacggtgacgggaggaggcggaggaggagtgaacggtggtggagatatgtcggcggcgtatataaggagaaaagcggcggaggttggagcacaagtggatgcgttagaagcggcgggggcgggagggaatcgtcatcatcatcatcatcaacatcaacgtggtaatcatgattacgtagataatcatagtgattatcgtattaatgatgatcttatggagtgtagtagtaaagaagggtttaagaggtgtaatggatcgttggaacgggttgatttaaacaaattacccgatccggaaacttcagatgacgattaggaaagcaaaaaatagaa

SEQ ID NO: 1513 - DNA, 1031 bp, Artificial Sequence; identical to SEQ ID NO: 185
  P6848 (opLexA::G1756, G1756 is from Arabidopsis thaliana)

SEQ ID NO: 1514 - DNA, 1441 bp, Artificial Sequence
  P6870 (opLexA::G1560, G1560 is from Arabidopsis thaliana)
tgcatcctttcaatttccactcctctctaatataattcacattttcccactattgctgattcatttttttttgtgaattatttcaaacccacataaaaaaatctttgtttaaatttaaaaccatggatccttcatttaggttcattaaagaggagtttcctgctggattcagtgattctccatcaccaccatcttcttcttcatacctttattcatcttccatggctgaagcagccataaatgatccaacaacattgagctatccacaaccattagaaggtctccatgaatcagggccacctccatttttgacaaagacatatgacttggtggaagattcaagaaccaatcatgtcgtgtcttggagcaaatccaataacagcttcattgtctgggatccacaggccttttctgtaactctccttcccagattcttcaagcacaataacttctccagttttgtccgccagctcaacacatatggtttcagaaaggtgaatccggatcggtgggagtttgcaaacgaagggtttcttagagggcaaaagcatctcctcaagaacataaggagaagaaaaacaagtaataatagtaatcaaatgcaacaacctcaaagttctgaacaacaatctctagacaatttttgcatagaagtgggtaggtacggtctagatggagagatggacagcctaaggcgagacaagcaagtgttgatgatggagctagtgagactaagacagcaacaacaaagcaccaaaatgtatctcacattgattgaagagaagctcaagaagaccgagtcaaaacaaaaacaaatgatgagcttccttgcccgcgcaatgcagaatccagattttattcagcagctagtagagcagaaggaaaagaggaaagagatcgaagaggcgatcagcaagaagagacaaagaccgatcgatcaaggaaaaagaaatgtggaagattatggtgatgaaagtggttatgggaatgatgttgcagcctcatcctcagcattgattggtatgagtcaggaatatacatatggaaacatgtctgaattcgagatgtcggagttggacaaacttgctatgcacattcaaggacttggagataattccagtgctagggaagaagtcttgaatgtggaaaaaggaaatgatgaggaagaagtagaagatcaacaacaagggtaccataaggagaacaatgagatttatggtgaaggtttttgggaagatttgttaaatgaaggtcaaaattttgattttgaaggagatcaagaaaatgttgatgtgttaattcagcaacttggttatttgggttctagttcacacactaattaagaagaaattgaaatgatgactactttaagcatttgaatcaacttgtttcctattagtaatttggctttgtttcaatcaagtgagtcgtggactaactt

SEQ ID NO: 1515 - DNA, 840 bp, Artificial Sequence
  P6901 (opLexA::G280, G280 is from Arabidopsis thaliana)
aatccctcctcacacagattccttccttcatcacctcacacactctctacgcttgacatggccttcgatctccaccatggctcagcttcagatacgcattcatcagaacttccgtcgttttctctcccaccttatcctcagatgataatggaagcgattgagtccttgaacgataagaacggctgcaacaaaacgacgattgctaagcacatcgagtcgactcaacaaactctaccgccgtcacacatgacgctgctcagctaccatctcaaccagatgaagaaaaccggtcagctaatcatggtgaagaacaattatatgaaaccagatccagatgctcctcctaagcgtggtcgtggccgtcctccgaagcagaagactcaggccgaatctgacgccgctgctgctgctgttgttgctgccaccgtcgtctctacagatccgcctagatctcgtggccgtccaccgaagccgaaagatccatcggagcctccccaggagaaggtcattaccggatctggaaggccacgaggacgaccaccgaagagaccgagaacagattcggagacggttgctgcgccggaaccggcagctcaggcgacaggtgagcgtaggggacgtgggagacctccgaaggtgaagccgacggtggttgctccggttgggtgctgaattaatcggtacttatgcaatttcggaatctttagttactgaaaaatggaatctcttagagagtaagagagtgctttaatttagcttaattagatttatttggatttctttcagtatttggattgtaaactttagaatttgtgtgtgtgttgttgcttagtcctgaga

SEQ ID NO: 1516 - DNA, 577 bp, Artificial Sequence
  P7026 (opLexA::G459, G459 is from Arabidopsis thaliana)
aaacatcaaagatggcgaatgagagtaataatcttggactcgaaatcaccgaactacggctaggtcttcccggagatatcgtcgtctccggtgagtccatctccgggaagaagagggcttctccggaagtagagattgatttgaaatgtgaaccggcgaaaaagagtcaagttgtgggttggccaccggtttgttcgtaccggagaaagaacagtctcgaacggaccaaaagttcgtacgtgaaagtgagtgtagatggagctgcatttttaaggaagattgatttggaaatgtacaaatgttaccaagatcttgcttccgctctgcaaattctgttcggatgctatatcaattttgatgatacgttgaaggaaagtgaatgtgtaccaatatatgaagacaaagatggagattggatgcttgctggagatgttccttgggaaatgttccttggatcgtgcaagaggttaaggattatgaagagatcatgtaacagaggatgaatgatatttatagtcacatgtgaatgtgagtgagccttacagatatctaaatatacatttttgcagttaataaa

SEQ ID NO: 1517 - DNA, 3280 bp, Artificial Sequence
  P7058 (opLexA::G373, G373 is from Arabidopsis thaliana)
aatctctctctcactcgtttcaacaatggcgattgaaactcagcttccttgcgacggtgacggtgtgtgtatgcggtgtcaggtgaatcctccgtcagaagagactctcacttgtggcacgtgcgtcactccatggcacgtgccgtgtctcctccccgaatcactcgcttcttccactggagagtgggagtgtcccgattgctccggcgttgtcgttccctccgccgctccgggtaccggaaacgctcgacctgaatcttccggttcagttctcgttgctgcgatccgtgcgattcaggctgatgagactttaaccgaagctgagaaagccaaaaaaaggcagaaactgatgagtgggggtggtgacgatggtgtcgatgaagaagagaagaagaagttagaaatcttttgttctatttgcattcaattgccagaaagacctatcacggttcgttttcattcttcaaatcaatgtgtttttgagtttattcgctaatttatgtgtttgttcttgtgatttgtgttaatgacttgttagatcttgtgattagtacacataaaccctactagaatcgctaatttatgcttgtgacttgtgttaatgacttgttagatcttgtgattaatacacataaaccctactagaatcgctaatttatgtttgtgacatgtgttaattacttgttagatcttgtgattagtgttgataatagtagtagaatcgcgaatttatgcttgtgatctgtgttagtgtcttgttaaatcttgtgattagtacgcataactgtagtagaatggctaatttatgtgtttgttgttgataaggatgattaatatttgaagtagcacactaatggcttatttgcaaccagtcttatgcttgtgattagttttaatgccttgttgaatcttgtgattagtacacataagtgtagtagaatcgctagtttatttgtaaacttgataatgatgattagtgtatttaagtagcagactaatggatgtattgtacttgtgtgtttgtagacaccgtgtgggcacaatttctgtttgaaatgtttcgagaaatgggcagtaggtcaagggaagctaacttgtatgatatgccgaagcaaaattccgagacatgtggcaaaaaatcctcgcatcaacttagctctagtttctgctattcgtttagcaaatgttaccaaatgttctgttgaggcaactgcagccaaggttcatcatattatccgcaaccaagaccgtcctgagaaagcatttactaccgagcgggcagtaaaaactgggaaagctaatgctgctagcggtaagttttttgtgacaatacctcgtgatcattttggtcccataccagctgagaatgatgtcactagaaagcaaggtgttttggttggagaatcttgggaggacaggcaagagtgtaggcagtggggagctcatttcccgcatattgctggcattgccgggcaatcagcggttggagctcagtctgtggccctctctggaggttatgacgatgatgaggatcatggtgaatggtttctctacacaggaaggtttgattttttacattatatttgtcacctgtttcccttcttattgaagtagccttgttccaatttatcttaatatgtgtgaatgtgtgttgcagtggtggaagggatctcagtggaaacaaaagaattaacaagaaacagtcgtctgaccaggcgtttaaaaacatgaatgaatctctaagacttagttgcaaaatgggctatcctgtccgagttgtcaggttagcttttctttgtgcaaagttcttatacctttctcactttctgcagactctcttcaactttatgtgaataagaatagattatctttatactctgagtagatagttatcctgactcttcaatcttcaggtcttggaaggagaagcgttctgcatatgcccctgctgaaggtgtgagatatgatggggtctatcgaattgagaagtgctggagtaatgttggagtacaggtttgaatatatagctaacattcctattttgttccttttatgcagagctagatttttctttcttgacatacactcttctgttttctgtagggttcttttaaggtctgtcgttacctgtttgttagatgtgacaatgagccagctccatggaccaggtttgatctttgtttttccccggaaagtgtcttatatctgtattttctgtttgatggctcataattttttttaattatatactgcagtgatgagcatggcgatcgtccaagaccgttgcctaatgttccggagcttgagactgctgctgacctgtttgtgagaaaggagagtccatcatgggatttcgatgttagtaaagtctctcttttatatgaacagagcagatatcgaatattcttcggttggttcattattttgtaacttttccctcatcaggaagctgagggtcgttggaaatggatgaagtctcctcctgttagcagaatggctttggatcctgaggagaggaagaagaataagagagcaaaaaatactatgaaggccagacttctgaaaggtaaaccgtccattatcacttgtgttattattgtatatagcacaattcataattgttttcttgggttttatttgacacagaatttagttgccaaatctgtcgggaagtgctgagtcttccagtgacgacgccttgtgcacacaacttctgcaaagcatgcttagaagcgaagtttgctgggataactcaactgagagagagaagcaatggcggacgtaaactacgtgcaaagaagaacatcatgacctgcccttgctgcacgacggatctctccgagtttctccaaaacccgcaggtaataaacagaaaccaactcttcttcttatattctagttcttcccagttttgttgtgattaactttggctaatcacaaatgtataataaaacaggtgaacagagagatgatggagataatagagaattttaagaagagtgaggaagaggctgatgcatccatttctgaagaagaagaagaagaatccgaacctccaactaagaagattaagatggataacaactctgttggtggtagtggtacaagtctctcagcttaaggagctctttagtttttcgaaacaaacttcctttctttttttggtaatattccgcaaacgtctgtgaagtttgcattgcgacttatcatttttattttaaaacttatcagaaattgttcgaatcttttttttccgttacatataaattcaacattagta

SEQ ID NO: 1518 - DNA, 4715 bp, Artificial Sequence
  P7061 (opLexA::G1146, G1146 is from Arabidopsis thaliana)
tggagaaaaagagtttttgaaaatccaaacaacaaaaaatgccgattaggcaaatgaaagatagctctgagactcacttagttatcaaaacccaacctttaaagcaccacaatccaaaaaccgttcaaaacggtaaaatccctcctccttctccttctccggtgacggtgactactccggcgacggttactcagagtcaagcttcttcaccttcaccaccgtcaaagaatcgtagccggaggagaaaccgtggtggaagaaaatctgatcaaggagatgtttgtatgagacctagctctcgtcctcgtaaaccgccaccgccaagtcaaaccacttcctccgccgtctccgtcgccaccgccggtgagattgtcgctgtgaatcatcagatgcagatgggtgttcgtaaaaactcaaactttgctccaagacctggatttggaacacttggaactaaatgcattgttaaagctaaccactttctcgctgatttgcctaccaaggatttgaatcagtatgatgtaagtttttattagaaaaagttaagattttttttgccttttttttagtttttgctgtaatgagaaacaaagcttgaacctttagatggtttcctgaaaaaaggtttgaaatttaatgaaggagagagagttagattttaatgttgttcttattgcttatttgggtccattgacatttggttaatgttttgcaggttacaattactcctgaagtgtcatcaaagagtgttaacagagctataattgctgagttagttagactttacaaagagtctgatctcgggaggagacttccggcttacgatggccggaaaagtctttacactgctggagaacttccttttacttggaaggagttcagtgttaagattgttgatgaagatgacggtatcatcaatggccctaagtaagtgtctaaggttctttaggtgattgattttgttatgtgtagttttatattgaaattgacacattttgctttgtagaagggagagatcatataaggtggcaatcaagtttgttgcacgggcaaatatgcatcacttaggcgagtttctagctggtaaacgggcagattgtccgcaagaggcggtgcagattcttgatattgtactcagggagttgtcggttaagaggttttgtcccgttggaagatctttcttttcgcctgatattaaaacaccgcagcgactcggtgaagggttagagtcatggtgtgggttttaccagagtattagaccaactcaaatgggtttatcactaaatatcggtaaagatttgacttaagagattgttacagttttggttttattttataagtcagcccaatcttaatgttattctccttactttgtagatatggcttcagctgcattcatcgagcctcttccagtgatagagtttgtagcacagcttcttggaaaggatgtcttgtcgaagccattgtcggattctgatcgcgtcaaggtacacaagtctcttcatcttattatatcttgtctcaagtccttgattgtttcctcaagaatgttttttttcttgggaatttttaacagattaagaagggtcttagaggagtgaaagtagaggttactcacagagcgaatgtaagaaggaaataccgtgttgcgggtttaacaactcaaccaacaagagagctaatgtgagtattttctttttacttactctttgattactaaggcttgtttcattgagattaatttctggtttatattcttaggtttccagtagatgagaactgtactatgaagtcagttattgagtatttccaagagatgtatggattcacgatccagcacacgcatttgccatgtctccaagttggaaaccaaaagaaggcaagctatttgccgatggaggtaaaccgtaaactgctggtttgtttgtttcaagacttcacatttcagctcttggctattttcgctgattcaatttccaatgtaggcatgcaaaattgtcgagggacaacggtacacgaaaaggttgaatgagaagcagattactgctctcttgaaagttacatgccaaaggccgagggacagagaaaacgatattttgcgggtatttttttagtcatgtatcttatatggttctttgtgagttagaacttagaagtgaggattaatcttgttgtcaaaaatgttttatagactgtccaacacaacgcatatgatcaagatccatatgcaaaggagtttggcatgaacataagcgaaaagttagcttctgttgaagctcgtattcttccagctccatgggtaaaaaacctaaacagatctctgaatgctcatactatgagaatactgttatgttaattcgtctctctttgcttgctacagcttaagtatcacgagaacgggaaagaaaaagattgtctcccgcaagttggtcagtggaatatgatgaacaagaaaatgatcaacgggatgactgtgagcagatgggcctgtgttaacttctcacgcagcgttcaagaaaacgttgctcgtggattttgtaatgaacttggtcagatgtgtgaagtctcaggcatggtaataatattcatctttttttcttttcttgttgcattgtttgaattctcttttaactcgatgtgattcttatcagaaagctttgcttcgtttatcattgtaggagtttaatccagaacccgtgataccaatatatagtgcgaggcccgatcaagtcgagaaagctctaaagcatgtttatcacacttcaatgaacaaaaccaaaggcaaagagttagagcttctgctggcaatattacctgataacaacggttcactttatggtattatttcgacatccataaacttaacccttttgccttctttagtaatggttttgatgaaaacgaaatgtttcttgtaatctcaggtgatcttaagagaatctgtgaaaccgagcttggtttgatatctcaatgttgtctcacaaaacatgtgttcaagattagcaaacagtatctggcaaatgtatcccttaaaatcaacgtaaaggtgaatagtttttactgctgtatcgaagattttcgattgtttttagtattatgaatctcagatctttctatgtttggtttcagatgggaggaaggaacacagttctagtagacgccataagctgtagaataccactggttagcgatataccgacaatcatttttggcgcagacgtgactcacccagagaacggggaagagtcaagcccttcaatcgctgctgtaaggattatacacttttatcaagtagtggagcatcgaaattcattatactcagtttttttcttttgttttctttaggttgttgcttctcaagactggcctgaagtgacaaaatatgcgggtttagtttgtgctcaagctcacaggcaagaacttatacaagatttgtataaaacatggcaagatcctgttcgcggtactgttagtggcggtatgatcaggtaataactcgcaatatttcggtttttgtagtttgattttatcggtgtatctcaaggtttttttgcttgctttctacagggaccttcttatctcatttagaaaagcaacagggcaaaaaccgcttcgaattatcttttatcggtaagtctctctttgctcatttaagtaaaagaattatatctaaaacccacaattagttctcatggttgttttattcgcgcagtgatggagtaagcgaagggcaattctatcaagttttactctatgagttggatgcaattcgaaaggtaaaaacttttgtgcatagcatgaaatgaatccgccacaaagttagcaaaacattttacataatcggaaacgggtttgtgtttgtttaggcttgtgcatcgcttgaaccgaattatcagccaccggtgacattcatagttgtacagaagcgtcaccacactcgtttgtttgctaataatcaccgagacaaaaacagtactgaccgaagcggaaatatcttaccaggttagttattaaaaacggttgaaagaagatcataacagaaataattaactaactaactaactgcttctttgccaccttttgtttcaggtactgtagttgacactaaaatatgtcatccaactgaattcgacttctacctttgtagccatgcgggtattcaggtacgaaacaactatcgaaatatccgttaatatgaccttttccgtaactatacagataaaatgacactgtttgtgtttgttgtatgatctagggaacaagcaggcctgcacattaccatgttctttgggacgagaacaatttcacagcagatggtattcaatctctgactaacaatctctgttatacctatgcgcggtgcactcggtcggtctctataggtaaataacaacatttcttcttcttcttcgtgtacccgcaaatatgacgaaaatcagcaaactcatatgttcttttattttctgatgttgtacagttcctccagcgtattatgctcatcttgcagcatttcgagcacgtttctacctggaaccggagataatgcaagacaacggatcaccgggtaaaaagaacacgaaaacaacaactgtcggagacgtaggtgtgaagcctttaccagccttgaaggagaatgtgaagagagtaatgttctactgctaaaaatccaaacattccttaatcagttttaataagtagtttggttgtttgcttgt

SEQ ID NO: 1519 - DNA, 794 bp, Artificial Sequence
  P7091 (opLexA::G1020, G1020 is from Arabidopsis thaliana)
ctgttcacaagaaagctccccaaaaggagcgttgctttactctcctataaaaagaagctcttctacttcttctcgttaccacaaaactctttcaccgatcttctcgttccattcttcttcctaattacaccatgcccaacatcaccatgggtttgaaacccgacccggttgctccaacgaacccgactcatcatgagagtaatgctgccaaagagattcgttacagaggcgttaggaaacgtccatggggaagatacgccgctgagatccgagatccggttaagaaaactcgagtctggctcggtacgttcgacaccgctcagcaggcggcgcgtgcttacgacgcagccgcgcgtgactttcgtggtgttaaggctaagaccaatttcggtgttatcgttggtagtagtcctactcagagtagcaccgtcgtcgactctcccacggcggcacggtttataacacctccgcacctcgagctcagcttaggcggcggcggcgcgtgtcgtcgtaagatcccgcttgtgcatccggtttactactataacatggcgacgtatccaaagatgacgacgtgtggtgtccagagcgagtctgaaacgtcgtcggtcgttgatttcgaaggtggagctgggaagatatctccgccgttagatctggatcttaacttagctcctccggcggaataggccgtgagttttttttttcttatgtcgtttctttagacaaaaaaaaataacgtttcctttttttttctgcctaagaaaaaaatattatccgttttttagaagaaa

SEQ ID NO: 1520 - DNA, 829 bp, Artificial Sequence
  P7093 (opLexA::G1090, G1090 is from Arabidopsis thaliana)
aaactaattcgcacagttctatatacactcacaaacacacacacacacaatatagtgctactaaaataaccttgtattaattatggaaaacacttacgttggccaacgagattaccgcttcaacgttaaccagttgtcctacagaggcattcgtcggaggaaatggggcaaatgggtatcggagatccgagaacccggtaagaaaacaaggatttggcttggaagctacgagacggccgagatggctgcagcggcctacgatgctgcggctcttcacctccgaggacgtgggaccaatctcaactttccggaactcgtcgacagttttcctcggccggaaagctctagttcggagcacattcaagcggctgcacaagatgcagcacttatgtttaaaccaggtaggttgagtgaaccagctctcgagtctggtcaaggactttctcgagtaggattgtctccggatcagattcaagcgattaatgagtctccattagactcgccgaggatggggtggatgcaggatttggaagttgctgactacgaagaattatacggacaattttttggtcagcacgatagggatgagttttttgaaatgcagcaatttcagtccatatggaattctaataattgatatacgttcgcttaattgcttaaccatttgattttttttttaataatgtcatatcatcaaccaaggtttttcgattatattcagtaaagtataataaattttcgacccttactgtttttcttgggttcaatttgtaatctcttaacaatgatgatgtcataaataccaatatgattaattcaaattttcaaa

SEQ ID NO: 1521 - DNA, 1379 bp, Artificial Sequence
  P7094 (opLexA::G2484, G2484 is from Arabidopsis thaliana)
tttagggtttgtagctcctttctctttttttcttttctcaatttcccccaaattaaaaaaaaactctctctttcagagatttacaaatttcatttctccaaatccgaaaccccaaagtgaatatttttccttctgggtttcttttgtttgcctggaaacatttgtctcagattttgattttgaccggagtactcatattctccggcgatttctccggcgacatcgtttgtgaaatggagggaattactcatccaatacctcgtactgttgaagaggtctttagcgacttcagaggtcgacgagctggtcttattaaagctctcactaatgatatggtgaagttttaccaaacgtgtgatcctgagaaggagaatttgtgtctctatggacttccaaatgagacatgggaggttaatctacccgttgaggaagttcctcctgagcttcctgaaccagctttaggcatcaatttcgctagagacggaatgcaagaaaaggactgggtatctttggtcgcagttcacagtgattcatggctgctttctgttgcattttactttggtgcacgtttcggatttggcaagaatgagaggaagaggctgttccagatgattaatgagctgccaaccattttcgaagttgtgagcggcaatgcaaagcagtccaaggatctatctgttaacaacaataatagcaaaagcaaacctagtggcgtcaagtctcgccaatccgaatctctctcaaaggttgcaaagatgtcatctccaccgccaaaagaagaagaagaagaagaagatgagagtgaagatgagagtgaagacgatgaacaaggtgcggtttgtggtgcttgtggagacaactacggtacagatgagttctggatttgctgcgacgcgtgtgagaaatggttccatggaaaatgtgtgaagataacacctgcaaaagcagaacacatcaagcattacaaatgcccaacttgcagtaacaagagagctagaccttgaagttaaataaccaaattatgaaaaggtaaagcgagttaggagaaaattatgaaagaagaaggtgaagtttccagtttataagaaatgccagtaaaagggacttagaagatgtaagcaggtaaaaaaaaaaattgtattgcttagtctttattgttggattgagactatctacagttggtgatgtcttttcttttctttttttggatttttgttgttgttaatgttaattctactactaatttgtttggtctgtttaagatattttagttctgattagtaattttttttttttttttttttttttctgattagtaatttgctaaaattgtaaaaactattatgtcgttatgtagtctttttattcatctttttaaa

SEQ ID NO: 1522 - DNA, 2065 bp, Artificial Sequence
  P7102 (opLexA::G1584, G1584 is from Arabidopsis thaliana)
aacatcaatcatcatcatatgcatacacatacatctgtgttctgcggatcgagttaattagttatggcttcttcgaatagacactggccaagcatgttcaagtccaaacctcatccccatcaatggcaacatgacatcaactctcctctcttgccttctgcttctcaccgatcttctcctttctcttcaggtccttctacttctacatatttaccaattcaaaactaaattttgttttaaagaactcttatctgatgagattgtgaattttttaggatgtgaagtggagaggagtccagagccaaaaccaagatggaatccaaagccagagcagattcggatacttgaagcaatctttaactccgggatggtgaatcctccaagagaggagatcaggaggattagggctcagcttcaagaatacggccaagtcggtgatgctaacgtcttctactggttccaaaaccgtaagtcccgtagtaaacacaaactccgcctcctccacaaccactccaaacactctctccctcaaacgcaaccgcagccgcagccgcaaccttcggcttcctcttcctcttcctcctcctcttcctcctccaaatccaccaaaccccgaaaaagcaagaacaagaacaacactaatctctctttgggtggtagtcaaatgatggggatgtttccaccggaaccggcgtttctcttcccggtctccactgtcggagggtttgaaggtatcaccgtctcatcccaattagggtttctctccggtgatatgattgagcaacaaaaaccggctccaacgtgtaccggactcctgctgagtgagatcatgaacggtagtgtgagttatggaactcatcatcaacaacacttgagtgagaaagaagttgaagaaatgaggatgaagatgttgcaacagccacagactcagatttgttacgctaccactaatcatcaaatagcttcttacaacaacaacaacaacaacaataacatcatgcttcatattcctcccactacttctactgccaccactattactacttcgcattctctcgctactgtcccatcaacttcggaccagcttcaagttcaaggtaatgttaatatataaagttatcaccctttttaagttatagattacttatatacatgttgaaattttactcaatcgtagagatacattaattttgtgtcaacaatgtaagggacacattgatccatacaaatctttttttaaaaccttcatgtttagtagcctttagatgattctttatttctatataccctctctctctttcttgaaaatagattgtgtgagctttacaattttgttttatatagattgttatagtcattatactaacatgaaataatgggataacaatggctaaatatggatgcagcggacgcacgaataagagttttcatcaatgaaatggagcttgaagtgagctcaggaccgttcaatgtgagggatgcatttggggaagaggttgttctgattaattccgcgggtcagcccattgtcaccgatgaatatggcgtcgctcttcaccctcttcaacacggagcctcgtactatctggttttgtttcctctctattttcctttgttatactaattaaggttccactatagctagatactactctatcggttaaataaactatggtaaaatgaatacttatttaatgtctatataattatagtttatacatctatattagtactagtttatttcttcattgggatctaaaatggataaatgcatgcgagagacatgttgtttggcttaggtcaacaatgttgactcaatctaatttaattacacacacacaccttgcgcttctttagagcattcattggggttttttttctttttttggccttcgtgtattttgacttttgtagtataaattctaatactaccatatttcggaggatgtgcctgcatgtgtgtgtatataattgtttatgtgatttaatttcgaggtctcttttctgcttttgcagatctagtcgtgtgggagatttgagtttgaagaagaaattaagacctgtc

SEQ ID NO: 1523 - DNA, 2185 bp, Artificial Sequence
  P7105 (opLexA::G1038, G1038 is from Arabidopsis thaliana)
gtgtcgtcgtttcataataaaacgcaaacaaaaacccactcccactttctcctttccaaaaaaagaactctcgccactttctctgctctttttctttctctctctctttcttgttttcgccggcgatcatggagaaaagcggcttctctcccgtcggtctaagggttcttgtcgtagacgatgatccaacttggctcaagattctcgagaaaatgctcaagaagtgttcttacgaaggtctctttcttcttcttctatcttatgttttccccaacagttggatttactaaaatatctccttactttcctatgttgcagtaacgacctgtggattagctagagaggctttgaggttgctgagggagcgtaaagatggatatgatatcgtgatcagcgatgtgaacatgcctgacatggatggtttcaagcttcttgagcatgttggtcttgaattagacctccctgtaataagtgagaagaaagatcttgacttgttgtgtaataaatgaaaaaggttattgatttttgtgtgttttgcgttgtagtgatgtcggtggacggcgaaacaagccgagtgatgaagggagtgcaacacggagcttgtgattacctcttgaagccgataagaatgaaggagttaaagattatatggcaacatgttctgagaaagaagcttcaagaagtgagagatatcgaaggctgtggatacgaaggaggagcggattggatcactcgatacgatgaagcacattttcttggaggtggtgaagatgtttcttttgggaaaaagagaaaagactttgactttgagaagaagcttcttcaagatgagagtgatccatcatcttcttcttccaagaaagctagagttgtttggtcttttgagcttcatcataagtttgtcaacgccgttaaccaaatcggatgcgatcacagtaagtacgttggcgactttggtttcttatcatgtccccttgcctccctttattatcatgtcttcatagagccgtgaaattttttccggtctcttgtttggcagaagctggtcccaagaagatattggatctcatgaatgttccatggctcactagagaaaatgttgcaagccaccttcaggtaaaaactttaccttgtcatcatcattattcagaacaagtgttagattaagcttttcgtcactttttttttgttctgtttttgtagaaatatagactttacctgagcagattagagaaaggaaaggagctcaagtgttattcaggtggcgtgaagaatgcggattcatctccaaaagatgtcgaagtgaattcaggctaccaaagccctgggaggagcagctatgtattctctggaggaaattctctgatccaaaaagcaacagagattgatccaaagccacttgcttcagcttctttgtctgacctcaacaccgatgtgatcatgcctccgaaaacaaaaaagacgcgtataggatttgatcctcccatttcctcctctgcgtttgactctctgcttccttggaatgatgttccagaggtccttgaatcgaagccggttctgtatgagaatagctttctccagcaacaaccattgccaagtcaaagttcctatgttgcaaattctgcaccatctctcatggaggaggaaatgaagcctccttatgagacaccagcaggaggcagtagtgtgaatgcagatgagtttctcatgccacaagacaagatccctactgtaacccttcaagatttggatccctctgccatgaagctgcaggagttcaacacagaggcgattctgagaagcttgaactgggaacttccagaatcacatcattctgtttctttagacactgacttagacttgacttggcttcaaggcgagcgttttcttgcaaacaccggactccagtttcaagattacagtagtagcccatcactcctatctgagctcccagcccaccttaattggtatggaaatgagcggctgcctgaccctgacgagtattccttcatggtagaccaaggtttattcatatcttaaccttgttccaataacttcttttcgtatattggttggtgtaatgcagaaagattttgtgggtatacctgaaaataatcttgctttcccaagaaccttccatgatcggatgcattgtacaataatccacgagtgtcgtaggctaatt

SEQ ID NO: 1524 - DNA, 1084 bp, Artificial Sequence
  P7111 (opLexA::G1075, G1075 is from Arabidopsis thaliana)
tttgtgtttggtgttggcatggctggtctcgatctaggcacaacttctcgctacgtccacaacgtcgatggtggcggcggcggacagttcaccaccgacaaccaccacgaagatgacggtggcgctggaggaaaccaccatcatcaccatcataatcataatcaccatcaaggtttagatttaatagcttctaatgataactctggactaggcggcggtggaggaggagggagcggtgacctcgtcatgcgtcggccacgtggccgtccagctggatcgaagaacaaaccgaagccgccggtgattgtcacgcgcgagagcgcaaacactcttagggctcacattcttgaagttggaagtggctgcgacgttttcgaatgtatctccacttacgctcgtcggagacagcgcgggatttgcgttttatccgggacgggaaccgtcactaacgtcagcatccgtcagcctacggcggccggagctgttgtgactctgcggggtacttttgagattctttccctctccggatcttttcttccgccacctgctcctccaggggcgactagcttgacgatattcctcgctggagctcaaggacaggtcgtcggaggtaacgtagttggtgagttaatggcggcggggccggtaatggtcatggcagcgtcttttacaaacgtggcttacgaaaggttgcctttggacgagcatgaggagcacttgcaaagtggcggcggcggaggtggagggaatatgtactcggaagccactggcggtggcggagggttgcctttctttaatttgccgatgagtatgcctcagattggagttgaaagttggcaggggaatcacgccggcgccggtagggctccgttttagcaatttaagaaactttaattgttttttccacttttttgtttttctccgaattttatgaaattatgatttaagaaaaaaaacgatattgttcatgtattgaccctcttactgcatggtttcttctattgggttaattgactagctcataagaattgtttaatttggttattgtcatcaaatttgcccacatataaagcttctagcaaat

SEQ ID NO: 1525 - DNA, 847 bp, Artificial Sequence
  P7119 (opLexA::G1537, G1537 is from Arabidopsis thaliana)
ggtcttaaaaccctagttctccataaaaaaaatatccttgaacacaaataaatggaaaacgaagtaaacgcaggaacagcaagcagttcaagatggaacccaacgaaagatcagatcacgctactggaaaatctttacaaggaaggaatacgaactccgagcgccgatcagattcagcagatcaccggtaggcttcgtgcgtacggccatatcgaaggtaaaaacgtcttttactggttccagaaccataaggctaggcaacgccaaaagcagaaacaggagcgcatggcttacttcaatcgcctcctccacaaaacctcccgtttcttctacccccctccttgctcaaacgtgggttgtgtcagtccgtactatttacagcaagcaagtgatcatcatatgaatcaacatggaagtgtatacacaaacgatcttcttcacagaaacaatgtgatgattccaagtggtggctacgagaaacggacagtcacacaacatcagaaacaactttcagacataagaacaacagcagccacaagaatgccaatttctccgagttcactcagatttgacagatttgccctccgtgataactgttatgccggtgaggacattaacgtcaattccagtggacggaaaacactccctctttttcctcttcagcctttgaatgcaagtaatgctgatggtatgggaagttccagttttgcccttggtagtgattctccggtggattgttctagcgatggagccggccgagagcagccgtttattgatttcttttctggtggttctacttctactcgtttcgatagtaatggtaatgggttgtaacgaaggtttaatg

SEQ ID NO: 1526 - DNA, 920 bp, Artificial Sequence
  P7123 (opLexA::G674, G674 is from Arabidopsis thaliana)
tgtcaaagattgtcatcaccaatctacatatttttattcatcagtaccatacacgtatatataatatatctatttcaaatataaaaaaaaactttggaaaaataaaaatggtgtttaaatcagaaaaatcaaaccgggaaatgaaatcaaaggagaagcaaaggaagggattatggtcacccgaggaagatgagaagcttaggagtcatgtcctcaaatatggccatggatgctggagtactattcctcttcaagctggattgcagaggaatgggaagagttgtagattaaggtgggttaattatttaagacctggacttaagaagtctttattcactaaacaagaggaaactatacttctttcacttcattccatgttgggtaacaaatggtctcagatatcgaaattcttaccaggaagaaccgacaacgagatcaaaaactattggcattctaatctaaagaagggtgtaactttgaaacaacatgaaaccacaaaaaaacatcaaacacctttaatcacaaactcacttgaggccttgcagagttcaactgaaagatcttcttcatctatcaatgtcggagaaacgtctaatgctcaaacctcaagcttttcgccaaatctcgtgttctcggaatggttagatcatagtttgcttatggatcagtcacctcaaaagtctagctatgttcaaaatcttgttttaccggaagagagaggattcattggaccatgtggccctcgttatttgggaaacgactctttgcctgatttcgtgccaaattcagaatttttgttggatgatgagatatcatctgagatcgagttctgtacttcattttcagacaactttttgttcgatggtctcatcaacgagctacgaccaatgtaaatgttcggagagaggtccaagtaaata

SEQ ID NO: 1527 - DNA, 827 bp, Artificial Sequence; identical to SEQ ID NO: 245
  P7125 (opLexA::G2291, G2291 is from Arabidopsis thaliana)

SEQ ID NO: 1528 - DNA, 1117 bp, Artificial Sequence
  P7171 (opLexA::G1594, G1594 is from Arabidopsis thaliana)
attttgcaagaagacaattcaagaaagcgatttagaagacggaggagtttttaccggagatcttatacttatggatggaatgtacaatttccattcggccggtgattattcagataagtcggttctgatgatgtcaccggagagtctcatgtttccttccgattaccaagctttgctatgttcctccgccggtgaaaatcgtgtctctgatgttttcggatccgacgagctactctcagtagccgtctccgctttgtcgtcggaggcggcttcgatcgctccggagatccgaagaaatgatgataacgtttctctaactgtcatcaaagctaaaatcgcttgtcatccttcgtatcctcgcttacttcaagcttacatcgattgccaaaaggtcggagcaccaccggagatagcgtgtttactagaggagattcaacgggagagtgatgtttataagcaagaggttgttccttcttcttgctttggagctgatcctgagcttgatgaatttatggaaacgtactgcgatatattagtgaaatacaaatcggatctagcaagaccgtttgacgaggcaacgtgtttcttgaacaagattgagatgcagctacggaacctatgtactggtgtcgagtctgccaggggagtttctgaggatggtgtaatatcatctgacgaggaactgagtggaggtgatcatgaggtagcagaggatgggagacaaagatgtgaagaccgggacctcaaagataggttgctacgcaaatttggaagccgtattagtactttaaagcttgagttctcaaagaagaagaagaaaggaaagttaccaagagaagcaagacaagctcttcttgattggtggaatctccattataagtggccttaccctactgaaggagataagatagcattagctgatgcaacggggttagaccaaaaacaaatcaacaattggtttataaaccaaaggaaacgtcattggaagccatcagagaatatgcctttcgctatgatggatgattctagtggatcattctttaccgaggaatgaatttatttatggtacttatttaacgttgattaaaagatggatgtataattctgccttgctttg

SEQ ID NO: 1529 - DNA, 958 bp, Artificial Sequence; identical to SEQ ID NO: 235
  P7492 (opLexA::G2146, G2146 is from Arabidopsis thaliana)

SEQ ID NO: 1530 - DNA, 1025 bp, Artificial Sequence; identical to SEQ ID NO: 283
  P7493 (opLexA::G2763, G2763 is from Arabidopsis thaliana)

SEQ ID NO: 1531 - DNA, 1547 bp, Artificial Sequence
  P7502 (opLexA::G1276, G1276 is from Arabidopsis thaliana)
ttttgttgttgttgtgaaagctcagagttttgtttgcttttttgttgacttttttgagattgatgctggatctcaatctcgacgtcgactcgaccgagtctactcagaacgaacgagattcgattactgttaaaggggtttctttgaatcagatggatgaatcggtgacgtcgaactcttctgttgttaatgctgaagcttctagctgtatagatggtgaagatgagttgtgctctacacgaacggtcaagtttcaatttgagatactgaaaggaggaggagaagaagaagaagaagatgatgatgaaagaagtgctgtgatgatgactaaggagttttttcctgttgctaaaggcatgaactttatggattcgagcgctcaaagttcaaggagcaccgttgatatttccttccagagggggaaacaaggtggagactttataggtagcgggagcggtggtggcgatgcttcacgggtgatgcagccaccatcacagccggtgaagaaaagcaggagaggtcctaggtctaagagttctcagtatagaggcgtcactttctatcggaggacaggcagatgggaatcgcatatctgggattgcggtaaacaagtttatttaggtggatttgatactgcccatgctgcagctagggcgtatgatcgagctgctgtcaaattccggggtctggaagctgacatcaatttcgttattggcgattatgaagaggatctcaagcagatggcgaatctttccaaagaggaagttgtgcaagtacttcggcgacagagctctggtttctcaaggaataattctagatatcaaggagttgctttgcaaaagattggcgggtggggagctcaaatggagcagcttcatggaaacatgggttgtgacaaggcagccgtacaatggaagggaagggaagctgcttccttaattgagcctcatgcatcccgaatgattcccgaggcagctaatgttaagctcgacctcaacttgggaatctctctttcactaggagatggtccgaagcaaaaagatagggccctccggcttcaccatgtccctaacaattccgtatgtggaaggaacaccatgatggagaaccacatggctgcagcggcatgtgatacgcctttcaatttcttgaagaggggttcagaccatcttaataaccggcatgcccttccttctgcgttcttttcacccatggaaagaacaccagagaaagggcttatgttacgttctcatcaaagcttcccagccaggacatggcaagggcatgatcagtccagtggtgggaccgccgtagcagctacagcaccgccactgttttcaaatgcagcatcatcaggattctcactctcagctacacgccctccttcatccacagctattcatcatccttctcagcccttcgtcaatctgaatcagcccggtctctatgttatccacccatctgattacatatctcagcaccaacacaatctcatgaaccgcccacaaccaccaccatagcttcctccttcctccgcataactcaag

SEQ ID NO: 1532 - DNA, 706 bp, Artificial Sequence
  P7503 (opLexA::G2514, G2514 is from Arabidopsis thaliana)
cttctttaattagtttgccacctcgcacgtgtgacaaatccttcttcgccacgtgtgaaaacccttctccggcttgctactaatatacgactaatagtatgaatagttcaatggcttctgccggcttaggtagccggagaaaggatccggtgtacagaggaatccggtgccgaagtgggaaatgggtctccgagattcgtgagccgaggaaaaccacgagaatctggcttggaacttaccccatggcagagatggcagcagccgcctatgatgtggctgctatggctcttaaaggaagagaagctgtcttgaacttccctggatccgtcgggtcatacccggttcctgaatcaacatccgcagcagatatacgagccgctgcggcagccgcagcagcaatgaagggatgtgaggaaggggaggaggagaaaaaggcaaaggagaagaagagtagtagttcgaagtcgagagcgcgtgagtgccacgtagataatgatgttggatcttcgtcgtggtgtgggacagagttcatggacgaagaagaagtcttgaatatgcctaatctgctggctaatatggcagaagggatgatggttgcgccgccgtcgtggatgggttctcggccgtcggatgactctccggagaattcaaatgatgaggacttgtggggctattgatcggtttgtgttgtccacgtacgtatatg

SEQ ID NO: 1533 - DNA, 2577 bp, Artificial Sequence
  P7507 (opLexA::G2574, G2574 is from Arabidopsis thaliana)
ggaaaaaaacagacaacaaaaagaaaagaaaatccaaacaagaagaagaagacgaaaatcttctgatatttctgacaatggaggttcttttgaaattaccctcttcagagtctcctcttaaggataaatttggatctgttcaaatccatgaagctaataaggtaaataccaactctatatgtgcatatacaaaattatacatgtatatggaaataatttagatcacaaaaccagaaaactgaccgttcttattctttatcggtgtgttttatgctttaacgtaattcttgtatcctgagatgtctcttccactctataatggcctctctcttttttcttattatcgtaattggtttaaaaagaaaaactcaaaactctaccatgttcattttttttatggaaacgggaagattatattagttatctatctagaaatattgaataattcgttagaattaagaatggaagtatgatgtgttagaaacttagaataaagaacatttttagatttagttgagaaattaatcaacttttttattcaatgatattaatcagggtgatggtgatcatcaagaacttgaatctgccaaggcagagatgagcgaggtgaaggaagagaacgagaagcttaaaggaatgctcgaacgaattgaaagtgattacaaatctctcaagctcagattcttcgacataattcaacaagaaccttcaaacaccgcaactaaaaatcaaaacatggttgatcatcccaagccaacgacgacggatttgagttcttttgaccaagaacgcgagcttgtatcgctttcactagggagaagaagttcttccccaagtgatagcgtccccaaaaaggaagagaaaacggacgcaatcagcgcagaagtcaacgctgacgaagagttgactaaggccggcttgaccttagggatcaataatggcaacggaggtgaaccgaaagagggtttatctatggagaatcgtgcaaattctggctcggaagaagcttgggcgccaggtaaagttacggggaagagaagctctccagcaccagcctccggtggcgatgctgacggtgaggccggtcaacaaaaccatgttaagagagctagagtttgtgttagagcaagatgtgacacaccaacggtacgtcctttaaattatacattaaataagttgatctataacgttaattaaaagatttgattatttatatgtgactaatgttgattcggacatgtttattaattatgttgtatagatgaatgatggttgtcaatggagaaaatatggacaaaagattgcgaaaggaaatccatgtccacgagcatattatcgctgcacggttgcacctggatgtcccgttagaaaacaggtatatttcgtattctatatagtctatttaagaatggaataaaaaatcggtttgaatttttcgtctggttttattttcatttccgtttgagttggatctgattttagttgttaaaatgtatcattcaatttaaactgaacaacataatttaagataaaaatgtatcattcagtttattttattttttgcgtttgcctttgcgtttccatggtattatagaaagtaagaaacatttgtgaccagtgtacaaataaaaagaaacgatctaactatttgtcctcgattatgtatgttttaggtccaaagatgtgcagatgacatgtctatactaatcacaacctatgaaggaacacacagccactctcttccactctcagccaccaccatggcttccaccacatcagccgctgcctccatgctcctctctggctcctcctcctcaccagccgctgaaatgatcggaaataacctctacgacaattcaagattcaacaacaacaacaaatccttctattcacccacccttcactccccattacatcccaccgtcactctagacctcactgctccacaacactcttcctcgtcttcttcttcattgctttctttaaatttcaacaaattctcgaactctttccaaagattcccatctacaagcctaaatttctcttctacttcatcaacatcatcaaacccgtctactctcaacctacccgcgatttggggtaatgggtattcttcttatactccatatccttacaacaacgtccaatttgggacgtccaacctaggaaaaacagtccaaaatagccagtccttaaccgaaaccctaacaaaagcgcttacttccgacccaagtttccactcggtgatcgctgctgccatctcaactatggtcggatcaaatggagaacaacagattgtcggtccacggcattcgattagcaataacattcaacaaaccaacacgacgaataataacaaaggatgtggaggctattttagcagcttattgatgtctaacattatggcgagtaatcaaacgggtgcttctttggatcaaccatcgtcgcaacttcctcccttctctatgttcaagaattcttcttcttcgtcttctacgactaatttcgtgaacaaggaagagaaaagctagtcattgttcttgttttttgttttttgggtgattttttattaggtgt

SEQ ID NO: 1534 - DNA, 1132 bp, Artificial Sequence
  P7515 (opLexA::G2990, G2990 is from Arabidopsis thaliana)
aaagctcttaacccaaaaaccctaagtcttttttttcttcaaattattggttatattaatgttttaagctatgatggatatgactcctacaataacaacaacaacaacaccaactcctaaatcacccgaacccgaatccgaaactccgacccggatccaaccggcgaaacccatttcctttagcaacggcatcatcaaacgccaccaccaccaccaccatcctctcctctttacttacaaagaatgtctcaaaaaccacgcggcggctttaggtggtcacgctctcgacggttgcggcgaattcatgccgtctccgtcgtcaatctcctccgatccaacttctctcaaatgtgctgcttgtggctgccaccgtaatttccaccgccgtgatccagataacaacaacgactcttcccaaatccctcctcctccttccaccgccgtagagtatcaacctcaccaccgtcatcatccaccaccaccaccacctcctccaccaccacgtagtcctaactcagcttctcctccaccaatctcttcctcttacatgctcttatctctctccggtactaataacaacaacaacaacttagcttctttctccgatcttaacttctccgccggaaacaaccaccaccaccaccaccaacatactcttcacggatctcgtaaaagattccgaacaaaattcagccagtttcagaaagagaagatgcatgaattcgccgaacgtgttggttggaagatgcaaaaacgtgacgaagacgatgttcgtgatttttgccggcagatcggagttgataaaagtgttctcaaagtttggatgcataacaacaaaaacacctttaaccgccgtgatatcgccggaaacgagatccggcaaatcgataacggcggaggaaaccacactccgattctcgccggcgagattaataaccataacaatggacaccacggtgtcggaggaggaggagagcttcaccagagtgttagtagcggcggtggtggcggaggatttgatagtgatagcggcggagctaacggtggtaacgttaacggatcatcgtcgtcgtgaagttaaagatgagagtgtcaggttaataagaagcttagagtaagcttattcgtatta

SEQ ID NO: 1535 - DNA, 1641 bp, Artificial Sequence
  P7536 (opLexA::G936, G936 is from Arabidopsis thaliana)
ctatatctagctaagcctagaacttctctatcgtttaccactttctttctatatttcttctgaatttgtaacatcagaagtaataatgattccaagtatggagggaggcgggaagactaacagagaagaagaggaggaggaagaggaagaagaagaagaaggtgaagagagtaaggtttcaagcaatagtacagtggaagagagcgacaagaagactaaggttaggccttatgtgagatctaaagtccctcgactccggtggactcctgatcttcatcttcgctttgtccgcgccgttgagaggcttggaggtcaagaaagtacgtccatagctactaacttcatctttcatcacctcctccacatatatataaaagcataagcaatttcttagttattcttaggttaactatttggtcaaaacctcatgtgattttcttttttttaatgtgtatgtttggttatgtataggagcaactccaaagttggttcgtcagatgatgaacatcaaagggcttagtattgctcatgtcaagagccatctacaggtatttgatctacatacatctaaaacgtacctatatatgtgttgtattttcgatttcgtttcaaataatctctgaaattagaaaaaaaaagaaatcactaaattgtgtattggaaaattttagatgtacagaagcaagaagatagatgatcaaggtcaaggtattgattctttctatttgtgttcattagttagttatcaagttatacatgtataggccaataaagtggggtttgaattgttggcagctatagctggtcacaaacatctcttcgagacttccacagatcgaaatatttataaactaagtcagctaccgatgttccgaggctataatcataaccatgattctccattcaggttgatataacttttttttttgaaaattttagattttatgtgttccttaatttgaatgatattccgttttaattatatttattcggaaactaaattaattgtcttcttttgtttttggtagatatggaagtaaaatttcaaatgcttctttgtggaactctagctctcaaggaacagaaaggagtttgatagaccaaattaggcccggtttaatccgcaacgcgtcggttagcaataacatccgtggtagtgattattggactaacaacaagtctttccaaaacatctactcttcttcaatttctaatcactttccgaaactacgacacgatcatcacgaacggaccaattcagtcacattcaacagcattcaaggacactcaagaacttttcaaaagttccataacggtgttgaggagaacactaatcattcttattgtagcaagacaaatggcaaaagagacgcaagtaggagcattgatcttgatctatctcttaagctaagacaaccggagaagacaattttggaagagacagaaacagcagcaacaacaacggatcaaacgttgtccttgtcgctatgtccagggtcgtcttcgtggaaaaagagccgactgatgaaagatgaagaggatcggacggttaagattggtcaggagagtactctggatctgactctatgaattatatttaagaatgagacaaattctaagtgagatcttgaggtacttacc

SEQ ID NO: 1536 - DNA, 1000 bp, Artificial Sequence
  P7546 (opLexA::G3080, G3080 is from Arabidopsis thaliana)
gcattcacgaactaaccaacgaagaaagatggcgactagttcttcgagttatgggattgaacaacttcaaaaaggatgttactatgagtggatgagtgtgcaggctaaacacatagttgatctcaaagaagcactcatgagtcatcgatccaaagaagatcacaagcttgaagaactcgttggtaaaatcgtcaatgacttccaaaaatacaccgaaaaacgatctgagctctctcgccgaagctgctcaagctactttgcaccgtcgtggaactctcctctagagaacggtttactatggatgggaggatgtcgtccatcgtctttcattagagttatttactctctttgtggatcccaagccgaaacgcagctttctcagtatcttctaaagatcgatgaaaatgtcgaagtaaaccatggtggttccatgagtgatctaaacgcgtcgcagcttgcaaaaatcaatgatttgcatataaaggttatagagaaagaggacaagataacaaagaaatcggcgaatttgcaagagaatgttgcggatatgcctatagccatcgcggcttatgccacggacttgatgaatggtgacgtggtggtggaagatgctttagataagtatgaggagggcatggcggttttaatggtggaagctgataaactgaggtttgagacgcttaggaagatcgtggatgttgttacgccggttcaagcggcggagtttttgctcgcagggaaaagattacacatatcattgcacgagtggggaagagttagagaagagcaacgttttgggtgtgtacgtacggatgcagcggctgccacgggaggagcgggaaccgagaagtcaaagaggtcaagcttgttgatgtgagtttaaagttgaatatatataacttgtgttatatttgtctatgtagagataaaatcgtgtttaagtgtctttatgtgtaatatatgtatgagagagtgcggctagtttcgagatgatgcaagc

SEQ ID NO: 1537 - DNA, 1926 bp, Artificial Sequence
  P7569 (opLexA::G3044, G3044 is from Arabidopsis thaliana)
gtgtagaaagttgagtttcatgtgatcaaaattggggctttactacttttaagagaatgagtgacaaagacgagtttgccgcaaagaagaaggatttggtcaatacgccagtggatttgtatcctccggagaatccaatgttgggtccttctccgatgatggattcattcagagaaactctttggcatgatggtggtttcaatgtccacacagatgcagacacttcctttagaggtaataataatattgatatacctcttgaaatgggttggaatatggctcagttccctgcagattcaggattcattgagcgtgctgcaaagttttctttttttggatgtggtgaaatgatgatgaaccaacaacaatcatctcttggagttccagattcaactggcttgtttcttcaagatacacagattcctagtggatccaaactagataatggtcctcttactgatgcatctaagttagtgaaagagagatcgattaataatgtatcagaggattctcaatctagtggaggtaatggtcatgatgatgctaagtgtgggcaaacatcttccaaggggtttagtagtaagaagaggaaaagaattgggaaggtatagagatttgtagcactccttttgtattttgtgttttttggtctttcgttgataatatttctgttggtaggattgtgaagaagaagaagataaaaagcaaaaggatgagcaaagtccaacttcaaatgcgaacaagacaaacagtgagaagcaaccttctgattctttaaaggatgggtatattcacatgagggcacgaagaggccaggctactaatagtcacagtcttgctgaaagagtaggaacaatatttttttgaagttgaatagaaagcaaatttcttttgttgttgtatttgaatttggttaaacttgttatcgtaggtaagaagagaaaaaatcagtgaaaggatgaagttcttgcaagatcttgtgccaggttgcgacaaggtaagtccttttctttttagatgttgatgtctacatgtagaagaatggaagctgaagctgttttcttttcatataaatgggacattgcatttattgtgtaggtgactggtaaggcagttatgctcgatgaaatcattaactatgtgcaatcacttcaatgccaaatcgaggtttccctttgtttgctttgggaatttcctattttcttagtgtctgttcttgagacttcatttaattagcaacctcactttgtgttagttacttcttccatgcatttcagtttttatcgatgaaactttcggctgtgaatcctgtgctcgattttaacctcgaaagcctccttgcaaaagatgtaacatatgttgaaacccttctctttcttatcatttgacgagtaacttcattgatatgatgttgatgtcttctatatattcatgcaggctcttcaatcatctgcaccgacatttccccacaacatgtcgatgctttatcctcctgtatcgtatctctctcaaacaggattcatgcaaccgaacatttcctcaatgtcgctattgagtggaggattaaaacggcaggtacatatatttggttgcgcattgtactccaacaataaacatatctttgcagaatcatttctttctcttgcattcatctaatattgttagtgagttttgaacaggaaacacatggatatgaaagtgatcaccacaatcttgtccacatgaaccatgaaaccggcactgcacctgatcatgaagatacaacaggtgaaagtaaaagccctataagtttcatacttttgtaaccagatacttgaaactcgctaaagcttttcatgtttatctgatcttacagctgacatgaaggtggagccgtagatgtttcttcttcactttgtactcagctttagctgctgatatagtgcg

SEQ ID NO: 1538 - DNA, 1125 bp, Artificial Sequence
  P7753 (opLexA::G2606, G2606 is from Arabidopsis thaliana)
aatcacatacaaatatatataaatacttagacatataaaccaaacccaccaaacactctttgatacttctctccatatatacatatacgacctcttgtgttcttgaaatacagagagcaaataaaaaacggaggatcatgacaagtgttcttgaggagagtggagaccacgcgcgtcttgttctcctcatcaagggcaaacgcaccaaacgtcagcgttctgcgtctcctcttatgatgaacgctgctgcagtatccagcgtttgtagcggtgaacgatcatcagtggaggtaagagaagaagaagctgctggtgaagtagaattccaaggagctaccgatgaagacgaagatatggcgaattgtctgatcttgttgtcgcaaggacatcaagcaaagagcagcgacgatcatttgtcgatgcagagaatgggtttctttagcaacaagaaaccggtggcttctctagggttagggctagacggtgtttaccagtgcaaaacgtgtgataaaagcttccattcgttccaagcgctaggagggcacagggctagtcacaagaagccaaaacttggagctagcgttttcaaatgcgtcgagaagaaaacggcgtctgcgtctacggttgaaacagtggaagctggagccgtaggaagctttctttccctacaagtgactagtagtgatggtagcaagaaaccggagaaaacacatgaatgttcaatctgcaaggccgagttttcttcaggacaagccttaggaggacatatgaggagacatagaggtttaacaataaacgcaaacgctacttcagcaatcaaaacagcgatatcatcatcaagtcatcatcaccatgaagaatctatacggccaaagaactttctccagttagatctgaatcttccagcacccgaagatgaacgatgctgcgagaaaccgaaattcgcgtttgcatccaaagatcagattcttctcttcacggccgcgtcaaattctttgattgattgtcatcactaattaagtagttctttgtaattacttttttattacattgatatgttaaatcattaacccttctcttattattgtccattcattcttgtaatctgacattgattgaattaaa

SEQ ID NO: 1539 - DNA, 1621 bp, Artificial Sequence
  P7770 (opLexA::G1361, G1361 is from Arabidopsis thaliana)
ctccctcatacctttgtttattctgatgaagttgtgagcactgaaagaaaagaagagaggagaagagagatatgcacaagaagaattaaacttagggacacaaaacaacatgacttggtgcaatgaccgtagcgatgttcagaccgttgaaagaatcattccctccccgggggcggctgagtcccccgtagcctcacttccggtctcttgtcacaaaacttgcccttcttgtggccataacttcaagtttcacgaacaggttcttgtttctctttctacctatatcaagtttaaactttagatgatattggatatttgaatataatatattaatatgtaatgtaggctgggatccatgacttgccgggacttcctgctggagtaaaatttgatccgacggatcaagaggtcttggagcatcttgaaggcaaggtaagagatgacgcaaaaaagcttcatcctctcattgatgagtttatccgtaccatcgatggtgaaaacggcatttgttatacccatcctgaaaaattgccaggtgattctatgttgcatgttcaatcatcaattaatcggttacaaattgagactatagttacaaattttccgtcttcaaatgatcttctagttatgcttattgaaaactacataaatacgttgaaaaaacaatttaatcatattttaatacgatggaaattgtcatatagaaaaagaaaatgtagctaatccaatttcttaattaaattaagtttgatgaatgctaattagtcgttgaatacatatataggagtgaacaaggacgggacggtgcgtcatttcttccaccgaccgtcgaaggcatacacgacgggaacaagaaagcgacgtaaagtccacactgattctgacgtcggtggagagacacggtggcacaagacaggaaaaacacggccagttcttgctggaggaagagtgagaggctacaagaaaatcctagtgctctacacaaactacggcaaacaaaaaaaacccgagaagactaattgggtaatgcatcaatatcatcttggcactagcgaggaagagaaagaaggtgagctcgtcgtctccaaagtcttttaccagactcaaccacgtcaatgcggtggctccgttgctgctgcagccaccgctaaggaccgaccttacctccacggcctcggtggaggtggtggccgccaccttcattaccatcttcatcataacaacggtaacggtaagagcaacggcagtgggggaaccgccggagccggtgagtattatcacaatattccggctattatctcgttcaatcagaccgggatacagaaccacttggttcatgactctcaaccttttatcccttaaaaacaaaatgattttatatcaacgatcctaaaataaaacaaacggtatataatctaagcattatctttgatatacacatacatatatacgttgaaaataatttaaaatttacagtgcattcttgtattcgtaacttgttttttgtttctcttaattcttttttccttttgattttacggctttgtacaatttaaattccttggactgagactgaccatgaaaaatatgtacaaagatctccattggctattgttacatg

SEQ ID NO: 1540 - DNA, 870 bp, Artificial Sequence
  P7777 (opLexA::G1753, G1753 is from Arabidopsis thaliana)
aagctgtgatcaattcctcccaaaccattttctaactggtttgcactttcttcactctcttctcttcactcttcactacgtacttcactctccaactaacttaactgcaccataaaatggcttcgatctcttcctctccttcctcaaactcatcactcttctctactcaaaaccctaatactcattatcaatatgcaaggaacctccaaagacaatggcggccgccaccctttgtacaggggagtaaggcagcgaaagaactcaaacaaatgggtttctgagatccgtgagccgagaaaacctaaccgtatctggttaggaacattctctacccccgagatggcggcaatagcctatgacgtggcagctctagccctcaaaggcagtcaagctgagctcaacttcccaaactcagtttcctctttgcctgccccaacctccatgtctccagcagacatccaagcagcagccgcttcggccgctgctgcttttggtgctgctagggatgcgattgttatggcaaataataacagccaaacaagtggtgtggcttgcatgaatagtagttatgataatacaaatatgaatggattcatggacgaggatttggtattcgacatgcctaatgtgctcatgaatatggctgaaggaatgcttcttagcccccctcgtcctactgtctttgatgctgcttacgacgctgatggttttcctggaggagacgattacttgtggaattttccatgatagttaaacaaaccaaccatataaatatgtgattttgtgtgtttctatatatgtatgtatgaaataaataaatatggtgtctagtgatgcattgtatgcatggttaggcccgttaagaccgta

SEQ ID NO: 1541 - DNA, 1179 bp, Artificial Sequence
  P7789 (opLexA::G1812, G1812 is from Arabidopsis thaliana)
gcgagagtcagacagagagagagatttcgaatatcgaatgtcgaagataaccttagggaacgagtcaatagttgggtctttgactccatcgaataagaaatcgtacaaagtgacgaataggattcaggaagggaagaaacctttgtatgctgttgttttcaacttccttgatgctcgtttcttcgatgtcttcgttaccgctggtggaaatcggattactctgtacaattgtctcggagatggtgccatatcagcattgcaatcctatgctgatgaagataaggaagagtcgttttacacggtaagttgggcgtgtggcgttaatgggaacccatatgttgcggctggaggagtaaaaggtataatccgagtcattgacgtcaacagtgaaacgattcataagagtcttgtgggtcatggagattcagtgaacgaaatcaggacacaacctttaaaacctcaacttgtgattactgctagcaaggatgaatctgttcgtttgtggaatgttgaaactgggatatgtattttgatatttgctggagctggaggtcatcgctatgaagttctaagtgtggattttcatccgtctgatatttaccgctttgctagttgtggtatggacaccactattaaaatatggtcaatgaaagagttttggacgtacgtcgagaagtcattcacatggactgatgatccatcaaaattccccacaaaatttgtccaattccctgtatttacagcttccattcatacaaattatgtagattgtaaccgttggtttggtgattttatcctctcaaagagtgtggacaacgagatcctgttgtgggaaccacaactgaaagagaattctcctggcgagggagcttcagatgttctattaagatacccggttccaatgtgtgatatttggtttatcaagttttcttgtgacctccatttaagttctgttgcgataggtaatcaggaaggaaaggtttatgtctgggatttgaaaagttgccctcctgttttgattacaaagttatcacacaatcaatcaaagtctgtaatcaggcaaacagccatgtctgtcgatggaagcacgattcttgcttgctgcgaggacgggactatatggcgctgggacgtgattaccaagtagcggtctgagtcttgtaggaattgatgaattag

SEQ ID NO: 1542 - DNA, 1056 bp, Artificial Sequence; identical to SEQ ID NO: 163
  P7855 (opLexA::G1555, G1555 is from Arabidopsis thaliana)

SEQ ID NO: 1543 - DNA, 1162 bp, Artificial Sequence
  P7858 (opLexA::G517, G517 is from Arabidopsis thaliana)
tgaaactttagtcgctctcggacaatgatgaatccggtgggtttcagattccgtccaaacgacgaggagatcgtcgaccattacctccggccaaaaaatctcgatagtgacactagccatgtcgatgaagtcattagcacagtcgatatctgtagcttcgagccttgggatttaccttccaagtcgatgatcaaatcgagagatggggtttggtatttctttagtgttaaggagatgaagtataacagaggtgatcaacagagaagaagaacaaactctgggttttggaagaaaactggaaaaacaatgactgtcatgcgcaaaagaggaaatcgtgagaagatcggtgagaaaagggttttggtttttaagaatcgagatggttcaaagaccgactgggttatgcacgagtatcacgctacgtccttgtttcctaatcagatgatgacgtatacagtctgcaaagttgagtttaagggtgaagagacagagatctcttcttcttctactggtagtgaaattgaacagattcactctttaatccctcttgtgaacagttctggaggatctgagggttcgtcgtttcacagccaagaattacagaattcaagtcagtctggtgtctttgctaatgtgcagggagaatctcaaatcgatgatgcaactacaccgattgaggaggaatggaaaacatggttgaataatgatggtgatgagcagaggaatatcatgtttatgcaagatcatcgcagcgattacacacctctaaagtcgttaactggtgtcttcagtgatgatagcagtgatgataatgattctgatttgatatctcctaaaacaaattctattggaacttcgagcacttgtgctagttttgctagctcaaatcatcagatagaccaaactcaacattctcctgactcaacagtccagctagtgtcattaactcaagaggtgagccaaggtccgggtcaagtgactgtgattcgagagcataaattgggtgaagagtctgtcaagaagaaaagagctagtttcgtttacaggatgatacacagattagtcaagaaaattcaccaatgttattctatctcaagaacatgataacaatagatgagaccaagaacaccttttagtacttttccaaatttgtagaaatata

SEQ ID NO: 1544 - DNA, 1179 bp, Artificial Sequence
  P7877 (opLexA::G2148, G2148 is from Arabidopsis thaliana)
aaatgtaaaggcgaacgcataagaaaagaaaaatggagaatgaagcttttgtagatggtgaattggagtctcttttggggatgttcaactttgatcaatgttcatctaacgaatcgagcttttgcaatgctccaaatgagactgatgttttctcttctgatgatttcttcccatttggtacaattctgcaaagtaactatgcggccgttcttgatggttccaaccaccaaacgaaccgaaatgtcgactcaagacaagtaagtttaagtaaaaaatgttaagtttcctatgtttacatttgtcgaatattaacccataacggtaatgcaaagcaggatctgttgaaaccaaggaagaagcaaaagttaagctcggaaagcaatttggttaccgagcctaagactgcttggagagatggtcaaagcctaagcagttataatagttcagatgatgaaaaggctttaggtttagtgtctaatacatcaaaaagcctaaaacgcaaagcgaaagccaacagagggatagcttccgatcctcagagcctatacgctagggtaattcaagataacctaaacaaatattttcattgttgatttgagtttttaggttttgtggaataataatgttgatgaatgttgcagaaacgaagagaaaggataaacgataggctaaagacattgcagagcctagttcctaatgggacaaaggtcgatataagcacaatgctggaagatgctgtccattacgtgaagttcctgcagcttcaaatcaaggtaacgactttttttcttgttggagtattgatcgtttcttgtactgcaagaaaccatgtaaaactcttacctaaactctgttttaccatttttcctaaccaaacacttttgtcgtttttggaaattttgcaatgtagctcttgagttcagaagatctatggatgtatgcacctcttgctcacaatggtctgaatatgggactacatcacaatcttttgtctcggcttatttaagacaaaatcattggaataacataacttacagtacttgttttttttctcgttctatattcatgattatggttattttttgtttgagttgttcaatttttctgtctattgcgttctatgaacttgacactctttttgtaattattatatgctaaagacaatttggactaacagca

SEQ ID NO: 1545 - DNA, 480 bp, Artificial Sequence
  P8068 (opLexA::G1476, G1476 is from Arabidopsis thaliana)
tccctcgatcgatcgaggcaacacacacatatatatatatatatatggagtgtgagagatcatcgtcgtccacgtcatcagaaaccggagcagtcaggcaccgtcgtacgtcgtcgtcgtcagtctccaccgtgacgagacgaatgtacgagtgcactttctgcaaaagaggtttcacaaacgcacaagctttaggtggtcatatgaacatccatcgacgtgaccgtctcaacaaggccaaggtgcaaaacgatgctgacgtggcactctcgcaaactcatagatgtttccacgtggcgtctgaccttggaggctacgagcaagtagactccgtcgtgttgaggacgacgacctcgaactacatccaacacttacgaatcggctcgatggctacaaggagagaaaacgtcgtcgttgaaggaaatgaaatcgatttggagctgcgtcttggcttatgatcatcaacttcttaccctctat

SEQ ID NO: 1546 - DNA, 979 bp, Artificial Sequence
  P8080 (opLexA::G2686, G2686 is from Arabidopsis thaliana)
cagaatctaaaccagaaaatgttttcaaacatcgatcacaaggctgtggcagcactccttcatggccagggatgcgctaacatcctcaagacggtcctcgacaactgtaaagttagctctgtttcaacagaacctctcattaacaccattcttgattccttttcactagctctatcttctgtgaattctcctaatcgtcaaccacaccatgagtcttcttctcgagacatggcaggtcttgtgcctcaaagatcatcaaagaagtaagttaccatttaccaacaaaaagctaaacactcggtgcgtatgttataaacaaagttcatgagtttatactacaacatcgcaggaagatttgcggagtaaaaggtttagagatttacagagatgattcccccaatccccgccttgatgacggcttcacctggaggaaatatggacaaaaaaccatcaaaacctctttgtaccaaaggttagtcaattaggtagactacaaaaacagagcaaatggcatgtacataaaaaaacagagtcaatgctcttctctgttctatggaaagacatgtaattacaagtgtgataatttacaggtgttactatcgttgtgcctatgcaaaagaccaaaactgctatgctacaaagcgggtgcagatgatccaagacagtcctccagtttacagaaccacttatttgggacaacatacatgtaaagcctttggggtgcatgataatacgtatggctctgaaatgataaacttcgaccaagttgtatctgaatcggttatgcgtcaacttgcaacaattggtgaacaagctgttctcatggaggacgaagctaaccatatcatgaaccaagaatatgatattaatgattatttggtggatgatgaagtcttttgggggaatgaatttcctctattttcatcggaagacctgatgttgttttgaaaacgttgatgcttttgattagaaacctttc

SEQ ID NO: 1547 - DNA, 979 bp, Artificial Sequence
  P8127 (opLexA::G2747, G2747 is from Arabidopsis thaliana)
ggtgaggaagtcaaaatcttgagagatctgagattgtaagaagatgaatcaagaagataaagagaagcctattgaagaagcttcttcatcaatggagagagaacacatgttcgacaaagtagtaacaccaagcgacgttggcaaactaaaccgactcgtgatccctaagcaacacgcagagagatacttcccattagataactccacaacaaacgacagcaacaaaggtttgcttctaaacttcgaagatcgaagtggaaactcatggaggttccgttactcttactggaacagtagtcaaagctatgtcatgactaaaggttggagccgttttgtcaaagacaagaagcttgatgctggagacatcgtttcttttcagagagattcttgtaataaagacaagctttacatcgattggaggagacgacctaagattcccgatcatcatcatcagcaattcgccggagctatgttccctaggttttacacttttcctcatcctcagatgccgacaaattacgaaactcacaacctttatcatcgatttcatcaacgagatctaggaattggatactatgtgaggtcaatggagaggagtcatccaacggctgtgattgaatctgtgccggtgatgatgcaaaggagagcacaagtggcttcaatggcttcgagaggagagaagcggttaaggctgtttggtgtagatatggagtgcggaggaggaggagggagtgtgaatagtacggaggaagagtcgtcgtcttccggtggtagtataccacgtggcagagtttctatggttggtgctggttctctcctccagttgaggttagtgagcagtgatgatgagtctttagtagcaatggaagctgcaagtcttgaggatcatcacttctttacaaagaaaggaaaaccttctttgtcttttgatttggataggtgatgattatgcatgagattaatcactatttaaaaatgc

SEQ ID NO: 1548 - DNA, 2451 bp, Artificial Sequence
  P8143 (opLexA::G2885, G2885 is from Arabidopsis thaliana)
gaagagaggagacttgcaaacgtattgcatcaaatatggagtttggaagcactgaagatggaaggcatgacaagtttcctgtaggaatgagggttcttgctgtggatgacaatccaacctgccttcggaaactcgaagagttgctgcttcgttgcaagtatcatggtactacatattctttgcttttgtttttttttacctgtctgcttcggaattggggtgcatggtcaatgatgtttgattgattacgccagtgacaaagacaatggagtcgaggaaagctctggaaatgctgagagaaaacagcaacatgtttgatctggtgataagcgatgtagagatgccagacacggatggttttaagttgcttgaaattggtcttgaaatggaccttcctgtcatcagtacgtctcctaccattgtttttcatatcaactctagcccttattgtaacctgcttcattgtctcagtgttgtcagctcatagcgactatgacagcgttatgaaaggtattatacatggcgcttgcgattatctggtcaagcctgttggactcaaggagcttcagaatatatggcatcatgttgtgaagaagaacattaaatcttacgcaaaactgctcccaccttctgaatctgattccgtcccaagcgccagcaggaaacggaaagacaaagtcaatgacagtggtgatgaagatgacagtgacagagaagaggatgatggtgaggggagtgaacaggatggtgacgggtcaggtacgcggaagaagccacgtgttgtttggtctcaggagcttcaccagaagtttgtcagtgccgttcagcaattgggcctcgacagtgagtttccccatagacctctttaaacctttccttatgtgtgatgtccactcttgtttctcctatagagttattttgatgctttcatgtgtgggatcctcttttcatttctccttgtgttcatcacagaggctgttcccaaaaaaatacttgatctcatgagtatagaaggtctcactagggaaaacgtagccagtcatttgcaggtactaattccccattctctcttgcatttttccccttctttcgcaaatataatcttggatggttagacttgttttattctctggttttggttgcagaagtacagactgtacttgaaaaagatagacgaaggtcagcagcaaaatatgaccccagatgcatttggaacaagagattcatcttactttcagatggctcaacttgatggacttagagattttactgccgcaagacaaattccaagctcaggactcttatcgcgttcccatctcaccaaactccaaccccctatgtattcatcgataaatctccaaggaatgaactcctccagcttcatccaacaggggcatcaccagaactcaagcaattcagctaatccgtttggaacatatcacagtactctgtcaccaagaatccagaacgtgaatctgtttcagcgaacttcatctccactagaacccctccagtttcctagaagcaagtcatacattggagattttaaaggcttaggggacagagctattggcggtagcttcctagatacttgtatgccatttggtagctctagcacctctttaccaagtgcttccaccaatcctctaatgttgcaagcaaactatacacaacccctgcatatagcctcagatggaattcagccttgcatcgagggaactccgtccaactctgcctccccaaacatcagtttccaaggcttatctagatttcctggtcatagctggcaagggaatttgaacacaaccagattcccaccgagttccttaccactaaatcttgctttcttgccggatcaagtgacatgtgcagggaacaatctgggagattgtacttctttggtttctgcagagaatcctggtggagagatgcagtgtgatcctcaattacttggcggcttcatgcagaacgtgaatccgttaggcggacagaaatgggagcaacagaactgcaccatgctgaacaatccattcggtaacattgagtatcctctacccgcagataacatggttttcagagacaacaattcaaccagaagcaaaggcttggatgagtcactgatgaacccaatagacaacagtcaagagtatgttggaaaagctactacaatgctggatccagagatgaagtcgggaaagccagagaatgacaaccagcatgatgtattcgatgacataatgaatgagatgatgaaacaggtaacgcggttgttttcttgattggattaaaagcttttgtagtttgtagaaaatgaaagtgaatgtgtttgttgcaggaggagaataacggaatggtgccagtggctactagatttggctttgattcatttcctccaccttagctagtcatctctttctctaccagttgcattaagtttctccacttgagacc

SEQ ID NO: 1549 - DNA, 1410 bp, Artificial Sequence
  P8193 (opLexA::G1245, G1245 is from Arabidopsis thaliana)
cagatgacacaagatggggaaagttcgtcaagattcaggatcagacgatgacaattcaataaagaaatcttttactaaaggtccttggacacaagcagaagacaatcttttgatagcttacgttgataaacatggtgatggaaactggaacgctgttcaaaacaactcgggcctttctcgttgtggtaaaagttgtcgccttcgttgggtaaatcatctgagaccagatttgaaaaaaggcgcttttacagagaaagaagagaaacgtgtcatcgaacttcatgctttgttagggaacaaatgggcacgaatggctgaagaagtatagctcacgtttccttctttaaccctaatcttgattttttttttcgtcttctaatcttttgttgtttctttcagctaccgggacgaacagataatgagatcaagaacttctggaatacaagacttaagagactgcaacgacttggtttacctgtttaccccgatgaagttcgagagcatgcgatgaatgcagcgacacattccggtctaaacactgattcattggatggtcatcatagtcaagaatatatggaggcagatactgttgagattcctgaagtggatttcgagcatttaccactcaatcgatcttcttcatactaccagtcaatgcttcgacatgttcctcccactaacgtctttgtgagacaaaaaccgtgtttctttcagccgcctaatgtgtataacttgataccaccatctccttacatgtctaccggaaaacgtcctagagaaccagaaaccgcgtttccttgcccgggtggatataccatgaacgagcaaagccctcggctctggaactatccttttgttgagaacgtttcagaacagttaccggatagtcatttgcttggtaatgctgcttattcttctcctcctggacctcttgttcacggggttgagaatttcgagttcccttcattccaatatcatgaagagcctggcggttggggagcagatcaacctaacccaatgccggaacatgagtcagataacactttggttcaatctcctctgacagctcaaacaccatcagattgtccatcatcatcactctatgatggactgttggaatcagttgtctatggatcatcaggggagaaaccggcaaccgataccgattcagaatcttcactgtttcagtcatttacaccagccaatgaaaacataaccggtaaaacttgttttcttactctttatgcattacatgcacttcattgtttgtgtaatcaattcaagaagtctcctcttctccatctgcatgacaaacttaattggtgtaacaaatttaggttcaactccttcaaatcagggacacacatcctttgatggtgattggataagattacttctcggtgaggatag

SEQ ID NO: 1550 - DNA, 1679 bp, Artificial Sequence
  P8197 (opLexA::G2, G2 is from Arabidopsis thaliana)
tctctctctctctttagctctttttttttttttgttttcattaaagtttttattttattttctaccaaccaaaagcttttctctttggtttctcttatttagcttctaaccttgaggagaatataccagaggattgaagtttgaaccttcaaagatcaaaatcaagaaaccaaaaaaaaacaaaaaaaatgtgggatctaaacgacgcaccacaccaaacacaaagagaagaagaatctgaagagttttgttattcttcaccaagtaaacgggttggatctttctctaattcaagctcttcagctgttgttatcgaagatggatccgatgacgatgaacttaaccgggtcagacccaataacccacttgtcacccatcagttcttccctgagatggattctaacggcggtggtgttgcttctggctttcctcgggctcactggtttggtgttaagttttgtcagtcggatctagccaccggatcgtccgcgggtaaagctaccaacgttgccgctgccgtagtggagccggcacagccgttgaaaaagagtcggcgtggaccaagatcaagaagttctcagtatagaggtgttacgttttaccggcgtaccggaagatgggaatctcatatttgggactgtgggaaacaagtttacttaggtggatttgacactgctcatgcagcagctcgagcatatgatagagctgctattaaattccgtggagtagaagcggatatcaatttcaacatcgacgattatgatgatgacttgaaacagatgactaatttaaccaaggaagagttcgtacacgtacttcgccgacaaagcacaggcttccctcgaggaagttcgaagtatagaggtgtcactttgcataagtgtggtcgttgggaagctcgtatgggtcaattcttaggcaaaaagtatgtttatttgggtttgttcgacaccgaggtcgaagctgctagagcttacgataaagctgcaatcaaatgtaacggcaaagacgccgtgaccaactttgatccgagtatttacgatgaggaactcaatgccgagtcatcagggaatcctactactccacaagatcacaacctcgatctgagcttgggaaattcggctaattcgaagcataaaagtcaagatatgcggctcaggatgaaccaacaacaacaagattctctccactctaatgaagttcttggattaggtcaaaccggaatgcttaaccatactcccaattcaaaccaccaatttccgggcagcagcaacattggtagcggaggcggattctcactgtttccggcggctgagaaccaccggtttgatggtcgggcctcgacgaaccaagtgttgacaaatgctgcagcatcatcaggattctctcctcatcatcacaatcagatttttaattctacttctactcctcatcaaaattggctgcagacaaatggcttccaacctcctctcatgagaccttcttgaatcttttatatttttaaggtttattattatataagaaaaacaaaaatgaacctttgaaatccccacatgttcttggtcatttcattaatcatcggcttatattttgcttattttcccctaaatcctcttgttaacttaggcgaacaaaaaaaattaatggaaatctttttccctccatcggttacaaaaata

SEQ ID NO: 1551 - DNA, 1351 bp, Artificial Sequence
  P8217 (opLexA::G1825, G1825 is from Arabidopsis thaliana)
gagtaattgatctcgagagctagctaaagacactctcgccggagagacatggccgggagatcttcgccgggaaaatgctccacgtggcttgacctgaacagagaagaaacagtggagaagaacaatgaagaagagtcatcagtggaagacgaagaccaaatcacgaataacgttagacagtatattcggtccaacatgcctcggcttcgttggacgcctgatcttcatctctccttcgttcgtgctgtccaacgactaggcggtccagacagtaggattcttgttctctctctccacgtctctttctctctttctctctctcagctttgtaatgtaattgttgtatgattttaaaggagcgacgccgaaattggttcttgagatgatgaatctaaaaggattgagtattgcacatgtcaagagtcatttacaggtaatcttcatcgtctgttattctaagattatctcagttttgttcatctttttcaatgttttcatgtttctgatttcaagatgtatcgaagtaagaagctcgagccgtcttctcgccctggtaagttagttttgatccgcagacatttaccattccttcactgggtttcataattgatggaaatgacttttgaacaggatttggagctttcatgagtggacaaagaagctatttgatggacatgatcgactctcgatgtatccctcatagcgatttaagacatgcctataactctaaaaccgttccttcgaggtcatacaaagaaacaagttccagttactaaaatgtttcacatttgtatatccgatccgaccaaggaagttaaaattgcattcttttctgtagggtactcaatcaagacgcggtcgttacaaatcttggaggtaactttcttatgcgaccttcgagctggtttagcgggttatgcagaaatgaccgagacagcacagagaacaagactctgcctctactcgaggtaactacctactttcgttttaagagttatagaggaacagttttgttaaaaaccgaggaaggtactgtaatcttggtgaaatcttatgcagattaggaagaagaacaatgagaaaagagtccgagatgaagaagtatcatcagtcaaacgattgaaatcaatgtccggaggtgggatacagttgcctgagtttggaaattgcaggcaaaaaccaacagatgatatcaacacaatgctctcgctctctctgttgtcgacatcatcagaaccgtaaccaacatactagagagatgaagtttaactttaaaagagattcaagagtagagacttttgttttccttagccgtttcatgggatgagtacttagccaggatctggatcag

SEQ ID NO: 1552 - DNA, 1511 bp, Artificial Sequence; identical to SEQ ID NO: 117
  P8231 (opLexA::G1108, G1108 is from Arabidopsis thaliana)

SEQ ID NO: 1553 - DNA, 515 bp, Artificial Sequence
  P8236 (opLexA::G2226, G2226 is from Arabidopsis thaliana)
tatcgaatccaacaagtgaaagatgggtctatcaagtcttcctggtccatcagaaggaatgttatgtgtgatattagttaatacagcattatcgatctccattgtcaaaggcattgtaagatcattccttggcatagtaggaatcagtctctcgccgtcttcatcctcgccttcttcggtgacggtatcttcagagaattcatcaacttcagagtcatttgatttccgggtctgccaaccagagagttaccttgaggagttcaggaaccggactccgacactgaggtttgagagcttgtgcaggtgcaagaaacaggcagacaatgagtgttctgtgtgtttgtcgaaattccaaggggattcagagatcaacaagctcaagtgcggccatttgtttcacaaaacatgcttggagaaatggatagactattggaacatcacttgcccattgtgtaggactcctcttgttgttgtgccagaagaccatcagctttcttctaatgtttggtgactgc

SEQ ID NO: 1554 - DNA, 679 bp, Artificial Sequence
  P8249 (opLexA::G2251, G2251 is from Arabidopsis thaliana)
tcacccattctccaccttatcatcacaatccaaaactctctctctctctctctctgtctcttgtcttatcatttatctctctaacggcgaggcaatgggttttccggtgggatattctgagctacttctcccaaaaatctttttctacttgttatctttcttaggtttgatacgtaaactcatctccacaatgttcaagatcattggtctaccagatttcttagaacctgaaccggtttcaacctcatggcccgacccaccacccacgttgaccaaacctgactcagcagcaatactagccggagagatgttaccggttgttcgattctcggatataaaccgaccggaatccgagtgttgcgcagtgtgtctctacgatttcgagaacgacgacgagatccgacggctgacgaattgtcgacatatatttcatcggggatgtttggaccgttggatgatgggttataatcagatgacgtgtccactttgtcgtacacagtttatacctgatcatcttcaactggagtttaatcaaaggctctggtctcaatcttctgctgtttcttctcaacttcttgatgaatcatcatcttaggacgtattaaatctttgtcccaaccaaaaaaaaagacatattaaatcctttttttttggtactttcattgggaattgggtttgg

SEQ ID NO: 1555 - DNA, 1456 bp, Artificial Sequence; identical to SEQ ID NO: 277
  P8498 (opLexA::G2741, G2741 is from Arabidopsis thaliana)

SEQ ID NO: 1556 - DNA, 609 bp, Artificial Sequence; identical to SEQ ID NO: 227
  P8506 (opLexA::G1985, G1985 is from Arabidopsis thaliana)

SEQ ID NO: 1557 - DNA, 2255 bp, Artificial Sequence
  P8510 (opLexA::G3061, G3061 is from Arabidopsis thaliana)
tttttttttttttgtctcttcttacatatgaatcaagacatgatgattccacataatcatgaccgcctctcattctctagctttgtccatgaccaagagcacatcacccctaatccttaccctaactctcagcctgcagcctccactaaaacacccaagaaaaagagaaaccttccaggaaatccaggcatgtgtatatataattttatatgttctccatgggtctttaataaagctctagcttgatgtgttttcatcaaaatcaataatctttttccaagtatagatcctttgtgttttcttttttctttcttgatactgttttatttttattggttctaattttgtttctaacaacaacaacaaaaaacagatccaaatgcagaagtcatctctctatctccaaaatccctcatggcgacaaatcggttcttttgtgaaatttgtaacaaggggtttcagagagaacagaaccttcagctccacaaaagaggccacaacctgccatggaagctgaagcagaaaacgaacaagaatcaggtgaagaagaaagtttatatatgccctgagaagagttgcgtccatcatgatccagctcgagccctaggagaccttactggaataaagaagcactttagcaggaaacatggagagaagaagtggaaatgcgataagtgttccaagaagtatgctgtgatatccgattggaaagctcataacaagatttgtggtagcagagagtttagatgtgattgtggtactcttttctccaggtcattactactctttctacgtcttcgtctgcagcattatcgtttgccttaacatgttcatatatcaaacatttttaaaaattgtaacaacggaaaaaacgttttcaaatcttcaggtttgcatttatttgaagtgtttgataaaaatataaatataaacgtaaaacacaaaacatatttgaattatatttgaaacaaaccgggtcttataattggacatcgaaacagatgcatgcatacataaaagcatgatattgcctatgctagaaaaataaaaagttattgagtttactttatgtatagcgagtacgttggtctttggctcgtagcttgtcatttggataccactaccgttaattatttcttggcttctctgtgtcttggtccagtttgtagttttatagagacaccaatatcgaggagaaaaaaggctgcatgactaggacatgatgtggtcatgtctccatagccttgagtcttttttttttcaccttactacacatatcgattataagcttgcatcgaataaagagttgcatatataccatatacaagaagacctattttaatttaatttatatgttaccaattagcctatattaacatagttactttattgaatgatttggttgattgtaccaggaaggacagtttcatctcacatagatccttctgtgatgtcttagctgaagaaagttctaaattcttctcagttccttcaccattagccgccaattcgaccatcgccactgtcactgataccaacaatccaattctcattcaatcacaattggatcaatcttccacaggtacggccgatcttaacgtcaacaacaatcacaccaccctatttggacaaaagttcaccaactccaacccaacccaacaacaacccaatgctttggcgttgtcctcaccaccatcacctcgtagtacatctgattcggttcataatctatggaagttacaagaagaggaatgtgcacaccagtggttactcaatgaatatatgaacaataacaaaaacatattccataagggaatattcaagaatcaagaagatgagataaagaagggaaatatctacagcggctcaaacccaaccgatggaaacatagcatccttgttctcgtataatcaagaagcagtgaatatggcttcattttcggcaacaacattgcttcaaaaggtagctcaaacgggaacaccatcaagctccgaaactagcaccaccatgtttgggcaaatgacttcctccatcttcaacaatacgatgctaaactcctattgtttaacggcgaagaataatgaagaagagttgaccagagactttcttggtgtgggaagtagtgaggaccaacaacgtctacatcgtcatcgcttcccatcaagcgtgccattgacggcgaaccatgatattcccaagttggccgcaaccattgtaggcaggaagcaaccatagacatggcgtcatctgattct

SEQ ID NO: 1558 - DNA, 2343 bp, Artificial Sequence
  P8535 (opLexA::G1798, G1798 is from Arabidopsis thaliana)
atatcgcaggaacaatggtgagagggaagatcgagatcaagaagattgagaacgtgacgagcagacaagtcacgttctcgaagcgaagaagcggtctatttaagaaggctcatgagctttcggttctatgcgatgctcaagtagccgccattgtcttttctcagagcggaagattacacgaatactctagctcccagtaagatattctttcatcaaattatttcaaaatatttacacatgtctatttccaaaatctttctctagctacacatagatttgttgagtatctagaacttctgtagtgaatagtataatatatctctggttaaatcgtactagagattttgcaataatataggcgctaaagatttggccccctttcttttggtgctagctagttcctgactttgcccaacaatgccttgtcacattctaattttagaatttaagttttgtaagtacttagcttctggattttatttaagcaaacttaagaatttttactacttaagagagtttcttcaagcacgagcaagtggattgtattagggttttcagaaaaaaagtttcttgaacagtgaacctcgtattccttggaacttaaactgttacccacacacccacttggcatctggttttattagaatatccagcataaatgaatatccgaaaatgtagttacattaagtacagaaattgtaaatataatgcatgatgagaagatttaaaaaatatctcgggcatccaaactttttcactagatttacaatcatgaggtcggtacattgttcattttataaatcccttttgttttgtggttaatagaattggtttaaagattagtactatacaatctttacagagtataatttattttgtataacttccctttgtttcatttttcatttcatgtttaacaatctttgtgcagcaaaaaccttccttcactaggtttggtgattgcaaaaattaaaagtattcgattgtatgagtgttatctaaattatagacatctacattaatcaaaatattggtggacaaatctatcatagaagctaagtcggtataaaagataacatgtagatatatatatattaagaatattcgtccataatatttcaatcttatgatccgtcatcatcattcatcactgacaaatatcttcttgtgaattaacttttcaggatggagaagattatagatagatatggcaagtttagtaatgccttctatgtggcagagaggcctcaagtagaacgatacttgcaggttcattctctatattcatatatattctttatgttagtttcttcatttatttaaaaaaaaaatgtacagtatgtattaattcagatggtaatcgactatttttggggttgtattattgtgtaggagctgaagatggaaattgatagaatggtgaaaaagattgatctccttgaagttcatcaccggttcgcatcttactattcttacggttaattactctgtgcattgtatatttgtatataactaaactttgtttcagtcctaaaatatactgaaatttattatctcttgattcttgaatgccactatatatgaagtaagctgttggggcaaggtttggattcgtgttcagtgacagaacttcaagagattgacactcaaattgagaaaagccttcgtattgtcaggtcaagaaaggtacaaacactcggacacaaatatatatataacatatacacacatgttaatgatgtaattatgtcttcgttggttgatcttggtgcgtaggctgagttatatgcagatcaactgaaaaagctaaaagaaaaggtaaatttttttaaatgagtaacttatatacaagttttaatttgtgggatcggttgtattttctccatgtgattttatttttaatcgatctttcttgctcggattctaggagagggagctcttgaacgagagaaaaaggctgcttgaagaggtaaatatgcaccactcatcaaaggttacatataaaaatacacatgaaatttagttatgtctcttcgtttaggtagaggcttagattcatcgcacttaaaacttctttcttataagaataatcatagttcatagaggccttgattgtttgtttgtgtttgcatttacgttttacatgacattttcagcaaaatagagaaaggttgatgcgaccggtggtgccagcaactttacaaatatgtgataagggtaatactgaaggtggtcacagaaccaaacattcatcagaggttgaaaccgacctatttatcggattgcccgtgactcggctataacatattactttggttccatgtttgtacactataatgcttc

SEQ ID NO: 1559 - DNA, 977 bp, Artificial Sequence
  P8594 (opLexA::G2454, G2454 is from Arabidopsis thaliana)
atcaagaatcctctgatcagtcaaatacccatcaatcaatcaaatccccaaacactcccaaaaaaagatcagcttccaatatttttccccttcttacaaaaaagatgtctatgtcgtctatgtcctccccttcctcagctgtttgttcaccggaccacttctctccttccgaccatctctgctatgtccaatgcaacttttgccaaaccatccttgcggttaatgttccttacacaagcttgttcaagaccgtaactgtccgatgtggttgctgtaccaatctcctttcggtgaacatgagatcatatgtcctcccagcttctaaccagctccagctccagctcggtcctcactcttacttcaatccccaggatattctggaggagctgagagatgcaccgtctaacatgaatatgatgatgatgaatcaacatcctactatgaatgacataccatctttcatggatcttcatcaacaacatgagattcctaaagcaccacccgttaaccgccctccagagaaaagacagagagtcccatccgcatataaccgattcatcaaggaggagatccaacgtatcaaagctggtaatcctgatataagccacagagaagcctttagtgctgctgccaagaattgggcccacttcccccacatacacttcgggctcgtgccagacaatcaacccgtgaagaaaaccaacatgccccaacaggagggagaggataacatggtgatgaaagaagggttctacgctcctgcagctgctaacgttggtgtgactccttattaaagagataaatataatcgactaagtatttgaggaattgaaatccaatttcttagggtttatcatgtccaaaagttgtggtttcttttcctttcttgaacttatttatatatattataaatatgcatgtgtctttttctgttgttgtaatcaaaaatcttgctaattaatggggtttcttaagtt

SEQ ID NO: 1560 - DNA, 1450 bp, Artificial Sequence
  P8607 (opLexA::G2859, G2859 is from Arabidopsis thaliana)
gaaactcagaaatggcgaatctctcttctgattttcagacatttacaatggatgatcccataagacaactagcagaactgagcaacacgcttcatcatttccaaacatttcctcctcctttctcttcttctctcgattctcttttctttcataatcaattccctgatcattttcccggaaaatctctcgagaataattttcatcaagggatattcttcccttctaatatccaaaacaacgaagagtcttcttcacaattcgataccaagaagagaaaatcattaatggaagctgtttctacgtcggagaacagtgtctctgatcaaactctctctacctcttctgctcaagtttccataaatggaaatatttcgacaaaaaatgtattttattaacctagaaaccctaatttcacacacatatattagagtactctcagtttctatgaattaatctaactttgtttttctcttttttcttattgatatcacagaattcttcaaggagagggaagaggtcgaagaatagagaagaagagaaagagagagaagttgttcatgttagagctagaagaggccaagccactgatagccacagcatagcagaacgggtaaaattgattttctctatacaaattatagtgtacataaataatataaatgaaaactatgagtaaaaaaattaaaattaactttcaggttcgacgagggaaaataaacgagagattgaaatgcttgcaagatatagtccccggatgttataaggtgattatattttgcttagactttaagaaaatatattattagttcttttattgaatatatatttggtgatgcagacaatgggaatggctactatgcttgatgagataattaattacgtccagtccttacaaaatcaagtcgaggtataacaataacaattaatttctcttaagttataggtcatctaaccaattccattcgtttcaataattatactaatttactttcttttttatgtgaactcagtttttatctatgaagcttacagcagcaagttcgtattatgactttaactcggagactgatgctgtggaatccatgcaggtacagaatctagaattataacttttaattaaaattttctcgtaagactggtgatgtttgctatgatttatttatttcttaatttaactatatggtttgatgtgattataattagatgatttaaatatcgatttttaattggaatattaaaatgcgcagaaggcaaaggcacgtgaggcagtggagatgggtcaagggagggatgggagttctgtcttccattcatcatcgtggaccctttgacttttgttttttgctctcctttttttgtctttctaattttcttcctttttttggatttaaaaagatacttttaaagattaatttcaagaaatctcgatgccatatgatatgtatacttg

SEQ ID NO: 1561 - DNA, 1383 bp, Artificial Sequence
  P8612 (opLexA::G2832, G2832 is from Arabidopsis thaliana)
cttctctgtatcagttttgtcggtttatgcagcactcgtcttcattcatagattttgatttgaggtaaactaaactcatcagatattaaaaatgggttctttacttctttcgatttcgtgtgtaaaggagaaacctttattgattctttcttgcttgtttgctgtttgatcatttgtctaagagaagaaggtcaaattttcaaatggaggaagggaaagagaattcgtttttgtgcaagtactgttacaagacgtttccttctgggaaagcactcggtggtcacattagaattcatacgaacgagaattcagttggttacaatggcaataagaagaagaggttggtggatcagagaaagatgatggctcagaaacataagcaacaacaacaagttggttgcagagaatgtggtagagtgttcgtttctttgaaagctcttagaggtcacatggcttgtcacggtgaggtaaagaagatgttgatggatgataatagccaatctgatactgaaagtgagacttcctcagctcctatgaggaaaagatccaagagggtggtcatgaaacaatcaaattctgaatctttgagtaatgggagctcgtcttttggttctgagattgaccaagaacgtagggatggggcttataatttgatgatgttgtcgagtgattctagtagtttcaagaaaagacgtaacatggtgatgaattctcttggtgagtcatctgacaacaactctgcgattgttgagaataagtcatcttcaggggatgagtttaagatcatgaatgtgaagaatgcagtagatgaccaatggagatctgctgatgatgatggagttagtctctgtgattcagatggctctgattctgattacttcatgaatggtccaagtaagtcggagtcagacatttctgttgacaggaacactggatttggatctggattcaacaactcattgatcaggttcaggaatagtaatgagggaggaacaaagtatgagctgagcaaaagcaagagagccttgttttcttatgaaactgattcatgtgcagacacaaacagcaagattcatcataggttcaaagatagcaaatcctcaatggttaagaaagaaggtggtgagaaggtgaagagcaaaggtcatgagtgcccaatttgcttcaggatgttcaaatcaggccaagctttaggtggtcacaagagatcacattccattgcaaaccacgcagctgaaatgcgtaaccaaatcgatctctatcttcctgtttcggatactgatgaatgaatcagaacctgagaactatagttctctctgatagtatttcatccccactttttgtttgttttctttgctccacattttagaactagatcaaaag

SEQ ID NO: 1562 - DNA, 2554 bp, Artificial Sequence
  P8618 (opLexA::G2831, G2831 is from Arabidopsis thaliana)
caacaaaacttttgtccaagaagaagacatgacaactgaagatcagacaatttcaagtagtggaggatatgtccaaagctcatcaacaactgatcatgttgatcatcatcatcatgatcaacatgaatccctcaatcctcctcttgtcaagaagaagagaaacctccctggaaatcctggtaacaattaattaagtttaatagagatcacaaaataattcaaccctaatcaacatttttttttctgtttgctgaaaagtcatgttcttttttttttcgatcttgatctacaaacatgcatgctttctactgtttagatctttcacatgatcaaatatgtatccagaatttgattgttatatttcgttctctatagatccagaagctgaggtcatagctctatctccaaagacacttatggccacaaatcgtttcctctgcgagatatgtggaaaagggtttcaaagagaccagaatctacagcttcaccgtcgaggacacaacctcccatggaagctaaagcagaggacgagcaaagaagtaaggaaacgagtgtatgtatgtccagaaaagagttgcgtccaccaccatccgacgagggcacttggtgatcttaccggcattaagaaacatttttgtcggaaacatggcgagaaaaagtggaagtgtgagaaatgcgccaagagatatgcagtccaatctgactggaaggctcattccaagacttgtgggactagagaatatagatgcgactgtggtacaattttctccaggtacttagtgtatatctacacacgtacgtactaatagatgatctttacatttcctcatcacggtatcatatatttttagtggcgtaacaaatattttgatcacctagctgtaagcgcatatcatgtttaattgcattatatatagattcaaatatgattttaacttcttaaccagtaaagttaatcatgtttgaatatattagaatataggaagaatatatatatacttatatacatatcttaaaactcatactaaacctagctagagcttatattttaccgggtgaatactatgatgaaaaacaaaaaaaaaacgaatctgttacctcaactaacactactgtaccactggaccacacaaacaaatttcgttttaccacgttgtttgtaagtaaataagatttttttttttttttttgtgaaacaatttgtaagtaaataagatacatgttttttgttggaagtagtagctcatgtagggtctaaaacaaaataatttggagttacttttgtatagatattgccatattggtcattctctgagcatacgtgctgcttgatttcttgaataagacagtttcttggattgacatattttggttaaagtaagatatacaactttatttatctttttttccttaattgctatctatattactatatacatacatattaaacacaagcataaattagcgagtgtgtatagacgatattgatcttattggtgtgtataatttggtcaacaggagagacagcttcattacacatagagcgttctgtgacgctttagcagaagaaaccgctaggctaaacgcagcctcgcatctcaaaagctttgccgcaaccgctggtagtaatctaaactatcattatctcatggggacacttatcccatcaccatcactaccacaaccaccgtcgtttccgttcggaccaccgcaaccgcaacatcatcaccaccaccaattcccaatcacaaccaacaacttcgatcatcaagacgtcatgaaaccagcgtctacgctctctttatggtcgggaggaaatattaatcatcatcagcaagtgaccatcgaggaccgtatggcgccgcagccgcattcaccgcaagaggattacaattgggttttcggaaacgcgaataatcacggcgagttaataacgacgagcgattcactcattactcatgacaataatattaatatcgtccagagtaaggaaaacgctaacggggcaacttctctttccgtgccttctctttttagcagcgttgaccaaattacccaagacgcaaacgctgcttctgtggctgttgcaaatatgtcggcgactgcgttactccaaaaagctgctcagatgggagcgacttcttctacgtcaccaacgacgacgattactaccgaccaatcagcgtatcttcagagttttgcatcgaagagtaatcagattgtagaagatggtggcagcgacaggttctttgcttcgtttggatcgaacagtgtcgagttaatgagtaataataataacggtcttcacgagatcgggaaccctagaaacggcgttacggtcgtttcggggatgggtgaattacagaattacccttggaagcgtagaagagttgatattgggaatgcgggaggaggagggcaaactcgggattttcttggggttggtgtacaaacaatatgccattcttcctctatcaatggatggatttgaaacactctttaatggatttttctaccttatttatgagtgaacttaattatcaaagctgatttc

SEQ ID NO: 1563 - DNA, 2353 bp, Artificial Sequence
  P8637 (opLexA::G2742, G2742 is from Arabidopsis thaliana)
tttcgaatgggtaggtgtggaagaagcaacgacggagtaattggtggagtaagaccatacgtacgatctccggtgcctcgtctgagatggacgccggagcttcaccggagtttcgttcacgccgttgatttgctcggcggtcaatatagtcagtctatttaaccaatctcttttttttggtattttttttagatatctttaagttcggtttttgtagcttttacttgggcagttatataaaatcgcaatatataccaatattcattatcgccatagtccagtttttaaatgttttgtatttttgtgtttgaatgaaacagaagcaactccaaaacttgttctgaagataatggatgtcaagggactaaccatatcacacgtcaagagccatctccaggtcaaagaaaatgctaaaaaaatacttttttaatactatttattgtcttgtactgtttattcgtatacatcacactgctctttccacctttatcttttattaatttgaatatttttaaaacgttttttcattgttttgattatactgcagatgtataggggatccagaatcactcttcttggaaaaccaggtaatgagttctacatattttgttgtttatatgaggaggcatcaacgaattacactctcaaacgtcatagtttcaagattaggacatttcttttcatatacccaccattcacataaaatctgtaataatgcataaattgaaatctcactcccaccattgtcagaaatattcaaataatgtaaagtatttattaaaacaaggatagagagattaacaaaaaaaaatgaaaaagaatttggttatagacttataggtaaataagtgcttcttttaatttattgccaaaaacaaaaatactcctaccaaagagtgaagagaatattcatcatggtcataaattaattaatgtttttataatatattttttgggggacagaagagagttcttcaccatcttcaagaagaagaagaagacaagacaatgaagaagatcatcttcatgacaacttgtctgtacacgcaaggaatgattgtcttttgggttttcactcttttaactttaggtaaaaaaaaaaattatttccttggcaaaaaacggaaagggaatattaatttgtttctgacaagtgttttaattttattccagaaaataggtatgttatcatacagttttgtttgaatatgaattgtcgaatttaaagattttttttttttttttgggggagaagagagcagacttcagcgactgataatgatgacgatgactttcttaacatcatgaacatggagagaacgaagacatttgcaggcaatggcgagtccatcaaatttcagtctcatcactctctcgaggtattaaatatattcaattttatcatatggtttcataaatagccgttgcgaaaagttgatatcaataataaaaatatttaagactcagataaacactcactaaaccactgaacattgttatggtatgggtcaacactagggtagcatggggctcggtactgaaaattttcagatagagattttattgtcacaataaattcttaagtagtaagcactaatataattcattagtaaaataatttataatttggataaacaactaacccattgtatgggtaaaagagttgataaaatcattagtaaaataaaatcaccacctatatttgaaggagtacataattgttttgattaggttaattcattgattttagatatactataatctatagacaattagaattgttgaatccgttgattaatgtagaagaattagtagatttattacaaatactaatcttatgttctcacggacattctcaaatttatatattgaccaagaagagtataacctatagtctctaatttataagagcttattatgtctttggaatttaggctgagaacacgaagaacatttggaaaaacacatggcgagaaaacgaacacgaagaagaagaagagttatcgctgtctctgtcgttgaatcatcctcataaccatcaacaaagatggaaaagcaatgcttcatcatcactcagtgaaacaagcgaagcagtctcatcttcttctggtccattcatcttcagagattgttttgcttcttcgaagattgatcttaatcttaatctctccttttctctactccatagctgaagctttgttcagctttgttcctttgttctaaattttagcgtagtgaacatttagattgtttttaaaccaccttaaaagttcctaatcttttagttaggcctcttgatttgtgattgtgatgtttttttttttggctgtctacaatgtcacaattacatcgg

SEQ ID NO: 1564 - DNA, 3094 bp, Artificial Sequence
  P8647 (opLexA::G2577, G2577 is from Arabidopsis thaliana)
tcatctatcacaaggagtagttagaatattatatgaactcgatgaataactggttaggcttctctctctctcctcatgatcaaaatcatcaccgtacggatgttgactcctccaccaccagaaccgccgtagatgttgccggagggtactgttttgatctggccgctccctccgatgaatcttctgccgttcaaacatcttttctttctcctttcggtgtcaccctcgaagctttcaccagagacaataatagtcactcccgaggtttgtgttttaaaaatatttattttatctttgtttttgttattttttccccttcttccaatgcatagaacaaagaccaagactcacgcacgtagccctatttttgtttttcattgtttatcgatttcatctcttttgagaatttccatgagtggggtttagtgtttgttcacatgatcacatctcatgaatttaaacttagtaaaacatgaaactagacatttattttgtacccttttatccttataaaatgaaaattccatttcgtatattatagatcggtgatgaatcaaacccaacgttggggatcgctttgttttttgtctatagattgggacatcaatggtggtgcatgcaataacattaacaataacgaacaaaatggaccaaagcttgagaatttcctcggccgcaccaccacgatttacaataccaacgagaccgttgtagatggaaatggcgattgtggaggaggagacggtggtggtggcggctcactaggcctttcgatgataaaaacatggctgagtaatcattcggttgctaatgctaatcatcaagacaatggtaacggtgcacgaggcttgtccctctctatgaattcatctactagtgatagcaacaactacaacaacaatgatgatgtcgtccaagagaagactattgttgatgtcgtagaaactacaccgaagaaaactattgagagttttggacaaaggacgtctatataccgcggtgttacaaggttaatttcattcatctatgtatatttttattgtgcttaaattgtgattttcttggtattgtttgggacattctaatggttcggttgagagagagtgcaacggaatgtctctcaatgtatattaaagagaaacattaattagtgtacatgggtttatatatacaataatacgtcatatatatggtatgctcttgatcatagtatataatgtttgaatttaatgtcaggcatcggtggacaggtagatacgaggcacatttatgggacaatagttgcaaaagagaaggccagactcgcaaaggaagacaaggtactatatatataaagctaattttttaattttcatttaccatttattttcaaactaatttaggttttcttttcatgtgtttcatcaaaatttgcacctgatggctctcttttcagtttatctgggtaagttcttgattttaagctataaattaataatagatgactattaaatctattctaagcaaaatataattgttgtgttatctgatcctacaggaggttatgacaaagaagaaaaagcagctagggcttacgatttagccgcactaaagtattggggaaccaccactactactaacttccccgtatgttaattaatcaataatatatacataaattcctaacttctaaccaattttagtctgaataatgccaatctcttaaactagtattatcttactattaactgtcatgtttatattgttacatttgttacaataaaaattagtaatgttggttggatataatattcagttgagtgaatatgagaaagaggtagaagagatgaagcacatgacgaggcaagagtatgttgcctctctgcgcaggtacagaatgaaactcttgaatttattgcattttagaaacccatcacgtatatatttattaaaatatatcgtaacattgaataaatcattatttggaaagatataagaaacatgtaaatatgcaggaaaagtagtggtttctctcgtggtgcatcgatttatcgaggagtaacaaggtacgtataatccatctagatatggaacgaatacagtgtttcattattttttttgatgtatacataataattgtcatacaatactattaatctaatctaattaatatttcctttaaaatggttccaaaaggcatcaccaacatggaaggtggcaagctaggatcggaagagtcgccggtaacaaagacctctacttgggaactttcggtacattttccaataaaatctatatactataagatattaaatatacacaaatatatctaagtgaatcatacaaattatgtaggcacacaggaagaggctgctgaggcttatgacattgcagccattaaattcagaggattaagcgcagtgactaacttcgacatgaacagatacaatgttaaagcaatcctcgagagcccgagtctacctattggtagttctgcgaaacgtctcaaggacgttaataatccggttccagctatgatgattagtaataacgtttcagagagtgcaaataatgttagcggttggcaaaacactgcgtttcagcatcatcagggaatggatttgagcttattgcagcaacagcaggagaggtacgttggttattacaatggaggaaacttgtctaccgagagtactagggtttgtttcaaacaagaggaggaacaacaacacttcttgagaaactcgccgagtcacatgactaatgttgatcatcatagctcgacctctgatgattctgttaccgtttgtggaaatgttgttagttatggtggttatcaaggattcgcaatccctgttggaacatcggttaattacgatccctttactgctgctgagattgcttacaacgcaagaaatcattattactatgctcagcatcagcaacaacagcagattcagcagtcgccgggaggagattttccggtggcgatttcgaataaccatagctctaacatgtactttcacggggaaggtggtggagaaggggctccaacgttttcagtttggaacgacacttagaaaaataagtaaaagatcttttagttgtttgcttt

SEQ ID NO: 1565 - DNA, 1394 bp, Artificial Sequence
  P8661 (opLexA::G1826, G1826 is from Arabidopsis thaliana)
tgtttgatctttgtccagagaactccaagatagaccaaaaaggttcaacctcaaaacaaacaacacaaaaacagccaaatagctagagaccaagatgagatcaagcagccaaaattctgaaaactccaagacttgtctatctaacaacatcaaagcaaccaccaagaatgaagaagataaagatgaagaggatgatgaagaaggcgaagaggatgaagaagagagatctggagatcagagcccatctagcaatagctatgaggaagagagtgggagtcaccaccatgatcagaacaagaagaatggaggatccgtgaggccgtacaaccgctcaaagactccgaggctgcgatggacgccggagctccatatttgctttcttcaagctgtggagagattgggtggcccagatagagcaacaccgaagcttgttctccaattgatgaacgtcaaggggctaagtattgcccatgttaagagtcatcttcagatgtacagaagcaagaagaccgatgagcctaatgaaggagatcaaggattttcgtttgaacacggagctggttacacttacaaccttagccaacttccaatgctacaaagttttgatcaaaggccttcttctagtttaggatatggtggtggttcgtggactgaccacagacgacagatctaccgtagcccttggagaggattaacgacacgagaaaatacaagaacaagacaaacaatgtttagctcacagcctggtgagagatatcacggagttagcaatagtattcttaacgataagaacaaaactatttcatttcgaatcaattctcatgaaggggttcatgataacaatggagtagctggagctgttccaagaattcatagaagttttcttgaaggtatgaaaacgtttaacaaatcatggggacagagcctctcttccaatcttaagtcctccaccgcaacaataccacaagatcatattgctacaacgctaaattcttatcaatgggagaatgctggagtggcagaaggatcagagaatgttttgaagaggaagaggttattattttctgatgactgcaataagtcagaccaagatttggatctaagcttgtcccttaaggtacctcggacacacgacaatcttggagaatgcttgttagaagatgaagtaaaagaacatgatgatcatcaagatatcaagagtttgtctctttcgttatcatcttcaggttcatcaaaactcgaccgaaccattaggaaagaagatcaaactgatcacaaaaagagaaagatttcggtcttggcaagtccccttgatctcactctgtgaatatgtataacaacttatatacgtatattctaagtgagatcttgtggtacttgttgatggaagacgg

SEQ ID NO: 1566 - DNA, 1368 bp, Artificial Sequence
  P8674 (opLexA::G3032, G3032 is from Arabidopsis thaliana)
gagggtaaatttgtgattccatctgcaaattattcctcctatatatatatagaacgtgatgaatcaaatttcttaagttgcaagccatgactaatcttgatgagtttcttgaagagctaagttctattgaatcacattctcagaaaatcgtgaagatagatgagcatttaaaaaagttggatgaagagacgaaagaagatgaagatgaagatgcggcgaagataattcaagatcggagtaccgcgagagaagcagaaattgctctacttatggatctccgtcagaactttcttccaccaccatcgatgtcatcctcctctcttcaaccaccgtcatcgtcaactctcgcaccatcgtcatcatcctctcttcaaccacccgcaccgttgatagacttctttcggtcatcagtgtcatactctcatcaaccaccgtcatcttcaactctcgcaacatcatcgtcaccgtctcttcaaccaccgtcgatgtcatcctcctctcttcaaccacccgcatctttgagggaattctttacgtcgtcagtgtcatactctcatcagccatcttcatcttcaactctcgcaacatcttcgttctttccgtcgtcaatgccatactctgttcgacctcccgattcgtctgatcgaccatctttgagggaattctttccgtcgtcaccatcatcctctattcagccacccgaatcatcatcatctaagcgagcacggcttagtaacatctttccgtcacctttatcctcctctccgtcaccgtttgttaacccgtttctccgtccgcaggcccaagaaccaacaataccaaatttcataaacccaataccacagatctctccaggcctacctgctctattcccaaaccctaaccctaatcctaaccctaacccaatcccaaacccaatccgaaacccagacttggtgtggacaaataggcttcaactagtgtttgatgacgcagttgtcagacttgggggattattcagtgcaacacccaaagccataaacgaactaatttctgaagagggtctcactggtgaccagatccgtagccacttacaagtcttgcgggatcgtcaaaaggctattgcagacaaattagccttggagtgaagaaaatattgaagatgagagataggattaaatagaaagagtgatagtatagaacgtttctttttcttttgttgttaatcttgcatattacaaacaattactatatcataatagaatttatgttaatgttggagttattaaaaaaaaaaaagttaaccataataacattcttactgtacgcatgagtgatcatttatcacaatctattagagcaaccccaatgggtgggatgatgacagtc

SEQ ID NO: 1567 - DNA, 691 bp, Artificial Sequence
  P9035 (opLexA::G369, G369 is from Arabidopsis thaliana)
ctctcggtcttcagctcaaggtatagctacattcatacgcatttcattttagggttggctttccaagttgtttgtgcacttattggaagttaatataatccttagtcacttttttgtatgtgtatagataacatagaatggaagatcattaccatcaagtagaagtggagggagaagaagagatcaagccaagcaaagaagccaacaagacagacgaaaacacatcatcattaagaatattcccctgcctcttttgttctagaaagttccatagctcccaagccctaggaggccaccagaacgcccacaagaaggagcgaaccgctgctagaagagccaaaagggcttatgattttgtcaacaacaatgacttccttcacacgttacctgttttcttatcctctccctctcaacatcacttgaccatcttaggctaccctgcttctgcctccgttgcctgttttccgacggttcatcccgaccatccgattttcaaatccagtggttctcatgtcgtgttggctacatcccaccaaggtagagattgcaaaggagggtactgttgtcaacaacgtgtagacattttggatcatcattataacgtggtcaatagtgacaagggtaaagatcagtgtcttgatctctccctacatttgtgattttagcattatcatttgttagttatggtctt

SEQ ID NO: 1568 - DNA, 2236 bp, Artificial Sequence
  P9080 (opLexA::G448, G448 is from Arabidopsis thaliana)
ccatcttcctcatcaccttcccaagaagaagaacaccaaagaagaagaaaggttaataatgatgggcagtgtcgagctgaatctgagggagactgagctgtgtcttggtcttcccggtggagatacagtggctccggtaaccggaaacaagagagggttctcagagacggttgatctgaagctaaatctgaataatgagcctgcaaacaaggaaggatctacgactcatgacgtcgtgacttttgattccaaggagaagagtgcttgtcctaaagatccagccaaacctccggccaagtaattttactattttgtcctttatgatttattttccactcttctctactgctcttaatattaacatttttgtaaaggtgactgcaaaaaaaaacagaaatttcattaaagatatatatttttcttcgccaaaaccattttatcatatgtctacggtttttttctcttcttaaatcgtccaatgtcttaatatatttaattatgtttaacccatagtctcatgcaagtaaaatttatgtgacatcacgtcaaagctaactacagtctatatcttgtataacataaccgtttttccgttttaaaaaaaatatagggcacaagttgtgggatggccaccggtgagatcataccggaagaacgtgatggtttcctgccaaaaatcaagcggtggcccggaggcggcggcgttcgtgaaggtatcaatggacggagcaccgtacttgaggaaaatcgatttgaggatgtataaaagctacgatgagctttctaatgctttgtccaacatgttcagctcttttaccatgggtacgttttataagtatattccttatatatatatgtagatccttccatgcacatttagttactaattaattgttactatagaaagaaaaattaatcatcatgatgatagatcagtcccaaatgaattaccgttatcgagtatacaaatatttcataattgagtaacccgttagtagtagtttagaaactgtgaaaagaaaactatgtgataaaatccaattgcgaaaaatgtatatttcatttgttgcaccataaaagaaaaccaccaagtttaaattcaggatatcaagttcttatacctaagattattttaggcaaacatggaggagaagaaggaatgatagacttcatgaatgagaggaaattgatggatttggtgaatagctgggactatgttccctcttatgaagacaaagacggtgattggatgctcgtcggcgacgttccttggccgtacgtcttcttcttctcccttattaattaccatttaattagagctttattgtttcggttaaaattcgagctttatttttgtttatgtcatttatttgtttctaataaataaccatttgttttaatctttttatttattagaatgttcgtcgatacatgcaagcgtttacgtctcatgaaaggatcggatgccattggtctcggtatgtattttctaccaatgcatattatattcacattgattaaattttgatttcagtttgttacccatttaaattaaaatttacgtgtatatgtatacaatatagttaaaatagcttacaaaagagatttgccccaaaaagaaaaaaaaaacttacaaaagagcttaaaagtttactataatgtacacctcaaccgcataacttggtcgcctaaataatttaatatgctatcgtttaagatgatgtctaatcatcaaacgcttaaaccgttcattatttttcgcacaattatatttctaccgtaaagaacaaatttgtcgaaagaaaacttatcgctttgatcttttaaatcattgatataatacatgatatttgattctcttttgtcaaatgcaaaaaaagaaagagattaaataacagagggaataaaaaatatactcttttaacagaataaataccgtggtcaaatgtctttgcttattaattgtaaaaatatttcagctccgagggcgatggagaagtgcaagagcagagcttgaagtcaaattaaaaggataagtggtatcgattatatatttgattaacacattgattggtgttaattgctcttttttttcttacgatgaaatacattgttcagtttcttttgattgtctgtgttttgatctggatttggtatgtagatatagtttgtatgctattatgtgtaatgaacttaagttaaatatttgagacatttgtaatggaaaatgtgtaat

SEQ ID NO: 1569 - DNA, 1254 bp, Artificial Sequence
  P9194 (opLexA::G3034, G3034 is from Arabidopsis thaliana)
gcttaaaggtctctttcatggagctgtttcctgctcagcccgatttatccttacaaataagtccaccaaacagtaaaccatcatcgacatggcagagaagaagatcaacaacagatcaagaagatcatgaagaactcgatttagggttttggagaagagctcttgattcaagaacatcttctctcgtctctaattccacctcaaaaacaatcaatcatccattccaagacctctcgctctctaacatctctcatcatcaacaacaacaacaacatcatcatccacaacttctccctaattgcaacagctctaacatcttgacctctttccaatttccgacacagcagcaacaacaacacttacaagggtttcttgctcacgaccttaatactcacttaagaccaataagaggaataccactttaccacaaccctcctccacatcatcatcctcaccgtccgccaccgccatgtttccctttcgacccgtcgtctctaataccctcttcctccacttcctcgccggctctaaccggaaacaacaatagctttaatactagtagcgttagtaaccctaattaccacaatcatcatcaccagactctaaacagagccagattcatgccaagattcccagctaaacgaagcatgagagctcctaggatgcgatggaccaccactcttcatgcccggttcgttcacgccgttgaattactcggtggccatgaaagagcaacacctaaatcagttcttgagctcatggatgtcaaagatctaaccttggctcatgttaagtcccatttacagatgtacagaacagtgaagacaaccgacaaagcagcagcttcgtcaggacaatctgatgtctatgaaaatggatcatcaggagataataactcagacgactggatgttcgatatgaatagaaaatcgagagatagcgaggaattgacgaatcctctagagaaatcaaatggtctatggaccaattcttccggagaagcacgtttgcatgggaagttaatcgataatgttgcagaaattatgctaccttctgagaaggaactagatggaaagtgctcaagttatgagagaatatcatcagaagagatgagctcatcaagcatctcgggaacaagccctttcaagccaaatcttgagtttactctgggtcgatctcactaaatttattgttgtagctaggtagtaattaattagtatcaattaacttatattttggctactgactagtttc

SEQ ID NO: 1570 - DNA, 2632 bp, Artificial Sequence
  P9218 (opLexA::G15, G15 is from Arabidopsis thaliana)
ggtgtgttcgttgtgtaaccaatgattgggttttagcttactacttcgagagattataagaaagaaagagtgaagatacattatagaaagaagagaagcagaaaccaaaaaaagaaaccatgaagtctttttgtgataatgatgataataatcatagcaacacgactaatttgttagggttctcattgtcttcaaatatgatgaaaatgggaggtagaggaggtagagaagctatttactcatcttcaacttcttcagctgcaacttcttcttcttctgttccacctcaacttgttgttggtgacaacactagcaactttggtgtttgctatggatctaacccaaatggaggaatctattctcacatgtctgtgatgccactcagatctgatggttctctttgcttaatggaagctctcaacagatcttctcactcgaatcaccatcaaggtcagtagtagtaatgttggagtttttagttttcttggtgttgatgttgttgtgtcttgtttgatgggaacatgtttggttttagggatttatgttttattttttatactaaggacattttctgttttttttggttgttatttagattcatctccaaaggtggaggatttctttgggacccatcacaacaacacaagtcacaaagaagccatggatcttagcttagatagtttattctacaacaccactcatgagcccaacacgactacaaactttcaagagttctttagcttccctcaaaccagaaaccatgaggaagaaactagaaattacgggaatgaccctagtttgacacatggagggtcttttaatgtaggggtatatggggaatttcaacagtcactgagcttatccatgagccctgggtcacaatctagctgcatcactggctctcaccaccaccaacaaaaccaaaaccaaaaccaccaaagccaaaaccaccagcagatctctgaagctcttgtggagacaagcgttgggtttgagacgacgacaatggcggctgcgaagaagaagaggggacaagaggatgttgtagttgttggtcagaaacagattgttcatagaaaatctatcgatacttttggacaacgaacttctcaataccgaggcgttacaaggttgtttttttattttataatattaaactttgtttgactttcgttagtaatgttacatatacttacttaaaaggttatgtgaaacagacatagatggactggtagatatgaagctcatctatgggacaatagtttcaagaaggaaggtcacagtagaaaaggaagacaaggtctagtgcttttttatttaattatcattaagctaaacatagaaactttttaagtagtttatgatttaacgtattactgacatttgagttttattttcttgttttctctatgtgtgataatgatttgatgatcttcttctcagtttatctgggtaagtacacacttcaatcttcatggattcatgatttccccctcaaatttctcgggaaaataatgatggattttgacttctttatttttgtttgattaaatctttattaggaggttatgatatggaggagaaagctgctcgagcatatgatcttgctgcactcaagtactggggtccctctactcacaccaatttctctgtaaatcatcttttctaaactttatgtctctttgaccttgttgtatgatttatttatataatatgataatggatatttgaaggcggagaattatcagaaagagattgaagacatgaagaacatgactagacaagaatatgttgcacatttgagaaggaagagcagtggtttctctaggggtgcttccatctatagaggagtcacaaggtccttttaaattacatttatataactttatataatacatagtttaataatgtgaatattgactttgtgtgagttttttgtactagacatcaccagcatggaaggtggcaagcacggattggtagagtcgctggaaacaaagatctctaccttggaacttttggtaattcatcatgccgatgattttgattgttaaaacttaacattttcaattgcttgtgtcttacgaaatcttttgacactatcataggaacccaagaagaagctgcagaagcttacgatgtagcagcaattaagttccgtggcacaaatgctgtgactaactttgatatcacgaggtacgatgttgatcgtatcatgtctagtaacacactcttgtctggagagttagcgcgaaggaacaacaacagcattgtcgtcaggaatactgaagaccaaaccgctctaaatgctgttgtggaaggtggttccaacaaagaagtcagtactcccgagagactcttgagttttccggcgattttcgcgttgcctcaagttaatcaaaagatgttcggatcaaatatgggcggaaatatgagtccttggacatcaaaccctaatgctgagcttaagaccgtcgctcttactttgcctcagatgccggttttcgctgcttgggctgattcttgatcaacttcaatgactaactctggttttcttggtttagttgctaagtgttttggtttatctccggttttatccggtttgaactacaattcggtttagtttcgtcgg

SEQ ID NO: 1571 - DNA, 2776 bp, Artificial Sequence
  P9236 (opLexA::G3070, G3070 is from Arabidopsis thaliana)
ctttataattcacatctctcccagtgaatccaaagacggatcttgaacaaacatgcgtggggtttggctttatctcaagaagtctcttagctgctgcaaggcacagaagtcaactgtagcttgtgatccagacaagatccaaattcagaagaaggagaatccatctggatgctcaagaagatcaatgtcgaatctgagagatgtctttgtaactaatggagatgaaggagctatgcagaatgtaagctgctgcagctcacggtctcttgagagctccaggtttgtaaacacagtgaaatttgaggagaatgcaggttattcagacagattcaaaggtttgcttagcggagcatcttcttctgatttacttcccggtcgttgttcagagagatttgatgttgttggctctgacatctgcggtttcggagttcttgcttgtcaaaaatgtcatgagagagtcagagatcttgacgcgtttgaagcacattacctctctaaccactctggtaagacttgaattagatgaactttttcattgacttttagccaatgttgtgaggagaatttgatttgttttttcttttttgcagtcgttagactcttagcaggagatttctcaagaacaactgtggaactaatctgcaacacaggctattctcacaagctaggcaaaatgaaagggaacaacatttcagcgatctttaaaatccagaacttgcagagagttgttgcagactttgaagattacagagagctcgtgaaaataagagcaaacaagctttcaaagaagcactctcgttgtatggctgatggcaacgagtttcttgggttccacggtacaactctttcttgcactctcggtttcagtaacagctcttcaaacctctgtttctcggatcactgtgaagtttgtcatattctaagacatggtttcagtcctaaaacaagaccagatgggataaaaggagttctcacagcatcaactagctctacagctcttgaatctatcgaaaccgatcaaggaagaaatagaggttcattgatagctgttgtgctatgtagagtgattgcagggagggttcataaacctatgcagacgtttgaaaattctttagggttttctgagtttgattcactagctttgaaagttggacaaaattcaagaattgaagagctttacctgttgagtacaaaagctttgttaccttgctttgtgataatcttcaagccatgaaacaagcccgtatatgcaaaatttattctttaggtttttgtatagttttctcatcttcttttttcttgcaaaatttggtgggcctgtaataggttaaaaatgttgggctttccccaaaattgaaagatggaaaacttgctggacaagtctatgcccagcctctatatttaaagggtgaagaagactgtaactgttagtgctaccattttcttcaattagggtttctttgactagctcttcgctaagaacactcatgtctcctctgcttctgagccggccttcagtgttctccctccggaaacctctgtttgtaagatactattctcttctctccccaatcacactttgttctttttttttttttttgatgatgttttgctgatgtgagatcactacaattatactcagagacgccctagtgttgggtgcttgtcatctcgacgctgaaccttgcggattgggtatgggaaaactcatgattgcaattagtagtgataattcgatgtgggttttggagaagaaggcccctgtggagttggtggaaggaggaaagggaattgtaggagcatcccatgggtgggtagctactttgaaagacggagtagtgtgtctccaagatgatctaaacccaagcacatcgaattcagacccgaaacgcatctcattgcctagtctagtaactctacctcattgccaaacccaagttgtcaccaacatggccatgtcttgctcatctcctgaggaaaatgactgtgttgtggctataagtcttaggaccacaactcagcttatgttgacccgctcaaagtaaccctgagtggatcaacatcgagattcagaactcaagcttcttctcttcccctgtcatgttttccaagagagttgagatgttctgcataccttcttctggaggtcacgttactggatcgtgggatctccacaaacacaagttgcagagggtgcgatttcgaaaccttgctaagttgacaaagaaggaatggaagcttttggattcgtgtagcaggagcgaacatttggtggagtcagcagaaaatgaaactttcttggttaagtggtacaggaagaaaagcaaagatttgaagagaatgatgacaacaaaggctgtaatggtgttcaagcttgacaaagaaggaaatgctaaaaaaaaaaaaaaaaaaaaaaaaaaaaaaaaaagaaggaaatgctgtttacactcgagacattggagatctctgcattttcctctcaaaatctgaatctttctgtgtctctgcaactagtagctacaaatccgttccttccctagtccgtaaccacgtctatgtccaggcttacgacgagtatggattcatggatatcgccaagccttttgacgattcctgggtcattcctgcctcacctgatgcgaacccgaatcctttctatattccacctcaaactatagaatatactttatctacgatgcacccggatctatgaattttttactttgtcgtctcccgttactagttttcgtacccgtttcaatgctacttagtcagg

SEQ ID NO: 1572 - DNA, 3119 bp, Artificial Sequence
  P9272 (opLexA::G2674, G2674 is from Arabidopsis thaliana)
tatgttcttctctccattgttggttttgtctttcttgttttttttttgtttctctataacttagattattgactatttaatttggttgcagagagggaaaatgaatggcgatcttgaagttgatatgtctagaggagatttcaatccaagtttttttcttggaaagcttaaagacgatgagtttgagagtagatcattgagtgatgatagctttgatgcaatgtctggtgatgaggataaacaagaacaacgccctaagaagaagaagaggaagacaaagtatcatagacacacttcttaccagattcaagaactcgaatcgtaagaagtttctggtttttaaaagaatctaaactttttcatattcatcaagtggtttttgaatgtttgatattttctgagtgtagtttcttcaaagagtgtcctcatcctaatgagaagcaaaggttggaacttggcaaaaaacttactttggagagtaagcaaattaagttttggtttcagaacagaagaacacaaatgaaggtactttatctgaaaagttatggttttgatagtagagttatgatttttatgggaatgttgtggtttttatattgaccagacgcaactagagcggcatgagaatgtgattctcaaacaagagaatgaaaaactgcggctagaaaacagtttccttaaagagtcaatgagaggctctctatgtattgattgtggtggagcagttatacctggtgaggtttcttttgagcagcaccaacttaggattgagaatgctaagcttaaggaagagcttgataggatttgtgctttagcaaatagattcattggtgggtctatttcacttgagcagccttcaaatggtgggattggctcacagcatttgcctataggacattgtgtcagtggtggaacttcactgatgtttatggatcttgccatggaagccatggatgagttgttgaagttagcagaattggaaacttctttatggagttcaaagagtgagaaaggatcgatgaaccatttccctggttcaagagaaactggtttagtacttatcaatagcttggctctagtcgagactcttatggacacggtatgctatactctctaataaccggtattttatcgatatatgcacactctactaaacgtctcatctttgttattggtttgttacagaacaaatgggcagaaatgtttgagtgcatagtcgcggttgcatcaacccttgaagtgatatccaacggtagtgatggatcaagaaacggctctattctattggtatgttactcaagaaccataaagattatatattttggcgacatttgctaattcaatgagtcctttgtttggaacagatgcaagcagagtttcaagtgatgtctccattagttccaatcaaacaaaagaagtttcttagatattgcaagcaacatggagatggtttatgggcggtcgtcgatgtttcttatgatataaacagaggaaatgagaacttgaagtcttatggtggctctaaaatgtttccttcaggatgcattatacaagacataggcaacggctgctccaaggtaacttctctttctttgttaggacaattttttatgtcttggatctgcgtgatgttttattgaattgtttatagttgagagtttggtcagtcttgtaaactaattacaaaggagtcgacaattagcctgagaacctgaagccttttgtgtataaaactataaaagattcttctatttctttgttaatacatatcaaagggttcacttttcaaggtagaggttgcttcttgtctgagctagttctaggctatcataaataatttatacaaaaatatcttgttttgtttacttatatcgatggaaacttacatattggattagatgaatctgatatgtacatttcttcgtaaaatgagttgttacttatagtcacaactattatttactcaatgtcacatatttggtttaacacaaataatttcaacaggtgacatggatagaacattcagagtacgaagagagtcacacccactcactttaccaaccgttgctcagttcttcggttgggttaggcgcaaccaaatggcttgcgactctgcagaggcaatgcgagagcttcacaatgcttttgtcttctgaagatcacacaggttttggctcgttctctttctttttctctcagcatttgaatcttgaaatgttgcaatttgaacgagagatattattcaagaatgttttacgataggtttgtcacatgctggaacaaagagtatactaaagctagcgcagcgtatgaagctcaacttttactcgggaataactgcttcgtgcattcacaaatgggagaagcttcttgctgagaacgtgggacaggacacaaggatactgacaaggaagagtcttgagccgtctggtattgtcctgagcgctgcgacatctctgtggctaccagtgactcagcagagactctttgagtttctgtgtgatggtaaatgcagaaaccagtgggatattttgtctaatggtgcttcaatggaaaacacacttctcgtcccaaaaggacaacaggaaggaagctgcgtctctcttcttcgtgctgctgtgagtttataatctattctgaatctctctattcattaaactccaaaaagatctctgttcttggttactgattagatcgatttgcaggggaatgatcaaaatgagagtagtatgctcatcttgcaagagacatggaatgacgtttctggtgcactggtggtttacgcgcctgttgatattccatctatgaatactgtaatgagcggtggagattcagcttatgtggcgcttcttccatcggggttctcgatattgcctgacggatcatcatcatcgtctgatcagttcgataccgatggcggtttggtgaatcaagaaagcaaaggatgtctcctgactgtaggatttcagatcttagtgaacagcctaccgactgcaaaactcaacgtggaatctgttgaaactgttaacaacctcatcgcttgcaccattcacaagatcagagccgctcttcgtatacctgcttagctaaagttgtaggacctaatcttgtttgtatgt

SEQ ID NO: 1573 - DNA, 1009 bp, Artificial Sequence
  P5284 LEAF-SPECIFIC RBCS3 PROM. DRIVER CONSTRUCT
aaatggagtaatatggataatcaacgcaactatatagagaaaaaataatagcgctaccatatacgaaaaatagtaaaaaattataataatgattcagaataaattattaataactaaaaagcgtaaagaaataaattagagaataagtgatacaaaattggatgttaatggatacttcttataattgcttaaaaggaatacaagatgggaaataatgtgttattattattgatgtataaagaatttgtacaatttttgtatcaataaagttccaaaaataatctttaaaaaataaaagtacccttttatgaactttttatcaaataaatgaaatccaatattagcaaaacattgatattattactaaatatttgttaaattaaaaaatatgtcattttattttttaacagatattttttaaagtaaatgttataaattacgaaaaagggattaatgagtatcaaaacagcctaaatgggaggagacaataacagaaatttgctgtagtaaggtggcttaagtcatcatttaatttgatattataaaaattctaattagtttatagtctttcttttcctcttttgtttgtcttgtatgctaaaaaaggtatattatatctataaattatgtagcataatgaccacatctggcatcatctttacacaattcacctaaatatctcaagcgaagttttgccaaaactgaagaaaagatttgaacaacctatcaagtaacaaaaatcccaaacaatatagtcatctatattaaatcttttcaattgaagaaattgtcaaagacacatacctctatgagttttttcatcaatttttttttcttttttaaactgtatttttaaaaaaatattgaataaaacatgtcctattcattagtttgggaactttaagataaggagtgtgtaatttcagaggctattaattttgaaatgtcaagagccacataatccaatggttatggttgctcttagatgaggttattgctttaggtgaaa

SEQ ID NO: 1574 - DNA, 1183 bp, Artificial Sequence
  P5287 EPIDERMAL AND VASCULAR-SPECIFIC LTP1 PROM. DRIVER CONSTRUCT
gatatgaccaaaatgattaacttgcattacagttgggaagtatcaagtaaacaacattttgtttttgtttgatatcgggaatctcaaaaccaaagtccacactagtttttggactatataatgataaaagtcagatatctactaatactagttgatcagtatattcgaaaacatgactttccaaatgtaagttatttactttttttttgctattataattaagatcaataaaaatgtctaagttttaaatctttatcattatatccaaacaatcataatcttattgttaatctctcatcaacacacagtttttaaaataaattaattaccctttgcatgataccgaagagaaacgaattcgttcaaataattttataacaggaaataaaatagataaccgaaataaacgatagaatgatttcttagtactaactcttaacaacagttttatttaaatgacttttgtaaaaaaaacaaagttaacttatacacgtacacgtgtcgaaaatattattgacaatggatagcatgattcttattagagtcatgtaaaagataaacacatgcaaatatatatatgaataatatgttgttaagataaactagacgattagaatatatagcacatctatagtttgtaaaataactatttctcaactagacttaagtcttcgaaatacataaataaacaaaactataaaaattcagaaaaaaacatgagagtacgttagtaaaatgtatttttttggtaaaataatcacttttcatcaggtcttttgtaaagcagttttcatgttagataaacgagattttaattttttttaaaaaaagaagtaaactaactatgttcctatctacacacctataattttgaacaattacaaaacaacaatgaaatgcaaagaagacgtagggcactgtcacactacaatacgattaataaatgtattttggtcgaattaataactttccatacgataaagttgaattaacatgtcaaacaaaagagatgagtggtcctatacatagttaggaattaggaacctctaaattaaatgagtacaaccaccaactactccttccctctataatctatcgcattcacaccacataacatatacgtacctactctatataacactcactccccaaactctcttcatcatccatcactacacacatc

SEQ ID NO: 1575 - DNA, 1176 bp, Artificial Sequence
  P5288 EPIDERMAL-SPECIFIC CUT1 PROM. DRIVER CONSTRUCT
tgtgaattatattttactcttcgatatcggttgttgacgattaaccatgcaaaaaagaaacattaattgcgaatgtaaataacaaaacatgtaactcttgtagatatacatgtatcgacatttaaacccgaatatatatgtatacctataatttctctgattttcacgctacctgccacgtacatgggtgataggtccaaactcacaagtaaaagtttacgtacagtgaattcgtctttttgggtataaacgtacatttaatttacacgtaagaaaggattaccaattctttcatttatggtaccagacagagttaaggcaaacaagagaaacatatagagttttgatatgttttcttggataaatattaaattgatgcaatatttagggatggacacaaggtaatatatgccttttaaggtatatgtgctatatgaatcgtttcgcatgggtactaaaattatttgtccttactttatataaacaaattccaacaaaatcaagtttttgctaaaactagtttatttgcgggttatttaattacctatcatattacttgtaatatcattcgtatgttaacgggtaaaccaaaccaaaccggatattgaactattaaaaatcttgtaaatttgacacaaactaatgaatatctaaattatgttactgctatgataacgaccatttttgtttttgagaaccataatataaattacaggtacgtgacaagtactaagtatttatatccacctttagtcacagtaccaatattgcgcctaccgggcaacgtgaacgtgatcatcaaatcaaagtagttaccaaacgctttgatctcgataaaactaaaagctgacacgtcttgctgtttcttaatttatttctcttacaacgacaattttgagaaatatgaaatttttatatcgaaagggaacagtccttatcatttgctcccatcacttgcttttgtctagttacaactggaaatcgaagagaagtattacaaaaacatttttctcgtcatttataaaaaaatgacaaaaaattaaatagagagcaaagcaagagcgttgggtgacgttggtctcttcattaactcctctcatctaccccttcctctgttcgcctttatatccttcaccttccctctctcatcttcattaactcatcttcaaaaatacc

SEQ ID NO: 1576 - DNA, 2244 bp, Artificial Sequence
  P5290 VASCULAR-SPECIFIC SUC2 PROM. DRIVER CONSTRUCT
aactaggggtgcataatgatggaacaaagcacaaatcttttaacgcaaactaactacaaccttcttttggggtccccatccccgaccctaatgttttggaattaataaaactacaatcacttaccaaaaaataaaagttcaaggccactataatttctcatatgaacctacatttataaataaaatctggtttcatattaatttcacacaccaagttactttctattattaactgttataatggaccatgaaatcatttgcatatgaactgcaatgatacataatccactttgttttgtgggagacatttaccagatttcggtaaattggtattcccccttttatgtgattggtcattgatcattgttagtggccagacatttgaactcccgtttttttgtctataagaattcggaaacatatagtatcctttgaaaacggagaaacaaataacaatgtggacaaactagatataatttcaacacaagactatgggaatgattttacccactaattataatccgatcacaaggtttcaacgaactagttttccagatatcaaccaaatttactttggaattaaactaacttaaaactaattggttgttcgtaaatggtgctttttttttttgcggatgttagtaaagggttttatgtattttatattattagttatctgttttcagtgttatgttgtctcatccataaagtttatatgttttttctttgctctataacttatatatatatatgagtttacagttatatttatacatttcagatacttgatcggcattttttttggtaaaaaatatatgcatgaaaaactcaagtgtttcttttttaaggaatttttaaatggtgattatatgaatataatcatatgtatatccgtatatatatgtagccagatagttaattatttgggggatatttgaattattaatgttataatattctttcttttgactcgtctggttaaattaaagaacaaaaaaaacacatacttttactgttttaaaaggttaaattaacataatttattgattacaagtgtcaagtccatgacattgcatgtaggttcgagacttcagagataacggaagagatcgataattgtgatcgtaacatccagatatgtatgtttaattttcatttagatgtggatcagagaagataagtcaaactgtcttcataatttaagacaacctcttttaatattttcccaaaacatgttttatgtaactactttgcttatgtgattgcctgaggatactattattctctgtctttattctcttcacaccacatttaaatagtttaagagcatagaaattaattattttcaaaaaggtgattatatgcatgcaaaatagcacaccatttatgtttatattttcaaattatttaatacatttcaatatttcataagtgtgattttttttttttttgtcaatttcataagtgtgatttgtcatttgtattaaacaattgtatcgcgcagtacaaataaacagtgggagaggtgaaaatgcagttataaaactgtccaataatttactaacacatttaaatatctaaaaagagtgtttcaaaaaaaattcttttgaaataagaaaagtgatagatatttttacgctttcgtctgaaaataaaacaataatagtttattagaaaaatgttatcaccgaaaattattctagtgccactcgctcggatcgaaattcgaaagttatattctttctctttacctaatataaaaatcacaagaaaaatcaatccgaatatatctatcaacatagtatatgcccttacatattgtttctgacttttctctatccgaatttctcgcttcatggtttttttttaacatattctcatttaattttcattactattatataactaaaagatggaaataaaataaagtgtctttgagaatcgaacgtccatatcagtaagatagtttgtgtgaaggtaaaatctaaaagatttaagttccaaaaacagaaaataatatattacgctaaaaaagaagaaaataattaaatacaaaacagaaaaaaataatatacgacagacacgtgtcacgaagataccctacgctatagacacagctctgttttctcttttctatgcctcaaggctctcttaacttcactgtctcctcttcggataatcctatccttctcttcctataaatacctctccactcttcctcttcctccaccactacaaccacca

SEQ ID NO: 1577 - DNA, 1326 bp, Artificial Sequence
  P5297 FRUIT-SPECIFIC POLYGALACTURONASE (PG, HIGH EXPRESSION) PROM. DRIVER CONSTRUCT
accaatgcgctatatattaatcaacttgataatataaaaaaaatttcaattcgaaaagggcctaaaatattctcaaagtattcgaaatggtacaaaactaccatccgtccacctattgactccaaaataaaattattatccacctttgagtttaaaattgactacttatataacaattctaaatttaaactattttaatacttttaaaaatacatggcgttcaaatatttaatataatttaatttatgaatatcatttataaaccaaccaactaccaactcattaatcattaaatcccacccaaattctactatcaaaattgtcctaaacactactaaaacaagacgaaattgttcgagtccgaatcgaagcaccaatctaatttaggttgagccgcatatttaggaggacactttcaatagtatttttttcaagcatgaatttgaaatttaagattaatggtaaagaagtagtacatcccgaattaattcatgccttttttaaatataattatataaatatttatgatttgttttaaatattaaaacttgaatatattatttttttaaaaattatctattaagtaccatcacataattgagacgaaggaataattaagatgaacatagtgtttaattagtaatggatgggtagtaaatttatttataaattatatcaataagttaaattataacaaatatttgagcgccatgtattttaaaaaatattaaatagtttgaatttaaaaccgttagataaatggtcaattttgaacccaaaagtggatgagaagggtattttagagccaatagggggatgagaaggatattttgaagccaatatgtgatggatgaaggataattttgtatcatttctaatactttaaagatattttaggtcattttcccttctttagtttatagactatagtgttagttcatcgaatatcatctattatttccgtcttaaattattttttattttataaattttttaaaaataaattattttttccatttaactttgattgtaattaatttttaaaaattaccaacatataaataaaattaatatttaacaaagaattgtaacataatatttttttaattattcaaaataaatatttttaaacatcatataaaagaaatacgacaaaaaaattgagacgggagaagacaagccagacaaaaatgtccaagaaactctttcgtctaaatatctctcatccaaactaatataatacccattataattaaccatattgaccaactcaaaccccttaaaatctataaatagacaaacccttcccatacctcttatcataaa

SEQ ID NO: 1578 - DNA, 1242 bp, Artificial Sequence
  P5303 FRUIT-SPECIFIC PHYTOENE DESATURASE (PD, MODERATE EXPRESSION) PROM. DRIVER CONSTRUCT
acgtgtaatagctaccatacaagagaagtaactcgcactgtccatgtcttatgtggctcgactcagaaagcattcagggggattgataaccaccctccaaaccaactgaaccattgtgaataaccacccttcaaatcaaccgagtcctcgtgaaggacaaatatgtggttttatatacattaaattttgtttttacatgcttcctcttacttctttagttttcttgaccatatcttgcgtttttcccttctgtaattgacacttttcttcaaaccatccagcaatgtggaagcttgacgattttccttcagagtagaaattgaaaagaatcaactaaaaaggatagtccttcgatttgatttccggcttaaaaataaactaataagaatgagagagcgaataatagaatattttgaaattttaaagatattcaactatgttaaattgcgttataaatttcttaaattagtagcacctaatagtttagttctcaaaagtcaaaactactacataatgtgctcatttttcacattaaaatgcctacatgatgtaaaagtaaaactcgtagcattctacgtgttttactcaactcaaacatcctgttcattttaataaacgtacgatgagcttctctctccaattttcttttcttttttttttttaaaaaaatatttttttttatatcaatccaaatgggctccaatttatcataaattaggtagaaacttagatattaaagaaagaaaagggtttatctcgcaagtgtggctatggtgggacgtgtcaaattttggattgtagccaaacatgagatttgatttaaagggaattggccaaatcaccgaaagcaggcatcttcatcataaattagtttgtttatttatacagaattatacgcttttactagttatagcattcggtatctttttctgggtaactgccaaaccaccacaaatttcaagtttccatttaactcttcaacttcaacccaaccaaatttatttgcttaattgtgcagaaccactccctatatcttctaggtgctttcattcgttccgaggtaagaaaagatttttgtttctttgaatgctttatgccactcgtttaacttctgaggtttgtggatcttttaggcgactttttttttttttgtatgtaaaatttgtttcataaatgcttctcaacataaatcttgacaaagagaaggaattttaccaagtatttaggttcagaaatggataa

SEQ ID NO: 1579 - DNA, 922 bp, Artificial Sequence
  P5310 ROOT-SPECIFIC RSI1 PROM. DRIVER CONSTRUCT
caatcaactaaatggacttttcttgtgcattggtcccatttttacgccctaatattcgcttacttgcttttttgtattttatttattttagttttaattttatctacctccaaattgatagaaataattacacttatagtccttttgaaaaattataattatagcattcaagtaaataaaaatacgtatttttagtcactttgtaatgtataattttgagttgaaaatgtatcaaaagtaaatttatattcttaagatatggataaagtttacatatacattatccgtttcataccctatttatagtattacattgcataagttattgtagatcttgatcgaaagtatgtgatattaatactatttttagaattatgttattctcagttatggagtgatatttaaaatcaatatagtatatcgataatcagatagtttaattcttattttctccatccaatttatataatgatattataatcaattttacgaatgagatggatattttgaaatttttagtttaaaataaattttaaattttttgtgggtctataaattatctaattaagaggtaaaatagaaagtttgaaattaattattacttactaaatatataaatatgtcattttttcttaaactgatttagaagaaaagagtgtcatatacatggacagaacgaatataatttgataattaaatttgtaaagattcatagttaatagggatcaaaattgcacgtatccattactataaggtcatatttgcttcataaaaatcatcaggatcaaaaatcagaatttatattatatttgagggactaaaaatgctaatatcacaaattaaaattagtctataaatattcacactttactcttctaattccatcaaatatttccatttatcttctcttcttcttaaatat

SEQ ID NO: 1580 - DNA, 2365 bp, Artificial Sequence
  P5311 ROOT-SPECIFIC ARSK1 PROM. DRIVER CONSTRUCT
ggcgagtgatggtatatttattggttgggcttaaatatatttcagatgcaaaaccatattgaatcaataaattataaatacatagcttccctaaccacttaaaccaccagctacaaaaccaataaacccgatcaatcattatgttttcataggatttcctgaacatacattaaattatttttcattttcttggtgctcttttctgtcttattcacgttttaatggacataatcggtttcatattgtaaatctctttaacctaacgaacaatttaatgaccctagtaataggataagaaggtcgtgaaaaatgaacgagaaaaaacccaccaaaacactatataagaaagaccgaaaaagtaaaaagggtgagccataaaccaaaaaccttaccagatgttgtcaaagaacaaaaatcatcatccatgattaacctacgcttcactactaagacaaggcgattgtgtcccggttgaaaaggttgtaaaacagtttgaggatgctacaaaagtggatgttaagtatgaagcggctaaggttttggatttggtctaggagcacattggttaagcaatatcttcggtggagattgagtttttagagatagtagatactaattcatctatggagacatgcaaattcatcaaaatgcttggatgaattagaaaaactaggtggagaatacagtaaaaaaattcaaaaagtgcatattgtttggacaacattaatatgtacaaatagtttacatttaaatgtattattttactaattaagtacatataaagttgctaaactaaactaatataatttttgcataagtaaatttatcgttaaaagttttctttctagccactaaacaacaatacaaaatcgcccaagtcacccattaattaatttagaagtgaaaaacaaaatcttaattatatggacgatcttgtctaccatatttcaagggctacaggcctacagccgccgaataaatcttaccagccttaaaccagaacaacggcaaataagttcatgtggcggctggtgatgattcacaatttccccgacagttctatgataatgaaactatataattattgtacgtacatacatgcatgcgacgaacaacacttcaatttaattgttagtattaaattacatttatagtgaagtatgttgggacgattagacggatacaatgcacttatgttctccggaaaatgaatcatttgtgttcagagcatgactccaagagtcaaaaaagttattaaatttatttgaatttaaaacttaaaaatagtgtaatttttaaccacccgctgccgcaaacgttggcggaagaatacgcggtgttaaacaatttttgtgatcgttgtcaaacatttgtaaccgcaatctctactgcacaatctgttacgtttacaatttacaagttagtatagaagaacgttcgtacctgaagaccaaccgacctttagttattgaataaatgattatttagttaagagtaacaaaatcaatggttcaaatttgtttctcttccttacttcttaaattttaatcatggaagaaacaaagtcaacggacatccaattatggcctaatcatctcattctcctttcaacaaggcgaatcaaatcttctttatacgtaatatttatttgccagcctgaaatgtataccaaatcatttttaaattaattgcctaaattattagaacaaaaactattagtaaataactaattagtcttatgaaactagaaatcgagatagtggaatatagagagacaccattaaattcacaaaatcatttttaaattacctaaattattacaacaaaaactattagacagaactaagtctataatgaaacgagagatcgtatttggaatgtagagcgagagacaattttcaattcattgaatatataagcaaaattatatagcccgtagactttggtgagatgaagtctaagtacaaacaactgaatgaatttataatcaataatattgattatattgtgattagaaaaagaaaacaacttgcgttatttttcaatattattgtgaggattaatgtgaacatggaatcgtgtttctcctgaaaaaaatatcagcatagagcttagaacaatataaatatatccaccaaaaataacttcaacatttttatacaactaatacaaaaaaaaaaaagcaaactttttgtatatataaataaatttgaaaactcaaaggtcggtcagtacgaataagacacaacaactactataaattagaggactttgaagacaagtaggttaactagaacatccttaatttctaaacctacgcactctacaaaagattcatcaaaaggagtaaaagactaactttctc

SEQ ID NO: 1581 - DNA, 4361 bp, Artificial Sequence
  P5318 APICAL MERISTEM-SPECIFIC STM PROM. DRIVER CONSTRUCT
agaatgtagcaatacaaatatatgacggtaccgttatccatcaccattatatgtatatatgtataatttgataaatattcactttgtgtttcgtcgtttgcttaataaacagctcatttccatggtattgagtcttctatatgcgagagaatcagattcccgctgggataacaaaagaacaaggtactgaaaaaaatagacaaaacttttttttaaattatataagctataaaagaaaagagtatagagagagattagccctactgtttaagagggagagagtagggtcattagggctttagagagagaagacattcggactgtccccacttgcttttctgtagaataacattatttaaatcttatttttaattaaatattacaactaaaagaagaaaccaacttttaaaataaatgcagattatatgctctgacttggactaaataaaacttgcaagtaacagtttcaagtccttttgttttagaactttttctttcgtagaagtgataaatgattgccctagacctgatagattctctaaaattctacgtattacagcataagttacctcctttatttgactattagaccatccatattggtgggcttttagcaaatgttcttaacaataattttataatttattttaatgttaagaggtttgataattttttttttttaagagtgtattttgtttattaaaatgtgttttgtttcttatataagaaccaaatcttaactattttaccaattaaacattaaatttaaattttaatatctctaagaattatattaagagccaatatagatgcttttaaaaccattggttgaataaataaatctaaccttcttaattatttctgtgtgaatattttctaaattttcattttaatttagcacaatataatccatgttctaaaaagaacaattaacataatatttacaaacctaaaaagattataaaacacaattttattttttacagcttataatgttttaaagttcaggtttattttttaaaagttcaggtttattacattaggtttgacttgtaatcatcatttatcacaacgatcaaactattattacaatcacaatagtagacaaaatttaggatatatatatatatatataattatgtataaactatgaacatttaaagtgagatttttcaaaataatatataaattcaaatagaaatagactatttggttcttaaatgagagacccccgaaaaaatctttttttttttctcatcaagctgtttacatttttagatataaaatcatattctttatagtttagaatatgaattaaatagttttatatgttattaacttatcataagatatgcgtgaggttggccaaaaactcatcaattaaccaaataagaaaagtaaaattgtattttgctttgctaaaaatgtaaatatttcattgaaaaatgaaaaaggtttaggtaatacaattaagtaaatcctacaattttggttccatggcaaaagaataaaattgtattgctttggtaaaagttgatccaactaatatattcagtagaaactgcaaaactgaagaaataagtttgtttagtagaattgctttcggttatgtaatgaatatacatccaaaatggctttttagtaatgatgtcttttcatactctttccaatccctactactttcagattatttgtcctactattatagagatatacgttcgttttcaataatatgaaaagtgatatatatttaaatagtgtgatatatatataagttttgcaagtgcatcacttcccaaaatcgcataaatcattaatcatattgtcgaaaacagtataataacttcttaaacgaaaacgcagcgcaattaaaaataacaactagagataattgacaaaacattgattaatatttacctataagttaattattgtatttaaaatttatttaaagttcataaggaaaacatatgcaaaaatatttatatctaatattttgctatgttatccttttttttttttacgttatcctaattttgtttatcctaatttgttgtggttaaaatcttattattgataaaaagagaacttttttttttgtcatcataaaaaagagaacttattacttcgattttaaaattctatgagcgtaggagacaaagaaaaaaaaaataaaaaaaaaaagaagagaaaaatcacttcttttcttctttttagtccagatccaacatattttggataactaaatgaagattttttaaaaaaatatattttagggtatatataaatcataatttgaagcaaatgaaataaaatccagtttggtaatatataaatatgatttgatgggttccttgtaatctctctctatctattagtttctcagttatcttttctttgccagaaatggcagtgaaggcagtggctgaggagagagttttttttcttctttcatggggaaagtaaaactttgccttgaagatttctctcttcaatatttttctaagacttttgatttcaacgaatcactgtccttaacctaaaagcaagaaaaattagctttatactggtctttacttttttttaacatatttatttttatatagtttacttataaacatagacatacgagtatgggaatatatagtatatccaacttctaaataatatttcgaatagtgataacaaaattagcaatacatacggctagtgaaatgttgatcgaataaacggcactgatgtaatgtacttatcaattttgataattttaattgtattgtttttctttttttcccacagtattgaactagacaattaaatttaaagtaaaattatacatttctttcgttgtgtattaaagtaacatgcataatatcattttccttcgtacaatcctccaaattgacaattgatgaattactttgtcaatcgtaaatgaatttttctcaagtctgtatactattttcagggataaacaggtacaggtgtcccatgcttattctcttgatagtaacatgtgtcctatgttgagtcaattctacgttcgaagaagtgctaacaattgttaatagcctcgtatattattctaattaaaatgcctcgatagatttggttagtggtctgaatgtgattggttattttttcaagtggcaagaggtctaccatctaatattacaatcaatcgaccaaaaaggtcgagaacatgataatggtggcaaatacaaatggttcattgttgtctaatataacaagccatcagttgtcactttttaaaaacaatacagaatacaagatactttttttttaaggtaaaatgtgtgtttaatattttcgtttatataacaaataaacagttacatgttttactctatgattatatttatgacatttttcttcttcttaacaacatttttttcccataagaacatttacaatagtattaaaactttgattgcaatcaaatgttagatcacttattataaaattactaagactgctatcttttcctattgacaaaagcgaatccaatatatgttactgaaacaaatgcgtaaattatactatatggagatctatcggttaattattgagagaatctaagaaagtttttgagtacaacagtcctaataatatcttcacataccatataatatacatatatacatatacacaaatgtactttttaaaccaacatcagcatacgtatatcccatcaggaaacttagacttttgggaattcatggtatgaaaaccaaaaccaaatgacaacattcgatttgatactcccgacccatggtaaagaaataacaaattccaatatatctttcactggactttccgaggcacattccggttttctccatttcaagaaattgtcaaaaataaattgagatccggtttattacctcaaaaaagaagaagagaaattacaacattaatttccgaaaaggcataaatgagaaatcatatttcagcagaagaacacaaaagagttaagaacccacagatcacacaacctctgtccatgtctgctttttacacttttttaaaataagtttctcctaaaaagttatttcctatttataataatttccttagatttatcttcctggtctctcttctgctgcttccctctcccccataactatcactatttagaattttcaatgtggaaaaggaagctgattgttgaagcataaatcccgggagaccacttttgcattttcaaataattaaattaaaccatagatacacacacacagttacttactcttttagggtttcccaataaatttatagtactttaatgtgtttcatgatattgatgataaatgctagctgtatttacaatgggggctcct

SEQ ID NO: 1582 - DNA, 4801 bp, Artificial Sequence
  P5319 EMERGENT PRIMORDIA-SPECIFIC AS1 PROM. CONSTRUCT
ggaccgtgtaatgggccattgggccaagttttcttgatataaaatctgaaatactactaaattacaatttttcttaaactcgatttcataattcatgtgggactcagttctccgcgtcttatgacttaagagttaagagtaaagacaattgattgtagtttgcattattaaggttgtgattttaaaggctatattggcccaggcaaagtggttatgaaagttaaaaggtattattaaatgtcgttatggactagctaaagaaaagagatggatatagaaacggatttgccagtttgtgaggttacgtactcgttactttctattgcatttttgtgtgtcattgtgcttgtgatttctttagtatatgtttttctttttgtcaaactctttagtacatgttatgctttattttcttgtttagcattgttattgttattttgatccatgttcttttacttaatgtgtagagtgttcacgtacgactctttatgatcgctatactaatatactatgaaactcgaatgagaacatgcatgtcataaatcaataaaacataacatacgacacttaacctaaatcatacattcattgattcatactatcatgatcctcatcacattagtatcatttgtctttatttattacttagctacttcgttatcttattatatctttacctgttctgctggtcatttgccataaacaccaagtacaagcaactctttagtccaatatcagaccaaattaacaaacatttccccaatccaaaacggaaatttaattataattagcatttaaataggttcgattacaaaaaaaaatcaacaaaggaacaagtcaatttcataatggtttgtcaattgtcacacaacgaaatggctagccggatcaagcatgcatgatccaaatttcaacatttccatgataacctgaattataacgtctacataaaccatatttaaataaataggatggtcgaaagatatcattaaaagaacgattcaatattctttattgttcaattgatacacatgttattctccttaaccagttatgaacatgtcctacaagtttcttgacccaaactcataatttcatataccataatcccaagttaagttttttttttttggggatcaaaatctcaagttaagttaagttcaattatttagctgtaatgctcggaaaaaagatcggatgaatatccaattggttcaatatataccccaatccggccaatctccctatctttatagcttaattattagagaatggtcaattcacgccatcagaaccagtttcatatcttcatgaaccaaaacgcctacaaccctattattcaagaaatcactataattgtccaagtaaaaccattaattaaccgagtcgatttttctatggtcctataggcatgttgttactcaaactactgattaattaataagaagttgtagtttgaaaaagaatctagctgaaaaatactcctactctaagaatttaagttagaataaaacatattaatacaaatataaaaatttagttattaaaaaagcgctactaccaagacgtcctaaagaaaaactagctttgtcttctaaaagaaaacctagcttaactacccaaaaaaatctagttttacaaacactaaagacaaattttatttttcaacaaatttaccaattaaagaaaattccatgtaggaatgtatccaaattgaaaatatccctacatattttgtaggaaaaaaggtttttataaatattaaaaaaacgagaaaaagaaaagagaaaagagaaaaaaaaaagccggagagaatggagcacatgaggtaaaaggcaagagatggcagagagaagatcagagaagggatctgcctcaatttgacaactcatatgtcatgtcatttccctcactactattattttcctatttcaaaaacacctttctctgataccatcaccttttaccttctctttttttttactgtctttgctctgtttcacattcccttctatatatacagtatagtatattttatccttcttttattgttttgcttactaaaagtttttttcctccggaatcaaaattctaaaatgtatatcatgttaggtcgcgagggccatgcaatattatgaactatgcatgatgattaatgtctgtggatccatcacaaatattattgaaggttgatcagagactatggaccaaaatggtccgaatcgcctgataataaaaaactattcatttttattttttattttttttattaaacatgtgattaatgatagatcttacgattcgcaactgggaaacatgcactaactcaaacttaaaacacacaatactaaaagttctattaaattttgaatgtaaagagaaatatattaggcaatcaaacggtcaagtaaatcatacacatcgataatttatttttttatccttcaaagcaggcccatccaaggcccaccactattctcatatcaacatacttttcttgttttggttaaatcaacctaccatgttggctgttctctccgctcctctgtgtaagatcacaccaacaccactgcataatttcttgtattattttgagacttgagagtaaactgattgacaaaaaaaaaaaaaaaaaaaaaaaattgagagtaaactagtttcttgaatattgattttttcagcttaatttgttggggaaagatattactactattgctgtaaaaaaaaaaaaaaaaaaaaaagatattattactatatttgtagtgattttattttgaaaattctcttcacttttttgtagttaacattctaattttgtgaaaagaacttttaatgtcaggtcatgtctcttaaaaagtttgcatgatgaaatgatttacaaattacaatagaaaatggaaaccattgcaaactaaatttttatcaaaaaaaatcgaaaataaaatgtattgacttagtaatgctgtgtctgctacgattaactattacacataatgcaacactgaattatccaaatacattattagaataatagtattacagtatcactattacaacaacaatgtcaacaataatcttattataataatatataaatagaccttagtgacatcatattatatagaaaacatgtggttgcctaatttgtataagctagatacttgggggtgatgagtgactagttgatgcaatgataaaagagtgaaagttttgtctgcctgattatagacgtcggagaaatactaaaatacgctatgaagattttggcgcatggtagcagaaaaaaaaaacggagggtgtgagtgagtagtggtagtcggatgtgatggaacaaagaaaagtatttttggtagggttatgggagagagaaggggaccattattacacacttacatgctttccccaaaagataccattcccattttctgacacgtgtccccctcatccccaattactcatacgtcaaatccaatttttagcctaaaagttttttttatttgtttagccaaatctattttactaattaaagttttcaaatggcaaatagaaagatcttctaaggttttataaaattacttgattatttctagttttgctcattttttaaataaaatttctcttttttttcttgcaacattattgattttttttttgatagggagtaacattagtgatgttctatctcttctcattgcaaaaactttattttctcatctctatttgatcatcattgcgaaatcttccattttcaacaaatacttttccatgttaatatgctgtttcaaaatataagtgtttggaaaataaatcaacaagtttaaatgttaactatttttatgctattataattatttttcttatgggtaagtggaaattaatgttactcaaattggacataaaattctattgtttgagtgaaggagtttataaatggagcattattttcttgaatggttagtttttcttctatcattttgacaagtaaatgacttttcagccactaaagtacaacactttttcatttaaatttaaagcatcccctacattagattgtcattttatttctcataatgttatagaaaaatgaattttgagatcccaatgtagtaaatatatataaaaaaaggtttaatattgtcaatgacaaacaacgaacttatggaatttcaacttttcacctccacgcgcctctgtcagagttttttttttccccacttgtgatgtaaaaaggggaaaacgtctgtgtctcagtcggtaaactttttctctctttttttttttaaagattttattttaattatgccgtctctgtggtctaatcgtgtacgtcgtctggttttaaaagcctctctcactttggtcttttcgttttctctcttccattttctccaactatataaaaaaaaaaaagtgagagagagagcaaatctgtgtgatggaagttgctcttgagtttgggattatttatcttttcaatatcatttggtaagcatttttattttgttttatagtaataattttaactctcttatcttcttaataagtctttgcttaatagtgttttggggtcagcattaatttcccctgtttggtttccagaatataggttgtatagtgtgataataacaaattattccaagttttgcttcaaacattgtcaaagtttttgtcattttcatttcttgaaacggaaatttttcagactttgtaatttctaattcgaaaattcgacagatcttgtagatttgtttcgatcttttagagttttgaattggagagatttatgaaacgggttgatttt

SEQ ID NO: 1583 - DNA, 1109 bp, Artificial Sequence
  P5324 FRUIT VASCULAR TISSUE AND COLUMELLA, SEED AND ENDOSPERM SPECIFIC CRUCIFERIN PROM. DRIVER CONSTRUCT
ctacacgttttgaaaagttaacctgttggttaaatggttagctatgactctcgcaacaaacccaacccttaagatgatgatggtttaacatttgacaacatagttaagactgtgtctatataatagtcaacaaattcagattgtagtattatggagtcaacatatttcgagatcaaaaacattcaaaacgtaaatctatcgacgtctcacatagttttgttatgaagctgatgaaaaaagttggaagacatagttttgcaaacatcatttgttgctaacgtataaacgttggtttgattaaatgtaataggataaggatatccgtttgttcatataattgagttaaattatattttggttattataatatgttaagttgaaaataaataggtccaacaaccttgtttaaatagattttttaggagtgattcccttttaatagtatagattatactctcttcctaatcgaccttccgtggggtaaagtggtcaattatattctttatggatgagcttgattgagaatgggtttatgggttatgacaagggcatgtacaaatgtcactgcctcttgacatgcaaccgaacagttggcgactcaagtcgcagaagatacaacggaccaaaccctccgagtgtcgccgcgtctgttatgtgtcacctttttgtctcctttccttaaaaattggtaactcatttttcaaaaaaagaagaggatagttttggctgtatctcctaaactattcgatcacaacgccagatattttaatactggatactagtgatgtaatttgatttgttaattgtcaaaaagtagattctcctatctcgtttttagttcaattattatatggttaaatgaatttaagtcgattagaaatgattagttaatcaaccagagttgctctataagtctatactgataacatgaaccattttctaaaaatgagatagatacatttgaattttgtcgtggtttggagtatgcggagatagtcgtacgcgcatgaacatcatgagacacttgcttcagctcacagagtgacgtgtaaagaccatagacccacgacttcatgcaaacccattcctacgtggcacaaaccttcatg

SEQ ID NO: 1584 - DNA, 3446 bp, Artificial Sequence
  P5326 FLORAL MERISTEM, STRESS INDUCIBLE-SPECIFIC AP1 PROM. DRIVER
cacggaccttggatctgaagttatgaacaataacatatttggcaaaacaaagaaaaaagaaacaacaatactaacatattttggtaaaagaacattgagaagtctcaaaaattaacttcttcttattttgtttcctaataagaccgtttgcttcatttcaagttcttaggaaataatttcatgtaacgtgtatgtagatatgtttatgtacagataaagagagatctgaaaatgatatatagagcttttgtggtgataagtgcaacaagcaggatatatatatcgaacgtggtggttagaagatagcgtcaaaatagatgctagctgctgcgtatacatcatattcatatcatatgtacttctcttttgtgatttctcatgtgattgaacatactacataaatcttgatagatttataaaaatgcaacaaattgttgtttatataagaaaaataaaacactgatatgatatttcattagttattatcaaatttgcaatataatgtttaacatccaagatttgttttacataatcgttacggttactaaagtttaatttatgatgttttaaaacaaattgagactaaatttctaaaagaaacatatacgtacatgtgtgtagctgcgtatatatatagaatggtggggctaaaagctaatgatgtgtacattaattggacatttgatgtggctggattggacccaacttgctctttgatagagacctaactaagacaattttgctcttcattcatttctcccgtatacataattgaattaactgtacataatgtttcacaacaagcgatctagctatatatttcaaaataacagagactgatattttaatctggtcttctaagctctaacgtcaaattaaaaaaaaaatccgatcttctaattaattagaagaaatcaattatagaacctctctctttaatttcatttatttaaaactgcttggaaatttaattattcactaaagactcactattctccttaatttatgataatttgtagatcatatgttcagtttttatttatttgccattcgaatgttgagttttaattaaaccaatatgttaatattcgaattaaaaaaacttacctataattcacttatttaaaaacataaaataataataattgcatcaccgtgatacaaagcaacctcacaagtcacaactctcgtgactacaaagatcactcattaaacaaaccttcctgccttctttttttctacttgggcacctcgaccgatcgaagactattcttgggatctgcttcaaaaacgactatatgttctaaatccacttcgtatgatgacgaacatttggtttactactgaagatagagattacgtccttctaattagaagtaattaattattttagtatttggaagctaatggtggagatgtaaccgtatcttagtggatcgagatattgtatataaaatatgtatgctacatcgaataataaactgaaagagagtaaaaagggatatttaatgggaagaaaagaagggtggagatgtaacaaaggcgaagataatggatattcttgggatgttgtcttcaaggccacgagcttagattcttttagttttgctcaatttgttaagtttctacttttccttttgttgcttactacttttgctcatgatctccatatacatatcatacatatatatagtatactatctttagactgatttctctatacactatcttttaacttatgtatcgtttcaaaactcaggacgtacatgtttaaatttggttatataaccacgaccatttcaagtatatatgtcataccataccagatttaatataacttctatgaagaaaatacataaagttggattaaaatgcaagtgacatctttttagcataggttcatttggcatagaagaaatatataactaaaaatgaactttaacttaaatagattttactatattacaattttttctttttacatggtctaatttatttttctaaaattagtataattgttgttttgatgaaacaataataccgtaagcaatagttgctaaaagatgtccaaatatttataaattacaaagtaaatcaaataaggaagaagacacgtggaaaacaccaaataagagaagaaatggaaaaaacagaaagaaattttttaacaagaaaaatcaattagtcctcaaacctgagatatttaaagtaatcaactaaaacaggaacacttgactaacaaagaaatttgaaacgtggtccaactttcacttaattatattgttttctctaaggcttatgcaatatatgccttaagcaaatgccgaatctgttttttttttttttgttattggatattgactgaaaataaggggttttttcacacttgaagatctcaaaagagaaaactattacaacggaaattcattgtaaaagaagtgattaagcaaattgagcaaaggtttttatgtggtttatttcattatatgattgacatcaaattgtatatatatggttgttttatttaacaatatatatggatataacgtacaaactaaatatgtttgattgacgaaaaaaaatatatgtatgtttgattaacaacatagcacatattcaactgatttttgtcctgatcatctacaacttaataagaacacacaacattgaacaaatctttgacaaaatactatttttgggtttgaaattttgaatacttacaattattcttctcgatcttcctctctttccttaaatcctgcgtacaaatccgtcgacgcaatacattacacagttgtcaattggttctcagctctaccaaaaacatctattgccaaaagaaaggtctatttgtacttcactgttacagctgagaacattaaatataataagcaaatttgataaaacaaagggttctcaccttattccaaaagaatagtgtaaaatagggtaatagagaaatgttaataaaaggaaattaaaaatagatattttggttggttcagattttgtttcgtagatctacagggaaatctccgccgtcaatgcaaagcgaaggtgacacttggggaaggaccagtggtccgtacaatgttacttacccatttctcttcacgagacgtcgataatcaaattgtttattttcatatttttaagtccgcagttttattaaaaaatcatggacccgacattagtacgagatataccaatgagaagtcgacacgcaaatcctaaagaaaccactgtggtttttgcaaacaagagaaaccagctttagcttttccctaaaaccactcttacccaaatctctccataaataaagatcccgagactcaaacacaagtctttttataaaggaaagaaagaaaaactttcctaattggttcataccaaagtctgagctcttctttatatctctcttgtagtttcttattgggggtctttgt

SEQ ID NO: 1585 - DNA, 1839 bp, Artificial Sequence
  P5486 HEMAGGLUTININ (HA) EPITOPE C-TERMINAL TAG, 35S
atggaagcgttaacggccaggcaacaagaggtgtttgatctcatccgtgatcacatcagccagacaggtatgccgccgacgcgtgcggaaatcgcgcagcgtttggggttccgttccccaaacgcggctgaagaacatctgaaggcgctggcacgcaaaggcgttattgaaattgtttccggcgcatcacgcgggattcgtctgttgcaagaagaggaagaagggttgccgctggtaggtcgtgtggctgccggtgaaccacttctggcgcaacagcatattgaaggtcattatcaggtcgatccttccttattcaagccgaatgctgatttcctgctgcgcgtcagcgggatgtcgatgaaagatatcggcattatggatggtgacttgctggcagtgcataaaactcaggatgtacgtaacggtcaggtcgttgtcgcacgtattgatgacgaggttaccgttaagcgcctgaaaaaacagggcaataaagtcgaactgttgccagaaaatagcgagtttaaaccaattgtcgtagatcttcgtcagcagagcttcaccattgaagggctggcggttggggttattcgcaacggcgactggctggaattccccaattttaatcaaagtgggaatattgctgatagcgcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagctgctgctgctgaggatcctgaagctcgaaaaacaaagaaaaaaatcaaagggattcagcaagccactgcaggagtctcacaagacacttcggaaaatcctaacaaaacaatagttcctgcagcattaccacagctcacccctaccttggtgtcactgctggaggtgattgaacccgaggtgttgtatgcaggatatgatagctctgttccagattcagcatggagaattatgaccacactcaacatgttaggtgggcgtcaagtgattgcagcagtgaaatgggcaaaggcgataccaggcttcagaaacttacacctggatgaccaaatgaccctgctacagtactcatggatgtttctcatggcatttgccctgggttggagatcatacagacaatcaagtggaaacctgctctgctttgctcctgatctgattattaatgagcagagaatgtctctaccctgcatgtatgaccaatgtaaacacatgctgtttgtctcctctgaattacaaagattgcaggtatcctatgaagagtatctctgtatgaaaaccttactgcttctctcctcagttcctaaggaaggtctgaagagccaagagttatttgatgagattcgaatgacttatatcaaagagctaggaaaagccatcgtcaaaagggaagggaactccagtcagaactggcaacggttttaccaactgacaaagcttctggactccatgcatgaggtggttgagaatctccttacctactgcttccagacatttttggataagaccatgagtattgaattcccagagatgttagctgaaatcatcactaatcagataccaaaatattcaaatggaaataccaaaaagcttctgtttcatcaaaaatga

SEQ ID NO: 1586 - DNA, 4276 bp, Artificial Sequence
  P6506 CONST. 35S PROM. DRIVER CONSTRUCT
catgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcggcggccgcaagacccttcctctatataaggaagttcatttcatttggagaggacacgctcgagtataagagctcatttttacaacaattaccaacaacaacaaacaacaaacaacattacaattacatttacaattaccatggaagcgttaacggccaggcaacaagaggtgtttgatctcatccgtgatcacatcagccagacaggtatgccgccgacgcgtgcggaaatcgcgcagcgtttggggttccgttccccaaacgcggctgaagaacatctgaaggcgctggcacgcaaaggcgttattgaaattgtttccggcgcatcacgcgggattcgtctgttgcaggaagaggaagaagggttgccgctggtaggtcgtgtggctgccggtgaaccacttctggcgcaacagcatattgaaggtcattatcaggtcgatccttccttattcaagccgaatgctgatttcctgctgcgcgtcagcgggatgtcgatgaaagatatcggcattatggatggtgacttgctggcagtgcataaaactcaggatgtacgtaacggtcaggtcgttgtcgcacgtattgatgacgaagttaccgttaagcgcctgaaaaaacagggcaataaagtcgaactgttgccagaaaatagcgagtttaaaccaattgtcgtagatcttcgtcagcagagcttcaccattgaagggctggcggttggggttattcgcaacggcgactggctggaattccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtagctagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatctagaacatatccatatctaatcttacctcgactgctgtatataaaaccagtggttatatgtccagtactgctgtatataaaaccagtggttatatgtacagtacgtcgatcgatcgacgactgctgtatataaaaccagtggttatatgtacagtactgctgtatataaaaccagtggttatatgtacagtacgtcgaggggatgatcaagacccttcctctatataaggaagttcatttcatttggagaggacacgctcgagtataagagctcatttttacaacaattaccaacaacaacaaacaacaaacaacattacaattacatttacaattaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctctagctagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatcgacctgca

SEQ ID NO: 1587 - DNA, 1510 bp, Artificial Sequence
  P9002 STRESS INDUCIBLE RD29A PROM. DRIVER CONSTRUCT
ggttgctatggtagggactatggggttttcggattccggtggaagtgagtggggaggcagtggcggaggtaagggagttcaagattctggaactgaagatttggggttttgcttttgaatgtttgcgtttttgtatgatgcctctgtttgtgaactttgatgtattttatctttgtgtgaaaaagagattgggttaataaaatatttgcttttttggataagaaactcttttagcggcccattaataaaggttacaaatgcaaaatcatgttagcgtcagatatttaattattcgaagatgattgtgatagatttaaaattatcctagtcaaaaagaaagagtaggttgagcagaaacagtgacatctgttgtttgtaccatacaaattagtttagattattggttaacatgttaaatggctatgcatgtgacatttagaccttatcggaattaatttgtagaattattaattaagatgttgattagttcaaacaaaaattttatattaaaaaatgtaaacgaatattttgtatgttcagtgaaagtaaaacaaattaaattaacaagaaacttatagaagaaaatttttactatttaagagaaagaaaaaaatctatcatttaatctgagtcctaaaaactgttatacttaacagttaacgcatgatttgatggaggagccatagatgcaattcaatcaaactgaaatttctgcaagaatctcaaacacggagatctcaaagtttgaaagaaaatttatttcttcgactcaaaacaaacttacgaaatttaggtagaacttatatacattatattgtaattttttgtaacaaaatgtttttattattattatagaattttactggttaaattaaaaatgaatagaaaaggtgaattaagaggagagaggaggtaaacattttcttctattttttcatattttcaggataaattattgtaaaagtttacaagatttccatttgactagtgtaaatgaggaatattctctagtaagatcattatttcatctacttcttttatcttctaccagtagaggaataaacaatatttagctcctttgtaaatacaaattaattttccttcttgacatcattcaattttaattttacgtataaaataaaagatcatacctattagaacgattaaggagaaatacaattcgaatgagaaggatgtgccgtttgttataataaacagccacacgacgtaaacgtaaaatgaccacatgatgggccaatagacatggaccgactactaataatagtaagttacattttaggatggaataaatatcataccgacatcagttttgaaagaaaagggaaaaaaagaaaaaataaataaaagatatactaccgacatgagttccaaaaagcaaaaaaaaagatcaagccgacacagacacgcgtagagagcaaaatgactttgacgtcacaccacgaaaacagacgcttcatacgtgtccctttatctctctcagtctctctat

SEQ ID NO: 1588 - DNA, 2649 bp, Oryza sativa
  Predicted polypeptide sequence is orthologous to G2
gactacgttctctccattccatctccccccaatcgctcgggcgcaatgcgcagcagcagcagcaaggccacacccacaacctcccctgcttttcgcgtcctctgctctcctcctaggttagcagcggctttgccaacgagatagataggcaaaagagaaagtacttgcatagcccaacaaggcaacagctgctgctaccctctctttcttttctctgcttctccttgctctctcttctcttcctttctttctttctatctcctgctcgttctttccattttcgagagctcaacggaggaagaaggagagagagagaggcaaaggggagcaaaagaagagcagcatggacgggtttggtattggattcgtcttgttttgggcatttcttgcttctgctccttttacctttcatagcaacatcttatcaagttattcttgccatactctctcctctctctctctctctctctctctctcttctcttctctcatcactcaccatcttcttgtcttctctctctcctctcatccttttgtgcaatgcagggattgtggcaagcaggtctatttgggtaagtttcattcatgtccatcttgtccataccccccatacttgggaactgctacaagcggcctccacgattggctcgccaattggagccgttttttctctatgggcgcggtttcgattcctcacaatggctgcctttgtgacgactgaatttgcaggcggatttgacactgctcatgcggcggctcggtaagttggactcaattcctcgtcttccaatcgctgacttctattccctgctcgcccaatcgaatccggcgctgtcaaaattctaatcttttttgttatgttcatttcccaatcgcagggcgtacgatcgggcggcgatcaagttccgcggcgtggaggccgacatcaatttcagcttggaggattacgaggatgacctgaagcaggtgagagcgcgatcgattattattacctgaactttcctttcttttcatgagtcgccacggtttcgttagatcatactactattactgtagctgcaagattaacgggatcattgcagatgagcaacctgaccaaggaggagttcgtccacgtgctccggcggcagagcacggggttcccccggggaagctccaagtacaggggcgtgacactccacaagtgcgggagatgggaggctcggatgggccaattcctcggcaagaagtatgtcctaatcgatcaccgtttcttcctctttcgttcgatcgttcgttcttgggcaatctcccgtaaatcatcttgtgggtttttggtgcactgcaggtacgtctacttggggctgttcgacaccgaggaggaagctgccaggtaaaattattgggccgcactgtgcgcgcgcgcggccattgttgttgaatgtcgagtgtggctgctgcgccgtttgcgagtttacgcttctgggttagatgggcgagcggtgatggtgattgatgtttcttgtctcttggccacagggcgtacgaccgcgctgccatcaagtgcaatggcaaggatgcggtgacgaacttcgatccaagcatttacgccggggagttcgagccgccgggtgggtgtgtcatgtgtgcgcttactgctcatggctaggctgttcgtttgtgagttgtgactgctcatccggacaaaatctgtcactgttttgcagcagcggccacgggtgatgccgccgagcacaacctggacctctcgcttgggagctcggcgggctccaagaggggcaacgttgacggtggcggggacgacgagatcaccggcggcggtggcggtggcgcgggctccgaccagcgcgtccctatggcgttcgaccttgactggcaaacggcggcggcgaggagcaccaaagctaaggtaaaaaaagaatggggactttgctttccgcatcagccgattgtcttctcatcacgtaataaaaaggcttaaaaattcctcgttttcttgtctagttcgaccagaactcgaaccatccccagatgcctccggtcctgcaggtcacccacctgccattcagtcccaggcatcatcaccaagtgggtagctcactatacaactccactccacttcgctccatttgctgctgaatttctcgcgtttggtttcaccggtatccgtgagctgatgaattcttgatgtctgtgctgctagttcttgagcaatggtgatccggggacagcgggaggcctgtcactgacgatcggcgcaggcatggccgggcactggcctccccagcagcagcaagggtggggcaacgccggcggcatgagctggccgcacccgccgcacccgccgccgccgccgaccaacgccgcggccgccgcaaccgctacagcagctgcagcatcatcacgattccctccctacattgcgacgcaagcctcaacctggctgcagaagaacgggttccattccctgacccggcccacctaagatgatcaaagatttaaaattcaagatcgctgcattcatcgtctcctcgtcgatcgatcatggcaaagatcgatggagagagagaggtgtgtgtcactgacgcagggaaaaactcaatgcagatttaccagcaagaacaagagctggatgctattcttttgctct

SEQ ID NO: 1589 - DNA, 1671 bp, Oryza sativa
  Predicted polypeptide sequence is orthologous to G2
gtatgtcctaatcgatcaccgtttcttcctctttcgttcgatcgttcgttcttgggcaatctcccaatcatcttgtgggtttttggtgcactgcaggtacgtctacttggggctgttcgacaccgaggaggaagctgccagggcgtacgaccgcgctgccatcaagtgcaatggcaaggatgcggtgacgaacttcgatccaagcatttacgccggggagttcgagccgccgggtgggtgtgtcatgtgtgcgcttactgctcatggctaggctgttcgtttgtgagttgtgactgctcatccggacaaaatctgtcactgttttgcagcagcggccacgggtgatgccgccgagcacaacctggacctctcgcttgggagctcggcgggctccaagaggggcaacgttgacggtggcggggacgacgagatcaccggcggcggtggcggtggcgcgggctccgaccagcgcgtccctatggcgttcgaccttgactggcaaacggcggcggcgaggagcaccaaagctaagttcgaccagaactcgaaccatccccagatgcctccggtcctgcaggtcacccacctgccattcagtcccaggcatcatcaccaattcttgagcaatggtgatccggggacagcgggaggcctgtcactgacgatcggcgcaggcatggccgggcactggcctccccagcagcagcaggggtggggcaacgccggcggcatgagctggccgcacccgccgcacccgccgccgccgccgaccaacgccgcggccgccgcaaccgctacagcagctgcagcatcatcacgattccctccctacattgcgacgcaagcctcaacctggctgcagaagaacgggttccattccctgacccggcccacctaagatgatcaaagatttaaaattcaagatcgctgcattcatcgtctcctcgtcgatcgatcatggcaaagatcgatggagagagagaggtgtgtgtcactgacgcagggaaaaactcaatgcagatttaccagcaagaacaagagctggatgctattcttttgctctaccttttttcttctctctttcttcttctctgtttcttgattgggcgagcgagatggagatggatctgatcatgaatgggacacaagtgggcatgtaaatgaggagctccctagaaggcgagagagattggccaagcgtcgcctcaagcagtgtaggagtatctatcttttgccgtttcgctcgctttctttccttcttttctttcaccatggccaacaacgatgactctgggtgtcaacatcacagctcattttgttcggtctcatgttgcatcattcactgcatgatgaccatgattcgggaaaatttgctccatgcacctccgcttggccgacaacacttgccctctagtaagcatccttaaacacccacggtttctactactattcatcgctttataaatcctacggagtgctagctttacgctactactactgtcatgtaatctatcatcatcaaaagagacgatcagattaacatatatgtcaactatttaagctttggctctttgctttccaagaaacgtaactgccgagatgtggagcatatagaagtattcgtccttctagatgttggtactaaagtaatgttctttcttttctccctct

SEQ ID NO: 1590 - DNA, 2001 bp, Oryza sativa
  Predicted polypeptide sequence is orthologous to G2
gacgtcccatccatccctccccccccttttccctcctcctccacctccactgccatggccgcctccgccgctcctctctcccgcgtggtagccgccgccggttgccgccgctaggggagcgcgacgggggaacggtaggggcgacccagctcgctctgtcgccccgcggctggtgggggtgcgcgcgggggagagcggttggttagtatggtgctggatctcaatgtggagtcgccgggtgggtcggcggcgacgtcgagctcgtccacgccgccgccgccgcccgacggtggcggcggggggtacttccggttcgacctgctcggcgggagccccgacgaggacgggtgctcctcgcctgtcatgacgcgccagctcttcccttcgccgtctgcggtggtggcgctggcgggggacgggtcgtcgacgccaccgctgacgatgccgatgccggcggcggctggggaggggccgtggccgcaccgcgcggcggatctcggggtggcgcagagccagaggtcccccgccggcgggaagaagagccgccgcggcccgaggtctcggagctcccagtacaggggcgtcaccttctacaggaggaccgggcgatgggagtcgcacatctgggactgcgggaagcaggtgtacctgggtggtttcgatacagctcataccgcagcgagggcctatgatcgcgcggcgatcaagttcagaggcctcgacgcggatatcaactttaatctgaatgactatgaggacgacttgaagcagatgcgcaattggaccaaggaggagtttgtgcacatacttcggcgccaaagcacaggatttgcaagggggagctcaaagtaccggggtgtgacactgcacaagtgtggccggtgggaagctcggatgggccagctgctcggcaagaagtacatctatctaggattgtttgacagtgaaattgaggctgcaagagcatatgaccgggcagctatccgcttcaatggaagggaagctgttactaattttgatcctagttcttatgatggagatgttctacctgaaaccgacaatgaagtggttgatggagacatcattgacttaaatctgagaatttcacagcctaacgttcatgagctgaaaagtgatggtaccctaactgggttccagttgaattgtgattctcctgaagcttcaagttctgttgttactcagccaataagtcctcagtggcctgtgcttcctcagggcacatcgatgtcccagcatccacatttatatgcatctccttgtccgggcttctttgtgaacctcagggaagtacctatggagaaaagacctgagttgggtccccagtcgttccctacttcgtggtcatggcaaatgcagggctcccctttgccattactccctactgcagcatcatcaggattctctacgggcaccgtcgccgacgccgcccgctcgccttcctcccgcccccatccatttcccggccaccaccagttctacttccccccgaccgcctgactgccacctattctggtggaggcgacacctcaccgtgcatccaccgccgcttgctgataacattcgtcgtttgtccagagagggaccttctccatatgatatccctctctatgttccacctggttatgatcagaattctcacgctcatgattcttttatcttcatttttgagtgcgaaaccacgaatcgtgaccatgctaccaggtaaacacccttgtacctctttgactctacaataaaattaatgtaagatattctggctaaaagtgattggccctccctactgtatttttacagagttgtaatttgaacagtgggcactaaagctggggcccactcgcaccagtgtctagtggagcgaagctttgcccttttcttgctatccagcaactattcctccgcctgcctccattgctgacagtggagatagcttcccagtggtcactgttccactgtactctgtcatagtttctgatcacccct

SEQ ID NO: 1591 - DNA, 1380 bp, Oryza sativa
  Predicted polypeptide sequence is orthologous to G2
atgtgggacctcaatgactcgccggcggccgaggccgcgccgccgccgctgtcgccgtccgccgacgactccggcgcctcctcgtcctcggccgccgccgtcgtcgagatacccgacgacgccgacgacgactcggccgctgtggttgtcgtcacgcgccagttcttccctccggccgtcccgggcggcggcggcgaccccgcccccgggaacgcgcgcgccgggtggctccgcctggccggagccgccccgccggtcgctgcaacggggccggcggcgtcggcggcggtgtccaagaagagccggcgcgggccgcggtcgcgcagctcgcagtaccgcggcgtcacgttctaccgccgcaccgggcgatgggaatcgcacatatgggattgtggcaagcaggtctatttgggcggatttgacactgctcatgcggcggctcgggcgtacgatcgggcggcgatcaagttccgcggcgtggaggccgacatcaatttcagcttggaggattacgaggatgacctgaagcagatgagcaacctgaccaaggaggagttcgtccacgtgctccggcggcagagcacggggttcccccggggaagctccaagtacaggggcgtgacgctccacaagtgcgggagatgggaggctcggatgggccaattcctcggcaagaagtacgtctacttggggctgttcgacaccgaggaggaagctgccagggcgtacgaccgcgctgccatcaagtgcaatggcaaggatgcggtgacgaacttcgatccaagcatttacgccggggagttcgagccgccggcggccacgggtgatgccgccgagcacaacctggacctctcgcttgggagctcggcgggctccaagaggggcaacgttgacggtggcggggacgacgagatcaccggcggcggtggcggtggcgcgggctccgaccagcgcgtccctatggcgttcgaccttgactggcaaacggcggcggcgaggagcaccaaagctaagttcgaccagaactcgaaccatccccagatgcctccggtcctgcaggtcacccacctgccattcagtcccaggcatcatcaccaattcttgagcaatggtgatccggggacagcgggaggcctgtcactgacgatcggcgcaggcatggccgggcactggcctccccagcagcagcaggggtggggcaacgccggcggcatgagctggccgcacccgccgcacccgccgccgccgccgaccaacgccgcggccgccgcaaccgctacagcagctgcagcatcatcacgattccctccctacattgcgacgcaagcctcaacctggctgcagaagaacgggttccattccctgacccggcccacctaa

SEQ ID NO: 1592 - DNA, 1342 bp, Oryza sativa
  Predicted polypeptide sequence is orthologous to G2
gtgtttggttgggttgccggtgtggtgaggattggagatgttgttggatctcaatgtggagtcgccggaacggtccggcacgtcgagctcctcggtgctaaactccggggacgccggaggcggcggtggcggtggcggtggcggaggattattccggttcgacctcctcgcgagcagccccgacgacgacgagtgctccggggagcagcatcagttgccggccgcctcggggatcgtgacgcgtcagctcctcccgcctccgcctcccgcggcgccgtcgccggcgccggcgtggcagccgccgcgccgcgcggcggaggatgccgccctcgcgcagcggccggtggtcgcgaagaagacgcggcgcgggccgaggtcgcggagctcgcagtacaggggcgtcaccttctacaggaggaccggccgctgggagtcgcacatatgggattgcgggaagcaagtctacctaggtggtttcgacacggcgcacgcggcagcaagggcttacgatcgcgctgcgatcaagttccggggactggaggctgacatcaacttcaacctgagcgactacgaggacgatctgaagcagatgaggaactggaccaaggaggagttcgtgcacatactccggcgacagagcacgggattcgcgagggggagctccaagttccgcggcgtcacgctgcacaagtgcggccgctgggaggcacgcatgggccaacttcttggcaagaagtacatataccttgggctctttgacaccgaagttgaagctgcaagagcatatgacagggcagctattcgcttcaatgggagggaagctgttaccaacttcgagcctgcatcctacaatgtggatgctttaccagacgccggaaatgaggcaattgttgatggcgatcttgatttggatttgcggatttcgcaacctaatgcgcgtgactccaaaagcgatgtcgccacaactggcctccagttaacttgtgattcccctgaatcttcaaatattacagtccaccagccaatgggctcgtctccccaatggactgtgcatcaccaaagcacaccactgccccctcagcatcaacgtttgtacccatctcattgtcttggcttcctcccgaacctacaggagaggccaatggacagaaggcctgagctgggtcccatgccgttcccaacacaggcttggcaaatgcaggccccttctcacttgccattgctccacgctgcagcatcatcaggattctctgccggcgccggcgccggcgtcgccgccgccacccgccggcagccgccgttcccggcggatcaccccttctacttcccgccaaccgcctga

SEQ ID NO: 1593 - DNA, 759 bp, Oryza sativa
  Predicted polypeptide sequence is orthologous to G2
ggattgtgggaagcaggtgtacttgggtggattcgatacggcacaggctgctgcaagggcttatgaccaggctgcaatcaagttccgtggagtggaggcagacatcaacttcaccctggatgactacaaggaggacataaagaagatgaacaacttcagcaaggaggagttcgttcaggttctccggcgacagggcgccggcttcgtcagggggagctcgcggttcagaggtgtcaccctgcacaagtgcggcaaatgggaggccaggatcggccagctcatgggcaagaagtacgtgtaccttggcctgtatgacacggagatggaggctgccaaggcttatgacaaagcggcgatcaagtgctgtggcaaggaggctgtgaccaactttgacacccaagcgtacgaggacgagctcaacctgcaatcttgggatagcgagcttgatcttgagctcagcctcgggtgctccggtggcgaacgggccgccggcgaggtcctccactctgcaccaagcaaccagaggacgagcctgacgttcatgctgccggaggaggaggagatgaccgcctgccaccgtcagaggagcatctgggctaggccttccttggctccggcgatgccggacggcggcgcggtcatccgccctgatcagcatcagcatcaccccagtagccggaacatgctcctgatggtatgtatgcttactgacagtggtgttcctacattgatcttcctgagatcacgggccctgagtag

SEQ ID NO: 1594 - DNA, 1305 bp, Oryza sativa
  Predicted polypeptide sequence is orthologous to G2
atgttgttggatctcaatgtggagtcgccggaacggtccggcacgtcgagctcctcggtgctaaactccggggacgccggaggcggcggtggcggtggcggtggcggaggattattccggttcgacctcctcgcgagcagccccgacgacgacgagtgctccggggagcagcatcagttgccggccgcctcggggatcgtgacgcgtcagctcctcccgcctccgcctcccgcggcgccgtcgccggcgccggcgtggcagccgccgcgccgcgcggcggaggatgccgccctcgcgcagcggccggtggtcgcgaagaagacgcggcgcgggccgaggtcgcggagctcgcagtacaggggcgtcaccttctacaggaggaccggccgctgggagtcgcacatatgggattgcgggaagcaagtctacctaggtggtttcgacacggcgcacgcggcagcaagggcttacgatcgcgctgcgatcaagttccggggactggaggctgacatcaacttcaacctgagcgactacgaggacgatctgaagcagatgaggaactggaccaaggaggagttcgtgcacatactccggcgacagagcacgggattcgcgagggggagctccaagttccgcggcgtcacgctgcacaagtgcggccgctgggaggcacgcatgggccaacttcttggcaagaagtacatataccttgggctctttgacaccgaagttgaagctgcaagagcatatgacagggcagctattcgcttcaatgggagggaagctgttaccaacttcgagcctgcatcctacaatgtggatgctttaccagacgccggaaatgaggcaattgttgatggcgatcttgatttggatttgcggatttcgcaacctaatgcgcgtgactccaaaagcgatgtcgccacaactggcctccagttaacttgtgattcccctgaatcttcaaatattacagtccaccagccaatgggctcgtctccccaatggactgtgcatcaccaaagcacaccactgccccctcagcatcaacgtttgtacccatctcattgtcttggcttcctcccgaacctacaggagaggccaatggacagaaggcctgagctgggtcccatgccgttcccaacacaggcttggcaaatgcaggccccttctcacttgccattgctccacgctgcagcatcatcaggattctctgccggcgccggcgccggcgtcgccgccgccacccgccggcagccgccgttcccggcggatcaccccttctacttcccgccaaccgcctga

SEQ ID NO: 1595 - DNA, 1005 bp, Oryza sativa
  Predicted polypeptide sequence is orthologous to G3
attccgcgaggatggataggtgggaggccaccgtcttcttgcccccgccgccgccaccgcagccgacgcagccgcagcagcagcctgcggcggcggcggtgagggctccggtaggcgggaggggtgggggaggagggaggcagtatcgcggggtgcggatgcggaagtgggggaagtgggtggcggagatccgcgagccgaacaagcggtcgcggatctggctcggctcctactccaccgccgtcgccgccgcgcgggcctacgacaccgccgtgttctacctccgcggccgctccgcgcgcctcaacttccccgaccagctcgacggcgcgggtggtggtggcgcgggcgccggcggcgccgaggaccacagggagctcaccgccgccgtcatccgcaagaaggccgccgaggtcggcgcccgcgtcgacgcgcagcactccgtcgtcggcgccgcggcgcccgtgccgctccagccgccgcagcccccgccgccccagcgccgccggaccaagaaccccgacctcaaccgggagcccaccccggacacctccgacgacgagtagtaatccgtgctaattttgcctcccttcttccatccatctagttcgtagtccttagccaccccaagacacagagagagagagagagtagcagctagtagctatagctagtcagcgaagcagatagcgccaaggaggcggtcgtggacggggcgcatgcaaggtgttcggcgaaatgcgattgaggtcggaggagcccacaagtatatccaataatggagccgcgacgtcgccgtcaagccggggaagtggtggttagcaagtaggaatctagagctcagctcgtcgtctgttccggcgacggcgactgtactaggagcgtgcgtgtcagcgtgagcatgtagctaaaagcaagacggctatgtacctcacccttttcgcttaagcgtttgtttgtaaagagaagatacccagcaagcaagacaaaaaaaacagcttcaag

SEQ ID NO: 1596 - DNA, 1539 bp, Oryza sativa
  Predicted polypeptide sequence is orthologous to G8
atggagttggatctgaacaacgtggcggaaggggtggtggagaagcatgagacggcggcgaggagcgactccggcacgtcggagtcgtcggtgctcaacggggaggcgtctggcgcggccatcgcgccggcggaagaggggtcgagctcgacgccgccgtcgccgccgccgcctcccgcggcggtgctcgagttcagcatcctgaggagctcggcgtcggcgtcgggcgagaacgacgccgacgacgacgaggaggaggaggccaccccctcgccgccgccgcaccaccaacaccagcagctgctcgtcacccgggagctattcccttccgccgctccctcgccgcagcattgggcggagctcggcttcctccgccccgacccaccgcgcccacacccagacatcagaatcctcgcccacgcgcctcccccggcgccaccgccgccgccgccgcagccgcagcctcaggcggccaagaaaagccgccgcgggccgcgctctcgcagctcgcaataccgcggcgtcaccttctaccgccgcaccggccgctgggaatcccacatctgggattgcggcaagcaagtctacctaggtggattcgacactgctcacgcagctgcaagggcgtacgacagggcggcgatcaagttcaggggagtagaggctgacatcaacttcaacctgagcgactacgaggaggacatgaggcagatgaagagcttgtccaaggaggagttcgtgcacgttctccggcgacagagcaccggcttctcccgcggcagctcaaagtacaggggtgtcaccctccacaagtgcggccgctgggaggctcgcatgggccaattccttggcaagaagtacatatatcttgggctattcgacagcgaagtagaggctgcaagggcttatgataaggctgcgatcaaatgcaatggcagagaagccgtcaccaacttcgagcccagcacatatgatggtgagctgcctactgatgctgctgctcaaggagccgatgtggatctgaacctgagaatatctcagcctgcagcctcacagcagagccccaagagggatagcggctcccttggcctgcaaatccaccatggatcatttgaaggttctgaattcaagagagcaaagaatgatgcagctccctctgaacttgctagccgccctcatcggttccctcttctgaccgagcatccgccaatctggactgcccaacctcatcccctattcccaaataatgaggatgcatccagatcatcggatcagaagaggaagccatcagagggggtagctgttccaagctgggcatggaagcaggtgagccatcatcaccctgctcctcctcacacgctgccattgcccttcttctcctcctcctcgtcgtcgccgtcgtcgtcctccgctgcagcatcatcaggattctccaaagccgccacgacagcagctgctgcccaacacactgccaccctccggttcgacccgacggcgccgtcgtcttcgtcgtcaagccgccatcaccaccaccattga

SEQ ID NO: 1597 - DNA, 536 bp, Oryza sativa
  Predicted polypeptide sequence is orthologous to G12
tcctccgacctcaatcgcatttcgccgaacaccttgcatgcgcccccgtccacgaccgcctccttggcgctatccgcttcgctgactagctatagctactagctgctactctctctctgtgtcttggggtggctaaggactacgaacaagatggatggaagaagggaggcaaaatcagctcggattactactcgtcgtcggaggtgtccggggtgggctcccgttgagtcggggttcttggtccgcggcgctggggcgcggggctgcggcggctggagcggcacgggcagccgcggcgccgacgacggagtgctgcgcgtcgacgcgggcgccgacctcggcggccttcttgcggatggcggcggcggtgagctccctgtggtcctcggcaccaccgccgctgccgccaccaccacccgcgccgtcgagctggtcggggaagttgaggcgcgcggagcgccgctctagaggatccaagcttacgtacgcgtgcatgcgacgtcatagctcttctatagtgtcacctaatcatcatg

SEQ ID NO: 1598 - DNA, 1216 bp, Oryza sativa
  Predicted polypeptide sequence is orthologous to G12
aagaagaagccgcccaaccaacgccaaaagctactgctgcttgcacaggagagggcagagagagagagagagagagagagagaagagggcggctgcggcggcggcgcgcttcgctcatgcagggcgagtaccaccgctcctccagcgaggactcggctgcttctgctgctgctgctgcggcggcggcggctgcggctatggctcctctcgccgcggctgcggcggcggttgctgccaaggaggagcaggcggcggcggcggcggtgctgccgctgcagcagcagcagccgaggcggcagtaccgtggcgtgcggatgcggaagtggggcaagtgggtggcggagatccgggagccgcacaagcggacgcgcatctggctggggtcgtacgcgacgcccgtggcggcggcgcgcgcctacgacacggcggtgttctacctccgcgggcggtcggcgcggctcaacttccccgaggagatctcctcgctggcgtcgctgtccgagggcggcggcgcgagcgagccccgcgagcccgacggcggcacgctgtccgcggcctcgatccggaagaaggccatcgaggtcggctcccgcgtcgacgcgctccagaccggcatgatggtcgcgccgacgacccaccaccgcgagcggcagaagcaccaccaccaccaccaccaccaccacccgcacctgcagccgcacggcgaggagcaacaccaccaccacgagcagaagcaccagcggacggcgtggagcggccgcgccaagaacccggatctcaaccaggcgccaagcccggagaactccgacgccgagtagaagccaacaaaaccgcctccgcgcggcaagatcgatcaacggcttcgtcaacatgcagccagcgtatgatcacctccaccacgtacgctcgctgcatccatccacctaccacctattcgtccacccctcatctccacctcggcggcggcggcggcggcttcgtggcgagatttttcgatgcggttttggataagaacaagggaagggcagcgtcgggaggagggcggtggagacgggggaggaggacgccacaagtggcggtctttccaaatgtcaaaaaagacagctgtaacagtgataaaacaagtcatcctctctgttttttttttcctctctctcttctccgtgttattatcgactagataagcagcgattaattaatccgtccttcccccttt

SEQ ID NO: 1599 - DNA, 1440 bp, Oryza sativa
  Predicted polypeptide sequence is orthologous to G15
agaaggaaggccagaccaggaaagggaggcaagtttatctcggtgggtatgacatggaggagaaagcggcgagagcgtatgacctggcggcgctcaagtattggggcccttccacacacatcaacttcccgctggaggactaccaggaggagctggaggagatgaagaacatgacaaggcaggagtatgtggctcacttaaggaggaaaagtagcggtttctcacggggagcttccatgtaccgtggtgtcacaaggcatcatcagcacggacggtggcaggcacgcatcggccgagtctccggcaacaaggacctctacctcggcactttcagcacgcaggaggaggcggcggaggcgtacgacgtggcggcgatcaagttccgggggctcaacgccgtcaccaacttcgacatcacccgctacgacgtcgacaagatcatggccagcaacaccctcctccccgccgacctcgcccgccgcaacgccgccaccaccacctccaaggacgaccactccgccgccggcgccggcgccattgtctcggtgcactccgccgccgacatcgccgtcgccgacaccctctggaaggccaccactgccccgaggcagcagcagcagcaccacgacgacgtcgtgctgtccggcgccgaccaggccgcattctccgtcctccacgacctcgtcgccgtcgacgccgcggcggcgcaccagcagcagcagcagcagcagcacatgtccatgtcggcggcgtcgtcgctggtgacgagcctgagcaactcgcgcgaggggagccccgaccgcggcggcggcctctccatgctcttcgccaagccgtcgcccgccgtggcggcgtcggcgcagcagcaggcgtcgaccaagctcatggcggcgccgctgccgctcggctcctgggtctcctcgccgccggcgtctgccaggccgcccgccgtctccatcgcccacatgcccctcttcgccgcctggaccgacgcctaatcaccctcgccgccatggctcaccggagtagtaattagctagctatagctagagctaggcaacgacgacgacgacactagcttaattagctcgtgtttagttggttaatttagggttcttggttgctcggcgacatgattagctaagctagcgatgtagtagtagcactagcagctagttggagtattaattagtatcactcaaggcgaggaaaccgacgcacgccatggccgcggcctctcccccacctttccttcttctccggcgacggccggccgccatgtatcagagagctcgatcggcgccggagaagaagggtttttgtaacacggaggccggagatctatcgaggcggtgcttctcctccaaaatccaaaactatatatcttatattaattaattaattaattatagcctcaccaaattaatttctcaaaaaaac

SEQ ID NO: 1600 - DNA, 2510 bp, Oryza sativa
  Predicted polypeptide sequence is orthologous to G15
tccttttgcagtttttttctgctcagctcaccgggtcccctctctcatcttcctcgtcgtgcaccttgcatggatgtagaagtagcgagctagcgcgcggcgactgcgagccgagagagcaacgcaagaacggcacgagaggctggcagcgagcgagcgtgtgcatggttggtgcgagcaaatggccagcggcggcggcagcagcaactggttaggcttctcgctctccccgcacatgccggccatggaggtgccgtcctcctctgagccatcgactgctgctcatcatcatcatcatcatcatccacctgctgctgctgctgctgccggagccatgtcgtctcctcccgacagcgccacgacctgcaacttcctcttctcccctcctgcagcacagatggtcgctccttcacctggctactactacgtcggcggcgcctacggagacgggaccagcaccgccggcgtctactactcgcacctccctgtcatgcctatcaagtccgatggctccctctgcatcatggaaggcatgatgccgtcgtcatcgccaaagctcgaggacttcttggggtgtggcaatggcagtggccatgacccggccacctactatagccagggccaagaagcagaggatgcaagcagggcggcctaccagcaccaccagctagtcccctacaactaccagccattgacggaagcagagatgctgcaagaggccgcagcggcgccaatggaggacgcaatggcggcggccaagaacttcctcgtcaccagctacggcgcctgctacggcaaccaggagatgccgcagccgctcagcctctccatgagcccagggtcccagtccagcagctgcgtcagtgcagctccccagcagcatcagcagatggcggtggtcgctgcagctgctgctgctggtgatggccagggaagcaacagtaatgacggtggcgagcagcgtgtcgggaagaagaggggcaccgggaaagggggccaaaagcagcctgttcaccggaagtccattgacacgtttgggcagaggacatcgcagtataggggcgtcaccaggcacaggtggactggaagatatgaagcccacctctgggataacagttgcaaaaaggatggacagacaaggaagggaaggcaagtatatctaggtggttatgacactgaagataaagctgcgagggcttatgatctggctgcgctgaaatactgggggctatctacgcatataaatttcccgttagaaaactaccgagatgagatcgaggagatggaaaggatgacaaggcaagaatatgttgcgcacttgagaaggagaagcagcgggttctctcgcggtgcttccatctaccggggagtaacaaggcatcaccagcatggaagatggcaagctcggattggcagggttgctggcaacaaggacttgtatctcggcactttcagcactcaagaagaagcagcagaggcatacgacattgctgccatcaagttccgtggcctgaacgcggtgacgaactttgacatcacaaggtacgacgtggacaagatcatggagagcagctcgctgctgcctggtgaggcagcgcgtaaggtgaaggcgatcgaggcagcgccggaccatgtgccaataggccgcgagctcggtgcgaccgaggaagcgagcgctgctactgtcacgggcaccgactggagaatggtgctccatggatcacagcagcagcaagctgcagcgtgcaccgaagcaacggcagatcttcagaagggcttcatgggtgacgcgcactcggctctccacggcattgtcgggttcgacgtcgagtcggcggcagctgacgagatcgatgtcccgggagggaagatcagtggcatcaacttctcgaactcgtcttcgctggtgactagcctgagcaactcgagggaggggagccctgagaggcttggcctcgccatgctctacgccaagcatcatcccaccgccgtcagcctcgccgccatgaacccctggatgccgatgccggcgccggccgcagctcacgtgatgaggccgccgagtgccattgctcatctccctgtttttgcagcctggacagatgcttaattagagccatgttgctgcttgctcgatcttgcttttgatcggctctttttgtaaactaaagcaagatcagcagcaatcaggtgcttatggtacttaaattagctggaagcctggagtagcatacttggttatgatggtaagcactaggctggtggtgtaagtgtttaaccagtaaacccataggtaggacattcaagcaaaatccaaatctctagagcatccactggtagtagtagtagtagacctttagtgttagaccggtagtgttctttgcttcttttgagcctctttttttgggggaaatttggttggaatgtatggctttttaacacgaaatcaggaatgtatggcttttaacacgaaatctggctgtggcattaaaaggaaaaggttcagtgag

SEQ ID NO: 1601 - DNA, 593 bp, Oryza sativa
  Predicted polypeptide sequence is orthologous to G15
cttgatggctacagctatggcgtcggctacggcagcagctgcatcgatcaggtcgacaacgacaagctgttccagcatcatcatcagcaggatcaggcacaagaacagcagcagcagctggtgtacaactacgacgagatcaagcagctgctgatgaacacatcaaccacaagtaatagtattaatgctggtcaggatcatggcggcagcatggaagcagggttgatcggctcacaagggaaggtaaccatgatgtaaattaaactgatcgattaaagaggaggggaaggcagcagctgggcacggcaagattaaggatggattaattaaaccaaggtgtgttgttttttttactgttctttgattggattctaccgtacgtacgtgatgcatggcgcgtttaattgttgtggttaaaaaaaaaaaacaaaggaaagaagtgtgtcccgtgtcacggtcgcatgcacgtgccagtgcagctgctagtatagcgtttgcgttcgtgttacagcctgcagtgtgttgtatgtcactgtgacatgggatcgatcgatggatatcatgactagagataatctctctctctctctctc

SEQ ID NO: 1602 - DNA, 3237 bp, Oryza sativa
  Predicted polypeptide sequence is orthologous to G214, G680
ggagagcgacccccacctctctctcctctctcctcttccccctcgcggccgcgcagcagcagcagcagcggaagcatccaggtagcagcagccgcgagcgagcagcgaaccgagccccccacatccatccatctcgcttggtttggtttggtttgcagtgttagtggcagcgagatccctttgctgttgttgtagcttcgggaggaggaggaggaggagttgtgacggcggcggaggagagagaaggaggaggggcttgtggtggtggtggtggtggtgatcgatgcagctgctgagccggcggcggcgaggccggtgacgcccgccgtggcggtcgcctgaggccgccgtgtggagggctggggcttgcaggcggagcgaggcggcgagcttggttgggattgctttgcttgctctcgagggcgacggcgcggttgggcattcgttcggtggtggtggtgctcggttgcttcgctgaggatcaaggaagtgtttggccttcgtagaactgcgagttttaatctgattctagagttgaagataacgaaaggagcaagggtgaactctgctgacttggtttttgtgtgcacagaccaactgcagctgaggatttagtagattgactgcaattggatcaattcaagtagaggtctaggaggaggtatgaggtactacttgcgtcaggtccagcgtttggttggagatatggaaggaggagtgcttttgtttgtggaagacctcaactctaactgacaaagcgaccaattgccaacacttctgttatatttcttctttttcttgaattgggaatggagattaattcctctggtgaggaagcggtggtaaaggtgaggaagccatacacaatcacaaagcagagggagcgttggactgaggcagagcacaacaggttccttgaagccttgaaactgtatgggagagcctggcagcgcatagaagagcatgttgggacaaagacagctgtgcagatcagaagtcatgctcaaaagttcttcaccaagttggaaaaggaagctatcaacaatggcacttctccaggacaagctcatgacatcgacatacctccaccacgaccaaaaagaaaacctaacagtccatatcctcgaaaaagttgtctcagctctgagacatccaccagggaagttcaaaatgataaggcaacaatatcaaatatgacgaacaatagcactgcacaaatggcaggtgatgcagctcttgagaaacttcaaagaaaggagatatctgaaaaaggaagttgctccgaagttcttaatctctttcgagaagtcccatcggcatcattttcttcagttaacaaaagctcttcaaatcatggtgcatccagggggctggaaccgactaaaacagaagtcaaagatgtggtcatcttggaaagggattctatttccaatggtgcagggaaggatgcaaaagatatcaatgatcaagaaatggaaaggctcgatgggatacacatcagctcgaagcctgatcattctcatgaaaactgtttggatacctcaagccaacaatttaagccaaaatcaaactctgtggagacaacatatgtggattggtctgctgcaaaagcttcacactaccaaatggacagaaatggggttactggctttcaagccactggaactgaaggaagccatcctgatcaaacaagtgatcaaatgggaggagccagcggaactatgaatcaatgcatccatccaacacttcctgtggatccaaaattcgacggcaatgccgcagcacagccctttcctcacaactatgcagcctttgcaccaatgatgcaatgccactgcaaccaagatgcctacagatcttttgccaatatgtcatccaccttctccagcatgcttgtctccacattgttgtcaaaccctgcaatccatgcagctgccaggcttgcagcatcgtactggcctacagtagacggcaatactcctgatccaaatcaagaaaatctttctgagagtgctcaaggaagccacgctggctctcctcccaacatggcatctattgtcacagctacagttgctgcagcatcagcatggtgggcaacacaaggtcttctccctctttttcctccacctatagcttttccatttgttccagctcctagtgctcccttttccacagcagatgttcagcgagctcaagagaaagatatagactgcccaatggataatgcacagaaggaattgcaagaaactcggaaacaagataattttgaagctatgaaggtcatagtgtcttcagagactgatgagagtggagaaggagaagtgtcgctccacactgagttaaagatatctccagcagataaggccgacaccaaacctgccgcaggagctgaaacaagtgacgtttttggaaataagaaaaagcaggatcgctcttcatgtggttccaacacaccgtcaagtagtgatatagaagcagataatgctcctgagaatcaagaaaaggctaacgacaaggcaaagcaagcatcttgcagtaactcttcagccggtgacaataaccaccgtagatttaggagcagtgcaagcacaagtgattcatggaaggaagtttctgaagggggtcgtctggcttttgatgcactgttcagtagagaaaggcttccccaaagcttttctcctccgcaagtagaaggatcaaaggagatcagcaaggaggaagaagatgaagtaaccacggtgacggttgacctcaacaagaatgccgctattattgatcaagaactcgacacagcggatgagccaagagcttcctttcctaatgaattgtcaaacctgaagctgaaatctcgcaggaccggtttcaaaccatacaagaggtgctcagtggaagcgaaggagaacagggtaccggctagcgatgaggttggtaccaagaggattcgtcttgagagcgaagcatcgacatgatttgctttccacctggttgctggcctctaccaagtcagaagttaaatttacatccgagctaccataggacttcagaccttccaatgcattacctcacaaactcaatttattgtgtgttgtatcttaatgcttgccaagcagctcctatagactgcttttaaaccgtatctcatagacttttgattagcatttaagcgactgctaaactttcttcataaaagggtattatccttattatgcattatagtctggggaaggtaataagtgg

SEQ ID NO: 1603 - DNA, 1983 bp, Oryza sativa
  Predicted polypeptide sequence is orthologous to G261
cgccctgcacccgttgccaccaccaccgccttctccgccgcgccgcctcctctcgcgtctcccgctcgtgcagggcgcgcgtcgtcgggcgagctgctgccgtctccgtggccgtggctgatcagaactagttggcgttcgatcggaaagtcgctgtcttttggcgactcggtgagaatttgcgccgcggttcaatgtgaaaaattttggcccgtggcgagttggatttggcgccgagtccattcaggtggttaagacttgttcgtgggagagcgaagctgcgcgcgttaagaccgggctccgttcttgcatcgtgcagagcagctgctggtttgagaattgagaggcgcggttgacatggagagttccaacctgggcggcggcggcggcggaggcggcggcggtgggccgccgccgttcttgatcaagacgtacgagatggtggaggacgcggcgaccaaccacgtcgtgtcgtgtggccccggcggcgccagcttcgtcgtgtggaacccgctcgacttctcccgtgacctgttgcccaagtacttcaagcacaacaacttctccagcttcatcaggcagctcaacacctacggtttccgaaaaatcgatcctgagagatgggagttcgcaaacgaggatttcataagagggcacacgcaccttctgaagaacatccatcgacgcaagcccgtgcacagccactccctccagaaccagataaacggaccactcgccgaatcggagaggcgcgagctcgaagaagagatcaaccggctcaagtacgagaagagcatcctcgtcgcggacctccagaggcagaaccagcagcagtacgtgatcaactggcagatgcaggcgatggaaggcaggctagtggcgatggagcaacggcagaagaacatcgtggcctccctgtgcgagatgctgcagagacgcggtggcgccgtgtcgagctcgctgctggagtccgaccatttcagcaagaagaggagggtcccgaagatggatctcttcgtcgacgattgcgcggcgggcgaagaacagaaggtgttccagttccagggaattgggacggatgcaccggccatgcctcccgtgcttcctgtgaccaatggtgaggcttttgacagggttgagctgagcctggtctccctggagaaactcttccagagagcaaatgatgcttgcacagctgctgaagaaatgtactcccatggtcatggtggtactgaacccagcactgctatatgtcctgaagagatgaacactgctccaatggagacaggcatcgatcttcagttaccagctagcctccatcccagctcacccaacacagggaatgcccatctccatttatccactgaactcacagagtctccaggttttgtgcagagtccagagctgccaatggcagagattcgtgaagatatccatgtgacaagatacccaacacaagctgatgtaaattctgagattgcctcctccactgatacttcacaagatggcacgtcagaaactgaagcttcgcatggaccgaccaacgatgtgttttgggagcggttcctcacagagactccacggtcatgtttggatgagtcagaaagacaagagtctcccaaggacgatgtaaaagcagaattaggctgcaatggcttccatcaccgggagaaggttgatcagatcaccgagcaaatggggcaccttgcttcagccgagcagactctgcatacctgatgcagtaataccatttgcgcggattcatagttcgtgtgtaaattagcgaagatgtaaattatagcttagatcggattagaggcttgcgtgttactttacagatttcaaccttttattagattacaataggtctttcacaatttatgattctgttctatccgctgactactgtgcataaattttttttagtagaccatatccatttttgtactccattgcccttctaagattcctcgttaaaatctc

SEQ ID NO: 1604 - DNA, 3008 bp, Oryza sativa
  Predicted polypeptide sequence is orthologous to G261
accatcgcatcttcgcttcgcatcgcatcgctcacatgcgctgccttcgtcacgctccttagcaatctcgcccgccatcatgtccaatcatcccgcttggcacgaccagcagccacagtacccaccccctccaccgcaaccaacgcgacatcactcgggcatggatgcctaccaaggaccatcgccctcgtcctctacacagcagccatcaccgtacaacagcgcgccccaacacactgcatcctatccgcacgcgcatcttccacccccagcagccagacataccccgcagcagcagcagcagcagcagcagcagcagcagcagcagcagcagcagcagcagcagcagcagcagcagcagcagcagcagcatccacaacaaccgcaatgggcgtccggcacgagtcaagactttggcggtcctagccccgccaactcggcgccgcgttccaacagcggatacacaggcttcgaccctccgtccgcgtccaacaacagcccgatgcgccaacatggaggctcgcacagctccgcttatacctcacactcgccctacgcaccctcacagtcgcacgctcccgacgccgccatgcatccccagcgctcctccatgccctcgcactacgactaccaaaacaactatccgcatccgcaccatccgcaaaacccacagatgccaccacaacaccatccgcatccgcatccgcatccgcatccgcatccgcatccgcatccgcatccgcatccgtctcaacaacaacaccaccaacaggcgcactggaacactggcccgctcccttcggtgcttcagccccagtccgcaccgctctcctcgacgcccagcagcaatcgcgggcccagcgctccgccgcctccgcagcaccacaccatggaccgtgcctaccccaacatcaagcacgacgacgacatggacgacgacgacactggcaactacgacgactttgaccccaagggcaaggcgcgcgccgctgccgatgccatgcaggccgccaacaagggcaccagcgatttcgtcaagaagctcttcagcatgctcgacgacaaggcgtacgacagtgtcgtcgcctggtcgccatccggcgagagcttcatcgtcaaggacatgaacgactttacaaaacacgtcctcccgcgcaactttcgccactccaactttgccagcttcgtgcgccagctcaacaagtacgacttccacaaggtcaagaatcccgaggacggcgccgccaccgtcggcgagcacgtgtgggagtttcagcatccagactttgtgcgtggccgcgacgacctgctcgaaaacgtcaaacgcaagatccccgcaaagaagaagcccgccaagcccggcctggtcgatgccgaccgcgacgacagccccgccatgcccgcgcccgtgcagatggaagcaccggaacgggcagagtcgaatgcagaactcagggcgcaggtggcccatctcaccgccgcgcaggaccagatgcagaaccacatcctcgcactcacaaaacagtaccagggcgtcatcggcgaaatgctcaccttccagcgcaacacgatccagcaggaccagctcatgcagaacctcatccaatacctcatcaacctcgaccaggaccgccgcgtggatggcgcacccgccccaccctccgcatccagcttcctcgcccacatgggcgccaatcagggcttcctcgccacacccgctcccgccagtgcgggcccgcatacggtgggggtgcccgcgcccgtgagcggtgccgacgctgggccatccagccatgctggggcggcgccgccgctgtcgcccaagagcgtcgcgtctccgctcgacgccacaggcagcacgcccgagatctcggcgcagctggcgtcgctgcgacagagcaatccgctggcgcccatgatgctgcatccgccccacctcgatgcggacccggccgatagctcgttggtgaatgcagcggcgagcgcggcgcgcaacccgagtctgtcgtcgttcgaaaaggcgggtctgcgcgtgtttaccgtgggaacgctgcagccgcgcgactcgcctggcgatcccacacccgccccgccacaggagcttgcgccggccgggctgcgcaacgggtcggcggggtcgtcgttcgacgtgcatgccaatggcaaaggcaaggaggctgctgacgacaagaagcgcacgcctacgcccggcgagggtcacccgagcaagcatctgcgcgtgcgccgatccacactggttcccggctgggcggtgcccccgcgtgtcctgctggtggatgatgacgaggtgtgtcggcgtctctcgagcaagttcctgcaggtgttcgggtgcagtatcgactatgcggtggatggcatgtcggcggtgaacaagatgaatctcgaaaagtacgatctggtgcttatggacattgtcatgcccaacctcgacggcatgccggcgacgtcgttgatccgacagtttgatccgcgcacgcccatcatcagcatgacgagcaacagtgggccttcggagctggtcaactacatgtcgagcggtatgacgggtatcctgcccaagccgtttaccaaggaggggctgttgaatatgctcgagaagcatctgttgcatctcaaggcggcgaggggtacggggcaggaatggcccaagggtgtttcacctgcgccggcggcgacgcccagtgggacagcgcagacgggtgcggatgatgggacgcttaacccgttggcggggatgggctttacggatgaagagtacgtcgccatgctgcagaacttgatcgctgcgggtactcaggatgacgaggcgtttggcatcgacctcaaggacggcaagaggatggcagacgagagtggcggcgagaacaagagacagcgctttgtcgattcgtagcatggttgtaccatcccacacaagtgtatagtagtctgggaccgtgcacatgtgcacacgcaagtgggaacacggataccattgtcagaatgcg

SEQ ID NO: 1605 - DNA, 1735 bp, Oryza sativa
  Predicted polypeptide sequence is orthologous to G261
aatccgagagggatttttcctcgcaaccaaccaaaccaaccaaacccccaaccaagcgagcaagccgccttcgccgggggggcccccaccctgacggcaaccctagccctccgatcaccggcgctgagactgatcccgccgccgtaggaggaggaggaggaggtggtggtggtggtggtgatggaggggggcggcgggggcgggtcgctgccgccgttcctgagcaagacgtacgagatggtggacgacccgtcgacggacgcggtggtggggtggacgcccgccggcaccagcttcgtcgtcgccaaccagcccgagttctgccgggatctgctccccaagtacttcaagcacaacaacttctccagcttcgtgcgacagctcaacacctatggctttaggaaagtagatccagaacaatgggaatttgcaaatgaggatttcataaaaggacagcggcaccggttgaaaaatatacatagacgcaaacctatattcagccattcatcacacagtcagggtgctggaccattaacagataatgaaaggaaagactatgaggaagaaatcgagaggctcaaatccgataatgcagcactgtcctcagagcttcaaaataatacgttgaagaaacttaatatggagaaacgaatgcaggctttggaagagaagctatttgttgtggaagatcagcagaggagtctgatatcatacgtcagagagattgtaaaggcaccaggatttctttctagctttgtacagcaacaagatcatcacaggaagaagaggagactgccaataccaatctccttccatgaggatgcaaatactcaggagaaccagatcatgccttgtgacttgaccaactcaccagctcagacattttacagagaatcatttgacaagatggaatcatccttgaactcattagaaaatttccttcgagaagcaagtgaagaatttggtaatgatatttcatatgatgatggtgtcccaggcccttcttcaactgttgttctcacagagctccattcacctggtgaaagtgatccccgtgtttcatcacctccaacaaggatgcgtacttcgtcagctggtgcaggagattcgcactcctctcgtgatgtagcagagtctaccagctgtgcagaaagtcctcctattcctcaaatgcattctcgtgtagatacacgagcgaaggtttctgaaatagatgttaattcagaacctgctgttacagaaactggtccatcaagagatcaacctgctgaagagcctcctgctgtcacacctggtgcaaacgatggcttctggcagcagtttcttaccgagcagcctggatcatcagatgcacatcaggaggctcaatcagaacggcgagatggaggaaacaaggtggatgagatgaaatcaggagatcgacaacatctttggtggggcaaaaggaacgttgagcagataacagaaaaacttggacttctcacctcaacggagaaaacctgacataattttgtttttctttttgtagatgaaaaactattaattcaggaacgctgacattggtgccttcctcagtgagatatgttgactaacatctatttcgcagtgtaccgtattttttccatcatgtaccgtaatgtatcatagtgccatacattcatctttggtccattgacactttctgatatcattgtgcgtgatttctaaaatattctcaagtttggttaaatgttac

SEQ ID NO: 1606 - DNA, 1049 bp, Oryza sativa
  Predicted polypeptide sequence is orthologous to G280
gtctagtcgtcttcttccctggatccaaatcgaaaatttctctccccctgttcacaccacgcctcactcccatggcgaccgaggaggacgcgtcgaccatggcggcggccgaggcggaccccaagcccgccgccaccccgtcttacccggagatgatactggcggcgatcgaggcgctggacgacaggaacgggtcgaacaagacggcgatctcgcagcacatcgaggggaagtacgaggggctcctcccccccgcgcacccgtcgctcctcacagcgcacctcgcccgcatgaagcagaccggcgagctcgccttctccaagaacaactacttccgcggcgacgacccgtccctcccgcccaagcgcggccgcggcaggccgcccaagcccaaggacgccgccgccgccgccgccgcaccggcgcccgcgcccgcggcgccggcggcctcctcgccgcgcccccgtggccgcccgcctaagcccaaggaccccctcgccgaggcggtcgcgaaggccaccagtggcatgccccgcgcgcgcggccgcccgcccaagaaggccaaggtcgaacaggaagaccccattggcgctcccgccgcagcttcggctcccgccgcggcggctgaggccgcgccgcctgtcaagcgcggccgtgggcgcccgcccaaggtgagacccgccgcgccggtcggggagccagccgctgcttgattagctccgattctccgcatcgccgcgatggcgacgatggtaagctcctttaggttgtaacgtagtcttcagattatgtctcgtactgattggaggcgcggctcgggttgctgcttattgtaagttaatcggatggtgggaggtttaggtgtgctggatggatcatccgttgctgagagttgtgattgaattcgtgttatcgcgtgctgattattatggtaatgttggtgactttcgtgtcgtttgtgttaattctagattggtggctgcatttagtgttatcaaatgatgttgaattgttctatgccatgccggacaaaaaaataagtctgattt

SEQ ID NO: 1607 - DNA, 763 bp, Oryza sativa
  Predicted polypeptide sequence is orthologous to G280
tgacgctgcaggtacggtcggaattccgggtcgaccacagcgtcgcacaaccccttctctctcagatcgcgtgcggcggcccaaatccacacgcgcacagcgcagcaccaacgccggaaggagacagcgcccctcgcccccgccaccccaaccctacgagagggagggagccagccagccagccagccaggcatggccacctccacttccactggccaccgcgccgccgacctcgtcctcccctcctaccccgagatgatcgtggaggcgatcgcgtcgctggcggaggagaacgggtctagccaggccgccatcgcgcgccgcatcgaggcggcccgcggcggcggcggcctcctcccgccgtcgcaccccgcgctcgtcgcggcgcacctctcccggatgtcagccgccggggagctcgtcgccgtcgcgggtgggaagtacgcgctccgcccgactcctccgccggcgccgccggcggatccggcggcggcggcggcggtggcggaggaagacgacgacgacgacgagttcttcggcgatgatgactcggccgacgacttacggccggctactcggccaagcgaagccggggcggccccgaaggtgcgcccccgagagtacagacgatccgccacgaaggaacgaacagacacagaagagaagaacgagaaacagcacaaacacggacagaagaaaaacggcgaggcaccacaaacagaaacaaggagaaacaacaaaaaaaagaacaagaaagccacga

SEQ ID NO: 1608 - DNA, 837 bp, Oryza sativa; identical to SEQ ID NO: 501
  Predicted polypeptide sequence is orthologous to G481

SEQ ID NO: 1609 - DNA, 1082 bp, Oryza sativa
  Predicted polypeptide sequence is orthologous to G481
aaccgccgtctcctcctccccccactctcgccttcccccctctctctcctctcctctccgcgactccctccacccccgcgcgcgcgcgttttttttttttcgtaagggtttttggagggcggcgcggggatggcggacgcggggcacgacgagagcgggagcccgccgaggagcggcggggtgagggagcaggacaggttcctgcccatcgccaacatcagccgcatcatgaagaaggccgtcccggcgaccggcaagatcgccaaggacgccaaggagaccctgcaggagtgcgtctcggagttcatctccttcgtcaccagcgaggcgagcgacaaatgtcagaaggagaagcgcaagaccatcaacggggaagatctcctctttgcgatgggtacgcttggctttgaggagtacgttgatccgttgaagatctatttacacaagtacagagagatggagggtgatagtaagctgtcctcaaaggctggtgatggttcagtaaagaaggatacaattggtccgcacagtggcgctagtagctcaagtgcgcaagggatggttggggcttacacccaagggatgggttatatgcaacctcagtatcataatggggacacctaaagatgaggacagtgaaaattttcagtaactggtgtcctctgtgagttattatccatctgttaaggaagaacccacattagggccatatttattagtagaagactaaagcacttgaagggtgttggtttagaaagggtgttaacagttggctgtggcgattgcttcacagatgtaaattgcttcataagtggtttaatgcttgtttttgcctgtatattcagagcaattttcacatattggtagttctgcaatcttttgcattcccatacatgtatcaggtggcacaaatctattgcaagtaccctagcattgaataatgctggttaacatataattctgtaacgtccgtattgtttcgactgtgatgcttgccgtatgggcaatggcatgtgttctagagggggcattcaatatttaggtatctcaagaatgtaccaaatactcccttcgttcaattc

SEQ ID NO: 1610 - DNA, 1225 bp, Oryza sativa
  Predicted polypeptide sequence is orthologous to G481
gaccccgaccccttcaatcgcgcccgcctcagccgccttctcttctccagcgtccgatctccccctctcgcctctccgcctcacctccgctccgcttcccacccccgcttcctctctctctcctctccccctctctctctctctctctcctcctcgcttcaccacctcgcgcccaacccccctctctctcctctccacgtcgcgccctctccgcgcgcgcccgcgcttctatataaggaggggggaggtgggatggcggatgggccggggagcccggggggagggggggggagccacgagagcgggagcccgagggggggagggggaggagggggaggtgggggtgggggtgggggggtgagggagcaggacaggttcctccccatcgccaacatcagccgcatcatgaagaaggccatcccggccaacgggaagatcgccaaggacgccaaggagaccgtgcaggagtgcgtctccgagttcatctccttcatcaccagcgaggcgagcgataaatgccagagggagaagcgcaagaccatcaacggcgacgacttgctgtgggcgatggccacgctgggcttcgaggactacatcgagcccctcaaggtctacctgcagaagtacagagagatggagggtgatagtaaattaactgcaaaggctggtgatggctctgtgaaaaaggatgtacttggttctcatggaggaagcagttcaagtgcccaagggatgggccaacaagcagcatacaatcaaggaatgggttatatgcaacctcagtaccataatggggatgtctcaaactgaagataggaccttttcatgcaactgttgctagcgcaggtggattttatttggtgctgcagtcgttagctaatatatatacctacacctcatggtgagcagtgaaggaagtaacttgctaccacctctaggtcccatgtttgtcaaccaggaactgatgctgcttggaagcgtcgagccaaggctgcttctcagatgtaaattactccccgtgaggatagtttcggttcgtggtctagctctgttgttgtatgtatattcaggataatttaacaattggtctttggctgtcattcggttccatataatctgtattgggaggcataaatattcatgttgtatttcgtcctgaactagcgtgttgtactattgagaaatagatgctctctgtaatggtagcaattttactctgattccc

SEQ ID NO: 1611 - DNA, 558 bp, Oryza sativa
  Predicted polypeptide sequence is orthologous to G481
atgcaagggcttcctagggcgtcgtcgtcgtcaacctcggcgtcgagagatcgagacggcggcgatggcgatggcggcggcggcggcgtgacgatgacgaacgggcaggacaacctgctgccgatcgccaacgtgggccggatcatgaaggacgggctgccgccgcaggcgaagatatcgaagcgggccaaggagacgatccaggagtgcgcgacggagttcatcagcttcgtcaccggcgaggcgtcggagcggtgccggcgggagcggcggaagacggtgaacggcgacgacgtctgccacgccatgaggagcctcggcctcgaccactacgccgacgccatgcacaggtacctgcagaggtaccgcgagggcgaggagctcgccgcgtcgctcaacagcagcagcagcgccgccgccgccgccgccgccgccggcagcaggggcggtggcgccatacagatcgacgtgagagctgagctctccatcttcagatcaggcaacaaccaaggtaaaaagggtgttaactctcttttcgtggaggtgaaacttaactga

SEQ ID NO: 1612 - DNA, 932 bp, Oryza sativa
  Predicted polypeptide sequence is orthologous to G481
cccgcgccctcctctcctcttcgtcttcctcctcgcttcgcttcgactgcttcgatcgaggagatcgaggttgcgatgccggattcggacaacgagtcaggggggccgagcaacgcgggggagtacgcgtcggcgagggagcaggacaggttcctgccgatcgcgaacgtgagcaggatcatgaagagggcgctcccggcgaacgccaagatcagcaaggacgccaaggagacggtgcaggagtgcgtctcggagttcatctccttcatcaccggcgaggcctccgacaagtgccagcgggagaagcgcaagaccatcaacggcgacgacctcctctgggcgatgaccacgctcggcttcgaggactacatcgacccgctcaagctctacctccacaagttccgcgagctcgagggcgagaaggccatcggcgccgccggcagcggcggcggtggcgccgcctcctccggcggctccggctccggctccggctcgcaccaccaccaggatgcttcccggaacaatggcggatacggcatgtacggcggcggcggcggcatgatcatgatgatgggacagcctatgtacggctcgccgccggcgtcgtcagctgggtacgcgcagccgccgccgccccaccaccaccaccaccagatggtgatgggagggaaaggtgcgtatggccatggcggcggcggcggcggcgggccctccccgtcgtcgggatacggccggcaagacaggctatgagcttgctttcttggttggtgttttggtaattaattaatcagaggacatgtcgggttaattaatcttaatctctgttttttcactctttttttttacctttctttctctctcttttatctttccttttctcaatgtgctaaaatgagtcaattatatggctaaattctctactaattcgcttc

SEQ ID NO: 1613 - DNA, 1717 bp, Oryza sativa
  Predicted polypeptide sequence is orthologous to G481
tctcattctcataaaataatcatcccctgcctaactccataacaaagaaatgcatactcctcggtcattagtatatgttagtataaattaaataattaacaccttaaacaatatctcttcgtcgtagtttgatcatcacctaagattttttagtcttttcaaaaatgatcatcaagctaacaagtgtatctttatttatttgtgcaagaagtaaatgagcatcattgaatgcgctgcacacatgtaatgcaaacaaccaagttaatttttattggtgcaacgggcgcgcactatttaaaacgtgacgcaatgcagcgatagagcaccttgatagataagaattaatttcagcatgatgtagattttgttatccttaatctctactcactttgcataggtgataaattaaaccgctgaactattactacatggtttacatgaaaggtgatcgggtagggacgagaatgtcgcgacacacatgatatatatagtagcgtccttatgtttgctttgtgtccgcatcgataccgtcttcccactcgcatctcctcacctcctttccttctttaaaaggagagcatcaccactccatcctcaactcccataacacctcccccttctctctctctctaactacacactctctctctagctagctagctagctatagctagtgttgttagcttcacatgaagagtaggaagagctatgggctcttgctgagcccggtgggcagcccgccgtcggacaacgagtccggcgcggcggcggcggcggctgcggcgggcggcggcggctgcgggagcagcgccgggtatgttgtctacggcggcggcggcggtggggactcgccggcgaaggagcaggacaggttcctgccgatcgcgaacgtgagccgcatcatgaagcggtcgctgccggcgaacgccaagatctccaaggaggcgaaggagacggtgcaggagtgcgtgtcggagttcatcagcttcgttaccggcgaggcctccgacaagtgccagcgcgagaagcggaagaccatcaacggcgacgacctcctctgggccatgaccacgctggggttcgaggcctacgtcggcccgctcaagtcctacctcaaccgctaccgcgaggccgagggcgagaaggccgccgtgctcggcggcgccggcggcgccgccgcggcgcgccacggcgagggcggttgctgcggcggcggcggcggcgccgatggcgtcgtcatcgacgggcattccccgctcgccggcggcctgtcacactcacaccatggtcatcagcagcaggacggcggcggcgacgtcgggctcatgatgggcggcggcgccgccggcgtcgggtacaacgccggggccgggtcgacgacgacggcgttctacgcgccggcggcgacggcggcgtcagggaacaaggcgtactgcggcggcgacgggtcgagggtgatggagttcgagggcatcggcggcgaggaggagagcggaggcggaggcggcggcggcggcggcgagagggggttcgccggccacctccatggcgtgcaatggtgaagactaaagaggagtactaattagctagctaggcacacgcgtagttttattattacttaattaccgcgttaattaattgttgatgctgatgctgtttaaaattgattctccttttgcatgaaaatgtttgatggtatggtttaaaaattgaagaa

SEQ ID NO: 1614 - DNA, 1800 bp, Oryza sativa
  Predicted polypeptide sequence is orthologous to G481
aacttcaaatcctacttagcagaagagaagtgctatacgaacgaccaatgcattcgactagcgtacgtctcatctcatcggattggcctgtttggtagagttttagcttctaaatttagcttcaagctccagaagttttaagtggagttgtggagctgtctaaactcatctctacctctctaaattattttgtgagagttttactcagcttcgctcctattttaagtagagctgaaactgtttggctaagttttagctataggagaggtggagctggagctgtgattacttttgtgggtccagtttttttatagctaatcatggtcatataggagttggatgtgcaagtcgtatgcatggtcattctgtgctcggcttattaaaaaaattgtgtaaatataaaaaacgaaaagttatgcttaaagtactttaggtaataaagcaagtaaaaaaaataaataataatttaaaattttttgaatcagacgagtgattaaaagtgcaaacaaaaacttaaaattttttgtattatgggacggagggaataggactgcaagtttaactaaagtatcctataaattcaagtattcaaaatattatgctttgcctgctgctggctggtgcagcaaattggtcctggccccggtgcacggtcctacgtggcgagccgggcactcgcgcatgtcaggggggccaaggcgccgtcccacgtggcctcggcccacccagacggcggggatccgtccgacgtggcgatgatggacagacggttgagcgccaagtggcacacgcttatcagcaaacgaacggctggggtcggtccacgtagacgcctcgatacgttcttatccgcgcgatccaacggaccgatccccccacgccattccccaccccaccatctctctctctctctctcttctcttcttcttcctcctagactagtcagtctctcccaagaacacccactcctctagtctctctctctcgagagagaaaattgatgattcttgggatgattttgaggcgtctgatttgctgaagaggaggaggaggatgccggactcggacaacgactccggcgggccgagcaactacgcgggaggggagctgtcgtcgccgcgggagcaggacaggttcctgccgatcgcgaacgtgagcaggatcatgaagaaggcgctgccggcgaacgccaagatcagcaaggacgccaaggagacggtgcaggagtgcgtctccgaattcatctccttcatcaccggcgaggcctccgacaagtgccagcgcgagaagcgcaagaccatcaacggcgacgacctgctctgggccatgaccaccctcggcttcgaggactacgtcgaccccctcaagcactacctccacaagttccgcgagatcgagggcgagcgcgccgccgcctccaccaccggcgccggcaccagcgccgcctccaccacgccgccgcagcagcagcacaccgccaatgccgccggcggctacgccgggtacgccgccccgggagccggccccggcggcatgatgatgatgatggggcagcccatgtacggctcgccgccaccgccgccacagcagcagcagcagcaacaccaccacatggcaatgggaggaagaggcggcttcggtcatcatcccggcggcggcggcggcgggtcgtcgtcgtcgtcggggcacggtcggcaagacaggggcgcttgacatcgctccgagacgagtagcatgcaccatggtacatatatacagtaatcagcagctgttcatttttctatgattactagttgactt

SEQ ID NO: 1615 - DNA, 693 bp, Oryza sativa
  Predicted polypeptide sequence is orthologous to G481
taattttttttttttgaatttgaaacccaactttgcataaacttgtgtcagcatcacacctgcttgcgtaatagagtttagaaaagtttctcttagatctctttacccctctgaatttagcatatgcaggacagccggaaacggccaaatatggttagacacaaccacacaacacacgactgaactagaacctacaacaaatttggacatcctggctaacacaagaacatttcaaaaagaacgacgactaacattcgtggtaacaaggtattggaactttggaagcatcctgcttacaacataacaggatgctggagcgttctttccctaaaaacgatggttctccttcctagatgccattagcgtgccaatcagtatcacactcctcgtcctacatgccttcaaacgatgatccaggatctccattaagtacaacatctttctttactggcagttcagaagctcttgaaccctttgtgtcaccctccgtctcccggtagagcctgaggtagagcttgagaggctcgacatagtcctcgaatccgagcgtgcccattgaccagatcaggtcgtccccattgatggtcttgcgcttctccttgaggcacttgtcgcttgcttcgctggtgatgaagctgatgaactcggagacgcactcctggacggactccttggagtccttggcgatcttgc

SEQ ID NO: 1616 - DNA, 1336 bp, Oryza sativa
  Predicted polypeptide sequence is orthologous to G504
atcctccacaagagaaactaggatcttcaagtatagctagcattgcgccctcatttcatccatggcaatgcagctgtccttgcctgtcttgccaacgggttttcgtttccatccaaccgatgaggaactagtcatcaactacctccagaggcgtgctaccgggctatcgtgccccatccccataatcgcggatgtcgaaatatacaacttcaacccgtgggagcttccatccatggctctatttggggaacatgagtggtacttttttacactacgcgaccacaggtaccccaatagtgtgcgccctagtcgctcagcggcgtcaggcttttggaaggccaccggcactgacaagcccgtccaagttgctaacatgcaaagcactcctgtagctatgaagaaggcacttgtattctatgttggccgcccgcccatggaaaccaagactacatggatcatgcatgagtaccgtctcacaaacacgggagggtccactgcctcccacccatccttgtcttcatccaccgcacacccttctgtgaagctagacgagtgggtgctatgcaagatcttcaacaagtccccagagccggacaacaccgcaccaccatcaaacgtcgtctcacggttacagtgctcgccgccgctgccgccgccggcggcaccgcccggcaactacccgccgctgccggtgggtgcgacgaacgacggcggcgtgttcgcctgcgccggcgacatgctcttcaccatccaagagcaccaggagggaacaccatcgatgctgccgccgatccctaaccttgagccaccggcggcaacaattgggaattcctctctcaatggcactgctgctgctgctgctgctgctgatggccatggccgccttgaggaagaggacaccagcgcctacaccttcaccgaccaggaaatggagcagatgctcatggacctgatggaccaggatttctttggcaatgatcaaccccaggagtgaactgtgtggtggagtgattttcatatcattccatagctctgatctgtgctggagagtgaatttagtatctattgtaccagatagaataaaaccagaaaagaaataaaagaaggccaaagaaaaaagcaaaaagaaaattgtataattactaggtttggatgccgtctgtagaaccttgtgtgctatgtaacttttttctttgtattttggcattttcatcatattgtgtcataaataaagcagggctttcttttgtagtttgccatctcaatcttgcaccgtgatgttataaaaaaacaaaattaattattgtgctacactgtacttttggctgtgttcggc

SEQ ID NO: 1617 - DNA, 2717 bp, Oryza sativa
  Predicted polypeptide sequence is orthologous to G504
ggcttccgcctctcctcgcctcctcccttcctttcccccccaaaccctagaattcccccccacaaaaccctagaattcgcgcgatcgaggcggctatggcggcggccgcggatgggcttccgccgggcgtcaggttcgaccccgccgacgacgagctcgtctcccgctacctgctccggcgcctccggaagcagcccatcccgctccacggcgtcatccacgaggcggatcccctcggcgcgccgccatggatgctcctcgccgctcacggccggggcggcgacgaggccttcttcttcgccgaggcgcgcgccaagaacgtcagggggaagcggcagaagcgtaccgtcgagggtggggggttctggcaggggcagcgggtgtgcatcgacggcgagaggctgcgcgtccccggcgacggcggcggcggcgaagtcggcggggaattggagatcgagtggcggaagtacatgctgagcttcttcgccgagggggagaggggcagctcggggtgggtgatgcacgagtacgccatcacggcgcccgctgacctcgcctcgtcgccgatccggctttaccgcgtccggttcagcggccacggcaagaagcgcaagcgggagccggaacgcctgggcgcccgcgtccacgacgacgacgtcgacggtggagaacgcgccgcgccccggcgcgccgtggcagagaccgccctgttcgtgcagcagtcgagcgccgtggattgcgccgaatccgccgatcagagcttctccggcgtgatcgagcctgtgttccacgatctccccgacatgatgccagagcaagctgatgccggagacactgcagagactacagcagcggtggtgaacctcacggacgccatgaccgagcagcccgttcttccgctagcagcagatggcgacgatcagagctcctacggtgtcatcgatccggcgttccgcgatcttgctgacctgatggtcctgccacctgtgctcgcgcagcaggagcctccgctcgcgcccgtggcaatggtggatctccctcctggcaatgctgattgcgccgatcatcagagctgctctggcgtgatcgacccggcgttccgtgatctccccgacatgaccgtgctgccaccagagcaagctgacaccggaggcggagcagagactaccacagcaatggtgagcctcacggacaagctgaaatactcctcctccatggacggcgaggcagcgccggcgtggtgtgatttcgattttccagagagcactgatgaggtgctcagctacatgaacttcaccgccggtgcccacgacaacaatgacggcagtgtgggacgcgccgcgccatggcgtcccgtgtcagagatcgccatgttcgagcagccgagcgccgtggatctccctcctggcgatgctgattgcactgaatccgccgatcagagcttctccggcgtgatcgagccggtgttccatgatctccccgacatgatccgtgagcaagctgatgccggagacaccgcagagactactgcagcggtggtgaaccagaactactccatggcgttgtgtgatttcgacagcggcattgacttcaccgccggcgcccacgacagcggcatggaacgcgccacgccctggactcccatgtcagaggccgccctgttcgagcagcaagggcctccgctcgctcccgcggcagtggtggatctccctcctggcaatgctgattgtgccgatcatcagagctcctacggtgacatgatcgtcctgccatcagagcaagctggcgccggaggcggagcagagactaccgaggccctgttcgaccagcccgttccgccgcttgcagcagattgcgccaatcagggctcctacggcgtgatcgacccggtgttccgcgatctcgccgacttgatcgttctgccaccagagcaggccgacgccatggacggcgaggcggcgccggcgtggtgtgatttcgattttccggagaacattgatgaggcgctcagctacgtcgacttcaccgccggcgcccacgctgacaacgacggtggcgtgtcagagaccgccatgttcgagcagccggggtctccgccacagcacgatcctctgctgatggatgctgatggcgccgatcagagctcctcctccggcgcgctgatcgacacggtgttcggtgatcacgccgaaccgatcgtcctgccactggagcaagctgacaccggaggtggtgcagcagcggcggtgaaactcatggacaagcagaagtactcctcctcctccatggatggcgaggaggcgccggcgtggtgtgattcggatttcccggagagcattgacgaggtgctcagctatgtcgacttcagcaccgatggcgcgagctgcgacttctccatggacgagctcttcgatcttgcagattagttagcatcctggagatagcaagccaccaagaacactggcattgacattgtctttctaagaagagctgtaatcagtagcgcaaaggcgagatttgttgatattctggtgtaatctgtagactagaggcagagtagatagatgttccttagtttattgactaatctatgcatagatgagttatttgtttattgattgaactcaatgtaagtaacattattgtaagtaatgaatatactcccttttcaatcattatattccctattcaaaatcaatatactgcattgatctgcc

SEQ ID NO: 1618 - DNA, 1654 bp, Oryza sativa
  Predicted polypeptide sequence is orthologous to G504
gatttcaatccttcctcttccttagcttattagcttccttccttcactagtgccagttttcctcctacctaatctaagctagccaggtcgtcatcttcttccttcagctcacgctgaccaaacaccatctgttattctgtttgtttgtttttttaaaaaaaagaaaaaaaatctagctaggcgagccgattgaaggagctgagcatgccgagcagcggcggcgccatgcctgcccttccaccaggcttccgcttccaccccaccgacgaggagctcatcgttcactacctcatgaaccaggccgcctccgtcaagtgccccgtgccaatcatcgccgaggtcaacatctacaagtgcaacccatgggaccttcctggtaaggctttgttcggcgagaacgaatggtacttcttcagcccgagggaccgcaagtaccccaacggcgctcgccccaaccgcgccgccggctcggggtactggaaggccaccggcaccgacaagtccatcctctccactccgaccagcgacaacatcggcgtcaagaaggccctcgtcttctacaagggcaagcctcccaagggcgtcaagaccgactggatcatgcacgagtaccgtctcaccggcacatcagctaacagcaccaccaccacaaagcagcgtagagcgtcatccatgaccatgaggaatccacaagaagagcaacgacttcaattcctctgaccaacacgaccaagaacccgaggaatcaaccgtcgaacagcttgaagacatccatgacaacaactcctctgaacaacctccagctccagctgacatgaacaaccaacagtcagatttccagcccatgacggcgatgagcatgagcaagtcatgctccctcaccgatctcctcaacaccatcgactgcgccgcgctctcgcagtttctcctcgacggctcatccgacgccatcgctgagcctcctgctcctcccagccccctaatatacacaacacctcatccaaattaccaaacactaaactataacattaacagcaacagcagcatgccacacgccttcgagtcacgcctagatcatcacgatggttacgttaacaattataatgttaatggcctgaggaggaagagaatgatggcgtgtagtgcaacttcctttgatgatggcagcagcagcaatgactttgtgcatgccgttgtcaagaaaccgcagctgctgccaagtgattcgaggggtagtggttttggaggaggttactgcaaccagcagctttcagagactgcgactggctttcagtttcagaacggcaatctgctgagccatccatttcctctgaacaatcatctgcagatgcagtagtaggcgtctagatcccgtttaccgatcgatctgaagagaggtgaattaatttcaacgaatgaaactacagattcagagaggaagatactgattgttccatttgtgatttattttgaggagttgcatgggcagatagacaaacagacggaattcttgatgtaaccgatgcaaggaaagattcagatttcttcctatggcattaatttgtgagtttttttttgttttcattttcatgtacaagaatgtaaattataaatggtaatatcgtgcaagctagtactcaagccaatttatatg

SEQ ID NO: 1619 - DNA, 1524 bp, Oryza sativa
  Predicted polypeptide sequence is orthologous to G504
gaacacccaaccccctctctctctctatctctctcctctctctctctctagctctagctctagctcgtcgccgccatgaacgttccaagcaaatgcatggctcctgcaaagtaaaaaaagaagaagaagcagcagctgcagcttctcttcagtatcgatctttaactgtatcgagctagcttagcttagcttagctctctgccattaacttgtgcttcactgagcttgagctagctagcttcttggctgtgtgactgagtagctctagctcctcgtcgtcgtcgtcgtcgtcgtcgtcgtcggcgtcggtggtggtgtgaattgatagaattgatacgatggagagggcggctgcggcggcgccggtggtggtgaggcatggaggagtggtgttgccgccggggttcaggttccacccgacggacgaggagctcgtggtgcagtacctccgccgcaaggcgttcggcctgccgctccccgccgccgtcatccccgacctccacaacctcttcaagctcgatccctgggacattcctggtgcgagcagcgacggggacaagtacttcttcgccgtgcggccacctgcggcgagggggaggaggcagcatgtgacggcgagcggtgggtgctggaagccggcgggcgggcgggacaagccggtggtggtggcccggtgcggcgggagccacctcgtcggcgtcaagaagggcatggtgttcgtcccacggcaagggaggaaggcaccggcggcggcggcggcggccgccggcggtggctgctgggtcatgcacgagtacagcctcgccctgccgatgcacaagaagggttgcttggctgaggctgaagaatgggtagtgtgccggatatttcagaggagcagcagcggcagccggtcgccgaggaggcctgacaacgacgtgaggcgaacgatgccggccgtcgccgagctcggccggtcgccgtcgccatcgtcgtcgtcgtcgcaatccagctgcgtcacaagcagctccgaccaggaagaggtcagcagcggctagctagctgaagaagaatgcaggcagcagcagcaagcagctaagctgcctctcaaagagaggcttgagtgttagcctagctaagcatatatatttatagccggccaaaccctctgaaagtgatctgcatcaatgcatgcccccctttaatttcttcttcctccttaattattttttcccaaccatgtaatgtaatgtaatttaatgtaatgcagtgtaatgtaacgggaaggaagcactgaattaatcaaattaaattaacaaatgaagagtgctcaaaagtccaaggaagcttctaaggttcaggagccagatattatctacttaattaattaattatgggcacatatctgtagttgctagctagctgcatatgcatctcgtcgttgtcgatccatttgtaacttgcaagttgtgttggtgtaatattgtaatatttttctccgatggttgagaaattaatctgaaatccattatagcaattaattgc

SEQ ID NO: 1620 - DNA, 1650 bp, Oryza sativa
  Predicted polypeptide sequence is orthologous to G504
atcgatcgatcgatgagcactcgctttgattcgatcaatcgattgatcgagctataggtagccaattacaagctaattaaagcagtaaccgtattagatcgtcgatggagatgacgatgtcgtcggcggcgacgtcgctgccgccggggttccggttccacccgacggacgaggagctgatcctgcactacctccgcagccgcgccaccgccgggcagtgccccgtccccatcatcgccgacgtcgacatctacaagttcgatccatgggacctgccatgtaagccttcttcctcgatcatatcgatggatcgattgagttggtcgttcggtcaattgctactggttaattaattgcagcgaaggcggtgtacggggagagtgagtggtatttcttcagcccgcgagaccgcaagtaccccaacggaatccggccgaaccgcgccgccgggtcggggtactggaaggcgacgggaaccgacaagcccatccacgacagcgccaccggcgagagcgtcggcgtcaagaaggccctcgtcttctaccgcggccgccctcccaagggcaccaagaccagctggatcatgcacgagtaccgcctcgccgccgaccctctcgccgccgccgcaaacacctacaagccctcctcctcctcccgattccgcaacgtctccatgaggctggacgactgggtgctctgccggatctacaagaagtccggccaggcgtcgccgatgatgccgccgctcgccgccgactacgaccacgacgagccgtccggagtccttgacgacgcctacagcttctacgcgccgccgatgatcagcaccacgctcatccccaagctccccaagatcccctccatctccgagctcttcgacgagcacgcgctcgcccagatcttcgacaccgccgccgacccgccggccgaccaccatcagcatgccctcgccgtccacccctccctgaaccagctcctcggcgtcggcgacaacttcctcgcggagtgctacccgtcgacggcgtccacggccaccgttgccggcggcaagcgcaaggcgagcccggccggagactacgccggcggcggccacacgccggcgaagaggctcaacggctcatgcttcgacgtggcgccgcagtccgtggtgggcggcttgcaagcgacgccgtcgtcagtcctcgccggactcaaccaccagatgcttcctcctcagctattctgaatatattcttaactagcttaattaatggccatggaaatcgatcaaacgcagtcgatcgaatttacggatgctacgtactggcatgaacaatcttgccgacgatattaagatcggatggaagcatggacgacgatgatgattggggtacggtatagaattattgtagtattgaacaattaggcatttgtatgcgattttttctcctacgtattcatttcaggcacagtgcaaaagcaagctggagccttgatagtactttacaccgtagagagggaatgttgtacaattaaagattactagatatacagaacaataatactttactgtagccaattgatatactactagtatacaggattgtagaagatatcaaatgcaatagattctggctctgatctgggaaatggaaattgcatggatgtgtt

SEQ ID NO: 1621 - DNA, 1817 bp, Oryza sativa
  Predicted polypeptide sequence is orthologous to G504
aactagcttagctagacagcgtgtgttggtggtggtggtggtgtgtgtgtgtgtgaggagggtgatcgatcgatcgagcgatggagagcccggactcgtcgtccggctcggcgccaccgcgagtactacggcggcaacagcagcagccgggctcggcgccggagctgccgccggggttccggttccacccgacggacgaggagctggtggtgcactacctcaagaagaaggccgcctccgttccgctccccgtcaccatcatcgccgaggtcgatctctacaagttcgatccctgggatctccccgagaaggcgaacttcggggagcaggagtggtatttcttcagcccgagggaccacaagtacccgaacggggcgcggccgaaccgggcggcgacgtcggggtactggaaggccaccggcaccgacaagcccatcatgtcgtcggggagcacccgcgagaaggtcggcgtgaagaaggcgctcgtgttctaccggggcaagccacccaagggcgtcaagactaactggatcatgcacgagtaccgtctcacggacacgtctagctccgccgccgccgtcgctacgaccaggcggccgccgccgcccatcaccggcggtagcaagggcgccgtctctctcaggctggatgactgggtgctgtgccgcatatacaagaagacgaacaaggccggtgcggggcagaggagcatggagtgcgaggactccgtggaggacgcggtggccgcgtacgcgccgtcgtcgcagcagcatgccacggctgctgctggcatggccggttcggacggcgccggaggagttgctgcagcgcacggcggcgactacagttcactgctccatcacgacagccacgaggacaccttcctcgtaaacggcctgctcaccgcggaggacgccgccggcctctcgaccggcgccagctctctcagccagctcgccgcggcggcgagggcggcggcgacaccgtgcgacgccaccaagcagcttcttgctccgtctccaaccccattcaactggttcgaggcattccttccacgggccaaggagtttcctagtgggctaagcaggagtagcagagacatcggcgacatgtcgctgtcatcgacggtggacaggagcctgtctgaggctggcgccgtggccattgacaccggcgacgccgccaatggcgcaaacactatgcctgcatttatcaatcctctcggcgtgcagggtgcaacctaccaacaacaccaagccatcatgggtgcctcgttgccatcggagtcagcagcagcagcagccgcctgcaatttccagcatccgttccaactctccagggtgaattgggattcctgaataaaaggtgccggcattatgcatacacatatatgcacatgcatacatgcatggcttttcaagtagtagcacaacattactagtaattaatcacactaatgtgtgtggcagtcgcattcagtgagcactgatcgagtagttgcatgaacacaacactaatgcatgcactacatatatatggccgcattgctcctagggcacgtacctgtacgaactaggtaagtgacctaaccagctagatcatgttcagaataaggagaagaagccgcatgcaaacacgtagatcatatggctttgccttcacatgcgtttgcatcatatatatcgcattcagaaagtagtgctgcagctaacacatagatatggtgttagcttcatgcgtttgtaccatatatagcggatgcagaaagtagctagttgcactgttcatcattatcccatgagatatgaactttatat

SEQ ID NO: 1622 - DNA, 1206 bp, Oryza sativa
  Predicted polypeptide sequence is orthologous to G504
atggctgaatcctccgaatctgcgtggccgcagcagagtcagcagctgcagattagcagcacaatgccggccggttctgcatggccggaggaggagaatctcgagaatctcgagcagccgcttcccctgctgatgccatcgtcggaggatcatcgcgagcagcagcttgttcccgttccatggctgcagcaggatcaggatcaggagtggcatgagcaggagcagtttcttcccctcaaaaatcagaatcaggagcagcttcaggatcagcaacctctgcaggatcaggaggagacgcgtagatatttgggcgtgcccggaatccggttcgtgccgtcggatatagaacttatccttgacttcctccggccgaaactacgcggcgagcagctgcccagctacagctacatgcatgtctgcgacgtctactccgaccatcctaaagaacttacgagtaagctgggtcccagccgcgaaggaaactggtacatgttttcacctagaaaccggaaatacaacaaaggcaaaaggcctagccgaagcaccggtcaattgggtttttggaagtcgactaccaagaacgaggccgtccttgacgccctcagcgataacatgttgattggatacaaggcatgcctcacctatcacgaatacgatgagagcatgccgacgccaaagttgaagaaagagaacgcgatcaagacgccgtggaagatgtgggagttcgtgtgttccaactccaaccggccgttcgacgcggaggaggagcccatgcggctcaacgactgggtgttgtgcaaagttaccaacaaggacaacaaagttaccaccaagaagttcaaaccacaacgcagcaagaagccgaagaagccgaagaagctacagcaggaggaacagccacaaaaccaaggcattgtgatcaggcagccgtcagaatccggctcggcctcctcgtcgcaccaagaaatccctggctcttctcttcccggagccggaggagacgccgcggccgcggcggcgacggcggcggcggtggtggatcctatgccattgcatatgattcctccttcttcatggaattatttcagcacgggagttactgcagatggtattgttatggatgacagtacgggagtcgattcatatggttgtgtagatggtgctggtgctcttaatttccagaggaacatcttctaccaccgttaa

SEQ ID NO: 1623 - DNA, 1125 bp, Oryza sativa
  Predicted polypeptide sequence is orthologous to G504
atggcggcggctggcgcggatgggctccctccggggctcagattcgaccccagcgacgacgagctcgtcggccggtacctgctccggcgcctccagggccagcccctcccgctcgacggcgtcgtcctcgatgccgatcccctgagcgcgcagccatggaggcttctcgcggatcacggccggggcggcgacgaagccttcttcctcgcggaggcgcacgccaagaacgccaagggcaagcgccagaagcgcaccgtcgagggtggagggttctggcaggggcagaggatgtgcgtcgacggcaagaagctgctcgtccccggcggcgacgacggcggcggcggcggcgaagtactggagatcgcgtggcgcaagtatgtcctgagcttctttgccgagggggagagggggagctcggggtgggtgatgcacgagtactccgtgacggcgccggctgacctcgcctcgtcgccgctccggctctaccgcatccgattcagcggctacggcaagaagcggaagagagagccggaagacgacggtcgagcacatggcgcgccccggcgggctgaggcggagactgctctgttcgatctggaggtcgggccaccgccaccgccactgctcgttcctcctcccgcggcggcggcggcggatcatggcaccgatcagagctcctccggtgtgaccgacatggtgttccgtgatcttcccgacctgatcgctgatgctggagctgctctgcccgatcagaaccaacaggattggtctgaagtcgccgatcagagctccttctgtgtgatgggcgatgactcttctctgctgctccctgatcttcctgggatgattgatgacaatgagcaccagcagtttgtgcgcgagtgcgacatgccacacctgttcgtcccgcaagcagaggaagccattgctggtggtggtgcagcatcggcgccatcggcggacaaccagaactgcgagttcaatgacggcgaggacatggcattgtcagattttgagtttccggagagtattgatgaggtgcttagctacatcgacttcagcacgagcgacacgagctgccgcgacttcaccatggacgagctgttcgatctgccggtggactag

SEQ ID NO: 1624 - DNA, 1818 bp, Oryza sativa
  Predicted polypeptide sequence is orthologous to G504
atggcggcgggtggtggtggcgctgatgggctccctccgggcctcaggttcgatccgaccgacggcgagctcgtctcccgattcctgctccggcgcctccagggtaagcccctcccgctcaatggcgtcatcctcgaggccgaccccctcagcgtgccgccatggaagctgctggcggagcacggccggggcgacgagggcttcttcttcgccgaggctcgggccaagaacggcaaggggagccgccagaagcgcaccgtcgagggtagtgggctctggcaggggcaaagggtctgcgccgacggcgagaagctgctcgtccccgatggcggcggcgtggaggtggagatcgtgtggcgcaagtacttgctgagcttcttcgccgagggcgagagggggagctccggctgggtgatgcatgagtacgccgtcacgtcccccgccgagctcgccgcgtcgccgatccggctctaccgcgtccggttcagcggccacggcaagaagcgcaagagagagccacaatccggcgaggacggtgtcggtcgagcacgcgcggcgccacagagcgctggaacagagactgctctgctcgaggagcgcgtcatgccgccacagccggcgccccagagcgtcggaacagaggatgccctggtcgaggagcgcatcccgccgccacagcccgttcccatccctcctatcgccggaacagaggatgccctggacgtcggcactgaggacgttcgaggacgagccgcgccacagagcgctggaacagagtctgctctactcgaggagtgcgtcctgccgccacagaccgcgccccagatcaccggaacaggggttgctctgctcgacgaggtcgttccaccgccacagaccgtgtcgatttcccctcccgcagcgctggtggacgctgtcgatgatgctgactgtgccaatcagggatgctccggcgtgatggacgattccacaatggtgttcagtcatcttccggacatgatcaccctgcccgcagaagaaggtgatgccgccggtggtgcagcgctggcgtcgatggactactcctgggctgattttgagttcccagagatcaacatggatgagttgcctaactgcatcgacttcaccacaactgaccccagctgcttggacattgagctctccatgggcgacctccatgagccccagagcactggaatagagtctgatctgctcgaggagttcgttccgcagccacagccagtgcttgttcctcctctggctgctctggttgaagttgccgatagctctgaaggccctgatcagggatgctccgttgtgatgcatgattcttctgcggtgtttactcatctgtcagacccgatcgtcctgccagaagaagaagaagctgatcgtcctgatgcgccggctgggactatgtcactagactatcagaactactccttgtctgatttcgagttcccagagtaccctctgctcgatgttgccggtgatgctgacggcgcagatcagtgctcttccaacgtgatggatgattcttccatggtgtttagtcaccttgaagacctgattaccctaccagcagaggaagcagaagccgatgcttgtagtgcagcgcctgcgccgtcgctggacaaccaaaaatactcctcacagggcatcatcgacagtgaggcgccggcattgtctgatttcgagttcccagagaccattgatgaggttctaaacagcatcaacttcacaatggccgacccgagctgcttggatatggagttctccatggacgacctcttagactttgatccgccggctgattag

SEQ ID NO: 1625 - DNA, 1524 bp, Oryza sativa
  Predicted polypeptide sequence is orthologous to G504
caacacccaaccccctctctctctctatctctctcctctctctctctctagctctagctctagctcgtcgccgccatgaacgttccaagcaaatgcatggctcctgcaaagtaaaaaaagaagaagaagcagcagctgcagcttctcttcagtatcgatctttaactgtatcgagctagcttagcttagcttagctctctgccattaacttgtgcttcactgagcttgagctagctagcttcttggctgtgtgactgagtagctctagctcctcgtcgtcgtcgtcgtcgtcgtcgtcgtcggcgtcggtggtggtgtgaattgatagaattgatacgatggagagggcggctgcggcggcgccggtggtggtgaggcatggaggagtggtgttgccgccggggttcaggttccacccgacggacgaggagctcgtggtgcagtacctccgccgcaaggcgttcggcctgccgctccccgccgccgtcatccccgacctccacaacctcttcaagctcgatccctgggacattcctggtgcgagcagcgacggggacaagtacttcttcgccgtgcggccacctgcggcgagggggaggaggcagcatgtgacggcgagcggtgggtgctggaagccggcgggcgggcgggacaagccggtggtggtggcccggtgcggcgggagccacctcgtcggcgtcaagaagggcatggtgttcgtcccacggcaagggaggaaggcaccggcggcggcggcggcggccgccggcggtggctgctgggtcatgcacgagtacagcctcgccctgccgatgcacaagaagggttgcttggctgaggctgaagaatgggtagtgtgccggatatttcagaggagcagcagcggcagccggtcgccgaggaggcctgacaacgacgtgaggcgaacgatgccggccgtcgccgagctcggccggtcgccgtcgccatcgtcgtcgtcgtcgcaatccagctgcgtcacaagcagctccgaccaggaagaggtcagcagcggctagctagctgaagaagaatgcaggcagcagcagcaagcagctaagctgcctctcaaagagaggcttgagtgttagcctagctaagcatatatatttatagccggccaaaccctctgaaagtgatctgcatcaatgcatgcccccctttaatttcttcttcctccttaattattttttcccaaccatgtaatgtaatgtaatttaatgtaatgcagtgtaatgtaacgggaaggaagcactgaattaatcaaattaaattaacaaatgaagagtgctcaaaagtccaaggaagcttctaaggttcaggagccagatattatctacttaattaattaattatgggcacatatctgtagttgctagctagctgcatatgcatctcgtcgttgtcgatccatttgtaacttgcaagttgtgttggtgtaatattgtaatatttttctccgatggttgagaaattaatctgaaatccattatagcaattaattgc

SEQ ID NO: 1626 - DNA, 3528 bp, Oryza sativa
  Predicted polypeptide sequence is orthologous to G559
aagcgaaaaaccgagtttgtatactcgataaattaagaaaaagttgagcgcgccgtaccgcccgccgcagcgccgacgcgcacagactagggccggtgccactggtggtggctgtggggtggtcgtgggcggcggtctgcgcgtcggcactgtccggcacgtcttggccggtgcaggcgcggccgtcgaattggccgcagacaccgcctcagcaactgtcacaaccaacgagtcgaaacgcgccggcgccgctgtcgacgacggcgatggaacgctggagcgggtggtgcgcatcgcatgcgcgtgtctgtccaaattcacgcccgaaaagagccgcactgtggcggtgcagctcgtggagcgtgcgtttgggcacacacgcgcgaccgtgacgcgcgctaaattgcgtgcgattgccgcgctggtgctggacaaagccgtgactgaaccggcgtttgtggtgtgttatgcggactggactcacgcgctgtgtgagcagctgcgggcattgacgcccgccgataccgacgcggccgcagctgcagccgctgcggccggtggtgtgtcggtggctgacggtgacgcggatgcgcacgcgcgcgtgtgtaccacacccgacgccgcgtactgccaggcgctagccgacgccgtgcgtcagcggtttgacgacacgtttggtggcgctgctgtcgtgcagcatcctgctgcacccgcgctggcgtcagcggacggcgctgccgtaccgccacagtggcccgatctggtggtggtgcacgaattggagtcactgctcacccgcgagcgcgacgccgacgacgcgtttgtgcggccgcgcgaacgcgacgacgaacggcggcggtctgtggccgaccgggagtgccgtcgcgccgccgcactgtgtcacttcattgccgcgctcttggacgttcgcggcatcggcagcggcgacggctcctgtggtggtggtgagcagcatgaggctgctgcgggcggcgtcatcgcatggccgtggatgacgcatgtcattggcgtactgtgcggtccgcaggcaccaccgcgggcgcacacgtcagcgtgtggcgcagcgtatggtcggcctgggcggcgaccgaacaacggcgcacgctaccggccgctctggagcgtttgggcgctgccgtcgatgcggcggtcggtcacctgcgcgtgtggtgtggcgaaccatccgccgatgcggttgccaaaggcagtgcgcgacgggccgctatgcgccaacgcctgacaccggacgtttgtgaggctgtcgacgcgctatgcgcgttggctgcacagcgctgggcggtaccatcagctgcctcagcgggcacgggcccgcaccggcaatcggccgcagtgcgcagactcgtcgcggcgcacgcacaggctcgcgcacacgcggtgcgctgtctcgcgtctgcggttgcggctgcggggcacagcgcgccggtacgagcagttgttgcggcggcagcggcagcagccggtccggctgcatgtgctctcagcgcagtggctgctgcggccgcacccgcaaccgacgccgtgatcgctgccacgtcgccggcgtcaccaccgctgcgcccacagcgcgtcatgtcagccgcggcgccgcctgcgcgtcggcagccgcaacacagcgacagcggcggtaacgaaggcgttggtcactttaaggcgacgcgtcggctcaatgcaagcgcccgcgtgtttgtgccgcgcactgccgtcactttaggcgctgcgactgcttcaccgccgccgctcctccctgccggcgccgtggccgcggcaggagccgtggcagccgctgctgtcggcccgccgccgtccgcagtggcgctgcctgcgcgggagcagcggcagcaaccgcaacaccaacacccgcaatatcgcggcgacaccgatgcggacgcggaggagacgaaggaaacggcggcgcgtgcacagtggcgacggcacgtgtccgcacttatcggcaaactcacggcggagacatgcgagcgcttggccctgcggtttgttgcggactcaccgggcagtttcggggcggacgtaccggaacgcgtgcagcgcgtgcgcatggccgatgccgtggcccttatcgtgtactatgcgcagagcgagtacatgtacacgccgatgtacgcagcatttatggcgcacgtgcgcgatgcgtttgcccaagccgatgtagcactggcggcggcggactccgctgctgctactgctgttcccacagcccctcccggtggtgccgctccggacggcaacagacaccacaagcccgcacggctgcccgcagtactgccgtgggatcgtgcacgggcgtggtttgcgaccgtgagcgagtgtgtgacgggcgaagtgaacgacttttttggtgccgacgcctttctgtgcactccaacgctggccgacctgcagccgcacaccaccaacagcagcagcagcagcagcagcagcagcaacaacaacaacaacaacaacaacaacaacaacaacaacaacaacaacaacaacaacaacaacaacaacaacaacaacagcagaagtgcgtatggcattccgctcgacagcgatcacgctgcggcggctgtcgtcgccgacgcagccggtgccagtgccggtgacggtatcggtttgccgatcgcctgcggtcattacgtgataccactcggcgggtggtgtgcagcggcgaacacagcggcgcgcgaacacgcctccggtgacgcctgtggtgcgtgggagctggtgccggagatggaggccgtcaaagtgctcgaagacctgctttcgtccgacggtgagcatcccgcgcctctgcacgctgcgtcgatggtcgctgctgagcgcgaacggcgccaacagctcatgacacgcgtacggcggcgcatacacgggtgtgtggcgttggtgtgcgaactgcacgcacggcacatggcgcggcgccgtgtgctgctgaccgtactgtggggtttgcgtggtgtggcgttggggaccggtaccggcgtagcggcaccgccgttttggtatggccatgcgccggtgctgccgcccacgtgggcgctggagatgctgtgccgtgcgctgagcggccgtctcggagccgcactgatgccgccatcacagccgccaccacagtcgccaccggcatcaccggcatcggcagcgccgtcgccagcactggcaccggcggtcagccgcgccggagagcgcgcgttagcgcttgcgctcagcgaactccacgcactgagcgtgcgcaaggatttgctgccgagtgcgcgcgcacgcttcctggtactcgacacactcgacgatgccgcacatcactgggagccaaattggcgcgcgcgggaacggcgcacgcgctaccaacagcagccgcagcagcacccgcagcagcaggcgtcaggggttggtgccgcagcgccgttgacatcgtagcagttcagtgttgtctgtgttttcagtctcatttgccgtcggcagtctgagatgtgccattggtct

SEQ ID NO: 1627 - DNA, 1805 bp, Oryza sativa
  Predicted polypeptide sequence is orthologous to G559
gactccgattcctcttctttcgcccaaattttggctcaacatttcgcagcgcaatctcgagctgaatcttggggggtaaagctttgcttcttggaatcttggtgcggtttttgggggagatttgcgagcgtttggagccgagaagatgaacagggagaaatccccgatcccgggagacggcggcgacgggttgccgccgcaggccacccgccgggcgggccctccggcggcggcggcggcggcggagtacgacatcagccgcatgccggatttcccgacgaggaaccccggccacaggcgcgcccactccgagatcctgagcctccccgaggacctcgacctgtgcgcggccggcggcggcgacgggccgtcgctgtcggacgagaacgacgaggagctcttctccatgttcctcgacgtggagaagctgaacagcacgtgcggggcgtcgtcggaggcggaggcggagtcgtcgtccgccggcgccgcggcggcggtggcggcggcggccgccgccgccgcccatggagcgaggccgaagcaccagcacagcctgtccatggatgagtcgatgtcgatcaaggctgaggagctcgtcggggcgtcgcccgggacggaggggatgtcgtcggcggaggccaagaaggccgtgtccgcggccaagctcgccgagcttgctctcgtcgatcccaagagggcgaaaaggatttgggctaacagacatctgcggcaagatcaaaggaaaggaaaatgcgatatattgctgaacttgagcgcaaggtgcaaaccctgcaaacagaagcaacaacactgtcagcccagttggcactgctacagagagataccagtgggctaactactgagaatagtgaactgaagctacgtctgcagaccatggagcagcaagtccacttgcaagatgctttgaatgacaccctgaagtctgaggttcagcggcttaaggttgcaaccggtcaaatggcgaatggtggagggatgatgatgaacttcggtggcatgccacaccaattcggaggcaaccagcagatgttccagaacaaccaggccatgcaatctatgctggcagcacaccagctgcaacagctccagcttcatcctcaggctcagcagcagcaggtgctgcaccctcagcatcagcagcagcagccattgcaccctctacaagcgcagcagctccagcaggcggcacgagacctcaagatgaaatcgccgatgggcggccagagccagtggggagatggcaagtcaggaagcagcggcaactgatgcgtcatttacaaatttacaaaaaaattccccaaagtttcggtgtaaggttgtggtttaacaaccatggagatggtctgtttcattgagatgatgatgatgtgcaagagtagttatcatcatcatcatcggtaggttcaggttggcttcagcttcagtcatacagttgggtggatgttcagttgaagagtttatctgtagctggttcagtaaggaaatggtcgaataatcaagaattccaggttaaaatctttcgtttctttggtaaggtagcacatcaccaagatgtactgttgtagtgttgtctacagttccataaattcaagtagccagtatacgctgttgtttagtttttctccggttttttagaggtagaggcgtttctagtgttaatcgagaggtatactgtataccttctgattaacatgtaaatcactcaacacctctacctccataaggaccggagaaaaactcaattgtttaattaagatgccattcatgactagatgttctctgtc

SEQ ID NO: 1628 - DNA, 1879 bp, Oryza sativa
  Predicted polypeptide sequence is orthologous to G559
cagactctccagacagaagcaactacactatcagcacagttgtccatgttacaggtactttattttggctttaccttatctcatactttgtgcatccatgatttagacactctacaccaatgtttagcagttggttctactctactagacaaatgcctcagccccatgaaaatgtttatttaggtacatgcctatgcttttaacttggcattttttacctggcaggcttcctattatctgtgttagtataaggttactaaacttgtaggttattctaaatttcatgctggttgtatatcaagtgaagctatttgacaaagtgctgcactgctgcttgttctggaaattccgacaacccatacctaggggtggtaatgggcccatcattttgacctacaaaatgtgagggttgggtccaaaaaggtttgggctgaaatttagaatttttttgtgctaaaaatatttaagggttgagatgggttgtgaaaggacccacaggccaccccgaccctgtttcctctatctgagcagtaaccatttatggtagttaggatgttaacatctgatttattttttccagctgcaaatacaccttttgtatcctacaggttgatactgttaacatattgcagattatgtagtttttgaaggaacttacttttcagttttccacgagtctatccttgattatctctacctgaataatacagagagataccactggtttaacaagtgaaaatagtgatttgaaaatacgggtgcaaacaatggagcaacaagtcaggctgcaggatggtaaggttttcatatcatcgcagtaattctaatcgaattgccatatattttgagaaaaaaaaatgaagtgtcttcatgacacactaatttatagtatatataactggaaattacttgagcctattaagtattgttttcttttctctttattctcttgcgtcttcgttggaataatatagtgtgatattatcttcaattttctcctgatattttctttttcatcacctagtgatcgaagtgatattattgttttctctaccccttttgctgagttattaaccttttgtctatggtagagacgtaacaaaaaatcatataacaagatataagttgtatgaagaaagtaagcattagttaatgcaaattatgacttaggatatcatctttgataggcttcagatcatttattactattttgtaggtgtcacaaaaactctcctacagtgtttttccaatcatctttaggattgtaactgttccttgtttgcatgtagcactaaatgacaggctaagagatgagattcagcagctaaaggttgcaacaggtcaggttaatgccaactgcggcaaagtgggaaactttggcctctcctcatttggaggcgccaatccacaaggttaccagcgcagtcacatacaatctcttctggcagcccagcagctgcagcagctacagatccactcccagcaccagcagcaacagatgcatctgcagcagcatcatcatcttagcacggtccaacagcagcttctgcaggaggggttgcccttgccaggggatctgaagatgaaaggaattgtggcggcatcccatgcacagaacgccggcgcatctgaaagccacgctctgaggagtgagccgtgagttggcataggctcatggcggttgtcagtaataataacatgttgtatctgagtgactcatgcataggctagcgcagtatctaggtaaaatttcagactatctatgaagcacttagatgcctgcagcctgtagaatgtagatcccattcagttgtaagttgtagaactgatgaggcaaaactgagtaattcaccggtgccatggagtatgttcacgtcat

SEQ ID NO: 1629 - DNA, 516 bp, Oryza sativa
  Predicted polypeptide sequence is orthologous to G559
atgccggactcgccgccgcggcgggcggcgaggcaccgacgtgcgcagtcggagatcgtcctcgggacggacgacattgcctccgacgccgacctcggcgtgttcttatttggatatgaaagtaaaaatgatgagaggtttatatgtatgattttcatgttatcgttatataagtgtgagactaatgtttactcgagtcatatcttatttagtctaatttacattaagaacagggagatcatgaagagccgccagagccacaaccggtcagaccgagcctgtcagggttatggataccacatacctaatagtagttgcctaaatctcggcagaacccactacataccatgtcctatacggaagcaaccttcggacataggaggagttccggataaggaaagacaaccaaagttctacatggaaacgacaagtactactcggattgtatccatattggtttccctagttctacttggacaaggggacacctatgggtataaatacaagctcccctag

SEQ ID NO: 1630 - DNA, 406 bp, Oryza sativa
  Predicted polypeptide sequence is orthologous to G559
cacgcaatttttaataacaattcaacagattatttgtcaccaagtggtgaaactggtgccaatttgaatggaggtaacgtcgaagaatgtccatcattgaacattgatgattctacaggtgcagcatcaccagcaggagaaccagaaccagcagcgttagaatcaacagcagtagaactagcagaaccaggaccaacagcagttcaaacagtactcgataaaaaagatgaaggcggcaatgttcaagctgattcaaagtttgtcaatcgtgcaacgggcacaaatggtcatgaagcaacttctcgtagtgataatcactatgaccaatgaacttcttcgtttttgtttgttttaatttattctcgcataatatccagaataaaaacaaaaaaagcttcgtagtttg

SEQ ID NO: 1631 - DNA, 900 bp, Oryza sativa
  Predicted polypeptide sequence is orthologous to G594
atgcctactccccattccccagcgttagggttccaggccgcgacttctccgggccagtggaacgaagttgccgcatcaatcgacaaggttgttgagatgagagcagcagcgccaccagcggacccaaccgtggtgatggcttcgtcgtcgccggagaagaagcatccacctggttgtggctctcgggactcccagcccatcgcttgcacggacgatccccccttgtctgaatccccaacgacggacctaggctgccacgatccgcgcgaggaggacgccgaccacccggcaccacccatgggcagagaggccggagatataaatcattttaattatctggaaaattcagattcagacgacatctttgcctcaaccaactcagacaatatgaatatgttgatcggtgacatcgacgaggatagtgatgatgatggttacgtagacgaggagacaacttgcccagggcagaacttcacgaaggagcaggaaaaggaaataatgcgcaagtggctggaaacatacgacaagaagaatagagaattcatggtggcgtgcgaggagttccaaaagcagggaggagatgagacgagtgcttctcgtccggtatttccttttaaaccgctccccgagacaacagatttttgtatcaccaagagtttatgctatcaccgtgaatacaagaccaatgatacttctgagactgcatccactattgggtggcgtgaacccaaggagatgctccagatcttctcaaagaagttgtccagctccatgtcctatcctattagtgtttacggaatctttgcagtacgtgattacttggaccctttgcggaattatgtcttcaaccgtaccagagatgatcctgtcatagttgaacagtgctacattttggtataa

SEQ ID NO: 1632 - DNA, 483 bp, Oryza sativa
  Predicted polypeptide sequence is orthologous to G594
atggcgccgaccaccaaaggcagaggggcctgtggagcggaggagggggctgagttagtggaggagttcaagtttggagaacatggagagagagagtcaactgttgttgccaatgctgcctcttgccgaatagaggaagaaggaaaaaaagggagggagaaggcaagatcatatagaaacgaggctcatatggagggaaaatggaagaatcagcaaagaaagaaaatcaaatgtggagagcctcatatggagggcgattttctgccaagcgtgaccatcatcatcatggatggtggtcgcagagcagtgccaggccagtccaccgtgccaaggcatcggcccaggcatgacccaactatcgggccgggccagcacaggcccgacaccagtcgtgccatgccgtgcttgagccgggccaaatggccgtgccatgggtcaggccatcaggcctcggaccatatggctatctataccaatgattaa

SEQ ID NO: 1633 - DNA, 1464 bp, Oryza sativa
  Predicted polypeptide sequence is orthologous to G668
agtttcagtttcagagagaggagtcagtggctgtatgctgccatggctctcaaggtggctagatagacagacatgttgcccatcaacttaagaagcaactagctgctgctgctgctaagggagagctataggcttagctgtggtaggctatagatattactattaggtagctactagcctataggcagacatggggagacctccatgctgcgacaatggcgtcggcgtcaagaaagggccatggacgccagaggaggacatcatcctcgtctcctacatccagcagcatggccccgggaactggcgctccgtgcccgagaacaccggattgatgaggtgcagcaagagctgcaggctgcggtggacgaactacttgagaccggggatcaagcgtggcaacttcacccctcatgaggaggggatcatcatccacctccaggcattgcttggcaacaagtgggcagcaatagcctcctacctcccccaaagaacagacaacgacatcaagaactactggaacacacacctcaagaagaaggtgaagaggctgcaacaacaacaacaatcacaccctgatcatcatcaccaccattccttccaaaccaccccttcttcctccaatgcagcagcagtagcaacaaccagcccaaactactacaaccctaacaacagcaacagcaacagcagcaattacctccataacaacaaccacaatcttgaatccatgcaatccatggccactgcacctagcaatgaggccaccaccatccccaagctcttccagttccagacatggatgaagccatcaccagcaacaacatcatcagcagcaacagctgctgcaggtagctgctacaagcaggccatggccatgcaggagctccaagaggagcaagagggctctgctgctgctgctgcaatggcttcttccattgatggcgtctccaaggaccaggattatcacatgtgtgctgtgatcagtggtgatgacaagtcgtcgtcgtcggagatgatgacggctgcggcaatggccggccatggcgaggcggccacgacgaccttctcgctgctcgagaactggctgctcgacgacatgccggggcaggcggccatgagcgccgccatggatgggttcttggagatctctgctggatactgctgtgcagaccctatcatgttctgaactttctgaacttctgatgatcatctcagccttaatttcccatatgagtctctctttgctataggtttcttaatttcactgagttaatttgcacttgtactagctgtttgatgctctctctctctcgatgatcttgtgtttccggtaataaaccgttggtttaatttcctcaagaaaaagcaatccacctggaaataatctggttggtttggagaaatattgtcagttctcaaggatgtaataaaaggattaaagctgccataattcgttgcctgatatgc

SEQ ID NO: 1634 - DNA, 2407 bp, Oryza sativa
  Predicted polypeptide sequence is orthologous to G668
gagatatctctgaaatctccacttctgacagacggtccaccgccggaccgcgacgatgcaccaccgcaccgcccgaccagcgccgaggcactaccgcactgctgcccacggccaggcgcgggtccagccgcctccgaccgccaccacagcgcctccactgcctgcagggacgccaccgctacccgcccggctacctccgttgccgccgccaacacgcgagtctcctcctccctgatcgagatcgagtcgacacacatacaccaccaaccaccggccggccgccgcgcgccggtgagcaggatggggaggccgccgtgctgcgacaaggttggggtgaagagaggggccatggacgccggaggaggacctgatgctggtctcctacatccaggagcacggcgccggcaactggcgcgccgtgccgaccaacaccgggctgatgcgttgcagcaagagctgccggctccggtggacgaactacctccggccggggatcaagcgggggaacttcaccgagcaggaggagaagctcatcgtccacctccaggctctcctcggcaaccgttctctaccataatcgtggtccacaacatagccatgctttctgaatactttcaatggataatcaacgaagctctacactacaaatttctgcaatgacaggtactattattttttgtctgaattttgctttgcttgctacctttattttacctgcagacaatttatatttggcctgtgataatactctattgtagtgtatgtactaaaaggtgtttttattctatttaattaggagggatcatatggaggttagtttatcaacattctaaagtatcaatattgatgctcatgattttgttaactattgtttatcactgattctctttcatgcccaataggtgatttcaccaatgaaagatggaacatttattgattgggatattgttgacaatatatggaatcatgctttcaagcagcggctattgatcaatcctgaggagcatcctatgttgatagttgaaccatctacaaacacagggcagcaaagagagaagtatgtccatatatattctgtatttaaattaattgtgttgcttacttgtatagaaaaacatcgcgtataagaactagctgatttatagcacaattttcttctatggctcttatcagttatgactgaactgtattggtaccaggatttactgcatgatcagacatcctaggtagtatattgtagataaaattcaattacatgggaaattttcaggctgtagttgctctgtttgttgctaacgaataattcagtcctatattcgtcttctagggttttacattcttcctctcgggtcctatattcattttctgggctcctgtatttgttctccgagtctttctctcgattcctatattcgtcctctagggtcctatatctaaatttaacaattctcaaatcctttttatcatttttgtatcgtgggttgtcaaaataagcaactatagtatttctacgtaaaacacccataaagggtatttcaatcgaaatcccaaaaacaggatattggttctttcgcttgctcttgatgatactgtttcttcgcattttggctaacaaatctgaattattttgaagaatagaaggatagacaaaattcaaatgaccattggacatgattcgatccggcgttgaataatcaagaatttccctatcttttttaacaaaagtatccattcagtcgttctttttatcatgccatttttgttatttatcagtttttttggaacaaaaacatggtattttcttagttgatgctttatgcaggtatctactgactttaaagatcatgaaggcataatgcatatatcagggctttgacatggtcttcgtgcaagaataaaatgccattttgtgtttgtcaacaagtgttatttattttttaatcaacaattgtttgtcttacttcaggttcactgatctaatgttttagtcttgcacctatcacttgctaataatgttgtaaccttgccttgcacctatcacttgctaataatgttgtaaccttgctcctgtcacttgatagtatttcaaataatttccaatattatttgtgcagattatataaggtcgctttaagattaccttgttcagattcttcggccggccctattctttacattatgcattggactattgagcctggttgtttttggaggaccagggagcatggctggagtatcatctggaggataacctgatgtggattattcacttggctttgtcttgacaaataatatatgagttattgcttgtaagagaggtcaagagaggtcttattttctgatcttatcctagattgtattaaggacaattcatgtggattaaggagaattcagaaacaaaatttgg

SEQ ID NO: 1635 - DNA, 2327 bp, Oryza sativa
  Predicted polypeptide sequence is orthologous to G668
ggctcgctccgcgcctctctctccccgctcgcgtcctcgctctgcgcctcctctcctcgcgacggtccaccgccggaccagcgacctcgcctcctcgctccgcctcaatgccggaccagcgccgaggcactaccgcactgctgcccacggccaggcacggtccagccgcctctgaccggcaccacagcgcctccgctgctcgcagggacgccgccgctacccgcccggctacctccgttgccgccgccaacacgctagtctcctcctccctgatcgagatcgagtcgacacatacaccaccaaccaccggccggccgccgcgcaccggcgagcaggatggggaggccgccgtgctgcgacaaggttgggtgaagaaggggccatggacgccggaggaggacctgatgctggcctcctacatccaggagcacggctccggcaactggcgcgccgtgccgaccaacaccggggtgatgcgttgcagcaagagctgccggctccggtggacgaactacctccggccggggatcaagcgggggaacttcactgagcaggaggagaagctcatcgtccacctccaggctctcctcggcaaccgttctctaccataatcgtggtccacaacatagccgtgctttctgaatactttcaatggatagtcaacgaagctctacactacaaatttctgcaataacatgtgatttcaccaatgaaagatggaacatttattgattgggatattgttgacaatatatggaatcatgctttcaggtgagttgctttatctatttgatgcagatctgagtaattttgtgccaaaagtgcacgcccaaaaagctggccacacttgtggcaaaacttgtctgaaaaataaatctatgacatgagaggcactggagtaaccaggtttggcacgctgcttatgtggttcgccaaacacttgcccgttgccgcaaaaggccgaacgtgcctaacttgtttctggggaagtttgggatgaaccaaactctatctttaacatagtttctttagaatcagcaacaaagttaatcttctatgcctctatggaatcttttggatgtcagcatggttactgctttatgcccaccatcttttcaccttacatatttatttatgctcttcaaatatactaatagtgaaatcccttcttatgtgtacaaccggataaagttgattaaatactaggatttcctttgtatggcatggagatgcaactactgaagttttttgctttgttagcttttatcctgaggagcatcctatgttgatagttgaaccatctacaaacacagggcagcaaagagagaagtatgtccatatgttctgtatttaaattaattgtgttgcttatgtggtcctatatctaaatttaacaattctcaaaacctttttatcttttttgtatcgtgggttgtcaaaataagcaactatagtatttctacgtaaaacacccataaagggtatttcaatcgaaatcccaaaacaggatattggttctttcgcttgctcttgatgatactgtaatggaatggcaaacctatttcttcgcattttggctaacaaatctgaattattttgaagaatagaaggatagacaaaattccaatgaccattggacatgattcgatctggcgttgaataatcaagaatttccctatcttttttaacaaaagtatccattaaggtgtttcttttatcatgccatttttgttatttatcagtttttttggaacaaaaacaatgtattttcttagttgatgctttatgcaggtatctattgactttaaagatcatgaaggcataatgcatatatcaaggctttgacatggtcttcgtgcaagaataaaatgccattttgtgttcgtcaacaagtgttatttatttttaatcaacaattgtttgtcttacttcaggttcactgatctaatgttttagtcttgcacctgtcacttgctaataatgttgtaaccttgctcctgtcacttgatagtatttcaaataatttccaatattatttgtgcagattatataaggtcgctttaagattaccatgttcagattcttctgccggccctgttatttacattatgcattggactattgagcctggttgtttttggaggaccagggagcatggctggagtatcatctagaggataacctgatgtggattatgcacttggctttgtcttgacaaataatatatgcggtattgcttgtaagagaggtcttgttttctgatcttatcctggattgtattaaggacaattcatgtggattaaggagaattcagaaacaaaatttgg

SEQ ID NO: 1636 - DNA, 1223 bp, Oryza sativa
  Predicted polypeptide sequence is orthologous to G668
ccacgcgtccgctcctctcttgcaacatcaaactcatccatccatccatcgatctgagaaatccagctttccagttcttggatctccatcgaccatggtgaggccgccgtgctgcgacaaggacggcgtcaagaagggcccgtggacgccggaggaggacctcgtcctcgtctcctacgtccaggagcacggccccggcaactggcgcgccgtcccgaccagaacagggctgatgcggtgcagcaagagctgtaggctccggtggaccaactacctgaggcccgggatcaagcggggaaacttcaccgaccaggaggagaagctcatcgtccacctccaggcgctcctcggcaaccgctgggcggccatcgcgtcgtacctccccgagcgcacggacaacgacatcaagaactactggaacacccacctcaagcgcaagctgcagggcggcggcgccggcggtgacggagacggtggcgccgccggcgacgcggtctccccgaagcccgccgcgcagaggcccgcgtcgtcgtccaaggggcagtgggagcggcgcctgcagaccgacatcgacatggcgcgccgcgcgctccgcgaggcgctcacgtcgctcgacgacgtcaagccaccgcatcagcccgacgccgccaacgccgccgcggggggaggcggcgccaccaccggagcagcagcgtccgccggcgccgatagccccgccgcgtcgagcacgtcgggggcgtcgcagtgctccccgtcatccgccggctacgtcctcaccaccgagaacatctcccggatgctcgacgggtgggcccggaagaagggcggcggcggcggcaggcgcgccgccggcagcgggccggccacccccggcgccaccgagagcgcgtccggctcgtcggaagcctccgaggtgtcctacggcggcacggccttgtccgcagcggcggcgcccgcgtccgccttcgagtacgagacaaagccgaccgtcaccgccgccgccgccgccgacgccggcgacgagacgcagctctccgccatcgagtcgtggctgttcgccgacgccgacggcatcgagagtggcagcttgctcgacgcggccatggattacaccttctaatccacaccaccaccaaaccatgcaagaatcgtaggcagcgagagtgagcagcgcgagttcatcactagcccaacctgaaaaaagaaaaatcgaaaaaaaaaaa

SEQ ID NO: 1637 - DNA, 933 bp, Oryza sativa
  Predicted polypeptide sequence is orthologous to G668
atggggaggccgccgtgctgcgtgaaggcggaggtgaagaaggggccgtggacgccggaggaggacctcatgctcgtcgcctacgtccaggagcacggcccgggcaactggcgcgccgtgcccaccaacaccgggctgatgcggtgcagcaagagctgccggctccggtggaccaactacctccggccggggatcaagcgggggaacttcaccgaccaggaggagaagctcatcgtccacctccaggccctcctcggcaacaggtgggcggcgatcgcgtcctacttgccggagaggacggacaacgacatcaagaactactggaacacgcacctcaagaagaagctcaagaagatgagcgccaccggcggcggcggcgacgacggcgagggaggtggcgccggcgaggtgaagaccagggcggctgcgccgaaggggcagtgggagcggcgcctgcagacggacatccacaccgcgcgccaggcgctccgcgacgcgctctcgctggacccctcgccgccggccaagccgctggactcgtcgtcgggcgccacggcgccgccgtcgtcgcaggcggcgacgtcgtacgcatccagcgccgagaacatcgcgcggctcctggagggctggatgcgccccggcggcggcggcggcaagacgacgacgacgccgtcctccgggtcgaggtcgtcggcggcgtcggtgctgtccggggaggccagccacagcggcggcgccacggcgccgacgcccgacggctcgacggtcaccagcaagacgaaggacgaggagaccgccggcgcgccgccgccgccgccgccgccggcgttctccatgctggagagctggctgctcgacgacggcatgggccacggcgaggtggggctcatggacgtggtggtgccattgggggacccgagtgagttcttttag

SEQ ID NO: 1638 - DNA, 908 bp, Oryza sativa
  misc_feature (326)..(326): n is a, c, g, or t
  misc_feature (897)..(898): n is a, c, g, or t
  Predicted polypeptide sequence is orthologous to G668
tgacgcgtaggtcggtcggaatccgggtcgaccacgcgtcgcccgcgtcgaatgcgcaatgtttgaggagtgttggaaagatgtctaggactaagccatcttagataacagaattgatgtgttgtccgatatatcttcactcttgtccggttaaggaatcaccgaagacagcattcctggaaagcactgccaatgatgtcatgttgatgtactaacagtagctgatagctgcttggagagcacaatgtttactggcagctgaatatgctcgacgcatcccaccccatatctggattgcaaagtgcctctgagttcagatttaattnggtctggagacgtttaactcctttagaacttttagaatgataagaattttttagaacattagtgttcatagatttgatgtatttttaacagtgcatggttttgatgtctctgctgctgttgtgcgccatacccagatattcatacctgagggatgctagtcgcatcttgtgttgtccttctggaatctgacatcacctagcgcgcttccaagatctttagtgaatgccattttgagtgtcttttggctgtgcatctgtgaaattattgccagttcatgacaactaatagctttgtaaaaaccttctatttcatggttatcagtaaaagttattgatggttcttttaaaaaaaaaagggggcgctggaataaaatcggggcgtcagaggtcaagtagtagcgtatggagtcttagtctatgggtcctattaatcgggcggtacagtctgaggaaacgggtccataagctggcacctgcagggtataaggccaatgctcaatcagagaaggcctagcaaggagggtacgccagaccagcataccaggcgcagccttgccattctcatatctanngggagaggac

SEQ ID NO: 1639 - DNA, 633 bp, Oryza sativa
  Predicted polypeptide sequence is orthologous to G729
ttttttttttttttttttgtgccttcacacttcacagtcttattggcttcttatctagccaagctagtcatttcgggcaaatgacactatatactactaactgggtcaagctagctatagcacaccgaaatcaatcaacttagttatgcatgcttggacttcgcggttctgatgtatcattgtgaagccttcccaatcccaagtgtgaactcaaggttcggccgacctggtaacctcaacatagatgtctctaagtccacgctcagttttgtattcttgagatatcttctgtaaatttcattagctggttctctgatgggtaagcctaccttgcctgacgagttattgctccataaaccactgtaaatattggtgtcgttctgttcagatgctagcatacttttgttttgcctcagaggaccgtcagtaaaactgtcgtcggagatatctccagccgatgcattgtcaaacccatcgttattttgtcctgcatttgagaccggtctgtcggtatttttaattgtgcgatacatctgcaggtgagacttgacatgagccagcgttagatccttgacatccatcagctccagcactgacttgggcgttgctcccccttgtctcgtcgctcaccta

SEQ ID NO: 1640 - DNA, 1526 bp, Oryza sativa
  Predicted polypeptide sequence is orthologous to G729
tcacaccagaaccaccactgctataactctcctcttcctcttccaccaccaccaacaccacaatatatggtcctctactatcataattctagaagtgtatgatcagtttgatccaagaagtggtagagagtagttggtgttgtattctcttccattgatcattgagctaagctatagctgtagcagcagcagcagcgacaacctcccatagctttgatcttgcaatgctgcaaaggaacctgccgaatctctccctccggataagccctccggccgtctcgtcggcggcggcgccggtatcctccggaacaccgacgacggcggcgaggacgactctgccgaccggagtgattacagacgcagaaggaggaggcgaagtagcagcgttctttggaaaccctagctccggcagcgagccccccggtctgagcctggggctcgggccgacgacgccggcgcacgcggacgccggcggcggccgccatggcgaccaccacctgcagccgcaggggtgcgcgccgttcaagcgcgcggcggccagggcgtcccagctgccggcgggctcgaagcggagcgtccgcgcgccgcggatgcgatggaccaccgcgctccacgcccgcttcgtgcacgccgtcgagctcctcggcggccacgagagagcgacgccgaagtcggtgctggagctgatgaacgtgaaggatctgacactggcgcatgtcaagagtcacctccagatgtataggacagtgaagagcacagacagatcatcccacattgcctcaggagaggcgcagctgcagcagcaggcaggaatggaggtggccatggaggcggcagctggaggaggaggaaatggtggtggtggtggtggtggggtggtgctaccgatgatgccggcatgtgacgacatggttgggatctgtagctcccctgcgccgcctgccgcagcgactagttccgctgctgcctacttcctctgcgcgacgacgacgtcaacagcaactgctccactggcagtagtgccatcgcctcctgctccaaccattcccacaaggaggactgaccaaacgccagcgctggaaaagggtgtcgcgattgttgactcgttgcaccggtgtcagaagcataactactcaccagtgcttcaagatgctcttcatcagggagctgaagaagatcatcttattaccgggaacctaccaatgggaggagcatcagcacaagcgagcattgaggccatggcgactaccaactcttcaagccctgcaagctcatctccatcacttgcaagcctggagcagctgctacctgaagactcgtttgcgcccaacctggagatctccctcgggagacataactggaacatggaccatcctgaagaactcagcctgaaatacctgtgaaaaaagccaaaaaaaaaaagaggtttttctctcctctgggtttcactccactaaccattgatgattgctcgatcagatcgttgtgatgatgactgaaaaatatattcagtaaccgcatccatc

SEQ ID NO: 1641 - DNA, 478 bp, Oryza sativa
  Predicted polypeptide sequence is orthologous to G729
tttttttttttttttggcattgacgtggcgcttacatgacaattcgatttgaaaaataatagtcatggacccacacgttagttacaaaaagatagtaatttaaaatggtggggccacatgtcattcttactcccctcctcatcttcctcagctcttccaatctcccctctcttcatcttgtcttgttcctgctcttcttgatgatggttgttatgcaggaattcagagacgaagaattagtgccctgcagctgctgattatgatgatgatgatgagcagttgtggatttaaggctggatatttgtagcaggagatatgcataggccgagagtgttcttaggataattgtatcatctcgatgtaattgactgagttaaataaaaacttccattatctaaaaaggatactctgctgctgctactaccgttgacggtaaaagagtaggcggctcgcagatgctgccgattggtggttgaat

SEQ ID NO: 1642 - DNA, 969 bp, Oryza sativa
  Predicted polypeptide sequence is orthologous to G729
atggagctcttcccttcgcagccggatctttccctccagatcggcctccccaccggcgcagccgcggcggcgcatggccacggcctcaacgcgaggttctttgccgccgccgcgggagcgggtggccacaacccggcaatggcgtcgtcgccgccgtcgtcgctgcagcttccgcttcccatgccgctgcccatggctccagccggcgccggcggcctgcagttctaccccgacgccgccgccgccgccgccgccgccatgctgaggcccatacgcggcgtgccgctgtaccaccaccaccagcagcagcacgccgcggcggcgccgttcgtgggcgcggcgccgctgccgcaccacccgagctcaggcggcgcgtgctactgcgagccgtgccacgtcgccggcgcgtggcgcaggggtggctgcggcggcggcggcgcccgcggcgtgctcccggcgaagcgcgccccgcgcgcgccgcgcatgcgctggacgtccaccctccacgcccgcttcgtccacgccgtcgagctcctcggcggccatgacagggcaacgccaaagtcggttcttgagctgatggatgtgaaggacctcaccctggctcatgtcaagtctcacttgcagatgtacaggacagtgaagaataccgaaaggccggcagcttcgtcagatcaagctgatgggtttgagaatgggtcggccggcgagatctgcgacgagaactcgctcgacctgcacggcggatgcaggccggaggcgatgtcggcggcggcgcgacatggaagggaggactggtctggcttccatgagtccaacactggaaccatgcaaactctgaaggatatgcaatccaagagcctagagatcatatcagacatgaactcctgcgtttcggagacgacatcgagcaccagcgagctgaacctcgagttcacgctagggcgaccacaaaaccgaccaaactaa

SEQ ID NO: 1643 - DNA, 573 bp, Oryza sativa
  misc_feature (51)..(51): n is a, c, g, or t
  Predicted polypeptide sequence is orthologous to G729
tttttttttttttattttttttgcaaaaaatgtctcaaaatagtacttcangtatataaccatttacctgcatcaatagcacagtgctcacaaatagtacttatagtatataacctttacataattccacagccagtgcatatacttctatagtgtgaccagtagaagtttatatggtatgccaaccatagaggtttatatctcagttactcttaggacattgtctcataatagtactccagtccattcttatcggaatagtgctcgacgtccttgtcttaaggggtatcccctagagcatgtacatcatcctagcagatgggcactggcagggatttcccactgggcatgtccctacatactaagcataactgtccaaaaatactgcacaatctcgggttctaactaatatcccagtcattcgagggttatccctcgtaaagttggtttaaattgactttgaaatcttgatttcaccgaattttgtgaacaaaaagcccatactgttactggaacaacaatgaagtatttttggcactaatgtttggttcacatcatttgttgaggctaaac

SEQ ID NO: 1644 - DNA, 1278 bp, Oryza sativa
  Predicted polypeptide sequence is orthologous to G729
atggcgtcggcgacgtcgacgacgcccgacctgtcgctgcacatcagcctgccgagcggtggcgcggcggtggggacgacggcgccgccggggctggggaacggcggtgcggttggtggtgccggcggcggcaaggcggcgggtggtggtgacccgtggcggaggctggatggctccacagcgtcgacggagctgtcgctgtcgacgccgcagcagcagcaggagggcagtacatcggcggccgatgtgctgccgtggcggctgcggcagccgacggcggcggcggcgtccgtgccggtgacactgccgacgataccgatggatggttcggcggcggcggcgcgcgcgccgatccgtggggtgcctgtgtatagcggcggcggcggcggtggccacccgttcctcggaggcggcggcggcgaccaccggcacaaccggctctacaacccctaccactccacggcatggccctcgtcgtcgctgtgctcgacgtcgccggcgccggctcctcctcccccaccagcagctctcgacccgacgacgtcgtcgctgctgtcgccgtccgcgtaccaccggatgctctccagcacggggcgcctccacggcgtgctcgccgacaccctccgcggctacgccggcgccgctgcggtggcgggctccatcggctacggctccgcggccgccgccgccgccgccatgggcggctacggcggcgccggcgccggcggcgggttcgcctcctcccgcttcatgccgcgcctcctcccggcgtcccgccgcagcatgcgcgccccgcggatgcggtggacgagctccctccacgcccgcttcgtccacgccgtcgagcttctcggcggccacgagcgagcgacgcccaaatcggtgctagagctgatggacgtcaaggatctgaccctagctcatgtgaagagccatctgcagatgtataggaccgtgaagagcactgacaagccagcagcagcctcagggccgatggacggcagcggctccggctccggctccggcgacgacgagctcctggccggcgatggaaggcaggcgacgtcatcgggcgccgatgcggaccggcggatgtcgttcaccgagcaccggtcctcctccgagggcgcggcgagccatgccggcggtggcggcgacggcgactgctcctcctctgccgtcaactccgacaccatcagagcgcgcagcaattcgccgagtacatcaatagaaacttgggattgtgtttggtgctgttcgttaaaagaaaagtcttag

SEQ ID NO: 1645 - DNA, 1095 bp, Oryza sativa
  Predicted polypeptide sequence is orthologous to G729
atggagctgttcccggcacaccctgacctgcagctccagatcagccctcctcctgccaccaagtcaatggacttagggttttggaaacgagctcttgaaacctccacgaccaccaccacggcggcggcggcggcaagtacaggtccttccgtcgctacttcctcctcgccgccggtagcgagtggcggggttggcggcggtgccggcggcttctaccagcaggcggccgtcgcgcctgcagctaacggccacggccatggccatggccatcaccaccaccaccaccaacatcaccagctcggcggcgcactccagttcttgcaccgcacccagcccatcccgccgcaggacgcggccgccggcggcggcctgcaggacctggcgttcgcgcggcccatccggggaatccccgtgtacaacacctcgcggccgctgcccttcctccagagccaccacctccagcaccaccagcattgctacgccgacacgatcggcgtcgcgccgggggccgggccgaggtcccccagcaagcaggcggcggcgctgcggctcgccgcggcgcccgccaagcgtggcgcccgcgcgccgcggatgcggtggacgacgtcgctgcacgcgcggttcgtccatgccgtcgagcttctcggaggccacgagagagctacacccaagtcagttcttgagctaatggacgtgaaggacctgaccttagctcatgtcaagtctcacttgcagatgtaccggaccatcaagaccactgaccacaaacaacctgctccaccatatgggcaaactaagactatcatagagatcccagacgacaatctgtttgacatcaacaacactagtgggtcagagtcttctgttcagcaacaatccaattttgacggcaatgaacaaggatccagcatgtgtgctctacggagcaacaactcctcaagtagaggggcctggttccatgacaaatcaagagatgctacccatggagacatcaaatccttcgaggacgtgcagtcacagagccctgaagacgacgacgcctccgacctgaatcgccgccgttccaaataccggagacgactgtcagcgccatga

SEQ ID NO: 1646 - DNA, 762 bp, Oryza sativa
  Predicted polypeptide sequence is orthologous to G729
cattttcttagctttggaagaagctgaaaaatcctttcagttttctcccaagaaacagcaatggcgactactgctgccaccgcgccggatctgtcactccacataagcccgccttcgccgccggacatggccgccggcggcgagacgatggagcagttggctgagccaaagctgtgcctagggtttggcacggcggcggcggcggcggcggagcagtacaacaatggcggctgcaacctccagcagcagcagcggctgcaccaacctagccagatccagagattcaagaagagcgccagcggcggcagccctgtgtgctccggcggcgccaccggcaccggcggcgttgcggcggcgagatccgggaatggcggtggaggtgggaagaggagctctagggcgccgaggatgcgatggacgacggctctccatgcgcactttgtgcaagccgtcgagcttcttggaggccatgaaagagcgacaccaaagtcagtattggagttgatgaacgtgaaagatctcacgctggctcatgtgaagagtcacctgcaggcaacttatttgcttgacctggtgcagatgtatagaacagtgaagggaaccacagacagaacatgtgctgaaggccatgggcagatgagagatatgggctttctgaggagaggaggtggtggagtggatggctttgacgtgcttggtaacacctcttcaattgcaatcgccaatattagggccttcaatctcaaggatgcaaatatataa

SEQ ID NO: 1647 - DNA, 433 bp, Oryza sativa
  Predicted polypeptide sequence is orthologous to G779
tgctaacatatagcaatttttgaagaaaggaaagctagaaatacccaatatcttgctgaagcaagatattgggtatttctaaaacacggcatcagtcccttccacaatacctgatcctcatcatattatgctagtccctccggctacagatttgctccatcaagatcacagccaaagcaatggctaacaggatacagcaggaactccaggcttccacaagatagtgctgaaactcaagctctagcagtagcagcaatccatccactgcgaaagtagaaaaatttcaccccaggtgtactctagtctcgggcttccgttgtccagctccaaactgaattttgctgaactacaaccactgattgcgagaagttaatatctacctggagggatggcaagctcttttcatgaataaaaaaaataaaaaaaaaaaaaa

SEQ ID NO: 1648 - DNA, 3215 bp, Oryza sativa
  Predicted polypeptide sequence is orthologous to G812
attccattcgacaaactcgacatcgcgctgcgacgctccggccgacgcaacgcaccgctacaaacgcattctcgagtccacctgtgctcacctcggtcgttcctacaccgactcggtcgactcgtcaatgtgcgcggctttggccagcattcgctcttttcacctctcgtgagcttcggcattggccgagcatcatatcgctccttctttgcaacgcaaccaaatccttccatcggccacggccggtcaacgtctcagctgcaattcagccttcgcctcgtccggtcctcggcaagtccgaaccaagaatcggctcgattccgcacaggtgcttccgcctacatcgcttcgccttgctccatccttacgcctcgtaagcttctcttcgccctcttccgtgcgtgtcgaagacgagtgtcgattgctcgctcgaactcgtctgcacccatccttttccaacgtgacaatcgcccggtaaggccgaacgacaatctcacgcacaacgccgaaaagatcgctgtcgacagctcctgcacccgcacttgccctctgcgcagcatcttctggcctgttgccggagcaggaacgtagcgctcaagcaggccgtcacgcccatcattgatacccttggtgcgccaccgacgctcgccactcgcagctccaggacgccgttcggttgcctctgtggtccgcctttgctcaacatgaacggcatggaacacggtcaaagctttgaccccgcctttgatgccttctttcaggctccgtcctcatcctctccacatcaccaacttcagcattccgccgccggctcgcctgcgtccatccagcagatcggcaacatgagcgcagccgactcttcgctcagtctgtacgctcaagacacctcggcgatgcgcccgagctcctcgtcgggcggcaatctccatctcaacatctccaacctctcggtcacgggcggtgaagccgacgcctcacacgcacaggcacaccagcagcagggcgtcgccagctcgctcagtttcgcgcctaacaacacggcctcacctcagtccaccctcgcgtcaccggccgatgccactgcttcattcaacatgcccagcaccacatcaacctcgccgctcttgcatcctgatgcaccggtgggcacagccacagaagcccacctcggcgttcctaccgcatcgtctcctctcaagaccgagtacaacctcggaaacgagtcggctggcctgacgtcgacgatgcgctcctacagctctacttcgatcaaaagcgccgcgggatcgcagaatgccgacagcccaagctccggcttcggtgccggcggcgcggcaaatcagagcatgggtgacgtctcgatcgatgatgccaatgtcgctagccagtcggaagccgagctggcggccgagaaacgccaaagcagcaaatttgtctacaagctcttccgcatggtcagcgaccccgactaccagcatctcatcagctggaaccgcaacggcaccagcgtcatggtgtgcaactttgacgagttcgccaaggaggtgctgggcaagcactttaagcacagcaacttttccagctttatccgacagctgaacatgtacggcttctacaaggtgaacaagacgcctcgcggccatcgacagtcggtggacgcgcagatctgggagttctcgcatcccaagttcctgcgcggccgttcggatttgctcgatgacatccgtaggaaggccctggactctgaacacgcgcgggtcgaagctcgcgatctgcagtacagcgtcagtgtggggcagatgcagctgcgtcagcaggtcgacgagatgcaattccggctcgaggagctcacagagcagaacatggcgctgcgaacctttacaacccaactccgagacgtgcttggcctggtgctcgagcacgtcaaaaagacgagcggcggcaacattggtttcgacgtgcgcatccccacgctggacctgccctcgcccatgccgccgcaaggcctgtggacgccgcagggtcacgatggcccgcctatctttgtcaccgagcccgagttcggcgctggtgtcggaccgggtgggctgaggatgggcccgacgcctggcatggtgcctgggccgggccacgctccgccaccgatgcatgcaccccaacaccactttggcggtgcgccggatgggttcgccatgacgggcacgcccatctcgcgtcgcgtgtcggcgagctcggcgcatagcgagagcatgcttgccatgaacggctcgcccatgcacggatcgatgcagggtgagatgggcatgctgcctgctggtctgccgcagcgctcggcttctttcggcgagggacagatgcctgcaccccacttcaatatcggccgcggcggcgtcaaccgaccgggcctggcggggctcgcaattgacacttcggctgcatctggcatgtttggcggcatgcatccgagcgtgagcccgacatcagcagggctatcggcaagcaatgcagggctgggcgtgatgagcatgccgccgtcgccgctgacgccacagcatcaagcgatgatggcagcgatcaacactccgctgcctccgtcgccggcgccggggtcattggcgggtggccagttcaagccgttcgatggctcgccgttcgtgaccaataacggattcccctcgtacggccatggtctttctcttgccgaccagagcttctttgggccggaggccgatggtcccaatgccaaggcgatgcgcacgcccatgaagcacacggcgtccaattctgggcctagcgcgcagggcacgccagtgctcatgcagtcaacgtcgcccgggcttgccaagcgcaagtcgccaatctgaacgcgatgtcttctttgatacccgggtggctggcgcacgtcgtcgccatcccagtgattctccccttcgtttgtctccacaatcctttcccctcaaggacatcccctgaacccaacttctcttcttccctctccacgattgtgcctacgctggcatttcccaccatcttggccgactgtggctttcccctcagcactgctggcacagtgtgcagcggggctagtgtcgggagagtctgaccacgctcgttttttcgatttgatcccccctctgtctctccgccttgcggcctgtacaagttcggactctcgtcgtcgtttaatgcccgaagtcaccttctgtacctttttt

SEQ ID NO: 1649 - DNA, 803 bp, Oryza sativa
  Predicted polypeptide sequence is orthologous to G860, G1760
atggggagggggaagattgtgatccgccggatcgacaactcgacgagccggcaggtgacgttctcgaagcggaggaacgggatcttcaagaaggccaaggagctggccatcctctgcgacgccgaggtcggcctcatgatcttctccagcaccggccgcctctacgagtactccagcaccagcatgaagtcagttatagatcggtatggcaagtccaaggatgagcagcaagccgtcgcaaatcccaactcggagcttaagttttggcaaagggaggcagcaagcttgagacaacaactgcacaacttgcaagaaaatcatcggcagttgatgggcgaagatctatctgggctgaatgttaaggaattgcaatctctagagaatcagctggaaataagtctacgtagtgtccgtacaaagaaggaccacgtcttgattgatgaaattcatgaactgaatcggaagggaagtctagttcaccaagaaaacatggaattatacaagaagatcagtttaattcgtcaagaaaatgctgagttatataagaagatctacgagactgaaggaccaagtgaagtcaatcgggattcaccaactccttacaattttgcagtaattgaaaaaacaaatgttcctgtgcaacttggactcagcacactaccacaacatagtgacgccgaacaatcaactgctcctaagctagggttacagttgaatccatgaccagaaaaacattgttttgctacacccttgtatgctgaagggatactatttgctgtcaagagttgatactcagatcaaga

SEQ ID NO: 1650 - DNA, 2110 bp, Oryza sativa
  Predicted polypeptide sequence is orthologous to G860
gagctgccggcggaggtgcgaagccatcgaggtgagtggaagcttctggaaccttaccctcctttttcctttctatctcgctgcggttggcttaatttgcctctgcgggcgcgtcgcggttttgcttctagaaccttctagttcttgtggtggtatgaagtttctccgtgagtgtcaaatgtggatccgccattagagatggatttgagttcgctgtgctttgtgacgataggcttgtttcggtggagatttcatggataggtcgacgacgagttcatagaaggaggggctttatatgcattagatgaacggcttccaacagtttccgtagcaagaagcttctatggtttaatctaattctaggagggcggtaggggtgatgtttgtgtgccgaagtcttgctaacctggatcaatggaatgcgcttgttgtgcaatgcagttggaaactgtggagtagcccgtgtgacagtgtgagttaattacttggttgcttatttgaggattaggatacacacaggaggtcatgagatgttgtttggttaaactgaacatttaatttgtagtctattaggctgaaaggaaaataaagaaccattcagcctagttgcaagactagtttttctttgtaacgttggtgaattgtactgtgtttaagccaaactaagttgttaaaggtttagactgacgtccccttatgtgatgtttatctttgttgttgttgtcatattttgaaaattgtgcattcaccatctctaaaatagctcatagggcattaacgagtgatttcaatcgaggtgccttgtttacaactattgctttgcatattctgatcattgcaatgttttcaaccagttattgcatatggtggcaccaagcatgaggttacaactgcattacttgcaagggaatcacaagtcacaagaaacacatgttattacaatggatgtaagatttttttattcccagtttattttcccatgattttgcgacagtgaatagttttattttttttaaataaaatgaacttacatgatcattgatgttgtctttaacaacaactcaccaatgaacaaccatacattgtcatatgtgaactctggttaaagagtatctttttgtaacttaagataaatgggcatctgtcctgcaaatggagatggaaagtttgcatagaagtaacagtgatatgctattctgcttataatcacctttccagatatatgttgtgctgtactagcagtctaatacatactatatgatgtctgttgttaatattcagaaaatgaccctgttttttgccaccataagtttccaacttttcaggctatcatatttcagtatgctgtgatagataagtgaacctctttgtgtgtaaatgtttcatggtctgatggataaacaagataattgtgtacagaacccagcttgcagcatatctgcattaagcagatgtagttttgctgcaagcaaagcatggcttattgctataccattgcctttgtgagtggaatggtatatcttctaaattaaggaaaagatgactttctccttttctggagctatgttggggttggctctgttcaagatcagagggagtatattcctcctctcaagagctcaaaacttttcttgtgaataagtttccatgttaaggactgcatagagccccttttccattgataggtacacccaaggcagcgggcagtctcattatataaaattatgttggtatggtcaaagcgcaccatcagcaggttgaaccttcctacttagttcttcaattccttgtgtcaaaggtggtcctatggcagaagattgattgcttcaatctaaatggaattaaaacaaagttgcagatattaatgaagcacatgctaaggtgaccttcatctgagatgtgactattgacatcacatacgctcattttgagttggttctctaaattccagagatctcttgcatttaggccagcaagctcctgtccatatttatcaataaacacaggacggagttgatttaacattctgagaaaaattgtcacaatttgatttcttatacatgtattctttctcactaacttactaatattatggaagagaagctgcttc

SEQ ID NO: 1651 - DNA, 1845 bp, Oryza sativa
  Predicted polypeptide sequence is orthologous to G860, G1760
atcgctcgcggtcgcagtcgcagtcgcccacacccttgccgcaccatggctggaacccgcggcggattcgagaatcattagatgattacttgtggctttcttgcaagttgtgcagttgctgcctcaagcttgctgcctccctctgccaaatctatcagcaaaaaaagaaaatcatgtcagtttccttgaactatatacatatgattaatctagaaacgcagtatgttgccaaaaatcacacacaactcaatcacatatgcatttgagatgaggtaaaatgctatctgattcacatagttccaatatctcaagatgtgggatatgcgtagcacaagtgcatcagagtgttatagttgttcagtcttcagtacttattattctagattaatttggaccaacttgtcaattcagctgacacttgtttttgtctagtgctccagtagcttggttgtttcatcatcattagacttttaaacctttggtcctaaactcctagctgaaaaatttgcacactgaacttccctgtgttctaaggaaaaaaaaaatctagacataaccttgctgatctgtattatggaccggccattggagtgcataatgcataactgctgatcactttgttggcacaaaacttacgcatagacataggaggtacttatgtataattgtatctttaatcaggactttgttttcaaccattttgttgatataacagttatactgtagtaatgatgagtacagtctccaatgtaaactcagggcaaatcagatttatccctttttggtgcttggtatctttttgtatttttcatgagcgatggcatttttgaacccaaaatagagggaaagagaaggatctctgtgggggcatgctatgtactacagttctttgagaccatgtaggtgtggatgcttgttttgaccttttccttaacatatagaaagaataaacattaaataaatgatgacatggaaatgaaattcataaaggagtacataagctagtactcctgaaaatatcacttcatattcccccatgattcagtaacatgaatatcataccatcagcagcagtgaaatttttatgcgtagacggtttgtttcttaaggtatatattttttatgtttacaattgtctgtcgagtttactggtcaattgagcaacaacggtacttttaactgttaatatcacttggtttgctatgtatccttgttgttctggctttgttgctttacagccattctgcttacgctattggcatctgttatttagaaaaccattttctaacagtttttagatttcctttcgagtctccaactgtttttaacctccaagttgccacataatgcataaatataccgagtaagtttgcccccctctgaaatatggatgttagatactcagacaggttcagtatgtgttgggtgttgttttctgagtttgtggttgtcataagatgcagcgaaattactgcgctgtatcttggaccaatgcaatcagcgaagtccttatcgtgccaaaaggatgtgcatggattttccatcatttgcaaacttgaggatggcctgccctgatgccctcagatgctgatgaagtgtgtggttcatgaaaacgtgagaagctaagtagtggagtaacgggagtgagtaccagtgtggccactatgaagaaagttaattactgagaaattaagacttgagcatgttattttcaagcaacttgtacagcattatattgcactaccatcaaatgcttctcctgcctatacaatactctgcaagctcttgtattgtacactgttttatcttgtttaaagtatgcttgtttttgcttatgttgagatt

SEQ ID NO: 1652 - DNA, 1104 bp, Oryza sativa
  Predicted polypeptide sequence is orthologous to G860, G1760
gtgctatacgcatcttccctagcttgctaagctagctagtcttctccttcctttctcctcttcctcctcctcctcttcttctcaatcttgctcagcaaatcttgtcggggagagagagagagagatcagcaaggagaagagggaattaagctagatcgaggtagtcgtcgatcgatcgattgaagatggggagagggaagattgccatcaagaggatcgacaacacgatgaaccggcaggtgaccttctcgaagcggcgcggcgggctgatgaagaaggcccgggagctggccatcctctgcgacgccgacgtcggcctcattgtcttctcctgcaccggccgcctctacgacttctccagctcaagcatgaaatcaataatagagcggtaccaggaggcaggagaggagcattgtcggttgctgaacccaatgtcagaggctaagttttggcagcgggaggttacaactttgaggcagcaagtgcaaaacttacaccacaacaacaggcaacttttgggagaggaaatctccaacttcacagttagagatctgcagcttctccagaaccaagttgagatgagcctacattccataagaaataaaaaggatcaacttttggcagaggagattctaaaactcaatgaaaaggggtctcttgttcaaaaggagaacagtgaacttcgcaagaagttcaacattgctcatcaacgcaacatagaattacacaagaagcttaactctggagaaagcacgtcaagtgagcaagttaccagaagctcaaaggatcccggagaatcgagtacaccccgtgattcacgtgtgtgtattgaccttgaattgagtcaaaaagaagttgaagatgaataacacatgatcaagtgttaaaaacaacatgatggccagtaacttttgcagcatcacgcctactacaagcgcaagaaaagctagctactactggaacaagggatcttaatcatgttttgaaacttaattagtaatattttaaaaaatcgtactatactaatcatgatgtgtagcgtattgcaccactgaatttattactgtaattaacatggtgagtgttaaaatattttgtgatatc

SEQ ID NO: 1653 - DNA, 3149 bp, Oryza sativa
  Predicted polypeptide sequence is orthologous to G860, G1760
gttgtgtgcctacaaggctagagtaaagaccttatcgctcttgctaaacatacatacgtgcaagcacagtgcctagctaatccatcagcagaatagaagggtggagggggtgggaagaggccaggcccctccgccccctggcgtcgctcttgctgatacttttcttgttctggtacatctgcacagataaattataatgccttttcatctcttctgtctgcttatggctttttaagataaaacagagcattgatcttgcatgctctacacttcgcgcactgtttgtttttgccaataagtttgcacacatgtagctgtcatttgggtaaacaaacttgcagatagtgccaaatagtcataagaaaataattttcatgggctcttcagataatacatttttattcgaatagattttacagtatcagatattaatcatccaagcatgcaaactgtgtcttgttatgtgttagcttctttatgaccaatacattttaagagctctgaactgtagcccttaagaatagtgaaaatataggcaacacttccacaccataaattgtcatggatgcaattggagcctgcaataatttcattaagttataattgatgtttcactaaagaactgagaatggatagatggatcatgtgcagaaaatctgagttaccctagtttaggaggtgtggtttgctcagcatcattttgttggcttgggggattgagttcaagacgagcaggagtgttggcttcctcgataaccgcaaagttgtatggagttgttgaatctcgattcgcttcattttctgcccctgtctcatagagctgaggagagagattagctgtcatcatataatgaagcgtatatcctgtgaaatcatctatctgcatttatcaagtaccttcttgtacagctcagcattttcttggcgaatcaggttgacctttctgtacagttccatgttttcttggtggatgagacttccctgcaaataagccagcaatagagttagcttactagctgattcaaagatttagcaattgtacatgatgttgtagaacctttcgattcagttcgtggatttcatcaatcatgagctggtcctgaaaacaacaatattgatcttaagttaatccattatataatcaatcaggtgcccaacaaaaaaatatggttagtaggttgaccttttttgtccggatgcagcgtatgctcatttctagctgattttctagagtttgcagttccttgacacccaatccagaaagatcttgccccatcaactgcctgccatcaaccaatggatgttatagtgttgttctgatgatatacagagtgaatattgacacttaattttagctgatcaacagacagctgttaattgataataaaaataatttgtacctttctagtttaggtattgtaaattaggcctgaaggacaaaatggagtgtttgaacaataatttaccaggcagaaagcacaggtgaagaaaatgtgatattcactctcctttgtaaatttggtctgtccgcctttgatgggtgctcagttctgtttttcttttagagataaccggaaatgcataaaaatcgaatggctgaaggtatatatttcttacttttaaatgatatagaaaattcacgtgccttcttcatttcttttgtttgtgaaggttaaacaatgcattatctataggaaatttggaatcagcatatatcactttcatactctgttttttcttcttttttctaagtatcatatacccaagcactaggtgcttgtttttatgatctggtactagtttatatttactatacaatcaggtgctggaagtattattgtcgctagcagttgctggattcatgagcaagtccccacaaaaaaaaaagttcgtcatcaagggttcatgatgcatgtatttcatagtagtagatatatgatggtttatgtttttctatcttgaggaattttctgatggaacattgaaaaacttgcagggttttatggccataccgatgattttcttgcaagctgtgcagttgttgtctcaagcttgctgcctccctttgccagaactattggatatgaaaacagagtcaagaaatgcagaatccaggtttgccaaaagcagcaatataaatatgttgtgtatacccatagaaacatgctgggttatcaactcactagtttttttttaaaaaaaaggaaactcaattacattagacaagaagactatttgaactgaggaagttattgtgtatggtaaaagaagtaacaagaggcaaacaaagaaatttgttgtaaacaaataagggaagtagtattatctttccagtttgaagacagtttttttttccagataagacgatgagctaccaactctattgaatttggtactccattatcagtcctcgttttgcggggtgttaccccctattgtaaaaagcttgtttgtctaagcaaaatgcttccaagtcccaccaaagctagattaactacaaagtatctgcagagtgcacaagtcaggtaaaaaacttgtttgtctaagcaaaatgcttccaagtcccaccaagctagattaactacaaagtatctgcagagtgcacaagtcagataaaaaacttgtttgtctaaacaaaatgctcccaagtcccaccaagctagattaactacaaagtatctgcagagtgcacaagtcaggtaagtgatgattatatcatcctggtacaagctttattgcggtgaaagataagcagttagtctgaaatctgtacagatctgtcagctgttaccgaagcaaaaggttcaatgtgaacttaaagatgcagtactgatccttttaagaggatttaacacagatttaacaggtacgtgccccttgtgattctttgttagttttcttgttataatgatgtttttatcctctgaattcaagcagggtgttctgtatgcgagctgtgatgggatggttctcttcagaagcattttattttaactaaattcagaagcatttcgatggcatgaggactgttcgattgacaatttgtatgtacatttccaccgtttacgcagcttaggaattggaccataattagttgtgtacctgcaagttttgtatacgaattatcctgaagggtgttcggtggattg

SEQ ID NO: 1654 - DNA, 3308 bp, Oryza sativa
  Predicted polypeptide sequence is orthologous to G860, G1760
acaatattttgtattaatttatgttttacaggcatacaacagatccaactttcaatgacatgtttattgtttagtttagctacaataattgttgggtagttgtagagcagcacatggtacttatgccacaagcccgcaaataaaataattcgcatttgctcatcctaattcatgctagcatctctattgcagaacaattttgatactattttttttttaaaattagccttgaaaatgccacttcccctaaggaatgacaaatgcatttttttttacaaatgcaaaaacttgcaggtagacacatatttggcaggtgaattcgtgtcatatggacatatctttcattggaagatatgtccatatgttggagctatttcaccagttctttcattggaataatgttagcatttaatcagtgatataggagatgattcaccttcaacaagctctcatttatcatcatgacgagtcagaagaatccgattgtcaagttacgccttctaccatatactccccaccaaaaacagctaccactggtaaataaattgctttctgttctaattggtgcctgaatttctgtatgctagatctgattgtttgttgctttcctggtattgtgtagtttttagttatgatgtacataatcctaagttaatccagaaattaatttttgagttctttctggagtttattcagtagtttataggttgtgaccaccagtgtccttttatggctgaatacaactcaaagaatcttcatgttggagttggattcactttggcagttcatacagtggatgctgatagatgcgctcgattattcctgtcgatagcatcctagtattgtgtctttatatagctatatctagcattttcatgtaaaagctatctgttctgtggatgggtgctcttattggttgcagcaatcaggataatcagctaaaataatgatatattgcagccttgtcagcctttattatatactgggttccctaaattgtcatctagtcattagtgccaaagtgcatgtagtcttctctgatcgttatttataactttatatgccaatggatgttacagacaacgtagtgtatgtcaatctatctggcgttttatttatcagaatactagaagagaatttgcaccagtggttcaagtaaatccctgaacattgaaactagatagtttgggctttttggcccctaatcttgtttgattgatacaaacaagtcaacgggtcacaagtgcttttgactgacagactacatccgtttctctcctctcatcttcactcttccccatcgaattctcctctcatcttcttcactcttccccatctttgaccaaattagccgcatcctatgcctggtggaatattctgacacaacatagcagtgtggcttgtttcagcagaaaattatttgacaggcgttgattgcaaagctgtcacagctgcacccatctgatcagatataggtaaactgagatgtggttctcagccagtgggaatgatgtacaaccacgttgtcattcaggggaactaaaaaccatctactcctgtttttagcaactcacatacagtacagatacctagaatcaacagatatccctactttaaccactttaaacaagtctgaggacatatattcctagtatcaatgttcatacacttgaaccagtaatgcaaggttcaggacatacaatgcaatttactcttgttttcttttatagttcatttgtcctcattttggtccctgatttaagttggacattcttatctcactagacggttgggtaagtaatgttaggggtcaaaatatagtggagttatgctatccaatcttgaaagcaatgtagagctttgatctgttactatccagtactacagtgaacagctagacttggagctagtgatttactcccttattggatacggatattgaagtagatatgggctggatgcctatactatgtaaattcacccattgacggttcattggctcagtcagatagagaacatgcctgcttaactgaattagtgaaagcaagtcaaataactaagtggcaactcttatcagcaaaactaatttgtgattatgatctgtggcttgtttatttcaaccatttcttttatatgaattgcgtgtaactcagaatttcatgtgaatactgagtaactagcacatctattttgatttgggcccaatttttcaactggcaagaaagaattggagtacaagatcaaagggtgggagtaactcttagtcttaggcatcgggattgggcaggatttgttgtgcacctaattttctttcatttctcgtacttgaacttgtttgtgcatataagtatgtgatcatccaactatttctaagaggaaattagccacaagcaacaaataggaagtttttatattcatacctttgcctcagaacttgcgttcatggtttgatggggatcttctttcgtctcattgtatctctcaattatggatttcatgctggttgaaaaaaaaaatcaagatcccattagaacacatgtcaacacatgccacagtagtgttgaatgctatcatatagctcctgcaagcttattttgtagtacatgggcatcagtatgtaagatgacaaatgcaaacttttaatgaaggcctagttctttgacaagtaatccacgtggatagataactgtaaggtcaacacaaagaattaagtgtggagtgttttgagttaattggttcttactgcttaatttcctgttatcttaaaacttcctgttatcttaaaactagacactgttctcctaatttgtcatccttttcctatttagtttgttgttttctacgaatcttgagctatttgtatggagaaaaagcagtgacaatggtaaaagatggttttgaaggcactacaagacatgcctcaagttataaccgtgctgttacgaggatccaagcatccaaaacacttggaagattaagcttcaggcgttgtcgacataatgcataattagttgcatacttcagtggatgattgaacgggatgtttggatatgcaaatatttctatgcatccggactgaatactttctgaacacaaagcaagccaacctgccatggccatgacacgatggttctatccatattttcctatttgtcatgtacggctgggctgggcctagcaccaaaactattcgttgttgtttattattattaggtaattaggttattcgtagatcatggttgtttattttattatgaacattttgataacattttttttaaaaaattaaagcctttatttttccgatc

SEQ ID NO: 1655 - DNA, 437 bp, Oryza sativa
  Predicted polypeptide sequence is orthologous to G860, G1760
aaacaaaagacccctccatttccattcctcctcttcctctcttctccccccccctccaataattcaaccccctcttctgggaaacctgggagctttctccttcaagagctccctgctagctagatctcctcctctctttctctctctctctctctctctttctgtccatttctatctgtgctctcgcctgagcggcgacaatccagctgagatcgatcgatcgatcgatggggaggggcaagatagtgatccggcggatcgacaactcgactagccggcaggtgacgttctcgaagcggcgcaacgggatcttcaagaaggccaaggagctggccatcctgtgcgacgccgaggtcggcctcgtcatcttctccagcaccggccgcctctacgagtatgccagcaccaccatgaagtcagtgattgatcgatatggg

SEQ ID NO: 1656 - DNA, 695 bp, Oryza sativa
  Predicted polypeptide sequence is orthologous to G860, G1760
ggaaaaggaggaggagatcgaaggggaagatggggagagggaagatagagataaagaggatcgacaacgcgacgagccgacaggtgacattctcgaagcggcggagcgggctgttcaagaaggcgagggagctctccatcctctgcgatgccgaggtcggcctcctcgtcttctccagcaccagccgtctctatgactttgccagctccagcatgaaatccataattgagagatacaatgagacgaaagaagatccccatcaaaccatgaacgcaagttctgaggcaaagctttggcaacaggaggcagcaagcttgaggcagcaactgcataacttgcaagaatatcatcgacagttgttgggacaacagctttctggtctggatgtagaagacttgcaaaatttggaaagtaagctggagatgagcttaaaaaatatccgtctgaggaaggacaatgtcatgatggatcaaattcaagaattaagcaggaaggttgttaccacttagcacattcactcaacattacttatgtacactagtctacttggtccaaatcttattggagtgagataatttgcttgacactgcacaaacttctcactgaattgtagggaagcctcatacatcaggaaaacatggaactacacaagaaagtcagccttgtccatcaagaaaacatcaatttacagaaaa

SEQ ID NO: 1657 - DNA, 708 bp, Oryza sativa
  Predicted polypeptide sequence is orthologous to G860, G1760
atggggaggggcaagatagtgatccggcggatcgacaactcgacgagccggcaggtgacgttctcgaagcggcgcaacgggatcttcaagaaggccaaggagctggccatcctgtgcgacgccgaggtcggcctcgtcatcttctccagcaccggccgcctctacgagtatgccagcaccagcatgaagtcagtgattgatcgatatgggcgagctaaggaggagcagcagcacgtcgcaaaccccaactcggagctgaagttctggcaaagggaggcagcaagcttgagacaacaactgcacagcttgcaagaaaatcatcggcagttgatggggcaagatctttctggattgggtgtcaaggaactgcaaactctagaaaatcagctagaaatgagcatacgctgcatccggacaaaaaaggaccagctcatgattgatgaaatccacgaactgaatcgaaagggaagtctcatccaccaagaaaacatggaactgtacagaaaggtcaacctgattcgccaagaaaatgctgagctgtacaagaagctctatgagacaggggcagaaaatgaagcgaatcgagattcaacaactccatacaactttgcggttatcgaggaagccaacactcctgctcgtcttgaactcaatcccccaagccaacaaaatgatgctgagcaaaccacacctcctaaactagggtaa

SEQ ID NO: 1658 - DNA, 992 bp, Oryza sativa
  misc_feature (876)..(876): n is a, c, g, or t
  Predicted polypeptide sequence is orthologous to G860, G1760
cagcggagggacggtcggagattccgggtgaccacgcgtcgctctctgtctctctctctcggggtattgcaagatagtagctaattaaccagcctttggccttcagtttccccatcggttcatcagagcacgccttcaatttcctaatcaatctcccatataattccccttagcttgtatgcctatcattagtacttcttgtgttgtgttgtcttcttgccttctttgagctagagctagctaggtttgtgacctgctgtacgtgcgtgtgttaattagatagatgtcttagatctgggagagagcgaggagatggggagggggaagatagtgataaggaggatagacaactcgacgagcaggcaggtgacgttctcgaagcgtcggaacgggcttctgaagaaggcgaaggagctatccatcctctgcgatgcggaggtcggccttgtcgtcttctccagcaccggcaggctctatgagttctccagcaccaacatgaaaactgtgatagaccggtataccaacgcaaaggaggagctacttggcgggaatgcacttcagaaatcaagatttggcagagggatgccgccagcttgaggcagcaactgcacacttgcaagaaagccaaaggcactgatgggtgaggagcttctggcctagtgttagagacttacaggcttccggatcgggtgaaatcagctacgtatatccaatggaacggccccctttgcacaggaacccgggctcctgtgaggggacctattccaggaaaatgaatcttaagctagtcgttgacaaaggggggttacgctggcggaacaagggcggttgtagatgacccaggtgggatcaggctgtctctcttagacacagagngaggatatcactaagacaccgcgccattcgtgcgcagtgatagtacctcagctcaggcgactaggcgtgctggcgtctaatcagagaggtagcagcagatgactggtgagtagagg

SEQ ID NO: 1659 - DNA, 1558 bp, Oryza sativa
  Predicted polypeptide sequence is orthologous to G904
aagatgacaatttgacacgaaagccttcctgtgcctttttatggtaattacgtttatacccctgcgatccaccggtacagcaccatgaacgccgtctcctcctcctccgtccccggcggcgacatcctcaccgcctccgcgtcccacagccatggctcctcctggctgtggctatggtggctctggtagctctggctccaccgggagctccaccgcccggagaaggacgatagggatgacgcggaggtggccagccgttccacgtactcccgcagccagccgcgcgtcgcgcccgccgcttcggccaccgcctcgccgggaggcggtggagactgctcggctgctggcttgtcttccttgactgcggcggcgctcctggttgtcatgggcgcggcgcgggagacgacggcctcgacctcctcgtcgatgtggtagtcgaacgtgccgagcgagtaggtggggcgggcgttgccgccggtggccgtcgacgcgctgcggttgctgacgctgcccatctcgacgcggaagctcctggaacggtccctgctcctcggctccggcggcggcggctgctcggcggcgaggatggcggagatcgaggggtgcgggagcgtgacggtggcgcggcagagcgggcaggacggggtggtgcggagccacgcgtcgacgcaggcggcgtggaacgcgtggcggcacgccgggagcagccgcagctcggcgtccagcgtgaacggcgacaggcagacggcgcagtccggtgagctcttggggagcgccgccagcgacgacgccatcgtgaacagcggcagcgactcgatcagccgctgcttctcgtcgcccaccacctccttcttcccctcacaaaccccattacgccgcaccggagaagcgtccgccgcctcgacgttgtgcacctcacggcgcgtccgtgggagcggcggcggcggcggcggcggcggcgacgacctggacagaagtctgagaagtaggtggatcgagaccgacgctagtagaacgaaggcaagaagagcagcgatgatgaggagagacgggaggaaggacgaggcggcgtcggaggatccggtgacgggatcggcagacggcggcgacggagacgagagagtggacgccatggcgaggcttagccttagcttgagaatggtttaacttaacccgcccgggaatgagacctctcgcgccttttatccccgggtttctttggagtgcgcggtggtggtggtgcggatgcagaggccggaagtaaatagtggcgggtttgcactctcctgatggagagatcccagaaatggtggaggtcagccttggaaaccaatccacgtctcggtttctacttttctacctctgcctgccctttgcaacctgaaattctgctactactgctacgtggaaaatttcgcatagcagttgagcagacagcagctcaactgtttgcaattcgatagtttgttgcacaatagtacaatgttgtacactggttagtgaacttaagtacgtgcaaagaatcaaatccgcagtaaaaatactgcattacagcagc

SEQ ID NO: 1660 - DNA, 1562 bp, Oryza sativa
  Predicted polypeptide sequence is orthologous to G904
agctcaccttcctcctcaccgccaagatcgcaagaacgcaacaagagaggaggagattgatgtcgtcttcggctgtgattccgccgccgtcgccggagaggagggtgccgatggtggctgtgccggtggtggccgacgatggaggcggagggcatggggcgaagggggaggagagtgtgagcgggagcgtcgcgggcatttcgccgagcatcctcatcatcgccgtcatcgtcgtggtgatgctcctcgcctccgtctccatccactacttcatccgccacctgtgccgccgctcgtcggcgtcggcggccgcgtcgtcctccgcgccggtgctccccgtcgtggtgcgccccgcgtcgtcggcggccgtgggggagcaggtggtggggaaggcgtcggcggagcgcgcggcggagatggagcggctcatctcgcggctgccgctgttcacgctggcgtcgtcgctggcggcgctccccaagtcgtcgcgcgactgcgccgtgtgccagagcgcgttccgcgacgacgacgagctccgcctcctcccggcgtgccgccacgcgttccactcccgctgcgtcgacccgtggctccgcgccaacccctcctgcccgctctgccgcgcctccatcgcgctcccgcacccgcccctcccggacctcctccgcgtcgagctcggcagcgtcagcagccgccgctccaaccccaactccgccgccgccgtcgccagcgcgccgcccgagggcgccgccgtccgcgcctacccgctccccaccctccccaactccgagtacctcgtcgaggaggagctcgaggtcgtcatcaagcaacccgccgccgccgctgcgccaagaaccggcgagccaagccagcatccgctgccggcggcgcaggcggagcgtgggcagccgtcgtcggtgaccccgacggcgtcgttcagctcggcgaggtcgcaggagcggtggagcaacaggtggagcagcagatggagcagccggtggagcagcgggcggtggagcagccggtacgacgccggcacggtgacggcggccgccacggcggagtggtggtgggacatggacggcggcgcggcgcccgccgcgcggcggcgcgaggtggaggagcagggcaacgcgttccacggcttcatgcgctggctcacaggggcatactagtaatttaccactcgatcaatgcccagttcactcgctcgtcaacctcgccggcgccggcgatcgccggagaattgaattcaactgaatttgaaatgaattatgaatttctgatgcggctcggctctgcttttgggcattcgtgattaggagtaattaatagtgtctccttttctcttttttttggctgtgaattcttgtattatttttttcttgagtgcgtggatttcgagggtggaggatgcatatggtgggaaggtttttgatgccgtacggatttgaaaactgcttcttcctccgaattggagaatgtcggcgggaagattgaggaattcggggactttgaggcaaatgaactgaactgcccaataaaaaaacagaattatttcc

SEQ ID NO: 1661 - DNA, 1296 bp, Oryza sativa
  Predicted polypeptide sequence is orthologous to G904
atatctgtttagagcttttctggtgaggactaatacagtgtggtttgttcactctgttgtttgtttgaaggcaagaaaaagaagccgccatggcagtggggagaaggggatgaaggaatacttagacacgtggcatgatctcaggagccgaggggcctcaagtcggtacagctattgaaccaagagagcaagaaccaccggccgtgaagttcgcagcggggaaatggaattcgaggaggattcggcctccttccatggcggcgagggcgtcaccggcgtactgcgctggcacacgacgacgctatcggattcgcccatcggcgattaagaacccctctcactgggccacgacgtcaccagcctcttctccttgtgccgcgacttccgccggtgcagggttgtgattccgaaccccatctacggcggtgacgccggccttctacatgtgcacaacaacaagaagacgctggccatccgcgagcaggtgtcagtgtcgcctggccgcgaacccggcgtcaagaacaggacatccgtgtgcaagcggcgtcctcggacgtttcatctcccttcgtctgcttctcagaagcagtgggctccatatacatcacattgtatcagattacaaggataggaatgaagaggaatatgagggaatgaacatatcactcttggaggaggcctcagtgcagaaggctgatgcaaaacctgtgtactgcacaaagtttctatctgactgggtttgcagcttaagaaattttaagtggaaagtagtggcagggattcaccaagcattagtaccgaatgaatacagttgggaagaagtaatgggctcaccaattattcaatacgcaggaggctgctcgctctcggcgtgcagtgtatgtatcgaccggcttgcgtttgagagaatccatgggagaggatcctttgcatggagggtagaatcaccccctgcaaaactcagaaaagaatgccttaagaggaatgcctggtcacaggaaagtggtgggaaatctgacagggtgctggatgtaatcattgacaacggagggctaccaacgactgacggaattatcatgttaccttggttgctttgcagcgtcaaatggtagatgtccaaaagcatttcaggggtggctcataatccggctgcaatagatttgatgctgcatgttttcatttaacactgtaaaatgatgaatccttctttgtgatgttgatcagggataagatgcccatactatatatgtttctttgtcatttgagatcaagcattatgttccatttacgtgaact

SEQ ID NO: 1662 - DNA, 1509 bp, Oryza sativa
  Predicted polypeptide sequence is orthologous to G904
atgttattaatcagagaagaacgagacggatacaactcatgtcctacacctccaaaaaccacatctcgacacagagaaatgacactgagaacaatcaaggtcagaaaaagcaaccaaagtcagagacacaaatcacagatgaacaaggaaagtagagagaaaaaactggacatgttcactcaccggaaagtaatctccgacctggtctctagtgatgtgtgtgcttgtgtgtgctctacttctactcgtctcacggctaatcacctggtatttgcgctccgatttcgctcgctctccgtgccaacgccgcgcaccccaaaacccataaataaaggcgcgagaccacacgcagggccgagccttaaacacaccgtctccttcccccccatggcctccctgccgccgcccgcgccgccggccatcggcggcgacccgctcgccgccaccattccgccctcattgccgtcgccggcgccgtcgtcgtcttcgctcaacctctccccgtcgcttctcatcatcaccgcgctcctcgccttcgtcttcttcgcctccgtgtcgatccacttcctcctccgctgcctcgcgcggccgtcgcacccggctccgagcccgctgcccagggcgtcggcggcggcccaacgcgcgacgacggcgtccgccgtcgaggctggggaggctaccgccgcgtcggcggtggggaggagccatgagggggaggcggcggcggggggtggggaggaggtcgacgacgagaaggagcggctgatcgcgtcgctgccgctgttcaccatggcgtcggcgctggcggcgctgcccaagagctcccccgactgcgccgtctgcctctcgccgttcgcgcccgaggccgagctgcggctgctcccggcgtgccgccacgcgttccacgcctcctgcgtcgacgcctggctccgcaccaccccgtcctgcccgctctgccgcgccaccgtctcgctcccgcacccgccactccccaccgccgccgccgccgccgcctccaacgcggcgcaacaggatcccctcgactcgcggagcagcaacaactcgaggagcttccgcgtcgagatcggcagcatcagcaaccgccgctcctccgccgcggccgacgaccggcgcacctactcgctcggctccttcgactaccgcgtggacgaggaggtggaggccgtcgtgtcccgcatcgcgcgccccgcggcggccaagtcaacgaccggttccgtgacgccggcccccggcgaggcgctggcggaggcggcggggtcgcggggatggctgcgcgagtacgtggaccgcctcgcctcctccgcctcgtccctctccggccggtggagcgggcggtggagcgcgcggtggagccagagccaccacagcaaccggcaggaggactcgtggcggtgggacccggaggcggcggtgatgtcggcgccgcgcggggtggacgacgacgagccgggcttcgtcacgctgtaccgttggatcgtaggcgtatag

SEQ ID NO: 1663 - DNA, 955 bp, Oryza sativa
  Predicted polypeptide sequence is orthologous to G913, G1753, G2514
atgatcacttgcatttcatcttttcatgaacgtttttttgtgcatgttgtttactgcatttttcagtttcagctgtgtagtagcacactctgtttgcttcatcgtttgtgttcgagatggatcgagacgagagcttgggcacgcagccattgaccgggaggcgggtgcgcgcggacacaaggcacccggtgtaccgcggcatccggctccgcagcggcaagtgggtctcggagatccgcgagccgggcaagtccagcaggatctggctcggcacgtacccgacgcccgagatggccgccgcggcgtacgacgccgcggcattggcgctgcgcggcgccgacgccgcgctcaacttccccggcacggccacgtcgcgcccggcgccagcctccggctcccccgacgacatccgcgcagcggccgcggccgccgccgcgatgatcggctccggtcaccgtggcaaccagcgcgccgccgacgcgagcacgtctcgcgcggcgacggcggcgccggaggccgccgtcgccgctggggcgggcgatcagaagcgcgtcgtggacgaggacgacgtcttcgagatgccgcggctgctggtgagcatggccgagggcttgatgatgagcccgccgaggctgagcccctcgacggacggcgtcggcggcgtgtcgccggaggacgacgaggacgaggacggcatgagcctgtggaaccattcctgaaatgggcttacgggtgcatagcatttgcaggaggacaccatgtattttccatgtgttcgtatgaattctgtgcctacgtacagtacgtactcggcacgtatgcgagataggaacagagcagagcaggatactgaattttatcgtagttgtcctgttacgtgtatacggtatatatggtcactccactgatgtataagccatccgtagacgaattatggctgaaaacgatgcccctg

SEQ ID NO: 1664 - DNA, 582 bp, Oryza sativa
  Predicted polypeptide sequence is orthologous to G913, G1753, G2514
atggagcaacgggcggcggcggcggcgcagcagcggcaggggaggaggcagagcgcggcggcgtgcgggatcaggcgggcgagggcggagacgcggcacccggtgtaccgcggcgtgcggttcagggcggggaagtgggtgtcggagatccgggagctccggaagccgagcaggatatggctcggcacgtacgccacccccgagatggccgccgcggcgtacgacgccgccgcactggcgctgcgcgggcgcggcgcggcgctcaacttccccgacgccgcgcggtcgcgccccgccccggcgtccgcgtccgccgacgacgtgcgcgccgcggccaccgccgccgccgccgcgatggcacaccaggaggaggacgacgacagtcggcgtcagctcgaggacgggggcggcggcggcggcgtggtggacgaggacgacgtgctggagatgccgaggctgatggtgagcatggcggaggggctgatgatcagcccaccgccggtgatgctcggcctgcaggcggacggcggtggaataatggacgagggcggcggcgtggtgaggttgtgggatcacagctga

SEQ ID NO: 1665 - DNA, 546 bp, Oryza sativa
  Predicted polypeptide sequence is orthologous to G913, G1753, G2514
accacgcgtcgctggtctcgatctcctcttcccttccctatctatactctctctatctccctcttgttgcataatcatatcgacttcttgcaagctaggttcgattgtgttgagacgcatactagcttaattagcagctggccggcagatattctcttggtacagcagccatagctaggggggagtaggtgcactgtagcttaatttggcggatataggtcatcccaaggtgtatatatgtcgatgggtgtgccctaatggtacatggctgacctgaccgagcatccgtcgccgactgctcctcctcaagtgcaaacagctggcctgccggtggcggcttctccgggtcctgcctcgcctcattcaccgtcggagcaaggggacaagacggcgcccggggcagccacggcgtcgacgatgacgacggcgagctcgggcgagccgtcgccacggtcctcggggaagcacgccttctaccggggcatccggtgcaggagcggcaaatgggtctcggagatccgcgagccgcgcaaagagcgccgcata

SEQ ID NO: 1666 - DNA, 1205 bp, Oryza sativa
  Predicted polypeptide sequence is orthologous to G975, G2583
gattgaacgcacgctacactgcaagaaaggcaagtataggggtggcaggtagtttatattcactggaaaccgagaacttcactcctcccagcactccacactaggaggatgctcactgtctgaatgactgactggctgctgctgctgctcattccttctcctactctgcctgcctcctctgctgtgtccttgggagaattcttcagggacagtatccctgcagaggtgagatcatgggacagtcgaagaagaagttccgcggagtcaggcagcgccactggggctcctgggtctccgagatcaggcaccctctccttaagaggagggtgtggctgggtacctttgagacggcggaggaggcggcgcgggcgtacgacgaggccgccatcctgatgagcggccgcaacgccaagaccaacttcccagtcgcgaggaacgccacgggggagctcacaccggcggctgcggtggcagggcgggatggccgtgtcggcggcggcagcggcagctcgtcctcaatgacggccaacggcggcgggaacagcctgactccagctgggtcatgaccgtcgagctcaacaaggacacggccgtgtcgtcggctgcgacggtggcagcagcaacagcagtgtcgtccagcgaccagccgactccgagtgacagcacagtcacaacgacgtccacgtccaccacgggctcgccgtcgccaccacctccggcaatggacgacgaggagaggatcgcgctgcagatgatcgaggagctgctgggcaggagcggcccgggctcgccgtcacatgggctgctgcacggtggtgaaggtagcctcgtcatctgaattccggaagaacaggaaagaaattgaaaatgcaaggttaaaacagcatgatcaggtcaccatctaagatcaaggatctggtagggtggttggtgcacaggcagttaagattgctacatatgataggtatatctctattactactacatatccagcttaattaggaaacaattataagatcgattactactgtgtgaagtgaagctgtgtatttattaaagacttacttgtatgtacaagacgtccccgtcattatagtcatactggtgaaagctctgctatgtatcaacgtcatcagagatcagactacatatatataagtggtgtcaacttctaataaaagtaaataaaaacattgtaattgtgt

SEQ ID NO: 1667 - DNA, 1328 bp, Oryza sativa
  Predicted polypeptide sequence is orthologous to G975, G2583
gaacgcacgctacactgcaagaaaggcaagtataggggtggcaggtagtttatattcactggaaaccgagaacttcactcctcccagcactccacactaggaggatgctcactgtctgactgactgactggctgctgctgctgctcattccttctcctactctgcctgcctcctctgctgtgtccttgggagaattcttcagggacagtatccctgcagaggtgagatcatgggacagtcgaagaagaagttccgcggagtcaggcagcgccactggggctcctgggtctccgagatcaggcaccctctccttaagaggagggtgtggctgggtacctttgagacggcggaggaggcggcgcgggcgtacgacgaggccgccatcctgatgagcggccgcaacgccaagaccaacttcccagtcgcgaggaacgccacgggggagctcacaccggcggctgcggtggcagggcgggatggccgtgtcggcggcggcagcggcagctcgtcctcaatgacggccaacggcggcgggaacagcctgtctcagatcctcagcgccaagctccgcaagtgctgcaagacgccgtcgccgtcgctcacctgcctccgccttgacccggagaagtcccacattggcgtctggcagaagcgcgccggcgcacgcgctgactccagctgggtcatgaccgtcgagctcaacaaggacacggccgtgtcgtcggctgcgacggtggcagcagcaacagcagtgtcgtccagcgaccagccgactccgagtgacagcacagtcacaacgacgtccacgtccaccacgggctcgccgtcgccaccacctccggcaatggacgacgaggagaggatcgcgctgcagatgatcgaggagctgctgggcaggagcggcccgggctcgccgtcacatgggctgctgcacggtggtgaaggtagcctcgtcatctgaattccggaagaacaggaaagaaattgaaaatgcaaggttaaaacagcatgatcaggtcaccatctaagatcaaggatctggtagggtggttggtgcacaggcagttaagattgctacatatgataggtatatctctattactactacatatccagcttaattaggaaacaattataagatcgattactactgtgtgaagtgaagctgtgtatttattaaagacttacttgtatgtacaagacgtccccgtcattatagtcatactggtgaaagctctgctatgtatcaacgtcatcagagatcagactacatatatataagtggtgtcaacttctaataaaagtaaataaaaacattgtaattgtgt

SEQ ID NO: 1668 - DNA, 873 bp, Oryza sativa
  Predicted polypeptide sequence is orthologous to G977
actgatcacctcgacctcacttcctcctcaacctcgagctcactcctcgctctcccgccgcgagcgcgcgctctctctcgccgcgaccacgcgcaatccgtcgccgagctcgaggacgtcggcaatggcgcggccgcagcagcggtatcgcggcgtgcggcagcgccactggggctcatgggtctccgagatccgccaccctctcctgaagacgaggatctggctgggcacgttcgagacggcggaggacgcggcacgcgcgtacgacgaggcggcgcggatcatgtgcggcccgcgcgtgcgcaccaacttcccccacgacgtcgccgacgaggccgcgccgccgccgccgccgcacagcgccgccgcagcctcctcgtcgttcctctccgcggcgctcgtcgccaagctccaccgcttcaacctcgcctccgtccaggctgcgcagcgcggcaacagcaacgacgacgactccaccacctcctcctccgccgccgcgtcgtcgcgcgccgtgattccgtcccttcccgccgccgccggcgcattgggcaatgcggcggcgacggcggagtggagcggcgggttcctcgaggagcagtacgtggaccagatgatcgaggagctcctcgactccaacttctccatggagatctcctgctgatgtgccctgttcatctacctgttcttctctgctccatctcctgtttctttctctctctcttttttttctttctttttttttgtttttttagtttagtaagctatgtgaggaagaactctgatcgaggttagtttggtcacagtgagttctggagcagcttgtgtatacggtagcatcatttagagcataatagggttgcagttgagaccttc

SEQ ID NO: 1669 - DNA, 519 bp, Oryza sativa
  Predicted polypeptide sequence is orthologous to G977
atggcgaggccgcagcaacgataccgcggcgtgcggcagcgccactggggctcctgggtctccgagatccgccaccctctcctgaagacgcggatatggctgggcacgttcgagacggcggaggatgcggcgcgggcgtacgacgaggcggcgaggatcatgtgcgggccccgcgcgcgcaccaacttcccgctcgccgacgccaccgcggcggcggcggcggccgccgcgtcctcgtcgttcctctccgccgcgctcgtcgccaagctccaccggttcaacctggcgtccgtgcaggccacgcagcggcagagggaggccgccgccaccgccgccgcggcctcttcggcctccgccacgacgccgccgctcggcaatgccgccgccgccgacgacgacgcgcggaccaccacgacgtacggcgcggaatggagcggcaggttcctcgaggagcagcacgtcgagcagatgatcgacgagctgctcgactccaacttctccatggagatctgctactag

SEQ ID NO: 1670 - DNA, 394 bp, Oryza sativa
  Predicted polypeptide sequence is orthologous to G1020
ttttttttttttcttcatactaatataaaggaatacatcccctccacggtttagtccatctcatcgccggcatgatctgttctaattaacaaatcccaaaatgaatttcgccctcggcaaaaaaactatttacaaggcttttccgtttttcacaggctactaaacgaaaacccagaggaccaaaacttcggagagaaatttccttcaaagaaaaaaataagagagaaactccaaagtcgtcagctaacccatcctgagctagttctttaccggggggggccggttcaaatccaaatcgaaagctgccgccttgttccccgtaaccgttggaggtgacggcccaaaatcaaccaccgacgaggagtcggagtcactttgtgcaaccgccgccacg

SEQ ID NO: 1671 - DNA, 1116 bp, Oryza sativa
  Predicted polypeptide sequence is orthologous to G1020
gcacgagcccaaacccaacctcccaaaacacccacccggtttaccagagatccgcgcccgccacttgtaaacctgctgtacccatggcgcccagagcagctacggtggagaaggttgctgtggcgccacccaccgggcttggtcttggcgtcggcggaggtgtcggagccgggggtcctcactacaggggcgtccgcaagcgcccgtgggggcgttacgcagcggagatccgtgaccctgccaagaagagccgggtgtggctcggtacctacgacacggcagaggaggccgcccgcgcctacgacgccgccgctcgagagttccggggtgccaaggcaaaaacaaactttccgtttgcatcacagtcgatggtcggctgtggcggcagccccagcagcaatagcacggtagacaccggtggcggcggggttcagacgcctatgcgggccatgcctctgccgccgactctggacttggatttgttccaccgcgcggctgctgtgactgcagtcgccggcaccggcgttcgctttcctttcagaggatatcccgttgcacgtccagcaacgcatccatactttttctatgagcaggctgcagcggttgccgcagctgaggctggataccgtatgatgaagcttgcaccgccggtcaccgtggcggcggttgcacaaagtgactccgactcctcgtcggtggttgatctcgcgccgtcacctccagcggttacggcgaacaaggcggcagctttcgatctggatctgaaccggccgccgccggtagagaactagctcaggatgggttagctgacgactttgtagtttctctcttattttcttctttgatggatatttctctccgatgttttggtcctctgtgtttttgtttagtagcctgtgagagacggaagagccttgtaaatagtttttctgccgagggcgaaattcatcttgggatctgttaattagaacagatcatgccggcgatgagatggactaaaccgtggagtgtatgtattcctttatattagtatgaagaaattattcagaaagtcacaaaaatatctgtgcacactgagtttgattgacgtttttaaaaaaaaaaaaaaaaaaaaaa

SEQ ID NO: 1672 - DNA, 1451 bp, Oryza sativa
  Predicted polypeptide sequence is orthologous to G1020
tttttagcaaaacagagtgaaaagattttttcttagaagggtttctacatagtttctcatgactatcaaaataataataatacatatataatcccgctccataacaacgccggcaggatatgtcttaggtgacacacatggtgtgatcttctcttaaactacatcgccggcgaaaaaaactatttacaaaaatgtcttccctcagttaagcaagagggtctaggcataagaggtacacggaatttttctactactaaaaattaaaaagaaagaaatgaactagcggtcatcatgtaaaaactccggctgctagacctccatcggcggcggacagttcagatcaagatcaaaagcgatggctttcttcgccaacgcggcgggcggtgatggtgccagatccacgatcgacgaggagtcggagtcgctctgtgccaaggcggccacggtgaccggcgccggcgcaatcttgagcatgcggcaaccagaggcggcggcggcggcggccgcttgtccaaagaagtagtaagggtgcgatacggggtagccctcgaaagggaaacgcatgccgcctgcgccggcggccgcggccgctgcggcgcggtggaacaggtcgagctcgagcgacggcgggatcggcatggccttcatgggcgcctgcacgtcgctgccgaacgactcgacggtgctgctgttgctgctgccgctgttcacaccggcggcgggcgcgccgttagggtaggggaagttggtcttggccttggcaccgcggtactcgcgcgccgcggcgtcgtaggcgcgcgcggcctcctcggccgtgtcgaacgtgccgagccacacgcggctcttcttggccgggtcgcggatctccgccgcgtaacggccccacggccgcttcctcacgccacggaagtgctggccggtgcccacggcggcggctccggcgacaccgcccacgccaagcgcgagtccggtggccgcggccgccggtgacatagtcttgtccgacgttctcggcgccatggcgatctttcttttctccgtgtttctttcttggtgcgcgctgatggtgcggtgcggatgcgggtgcagctgcggtgttgcggcaggagtatacaagcacatcacaggtggcatgatgggtggtcatgctgccaagttgattggatggggaaccacggatgctggcgaggattacttggctgcttgcaaaccagtggaacagaggatggggcgatgatgggtacttcaagatcataaggggcacaaaccgaatgtggcatcgaagaagatgttgttgctggtatgccctcgacgaagaacatggtgaggaactatgatagcgccttcggagtcggaacggccatagtttgacttaatcaaatttacatgatcccaaccgtattgagccataaccgacgcgtggcgacgcgtggtcgacccggattccgacc

SEQ ID NO: 1673 - DNA, 1283 bp, Oryza sativa
  Predicted polypeptide sequence is orthologous to G1038
ggacttgatgaatgttcctggcttaacaagagaaaacgttgctagccatctacagaaatatcgcctctacctgagtaggttgcaaaagcagaatgaggaaaggatattaggcgctgctaggcaagatttcagtcacaagggaacatcagaaaaccttaacctccgaagttccttccaagagcaaccaagcaacatagcaaatggatatccgcatgcttctcagaatatacaaactcaggccaacatgctagattctcagctagaggacaccaagagcacagtgcccttgcctgtgccagataaaaaaagaactctagcaagtgatgctgctgactcacagaatgtcaccagtgcttcaagtttaggtggggttctgtctttcaaaagcatgccggtgaatcaggacaggaagccatcagaaacaatgatcttggaatgccaggcctggaccggaggcattccatcgaagcagttcatgcagtatccaaagcataaccatgaacgctgtgacctattaggggattattcatgcctgccaaagccagacttagaacacccagttggccctagtaatctgtatgctccaccacctcttatctcaatgagttgcggtatggagggggatgccagagacttctcagacgtgaagccagctattatggactgcatcaagtccttatcaccggcgttgacatgtacagtggattcagtttctgttcaacttagcgacagtgtggtgacctcgattgacggtgacctgaagtcttccggtgtggacgggttgcccagcattaaagattgttgccttgatcagacgaacagccaaggaagtttgcgtccttcgcaagagccaagtatcataggcagcacagagttggcttctctgcctgaggacttacccagttatccacttcacggtgtctccctcgagaatataggactgagtagcattgacttactaaactacagtgacgcaatgatactatccggactacaaagtaactggtatgatgatctagagtttagcagcgaaatgatggactatccatcgatagatgaatgtctctttgcatcatcctgagctgccgcccttctttcgacaatgctattttgcgaggaaggatgatgttctttggtatgttcccatatagctcctcttgtagggctatagtcagctaacttgatcctacggtggaaggatttaattgtagtatctccacttttgataaatgtctgtattatagactgtgccatggtataagctatataccttttgaatgatc

SEQ ID NO: 1674 - DNA, 1263 bp, Oryza sativa
  Predicted polypeptide sequence is orthologous to G1063
gagcacataccattgcaagaaacccttcacatcttactgaaacagctactactcctgctagctagctcaagctcaagctcaatctcaagctctttccactaagctccgtgtgtctagctcatcaatacctggctagctagctagttgcttgatcgatatatatcctagctaagtgatggacttcgacttgttcaattcctacccggaatcgcagcttgacctgatgagcacgatgcttcagctggagcagctcactgcgctcagtgaccagtcgctgttcatggcggcgccgacgtcgccgccggtatcacccatggggaccccttctccccagttctcaccaccgccgcagatgtcggtcaccaccaccaccgccggtggcggttaccaggatcagtataactccatgccggcaacgtacggcgccggtgcgggcgtgcaccagctggacttcgcgatgtcgtcaccgggctccgactccggcgcgccgcagggctcgtcgtcgtcgtcctcgtcggaggcgatgcgggagatgatcttccacatcgcggcgctgcagccggtggagatcgacccggaggccgtgcggccgccgaagcggcgcaacgtgcgcatctccaaggacccgcagagcgtggcggcgcggctgcggcgggagcgcatcagcgagcgcatccgcatcctgcagcggctcgtcccgggcggcaccaagatggacaccgcctccatgctcgacgaggccatccactacgtcaagttcctcaagtcccaggtgcagtccctcgagcgcgccgccgccgccaccggcgccgccgcccaccgcgccgccgcattcggcgccgcctacccagctgccttacccatgcagcaccacgctccgtggtagctgcacgctactagctcccacatggatagatggtgatgagacaatcgtttcccattactatcgcgtctcacatgcttgtcgccgtcgtcgtcgtcgatcgatcaatcaccactgctgctgctgcagcatgcatgatcacatgcatgtgcaaattagtagtacaagatgtaggagactacctgattactagtaccatttattattgctgttgtacgttaccgcatgctagctcgtacgtacgtggctgctccgagcttttgttggactcgcagcccgtacgtgcatgcgcgtttcattcgaccgtaggcttgtactgtactgtacacatttccttctattctacccccctgttcaatgcagtacgtttcccgtacctc

SEQ ID NO: 1675 - DNA, 1291 bp, Oryza sativa
  Predicted polypeptide sequence is orthologous to G1075
cacacaaaccctaaacaaacacacacacacacacacacacacacacactctctctctcttctcctctcttctcctattatcatcatcatcatcatcatcatcatcacttgcatatcgaattattaataatatcgatggcaggccttgatttgggcaccagctacctccaccaccaccaatcactgcatctccgccacgacgatggcggcgccggctccgacgacggcggccacgacgacctctcgccggggagcggcggtggcggcgggcccagcagcacggccggtggcgccgggatcggcggcggcgaggtcgtcgctcgccgcccccgcggccgcccgccgggctccaagaacaagcccaagccgccggtgatcatcaccagggagagcgccaacgcgctcagggcgcatatcctcgaggtagccgccggttgcgatgtgttcgaggcgctgacggcgtacgcgtgccgccggcagcgcggggtgtgcgtgctctcggcggcggggacagtggcgaacgtcacgctccggcagccgcagtcggcgcagcccgggccggcctcgccggcggtggcgacgctgcacggcaggttcgagatactctccctcgcgggctccttcctgcccccgcccgcgccgccgggcgccaccagcctcgccgcgttcctcgccggcgggcaggggcaggtcgtcggtggcagcgtcgccggcgcgctcatcgcggcggggcccgtcgtcgtcgtcgccgcgtcgttcagcaacgtggcgtacgagaggctgccgctcgaggacggcgacgaggtggtccccccggcgccggcagggagcgaccagggcggcggcggcagcggcggcatgccaccattaggcgttgatccgtcgggcggcgccgccaccggtgggctcccgttcttcaacatgccgttcgggatgccgccaatgccggtggacggccacgccggctggcctggcgccggcgtcgggaggccaccgttctcatgatggatggatccccatattccggcgagcggccggcggcgaggtggtcggcaagattgaagacatggacatggacatgtacaacaacaagtagcctttcttatctctgaatctttttctcctcttgttcgatctctgtgatgtctgtctttgtgatcttttcgtgatgttttttgtgttaacctgtatgagagtacttgtgttaattgtttcagtcaggtgtctttgctgcttcgaatgtgttgtgaggacatgcactcataaattgatcaaatcaattattattgtct

SEQ ID NO: 1676 - DNA, 918 bp, Oryza sativa; identical to SEQ ID NO: 511
  Predicted polypeptide sequence is orthologous to G1075

SEQ ID NO: 1677 - DNA, 4052 bp, Oryza sativa
  Predicted polypeptide sequence is orthologous to G1082
gactaacctagttagccactctattactactacctccgttgccaacgccggaatccatccatccatccccgcgccgcgctgtgccgccgcgagagctttgcggcgggcatgcgggtggggattcaccgcggggtggaagaagctgaagcagcagctggtggcgcaacgccacgaggcgcaccccgctggcacccacaccaacaaaaggagaagattctcgccaccaccactcccactgatcccctcttcttcctcctcgttcgcctgccatctccggagccggaggaggaggaggagtagccgccgcccagatctgcgccgccatgctgccgctgctgcggaggcggcggctgtgaatagctaggtcgtttttattgttgtttttgggttggtttggtttgattccgatggggtgcgggcagtcgaagatggaggaggagtacgcggtgcggcactgcagggagaggtcggagctgctcgccctcgccatccgccaccgctacgcgctcgccgacacccaccgtgcctacgccgaatccctcgccgccgtcggcgccgtgctccacgacttcctccgcggcgtccagtcgctgcccccgccgccgctcgagcccacgctccgccttcccgcccaccgcaagggcgacaacctccccaccgcctcccccgtcccggccaaccccgccatcgcctcctcctccgccgcccagccgctgccgcccgtcgccaagcaggtacgaatcgccgccgcccccgatgacggcggcggcggcggccacatccacttctcggacgacgactccgattccgagggcggcgggcacatcaagttccactccgacgacgagggcgacgcgcccgctcaccgccgcccagagatcgtccgctccgccgcgccgccggtggctccgccgccgcagatggggccaccaccaccgtatggctccggatatgctcctcctccgccttatggttcgggatacgggtatggatacggccccgcccccgattacggcggcggcatggccgttgccaacggcggctatgacccagggtatggtggtatgggcggagccagtggcggcggcggcggcggcggctatgcgcctggatatggaggcatgggagttggggatggcggcagcggtggcggctatgagccagcctatggcggcatgggcagctatggccaaagcttcttcaacatcagctatgcgcgcagccagccgcctccgccgtccgtctcatacgagcaccggctgcaggccaccgatgccagggtccactactacgccggagaaggcaaccctcaagcacccccactcgggtatggcggtgggtatggttatccgccgcagggctcgagctcttacaaccagtatgcgtacggtggttactatggtggtgcttctcctccgcctccggccgatataccttctacctcccgcggggaggttacgccaccggcacctccatctccgccgagggtgtctacttgggacttcctgaacccatttgaaacctatgagagctactatgagcagccaactgctgctcaagcgtcatacactcccagcagaagttccaaggatgtgcgtgaggaggaaggcataccagatttggaggatgaggatatggaggtggttaaggaagcttatggtgatgagaagcacgccgccaatgggtacagtggcaaggggaagatggcaaaagaggaaggtggtaggagcagcaccggggatgaactgccccatgaatccaagttatcggaagcgagcagtagcgggagcaaccaggagcatgatgtccatgtagtggagaagagtgttgtgggagaacaggtgcagcggtcagagcctcgtcagcatgtcgcaggcctgccgcccataggatcggagaagacgtactttgatgatgctgaggtggtgctggagatcaggactcaattcgagcgtgcctcaaaatctgccattgaggtgtccaagatgcttgaggttgggaagatgccttactacccgaagagttcaggtttcaaagtgtctgcgatgatgatttgcgggataccaacaatggaggaagagttcctgcggtttgaagaagacaaggcgatggggtgtggcaatctttcctcaacactgcagaaactgtacatgtgggaaaaaaagcttcttgaggaagtcaaggctgaggagaagatgcgggcgttgtatgacaggcaacgtgaggagctgaaaatattagatgagaaaggtgcagaagctgataagcttgaggctactgaaagatccatcaggaagctatcaacaaagataagcatagcaattcaggttgtcaacactatctcagacaagataagtaagctgagggatgaagagttatggccgcaaacatgtgagctcatccaagggttgatgcggatgtggagcactatgttagaatgccatcagatccaattgcatgccatatcccatgctaaaaacatagattccatgataaacggtgcaaagtttggtgaagctcacatggacttgatcaagcgcctagagcttcagcatttggattggatagcctcttttgcctcatgggtgaatgctcaaaaaagctacgttggtactttaaatgactggttgaggaaaggagtcacatatgaacctgaggtaactgatgatggtgtgcctcctttttctcctggacggctaggagcgccacctatttttgtcatatataacaattgggcagttggtgtggggaggatatctgagaaggaagtagttgaggcaatgcaggcctttgcatctaatgttcttggcctctgggaaaggcacaggtcagagcaaagacaaggtcttatggctaataaaggtatggacaaggaccttagggtgatggaaagggatgaacagtcgatgcgcaaggctctggaagcacaaaataagaagctggtgctcatttctaatcagagcggtgtatccttatcagcacaagcacaggccttacaagatggaggttcccatggtgatactggtagtttgcaactaagtctgaagaatatttttgaagcaatggagaacttcaccgccaactctgcaaacacctacaaggatctccacctgcgtgctgaagaagagaaagctcgcgttgcccaagagagttgcagagtttcctagttcctttcgtggtttccatgttacatgagggcatgagccctttttaacgcaaaggagctgactgcagtggttcagatgagcactatagtttgcatggcagcgtcacaattcaagtggcaagtgatgcaccttgcatgaaatagcttctacccagggctgcgggctgccagacaaacctgtggcgtaaatggagacttgctagattgtgtttttttgaattggagcaacactcctcatgccatacagcccaggaactcaattttgctaatagctgaatcacaagacattgccgataggggaagaaaaatctgaagtggcgagtgacaagattcactcaatgttgggaaatcccagtaaatagttggaagatgtaagctgcataaacgaaatgcatggtctaagcatggagcagtaaaatgttccgatcatgagtccaagattcatgaagttgtatccatccatatgaaatagtcaaatgtgatcatgctgccaggttcagggaaagagtcactggaagagtgcaacaatgctagcatgccagtgtacatagttgaaggcaatgcgatatgggatgaaccaaagctgatgctgtgggagatgcttccctcccagctgggaggctgcagcctagctagttcacctgttaggggagtgatggatgatgatgagcttgtaggatagagaaaaaaagtggatgccctgaccccgttctgcagttcactaactgttggatttttttgttccgttatttattatacatataattcatttgtatccctgtacagccggtggctaactcataaacccccccttttttgtgtcatgtttattctatttctcccccatcgactttgcctgtttctgcttctctctcttttaatcgcg

SEQ ID NO: 1678 - DNA, 1661 bp, Oryza sativa
  Predicted polypeptide sequence is orthologous to G1082
taacgtcgccgcgtccgttccgactccccggagagccgccgatggtgcagacgttgccggcgagatcaaggcgcagtttgtccgagcggcggacgcggtcagggcgctcgcgccgattcttgaagtcgggaggcggagctaccatccccggagctcagtgtaccatgtttcatctcggatggtgtcagtgattgcgctgccgcattcaggatacggaggcagcgacctgttggatgtcggaggaggggagaaggtggtgggagcaaggaacttgtctttgactctgcaaaagctctatatctgggagaagaagctgtacgacgaggtgaaggctgaagagaaaatgcggctcctgcttgccaagaactctaagaggctgaaattcttggatcaaaaaggcgctgaagctcccaagattgatgcaactcgtaatttggttaggaagctatcaacaaaaatacggatagctgtgcgagttattgctaaggtgtcgaaaaagataaacagagtaagggacgaggagttatggccacaagttaataccttaatccaagggtttgtgaaaatgtggcaagataagctgaactgctaccacatccagtgtcaagcaatatcagaggcaaaaaacttggattcaataatttctggtggaaccagtcgagatctggcaatggagcttgaactagagttgattaaatggatcgtcaatttttcctcctgggtgaatgagcagaggagcttcatcaaggcactgaatggatggctggcactctgtcttaactatcagcaggaggagacggctgatggagttcctccgtattctcctggaagagtgggcgcaccccttgtgtttgtcatctgtaatagctggtcccaagctatggatcggatttctgagaaggaggtgattaccagcatgcaagctcttgtgtctagtgtacggagcctatgggagaaacaaaatgttgagcaaactgaacagctgattgcaatccgggaaagagaaaaatggaacaagatattggaaaggaagaccctggagattaacaaggaggccgacacactcaacagaaagctagctctagtaccgggccggcaaagccttcttccaacagcacaaacgtaccaggtccattttcttgaggcaaacagtgtgcaggttagtttgaagcgtgttcttgaagccctagaaagttactcttccaattccctgcgagctttggatgagaccctgaggcatgccgaagaggaaaggttgtctagagaaagagccaaagtttcataggcattggcatagaggttccatctgacactacagtgaacacagcttgtaaaatacaagggtctcctctccaggtggttataatttatcagatcaatgcagaatgttctgggcaaatgctgcttgcagatcaaatttttgtggggaagttctgactttggagttttgctaactgaccgttgtttgtcgatgcagttcaggcaaatgtcctgtgttgatccatcataatagatatagttgtgttgaagtagcaggtacattaggtacatataggtgaagtgctcgtttcggtgctagtatgcaatgtactgatcttctgtgttgcctttttcttggcctccatacaattgaatgaatgagcaagagtgcacttggaatg

SEQ ID NO: 1679 - DNA, 2814 bp, Oryza sativa
  Predicted polypeptide sequence is orthologous to G1082
atgttatctcgccggcggcgtgggaggagaccacgagccgacgacgacagcgaccagctgatccacccgctgttcaagcgcagctggacctcggcgtccgggacttcgagagcgggacgttgcattgcaccatcgatccttggcgacgtgtgcctttttcaccgccgcccacgtacggctgtcccccccgcttttgctcatctccgctcgccgccggcaaccgccaacccgcgctgtccagtccgtgacgttttcaccgtgcgccggcccgctcgactcgaggacgaagccgaaaagcgcgaagattctcgcgtcgccatcgcccatcgcccatcgccactgtacatggggtgcggccagtccaagactgacgggggcgggggcgggggcggcgcggctgtggcgctgtgccgggaccgcgccgcgctgctggccgacgccatccgccaccgctacgcgctcgccgacgcccaccgcgcctacgccgcctcgctgcgggacgccgccgccgcgctgcacgacttcctccgcggcgtccaggcgctgccgccgccgtcgtcgtccgacgtcgaccacgccgcgccgctgcgcctccccgacctgaggaagggggaccactcgctccccgccgccgtggttcccctccccgtcgacgcggtggtcatcaaacaggttgacgacgacggcggcggccacatacatttcccctccgacgacgacgacgacgagggcggttctgatggtagtggtggccacatccatttcccgtccgacgacgacgacgacgctgagccgcctcccccacgccccgccgcggctccggcgccgcacgccgccacgctatacacctacgctccgccgtacggctacggccccggcgccgggcagtatgaatacggcgtcgacatgggcggctacggccagagcttcttcagcatcagctacgcccggagccagccgccgccgccgtcgtccgttgtgtcctacgagcaccgcccccaaacggtcaatgcgactgttcactactacccgggggacggcgccgccgggccaccgcttcccggctcctactacggcagcgccgcgccgccgccatcgccgccgcgggtgtccgcctgggacttcttcaacccgttcgagtcattcgagagctactaccaccaggaccagccatctcctgctccaccggcctacacgccaagccggagctccaatggcgcgcgggaggaagatgacaatggcatccccgaggtggagcacgacgaggtcgacaaggttgacaaccaccaggatgccaatggcatgccattgccggcgaaggatgtcagtgaggagcagcacaggaagtccaagtcctcggaggccagcagtagtaccagcagcagcatgatcagtgatctccatgtagttcagaagagtgtgattgaagaacagctgcggcattcggatgccgcggggcctcccgcgatccccaggaaggtttacaatgacgatgtcgaggtggtggaggagatcagatcacaattcgagcatgccgcaaagtccgcattcgatgtatccaaggtgcttgaggttgggaagatgccttactaccagaagagttcaggattaaaagtatcctcgatgatgatttgtgggctatcttcggtgggggaggagttcctgcaatttgaggaggacaaggctatggaatgtggtaacctttcttcaacattgcagaagctgtacatgtgggagaaaaagcttcttgaggaagtcaagtgttgggttatactcaagcaactttgtttatcacagactgaggagaagatgagggtgctgtataaccaaaagcgtgaggagctgaaagttttgtatggaaggggtgccgaagcacacaagcttgaggcaactgaaactcatatcaggaagctatcaacaaagataagcattgccattcagattgtcaatactatctcaaaaaacatcaataatctgagagatgacgaactatggccgcaaacatgtgaactgattcaagggttaatgcaaatgtggcatgccatgtcaaaatgccatcagatccaatgccacgccatatcccaagctagaaacttggactctaagctagattctgcaaggttcagtgaagctcacatggacttaatcaagcggctagagcttcagttactggagttgatttctagttttgctacatgggtcaatgctcaaaagagctttgttggcactttaaatgagtggctcaagaggggaattgactatgtgcccgaagttaccgatgacgggactccccccttttctccaggacgcttaggagcgccccccattttcatcatctgtaataattgggcaatcggcacgggaagaatatcggagaaggaagtagtagacaaaatgcaggcttttgcctcaagtgtcctgcacctctgggagaagcacaggttagaatggaggcaaggtatgatggctaacaaagatatggacagggaccttagagtgatggagagggatgaactctcaatgcgcaaggctctcgatgcgcaaagcaagaagcttgtgcttgtttccaatcagagtggcgtgtcgttatctgcgcaggtggttcacgatagtggtccaactgctgaagttggtttgcaatcttgtatgaataaggtctttgaagcaatggagagcttcactgccgcttgtgcgaatgcatacagtgatctccatcttcgctctgaagaagagaagactcgactcggccaaaacaatggcagagttcctagcttcatttcagacttagctggtaagtacatagcaagtaactga

SEQ ID NO: 1680 - DNA, 556 bp, Oryza sativa
  Predicted polypeptide sequence is orthologous to G1100
gcagcactcaacatgcccgttttgtagaatttcattgtgtgactaccctgatagcaagcagacaatgtctcctctaccaagtgaagtgataatacctccatgttcgcctgaaccatcaaggtcagatcaatgcaattgcctgtttgtcggcacggggcattcaccaaggacatctcaggttcttataaatgaacctgaccagtcgaatcggacattatatagtccatcagtggaaggggataacaacttgccatcatctgaagttaatcctcctggtgaaattaacaaccaaacaatgaaaaagcatgtggagaatcatcgtattcaagacagatcatgatctacctagctaagatcctgcaagtgactgttgtgcagtctgctgtcttcagggtaaactacatgtaaaattataagcagcaatacaggtggattcatggatggctgttataggacataggttactttgaaggatgtaaatatgagaaaattgttcaggtttcttgttagaaaacacatttatttgttaatcatattcaagggctcattgcattaa

SEQ ID NO: 1681 - DNA, 2106 bp, Oryza sativa
  Predicted polypeptide sequence is orthologous to G1108
gggggagaagaaagcgtaagaaaaataaaaggagaaaaaggaatagagaaattggggaagagagctacctcgaatcgaagctgcgatctccacctggtgaaataggagaattgatgaattgctgagatttggtgattagagggacctttgctgctgaggcattgaggtacactaaaagcaagggtgtgaaaaaggcaacttcaattgaaaacatctacatatctaggaatgtcctgaaactaatgtgtggagtaaacttctagtttattgctgtccgtcctgttgggccacagtgcgaaggtcaggcagatagtcatccattactgatgggggactctggaaatgccagtcatcgtgatcacacgatcgacatactgagaaatgatgcaactttcccatcaacatctcatcaggataatcataataacttggatgagttgcaccaaactagagggcctctaaatgatgttcctcatgtcccagaaagttctgctagtgcaactcctgcatctatctcccgaaacgcttcttttgcaagaagagatcaaggacaccgtcaaccaaatcctttgaattctggcttctggatctcaattgagcttattgtaagtttaagccagattatagcagctattactgtcctgtcagtatcaaggaacgagcatcctcatgctcctttggctcagtggcttattggttatacgataggttgtgttgctactcttcctcacctttattggcgatttctccaccgcaatcggcagaacacagagcaagaatcaacaaatcaggtttcatctgaaagggacgtatatgagcctaattcttatgtagtagtttcgtctgctcatggatcagaagttgtggacagtggtaataatggtggagtagcaaggattgcaagtccaagggtctacgcattggttgcgtgcttcaaattggctctggattgtttctttgctgtgtggtttgttgttgggaatgtgtggatattcgggggccgtacttctctccatgacgctcctaacttgtacaggctgtgcatagtattccttgcattcggcttcatcggctatgccctgcctttcatcctatgtacaatgatatgctgctgcctaccctgcattatctccatgatgggcatccacgaggatttggattttaacagaggcgctactgcagaagcaatcgatgccttggtggcatacaagttccaatcgaaaaagtttcaagatggagaagcgggagaagataatggtggagtattggcagctggaacagacaaagagcgaactatttctgcagaagacgctgtatgctgcatctgcttgtcaaagttctcaaacaacgaagatctacgggagcttccctgcaatcatgttttccacttggaatgcgtcgataaatggctcaagataaacgcactgtgccctctttgcaaggctgacttaggcggctcgacgaatgctccggactcgagctccaggagcagccatgacagcaacaacagcagagtcaggaacgacgtcgagtcacaacagtagctgctctcatgccctttcccatgagcatggggatggaacacattcttgacaatctacaaattggcatgcaacttctcaagtcccttttttttcagacagacttgaatagagcatttgcctacactgctctctggtgttaacccagaaactcctatgaggctgaggctatggctatgagttgctgcctgcagtttgttctgaactgaagttgcctgtaaggctgtaacagattatagatggtgttggaatagttatcatgatgatcacctgagttgagcatattaggttgttgaggttaaccttcaaccggggaggttcaatgtaattatctccttgtttaggaaaaaatcccctcccctttgtatctgctcccttgtatagaaaacaaccatctccattgtatatcagatcaattttgcctgcattttgtaaattcagttagtaggcagagatctcccagcactcatcaagtgcttgagcaagtacagattagcagttgagtttattctactgtaatgcaacacttatagatgatattaccatgacataatcatttgagccc

SEQ ID NO: 1682 - DNA, 1869 bp, Oryza sativa
  Predicted polypeptide sequence is orthologous to G1108
gaggagtcaagtcgccgacttttggagttctcctcgccccagctcggtaaattccttcgctttttctccgctggttcggagatttccatgttcacttttgtttttttttttaattaagggctttgctttgatggaagggttgggtactggttccttccctccggatcaatcttgcttcttgcgctcacccaacctagtaattttttcctctcccgatttgtttaatgctaatctaggtggttgatgatgcttgcgagccaggcattgattcggctttaagcttgcctgcttgcttcgccgtcttgttctttgagttcttggttttcatggatccttgatccgatttaggggttgctgctgctagccgtggttggtgagacggttcttggagaagggggatttcttgaggtgcttttctgggaggtgtaaccaactaaattcctatgctaccttctggttgatggccgtccctcctgttgaatcagaaacaagaagtgaagaaacagataatttccctttacttgcagaccacatggaaaatactggacatcatgcacatgcagttgatatcccatgggattcttcaccatcgacatctcgccgagataatcataatggatttgatcaattacctcgtatcttagaaggttctcctgggacatctactccatctaactctcagaatggtcctctagcaagaagagatgataatcgtggtcgtcgtcagcctagtcccttgaattctggttgctggatctcagttgagctagttgtaaatgttagccagatcatagcagctatttgtgttctgtcagtatcaaggaatgagcatccacactctccgttatttgagtgggtcattggttatacagtaggttgtactgccacgctgcctcatctttactggcgctatctccatcgcaacctcccaaccactgggcaagagccaacagttcagaatatccctccaaacaacacccctgaagctaattcatatggagtaaccggcacaaatggagtctcaagaaacaatgaggcaacagtaaatccaaggttccaagcttttgctgatcacttcaaaatggctctggactgtttctttgctgtgtggttcgttgtgggaaatgtatgggtatttggtggacattcttctgctcacgacgcgcccaacttgtacaggttgtgtattgccttcctcacattcagctgcatcggctatgctatgcctttcatcctctgcgcattgatatgttgctgcctaccctgcataatctctatcttgggatttcgggaagatctaaaccaaaacagaggagctagtgcggaaacaatcaatgccttgggaacatgcaagttcaagtcaaagaaaactcgtgatggagatggaaacgaagttggtgtcggtgttgtggctgctggaacaaacaaggagcgagtcatttctgcagaagatgctgtctgctgcatctgcttggccagatatgtcgataacgatgatctccgagagctcccttgtgcgcacttcttccacaaggattgtgtggacaaatggctcaagataaacgcgctgtgccccctttgcaaggctgagatagatggtgtctccacaagtgctccagccattggctttgggcgtcgccacagcgacaacagggtaggaaacgacattgaatcacaactataactctcttcccacttcgttggcagcgtggatcacgcctttgatgaggccttccacacatcaacctgtaaattatagaggtagacatcaagatgtaaagggtcctcttacgatccaacaaagttcttttctgaatgactactgcctccactgtcagtatatattgcttccagcatttgtttcttctc

SEQ ID NO: 1683 - DNA, 2001 bp, Oryza sativa
  Predicted polypeptide sequence is orthologous to G1108
ggctttcgcgagagagggacacctgctctgcttccgcttccgcttccccctctcgagtctctcgcctctcccccgtggccaacccacacaccgcgggttggaggaggaggaggaggaggtaggggaaatccccgtcggccgtcggctcggcgccgaatcgatccgcttaggcttcttctgctgggctcttccatgaagcaaatgaagtttataatgcacatactaatgttcagtatattatactgagaatcaactttattctcagctgtatatacactagtatgccagccattggtagctacttgaaaggatggtgaaacgcatatgattacccatgatgagcatgtgtgttccctttttttattagtgctaagctggaaatcaataaatccaagatattcatggagcatgctacctgtgatgatgtgcatgagcatgctataaatgtatcacatggagaaactgcatcaacatcaaccagtcatcaagatttgcacagtgattcagatgattcacatcaggatgataggccttcaacaagcacacaaaccccatcaccacagtcttcagcatcaacttcgcccactgcatataacaccagaaatttatcctttcctagaagagatagtatgtatggtcatggaagaagtatttggaattctggtttgtggatctcgtttgaactggtcatatatgtagtacagattgtagctgctattttcgtccttgtcttttcaagagacgaacatccgcatgcccctttatttgcatggataattggttacacaattggctgcattgcaagcattcctcttatttgttggcgctgtgcccatcgaaacagaccttcggaacaagaacctgaacaaccacccgcagcctatcctaatttgacttcctctcaatcatcagaaggacgcaatcagcgtagcagtggtactgttttgcattttggatgtatcacaatttcgtgtccaaggcctagcatattggcttatcatttcaagacagctgtagactgtttctttgctgtatggtttgttgttggcaatgtgtggatttttggtgggcacagcactttgtcagattctcaggaagctcccaatatgtataggctatgcttagcattccttgcacttagttgtgttgggtatgctattcccttcgtcatgtgtgcagccatatgctgctgctttccatgcttaatttctcttctgcgccttcaagaggatttgggtcatactagaggagctactcaagaactaattgatgcactgccaacctacaaattcaagccaaaacgaagcaaaatgtgggttgaccatgcttcaagctcagagaatcttagcgagggtggcatcctgggcccaggaactaaaaaggaaaggattgtttcagctgaagatgctgtgtgctgcatctgtcttactaagtacggagatgatgatgagctccgtgagcttccttgcacccacttctttcatgtgcaatgtgtcgataaatggctcaagataaatgcagtgtgcccactctgcaagaccgagattgggggtgtggttcgatcattttttagcttgccctttggtcgccgacgtgttgataggatggcaggaagaggtatagctagctcgagattcactgtatagaacacgtcttcttctctagcatgtttgcttgtttcatctgctcatatgcacataaaagacgtgctcatggattgtagtttgttgatttgcaatgaaagcgataatctgctttcatcacccttgagttcaccaaagtgatgacagaaaagtggagacctgatgcttgcagtgacaagtttctgcagtacagtagaaacataagtatattctgatgtaacatttgatgtcaagattgtaaataaagagcacaaagttcacttcgggggtgtatatctgcatgtgtatgggaaaggaaagcctaattagttagtaactttgtaggcattttattgtgtgcaatcattgatcttgtttt

SEQ ID NO: 1684 - DNA, 1504 bp, Oryza sativa
  Predicted polypeptide sequence is orthologous to G1108
gtagaatcgtagataattcctgcactcagttttgagaaaactggaggtctcagaaatttagcagcttgcttctttctttgttgcatctaagaattgatgacctcagccttcaacgttacttgaaattcaaggtcataccgatatgcacgcttcgaggatggaacaaactacaggtgttagtggccatgagcacataattgatattccaagggacagtggtccatctacttcgacttcccatagtgttgctagagaaaaccatggagaaccaaatcctgttgatagatctgcaaccagagcgctagtacctgctttgcaggcaccatcagcagttggtgcacctatgttcgccggcacagaagccctttgaattctggactctggatttcaatagaagttcttgtcaatgtgagccaaattgtagctgctattgttgtgctttctctttcaagaaaggaacatccgcaagctccattatttgagtgggtcataggttatacagttggttgttttgctacactaccccatctttattggcgctatatacaccgcaatattgtcaatggtgaaaatgagccagcacatacacttcaaggctcctctcagaacaattcaactgagccttctgctagtgcatcagagcgtcgaaggaatgctgcacgaaatgcagtgctcgctaatccaaggattaatgctctttttgaccacttcaagatggccttggattgtttctttgctgtgtggtttgtcgtaggaaatgtgtggatatttggcgggcgttcttctgctgccgatgctccaaacttgtacaggttatgtattgtgttccttacctttagttgtattgggtatgccatgcctttcatcctctgtgcaatgatatgctgctgcctgccctgcatcatatctgttatgggatttagagaagatacaaacaatacaagaggggctacctcagaatccatcaattctcttccaacatacaaattcaaaaccaagaaacgccgtcatagttcaggaaatgaagctgaaggccaagatggtgggatagtagctgcagggactgacaaggagcggtcactatctgctgaggatgctgtttgttgcatctgtcttgcaaagtatgcacacaatgatgagcttcgtgaacttccctgcacacattgtttccacaaggaatgtgttgataaatggctgaagattaatgcactttgcccattgtgcaaatctgagatagcgagctcatctggaacatctgatactcgtcgctctgaccacacagatattcctgtgcaggagattgaaatgcattagggtgatctgctttctgaggtaatacggcagaatacagttacttgtggtgaccgtgtgcttgtataaagttcaagctttgatatgtggattgtaatgatgcatggggttatttttgttgctgttattttggagaagacagttctcactgtcaacatacacgaggaaatatacaatatctactcgttccatc

SEQ ID NO: 1685 - DNA, 2512 bp, Oryza sativa
  Predicted polypeptide sequence is orthologous to G1137
gatttccgtccgagggggccgataagagaagccgcgccgcggcgcacgctctcgctgtctctctctctctctctctctctcgtcctcgtctcggtctcgccgtgcggctctctctcgtgagcaacagcacgcgccgcggtcggcctccccttcaattccttcggctttggcccgggcgggtgtgtgagtgctcagctcctatcgccgattcgtcgtcctcctcctcctcatcctgctcgatctggtaattctagtgttgagggtctgaggagctgaaactagcacgggtaccctggcagcatgcggtggctggctctctcggtagacatcttccgcaaagggatctccttgaacctgtactgccgggttattctgtaaattgcctccattattgctctactccaatcctgatcttctagtctctgaagtttgggattgaagatctggttgctggcattgctgtttgggtttctgtggttgcctggcaattctttcaaggagaacgggcaggagtactaatggtgtggcaaccggtggctcagacgagattccgcgtgtttaaacatgagaatggaatcgctgtgagagttatagcttgcttccagccatcccaagattgccaggccgagtacttccgccatcttcttaagcccgtgacgtagttcgactccctcccttccatttgctgttgaatagaacctgtgctgctctaagtttttctgaagcaaaagtaaagcaggagaatttcctgttcatctcaattttctggtgatcctgtttgctggttgtttcttgatgggggagaaggttaatccctggtgccattggtctaatcccccatggaccgagagctctgcaaacaatctccacccacccgatgttagcctcgacaacacaaattcagtggcgttgccaacatatctgaacagcgatggctacatttattctggagttgctgcatctatgccgtctattgcagcatcagttactgacagacctgtttcattctcttctagatttgtcacaacattggtacccagtgtaggcttatcaacagctgagacactgagaaagagacctctggttttctttcataatgtgaataataccttcactgtaggtcctctcctgagcaaggggacattggatacagttccagagctccaaggtagcaatgagaccaatgtaactgatgttggagcacaaaatactgagtgtatgcatgagaatactgaggagattgatgcactcctgtgttccgactcagatgaagggtgcttgaaagtgcaagaactcaacaacagagtcaggaaatacccaatgcagaatgacaccatgagtgtggagtcggtagcaagcgctggtgcttcccaaccagcaaagaaaagaagactaagctctggtaccgacagatctgtggttgacacagccagctcagcaaggcctgaccactccgttgatcagaaacatctcagccatgacgacgacgcacagtcgtgttgtattggtgaagtggaaagcgatcaccagtttgctctgagggaaggtgaagaagcagaaggtgatgatggccccgatgatcggaagcggagaagagagaggatccaagagactgttgctgcactcagaaagatagttcctggaggcattgccaaagatgccacagccgttcttgatgaagcgatatgctatctcaagtatctaaagctcaaggtcaagacactgggagctgtttccctctagctcctcgatcgatgacggttctgttctggttcctgaacccaatacctatccctctctccatatatacaagtaatgagctaaaactatagcagcaataaggtgaaatgaaactcagtcagttccattcggtgattctgaggactactggagtgaaagctcaatggtgctttgcttacaagggtccaatgatttgagtggttacaatgaagattcagtattgcagtatattactagtgaatcaccgaccactgcaccttcatccatccatccactgatggagagtactacctagcagcaagccggtgtcacatctttcttctgggtcagttcagtgcagtgcctcttggtaggcacctcctccctctcataaaaaaaggctctcatggcgttgatggcgcaataagtaaaacagggaggctaagctataaagatcttttttctcccctccattgtggtgtgatccaaagcaaaggaaggaaggaggaatgaatgaatgaagtccatgcaaagtgcagtgctggtggcctggtgctgcatgcgtcgatggctttttgacccccaaaggttgagagatgagatggcggggccgcgcccgaggttagttcgggctccttgtgtgtgtttgtatggtggcgtgtgtagctagcagagtgtgcgtgatggcgtcgtccctcgcgctttttctgcctttctactagtactatacatatatgctactgtatactgtactcctatgtatgaatactgcatgtgtttgtgtttgtgtttg

SEQ ID NO: 1686 - DNA, 2423 bp, Oryza sativa
  Predicted polypeptide sequence is orthologous to G1137
ctcgccgtgcggctctctctcgtgagcaacagcacgcgccgcggtcggcctccccttcaattccttcggctttggcccgggcgggtgtgtgagtgctcagctcctatcgccgattcgtcgtcctcctcctcctcatcctgctcgatctggtaattctagtgttgagggtctgaggagctgaaactagcacgggtaccctggcagcatgcggtggctggctctctcggtagacatcttccgcaaagggatctccttgaacctgtactgccgggttattctgtaaattgcctccattattgctctactccaatcctgatcttctagtctctgaagtttgggattgaagatctggttgctggcattgctgtttgggtttctgtggttgcctggcaattctttcaaggagaacgggcaggagtactaatggtgtggcaaccggtggctcagacgagattccgcgtgtttaaacatgagaatggaatcgctgtgagagttatagcttgcttccagccatcccaagattgccaggccgagtacttccgccatcttcttaagcccgtgacgtagttcgactccctcccttccatttgctgttgaatagaacctgtgctgctctaagtttttctgaagcaaaagtaaagcaggagaatttcctgttcatctcaattttctggtgaagatcctgtttgctggttgtttcttgatgggggagaaggttaatccctggtgccattggtctaatcccccatggaccgagagctctgcaaacaatctccacccacccgatgttagcctcgacaacacaaattcagtggcgttgccaacatatctgaacagcgatggctacatttattctggagttgctgcatctatgccgtctattgcagcatcagttactgacagacctgtttcattctcttctagatttgtcacaacattggtacccagtgtaggcttatcaacagctgagacactgagaaagagacctctggttttctttcataatgtgaataataccttcactgtaggtcctctcctgagcaaggggacattggatacagttccagagctccaaggtagcaatgagaccaatgtaactgatgttggagcacaaaatactgagtgtatgcatgagaatactgaggagattgatgcactcctgtgttccgactcagatgaagggtgcttgaaagtgcaagaactcaacaacagagtcaggaaatacccaatgcagaatgacaccatgagtgtggagtcggtagcaagcgctggtgcttcccaaccagcaaagaaaagaagactaagctctggtaccgacagatctgtggttgacacagccagctcagcaaggcctgaccactccgttgatcagaaacatctcagccatgacgacgacgcacagtcgtgttgtattggtgaagtggaaagcgatcaccagtttgctctgagggaaggtgaagaagcagaaggtgatgatggccccgatgatcggaagcggagaagagagaggatccaagagactgttgctgcactcagaaagatagttcctggaggcattgccaaagatgccacagccgttcttgatgaagcgatatgctatctcaagtatctaaagctcaaggtcaagacactgggagctgtttccctctagctcctcgatcgatgacggttctgttctggttcctgaacccaatacctatccctctctccatatatacaagtaatgagctaaaactatagcagcaataaggtgaaatgaaactcagtcagttccattcggtgattctgaggactactggagtgaaagctcaatggtgctttgcttacaagggtccaatgatttgagtggttacaatgaagattcagtattgcagtatattactagtgaatcaccgaccactgcaccttcatccatccatccactgatggagagtactacctagcagcaagccggtgtcacatctttcttctgggtcagttcagtgcagtgcctcttggtaggcacctcctccctctcataaaaaaaggctctcatggcgttgatggcgcaataagtaaaacagggaggctaagctataaagatcttttttctcccctccattgtggtgtgatccaaagcaaaggaaggaaggaggaatgaatgaatgaagtccatgcaaagtgcagtgctggtggcctggtgctgcatgcgtcgatggctttttgacccccaaaggttgagagatgagatggcggggccgcgcccgaggttagttcgggctccttgtgtgtgtttgtatggtggcgtgtgtagctagcagagtgtgcgtgatggcgtcgtccctcgcgctttttctgcctttctactagtactatacatatatgctactgtatactgtactcctatgtatgaatactgcatgtgtttgtgtttgtgtttgatc

SEQ ID NO: 1687 - DNA, 1258 bp, Oryza sativa
  Predicted polypeptide sequence is orthologous to G1145
atcagctagcaaagcaaagcattttctcagctcaagttgcttgctcctcttctttctttcttcctcctccccttccctttcaggactcctccccccacatcagtagctttcactgcccaaaccctctttgtgggtggcaaccctagattattaatgtcctcctcctcatcatcaccatctcctcctcttcttcctcccctgcttctctctccagattctcttcatctggtcccttccttcccctgctttgcttgctcagctagctgatcgcacgtgggtagggtgagtgtgtgtgcgtgtgtggatgggagtccacgcaatgtcgtgccacggcggcggcggcggtggcggcgaaggggcactgtcgcggcaggggtcggtgtacagcctgacgctgaacgaggtggagagccacctgggcgagccgctgcggagcatgaacctggacgacctcctgcgcacggtgctccccgccgcggcggcggcggcggagacggcggggaggaagacggtggacgaggtgtggcgcgacatccagggcgccagcaccggccggcaccacgcgacgcccatgggcgagatgacgctcgaggacttcctctcgcgcgccggcgtcgccgtcgacggtgccgcctccgccgccggcgcgcattggctgcgtgggcactacccgccgccgccgccgccgacgacgacgacgctgcagtacgtgggcggctccggggcggtggtggacggcgtgtataaccgcgtggacgggcacggcgtcgcggggttcctctcgcaggtgggcgtggcggggcggaagcgcggcggcggcgtggacggcgtggtggagaagacggtggagcggaggcagaagcgcatgatcaagaaccgcgagtcggcggcgcggtcccgagcacggaagcaggcatacacgaacgagctcgagaacaagatctcgcggttggaggaggagaaccagcgcctcagggagcacaaggctgttgctgatttctcaacattccctagctgcgtcgatttcctgaaagcattcttgacgcagaagctggaaccagtaatgcagattgtgccccagccggagccgaagcagcagctgcgacgaactacttcggcctctttctaatcaaccaaccacaatgttcatagcgaaatgatttaaactcgatctctgtaggaaaatcaatgggggtttgtacttggggatgctggctgttgtgaacaagagctgaaacgacgaactcttttcttaact

SEQ ID NO: 1688 - DNA, 1593 bp, Oryza sativa
  Predicted polypeptide sequence is orthologous to G1145
acgtagcagtagctactactcgatcgatctatcgatccgattaatagtgccatgaaatatctctccatttgtggcagtaaattaagtactagctaagttagctaatgacactgttggtacttaaaggcttaaaagctagcagctgttgagctagctgtctcatgaagctagcttaattaagtctgatttatatatatatatatatgtagacatccagagagagagagagagagagagagagagagccagagacaagcttagcaacaacaaccaaaagcaaggagcactaactgcagctgttggcgatcgaattaaggatcctgcagctacaagcaagaaggtgcaggtgcagggtgcggccatggcgaactaccaccaccaggagtactaccagatggcggcggcggcagcggtggcgtggccgagggagccggacagcccgcagctgagcatcatgagcggctgcagctccctcttctccatctccaccctgagggacgacgacgacggcggcggcgtccgcctcgccggcgccgcgctgcccgccacgccggtgtcgctcgccgggatcgccggcggcgccagtacccccggcggcgacggggtggacatggaggtgcggcagcagagcggcggcagcggcgacgaccggaggaccatccggatgatgaggaaccgggagtccgcgcttcgctccagggcgcgcaagagggcgtacgttgaagagctagagaaagaggttcgccggctggtggatgacaacttgaatctcaagaagcagtgcaaagagctgaaacaagaggttgctgcactggtgatgcctacaaagagctcactgcgacgaacttcatcaactcaattctgaaggtcgaccaaaacaagcaagattatctgacgatacaaaatcattagaaagatctaaattatgtgtatttgcaatccggtgtgcgtttgtgcaggggtcaggcatgagagaggatattgtgtgtaggtgatcgatggatgctatgaactacctctgcagttagaaatgtgttagatcttgtctctgcaaagatgaacaccttttcttacttgttcaactcgatcagcatgcagtatcctgttcaatttttttccccttcagccattcagaaattcagaagtggctatcatgctttaattttgtttcaatcagtagtagtatttgttatctttgagggacagatgggcttgtctcttgtcagcattcaccttagctttacctcttactagtatattttatcactgagtgcgtttatgctcatagggcatatatatcttatgttggatataagtttttttttttttgtcttgtttagttaaactgaagatgcatggccgactgaacatgagaaaaatatcatttcgtttggaatgtcatggaaagcactttctgaatggctaacaggatataataaatatcagctctcacctttgtccactattgatagaaaaggaaaggcaagaagattgccttaattaacctaattgtcatcaaatcaaagtggccggcttatcgagaacctagctttgtctagaaactttgccttgaaatgaattgaaaaatcatgc

SEQ ID NO: 1689 - DNA, 1730 bp, Oryza sativa
  Predicted polypeptide sequence is orthologous to G1145
acatgccccatttccacccctcctatttcctctctttcacgcatctcgactccatctcactctcccccctccctcctctctcgctcgctgcgatctgcactgctactccggtaggtctcctcccccccccccttcctcgcgcggccgcggccaccgccggcgagaagcccgccgcggcggcgctgaccccctccgcctcttcccgcgcgcggccccgccagccggccaccgtctcgggtcaaatcgaatcgaatcgaatccaaagaggaaaatctggggttcagttgaaccctaatgcccccaggttaggtcagcctcgctgggtatcgcggctgctgaggttacttggagaggggtagggtggaatcctcgggggctgatttggtgtaattgagagcgccgattcatgattcaggcaatggcttcgcatgctggaggtagtggcggcggcggcggtggaagtggccgggatgctggctcggcgcagcgcgggccgatgcaggggttggcgaggcaagggtcgctgtatgggcttacactcaatgaggttcagagccagttgggggagccgttgcttagtatgaaccttgatgagctgcttaaaagcgtgtttcctgatggcgcggaccttgacggtggcggtggcggtggcggcatcgcgggccagtctcagccggccctggggctgcagcgccaggggagcatcacgatgcctccggagctgagcaagaagacggtggatgaggtgtggaagggcatccaggatgtgccgaagaggggtgctgaggagggtggccggtggaggcgggagaggcagccgaccctgggggagatgacgcttgaggatttcctggtcaaagctggggttgtcacggatccgaacgatttgccaggaaacatggatgtggtagggggcgctgctgcggctgcagctggtacgtctgatttgaatgccggagcacagtggctacagcagtatcaccagcaggctttggagccccagcatccaagcataggtgctccttacatggcaactcacctggcacctcagccattagctgttgctacaggtgctgttttggatccaatttactccgatggccagatcacttcgccaatgctcggggctctttctgatcctcagacacctgggcgcaaacgctgtgccacaggggagattgcagataagctagtagaaagaaggcagaagaggatgataaaaaacagggaatcagctgccaggtcaagagcgaggaagcaggcttacactaatgagcttgaaaacaaagttcttcgtctagaagaggagaatgagaggctaaagaagcagaaggagttggatgagatactgaactccgcgcctcccccggaacccaagtatcaactcaggcgaacaagctcggccgccttctgatggtgacgatgtccatagtaaattttgtagattatatggggtctgcccacatatttcgcatcctttggcggtaggaacaatcgatatagcttgagattccatcttccccctccagccggtggtggtttagagcttgtaaacaccagcaccagcagagccctagccatgtcgccccagctgctgatctcttcggaggctttgtcacttgtcagtatgtaaattctccaaggcacgtgtcgctgttaagttctcagagctccttggttatacatgattgggccctttgcctgtttcttgtggttggttgatacttagt

SEQ ID NO: 1690 - DNA, 933 bp, Oryza sativa
  Predicted polypeptide sequence is orthologous to G1145
atggcgtcgaaggccggaggcgggggcgtcgcgcggcgcggaggagggcggatgcggagtctggggaggcagggatccatgtacagcctcaccctcgacgaggtgcagagccagctgggcgagccgctgcacagcatgaacctcgacgagctgctccggagcgtgttccctgacggcctggccatcgccgacggtgccggtgccaccaccagtagccagcagcatcagccgggctcgggcctcctgcggcaggggagcatcacgatgccgcctgagctcagcaagaagacggtggacgaggtgtggaaggggatccaggctgctccgaagaggaatgccgaaacgggcggcggcggcggcggaggtcgacggcggcgagagaggcagccgacgcttggggaggtgacgctcgaggatttcctggtcaaagctggggttgtcacccaaggatctctcaaggagcttagtgatgtaggcaatgtggatccggttggaagaggtgttacagcaaccgggactgtggatctggcacctggatcacactggatagagcagtataagcagcagattgcatctactgatgctcatcaccatgggcagcaaggtgtgcagggtgcttattttccgaatcgattggtccctcagccacttaatgttggccccggtgctattctggagccatcctactctgatggccagacttcttcaggaatgatcggcggaatgtccgattcgcagacgcctggaaggaagcgaggcatgtcaggggatgtggcagataagttgatggagagaaggcagaagaggatgatcaagaacagggagtcagctgcccgttcaagagccaggaagcaggcctacactaatgaacttgaaaacaaggtttctcgtttagaagaggagaatgtgaggctaaagaggcaaaaggagtga

SEQ ID NO: 1691 - DNA, 804 bp, Oryza sativa
  Predicted polypeptide sequence is orthologous to G1146
gggaaaaggttgtgctggtgcaagatgcgactctccagggtgtctttgatgctctgaagaaggcttgtgcttctgcatgatgtatgttaaatgtgcatatgtgaaaactactcacttaactgaatagaaagagtgtcaacttaactagtgcccttttatctgtacaactctgtcctgcaatgaaccctgtaaacggttaattaaaaaaaaaaaaaaaaaactcgaggaagcatgtttttaagatgagcaaacagtatttagcaaacgttgcccttaaaatcaatgttaaggtgggaggaagaaatacagtacttgttgatgctttgacaaggaggattccccttgtgagtgataggccaacgatcatttttggtgctgatgttacacatccccatcctggagaagattctagcccttccattgcagctgttgttgcttctcaagactggcctgaggtcaccaaatatgccggattagtgagtgcacaggcccatcgtcaggaattgatacaggatctttttaaagtatggaaagatcctcaaagaggaactgtaagtggtggaatgatcagagagcttctcatttctttcaggagggcaactggacagaaaccccagaggattatattttacagggatggtgtcagtgaaggacagttttattaggttctgttttatgagcttgttgcctttagaaaggcatgtgccattttgaagccgattataagccccccgtaaccttggggggggccaaaacctaatacacaggctggttgctatacccaaggaccacgactggggcaga

SEQ ID NO: 1692 - DNA, 3548 bp, Oryza sativa
  misc_feature (7)..(7): n is a, c, g, or t
  misc_feature (26)..(26): n is a, c, g, or t
  misc_feature (28)..(28): n is a, c, g, or t
  misc_feature (33)..(33): n is a, c, g, or t
  misc_feature (42)..(42): n is a, c, g, or t
  misc_feature (3362)..(3362): n is a, c, g, or t
  Predicted polypeptide sequence is orthologous to G1146
tttcganccctttgaacccgtttaanangaccnactataggncgaattgggtaccgggccctgcagtagttgcatcagtgacgaagggttctaatgcctttctgtcccgcctcgcattaattctttggcttggttggatgcgagagaaaaaagaggagagattttggtagaattgtaagatttttgttactactaccactcgttttcttggcttggtttggtttggtgtttgatcacgcggtggtgacattataagggcgcggttgcgcaggtgttcgaccagcgggtggcgaggtcggcggcgaggtggtggtggtgcgcacatgctcgaggtgctggacatggcgccgccccggcaccagccggcagctgggaaggcgggcggcgggcgcgggcatgggcatgggcatgggcatggtggtggtggtggtgggccggcggcgaggaagcagccgttgcagagtagcatggcgcagcccaaggcggagacggcggcggcgacggcggcggtcgcgccgccggagggagggaagaagtgcggcggcggtggcgggaggcggcgcggcgggcgcgggcgcggcggcagggcgggtgcggggccggggccggggctggcggcggcgccggccgtggtggtggcgcccgcggcgcgcgccgtcattgggccgccggtggcgagcaaggggctgtcgttctgccggcggccggggttcgggacggtgggcgcccggtgcgtcgtgaaggcgaaccacttcctcgccgagctccccgacaaggatctcacccagtacgacgtgaagatcacgccggaggtgagctcccggagcgtgaaccgggcaatcatgtcggagctggtccgcctctaccacgactccgatctcggaggtcgcctcccggcctacgacggccgcaagaacctctataccgccgggacgctcccgttcgacgcgcgcgagttcgtcgtccgcctcaccgacgacgacgacggcaccggcgtcccgccacgggagagggagtacagggtcgccatcaagttcgccgcgcgcgccgacctccaccacctccggcagttcatcgccgggcgccaggccgacgcgccgcaggaggctctccaggtgctcgacatcgtgctccgtgagcttgccaaccgcaggtatgtctcgatagggcggtcgttctactcgccggacataaggaagccgcagcggctcggcgatggcctacagtcatggtgtgggttctaccagagcatccggccgactcagatggggttgtcgcttaacattgatatgtcatctaccgcgttcatcgagccgctaccagtgatcgaattcgtggcccaaatactagggaaggatgtcatatcgaggccattgtcggatgcaaacagaatcaagatcaagaaagccttgcggggcgtgaaagttgaagtcactcaccggggaaatgtgaggcggaagtatcgcatttcagggctgacaacacaaccaactcatgaactgattttcccaatcgatgaccaaatgaacatgaaatctgtcgtacagtatttcaaggaaatgtatggcttcaccattcagcatccccatcttccctgccttcaggtgggaaaccaaaagaaggcaaactatctaccaatggaggcctgtaagattgttgagggtcagagatatacaaagaggttgaatgaaaagcagatcacatcattactcaaggttacttgccgtaggcctagagaacaggagatggatattctacagtctcaacaaaatggatatgagcaagacccttatgcaaaagaatttggaatcaacattagtgagaagctaacctcagttgaagctcgggtccttcctgcaccttggctgaaatatcatgatactgtgaaggaaaaggagtgcttgccacaagttggtcagtggaacatggtgaacaagaaagtgataaatgggtgcaaggtgaatcattgggcttgtataaatttctcaaggagtgtgcaagaaactactgctcggggattctgccaggagttggcacaaatgtgtcagatatccggcatggaattcaacagtgagcctgtgataccaatatactcagctagaccagatcaagtagagaaggcgcttaagcatgtgtataatatgtcattaaacaagctcaagggaaaagagcttgagcttcttttggccatcctccctgacaacaatggttctttatatggtgatataaaacgtatatgtgaaactgacttggggttgatatcacaatgttgcttaaccaaacatgttttcaagatcagcaagcagtacctggcaaatgtctcacttaaaatcaatgttaagatgggaggaagaaacaccgtgctgctggatgcaataagttggaggattcctttggtcagtgacataccaactattatatttggtgcagatgtcacgcatcctgaaaccggggaggactctagcccatccattgctgctgttgttgcatctcaagactggccagaagttacaaagtatgctggattggtgtgtgctcaggctcatcggcaagagctcattcaagatctttacaagacatggcatgatcctcaaagaggcaccgtaacaggaggcatgatcagggagctcttaatatccttcaggaaggccactgggcaaaagccattgagaataattttctacagggatggtgtcagtgaaggccaattctaccaagttctcctctatgagttggatgctatccgcaaggcatgtgcatctctagaaccaatttatcagcctcctgtaacattcgtggttgtccaaaagcgtcaccatacaagactcttcgcaaacaatcacaaagacagaagtagcacggacaaaagtggaaacattttgcctggaactgttgttgattcaaagatctgccacccatcagagtttgatttctacctctgtagccatgctggaattcagggaacaagtaggccagctcactaccacgtcctttgggatgagaacaatttcactgcagacgaaatgcagacattgacaaacaacctttgctacacttatgcacggtgcacacgctctgtttctgttgttccacctgcatactatgcgcatctggctgcgtttcgagcgcggttctacatggagccagagatgtcggagaaccagacgacgtcgaagagctccactgggacgaacggaacctcggtgaagccattgcctgcggtgaaggagaaggtgaagagggtgatgttctactgttgatgactgggagactacctttaactactcacatatgatgtacctaacattgtagaattttagtggtagggatttagaattagcttccttcaggaaagggagcanagcaagcatttggatcctgagcgacctcttttgaccactctgtaaagtactaagtaacgcatgtataatagttgttgtatcagtctgaaaaaaaggaagtgcactcaaaaaaaaaaaaaaaaaaaaaaaaaaaaaaaaaaaactcgagcgcgggtcgacaaggggtttcgaaaggggtttccaaag

SEQ ID NO: 1693 - DNA, 3003 bp, Oryza sativa
  Predicted polypeptide sequence is orthologous to G1146
atcgttgctcgaatatttccccgtccgctgtgcgtcgactccgactgctcgtgtgttcgcccgccgccgccgattcctatccatctcgcgagcgagcaggggcgccgtcgttcgtcctgctgcttccgccgcatccatcctgtgctaaagtttgtaccttgccttggaacattagtcatggagagtcagagaatgacctggctctacgatcgtcaccactccttgaaacataataaagctgaaagacaagccattctatcaacttatagattagcaaaacgtccaaatctctcttcagaaggtatgattggcgaaagttgcattgtgaggacaaattgtttcagtgttcatctggagtctttggatgatcagactatctatgaatatgatgtatgtgtcactcctgaggttggaatcaatcgtgctgttattagagagttggtaaaacagcagaaagattctggtttgggtggccgtcttcctgcctatgatggaaggaagaggctatacacatctggtccattgccatttgattcacatagatttcttgttctgctggatagtattgaagacagtcctgaagagtcaaggcacttgagagtgagagattttgtggtcactttaaaatttgctgcaaaaatttccttatggactttacgcaagttccgtggtgggaagccaaaccgagaaagtcgagcggccctgcgagcacttgacgttgttctaaaggaattacccactgcaaggtatacccaatttgctggttcattttactcacctaacttaggagaatgccgacaattgtgtaaggtcttggaaagctggcgtggttttcaccaaagaatacaagctactcagatgggacttcaactgaatatcgacgtgtcatcatcagtgttcatcaagcctgtacctgtggttgactatgttgcacagcttcttaacgaggacatcttattagacagaccattatgtagcactgagttcttgaagattaaggaggctctagaaggtctgaaggttcagattaatggcattttgttcaacacatatcatgtacaagaccttgtccatcaagcagcaagttttccagttaactttagtattcagtacccatctttgccttgcttgaaagtggctcattttggggagacaatatttctgccattggaggtctgtaaaattgctgagggacaatgtcaccagaaacagctcaatgcaaaacatatggctgctcttcttcaggtagctcgacagccccctaatgagcgtgactacaacattctgcagactgtgcatcagaacaaataccaggaggacccacatgctaaagagtttggcattaaaattgaggaaaaacttgtatcaattaaatctcgcatcctacctgctccttggcttaaattccatgacagtggcgagacgacagaattcttgccacaacttggcatatggaatatgatgcataagaaaatgatcaatggtgggagagtgaaaagctgggcatgtgttaacttttgctggagtgtacgggagtatgctgctaggaatttctgttatgaccttggctttatgtgccgagaatctgggatggtcttttcagttaaacctgtgcttcctctagtgattgctaaacctggatgtgtagaatctgcactcaggacacttcatgacgatgtcatggacatacttagaccacagggcagaaaacttgacctgctgattgtaatattgcctaacaacaatggatctctttatggtgatgtcaaaagaatatgtgagacagatattggactgatctctcaatgttgtcttgcaaaacatgttcttaagatgaacaagtggtatcttgcaagcgttgcccttaaaatcaatgctaagatgggcggaagaaatactgtactggttgatgctttagaaatgagactcccccatgttagggatacaccaactattgtatttggtgctcatgtcacccatccacatccaggaaaagctaatagttcttccattgctgctgttgttgcttctcaagactggcccgaggttaccaagtatgctggtttaatcagtgtgcaagcgtgccaccaggagtcaatacaaggtctttttaaagtccaggatgatccggaaagaggaaccacaactagcggaatgatcaaagagcatctcatgtctttctatcgagccactaaacggaagcccggaaggattatattttacagggatggtgtgagcaaaggacagctccctcaggctttgatgcacgaacttggtgccatcaaaatggcgtgtgcatctatgggacccgattataatccattagttacatacgtggtgctccagaagtgtcgccatacacgtctgtttgctgactactataatgcgaatactcatgattcaactgcaaacatacgggctggtactgtggttgattcaaatatttgccaaccaaatcagtttgatttctacttgtgtagccaccgcagcacgcagggaactaagcggcccaggtattatcatgttctgtgggacgagaacgacttcttggctggttctttccaagagctcacaaactacctctgctacacctccgcaacttgcacccaatccatatcagttgtggcccctgtgcactacgctcgtcttctgtcatcacgagctcgatgttacattaaaccacgctcgattggcgattcaacgagccacacctccttgccttctgaagaagatagcagcgcagcctcagagactggcagtcttcttcctataaaggataatttgaaaggggccatgtttttctgctagaactgctgccagcaagatctgctgtcattttgtacgtggtctgtacagtcccacagttcttggtagatttgactgagcagtcaaaactcattatcgttcagcgagattcaggtgtagcagctgtaggattactgataaacattgttcctgtaccgatactttagaagaaatgaattaattatatcttagaacagc

SEQ ID NO: 1694 - DNA, 3432 bp, Oryza sativa
  Predicted polypeptide sequence is orthologous to G1146
ggtcttcttccttcctcggcccggcctcgctcgctgcctgccagctgcagctgcaactctccatccatcgatcgatctcctcctactcccccgccgccgccccgtccaagacaagccaagccagccaccactccctgcatgccatggcctcacggaggccaacgcaccgccaccataccgaggctccagatcctggtggaagagggagagggagaggccgtgccgcccgatatgctcagcctcagcctcagcctcagcagcagcagcagcagcaaggacgaggatgccgtgctagaggtgcctcgccgccgccgccgccgcagcagcagcagcagcaacagccaaggtctactcctactcgtgctaccactgtcaccgtggcttcctcttcatctaccacggccaccgcatcatcaagccctctagctcccgagctgcgccaagcaataatggaagctccccgtcccagtgagctcgctcaaccctcacccactccgcctcaggaacaacctgtggatgccgctaccacgacgccgcaccatattccatcctcaagcaagtcaattaggtttcctttgcgcccggggaagggtaccattggcaccaggtgcatggtcaaggccaatcatttcttcgctcacctgcccaacaaggatcttcatcactacgatgtctccatcactccagaagttacatcacgcattgttaaccgagctgtgatcaaggagctggtaaatctgtacaaggcatcttatctgggtgggaggctgcctgcatatgatggtagaaagagcttatacacggctggcccattgccgtttacttcacaggagtttcagatcactttacttgacgacgatgatggttctggttctgagaggcgacagaggactttccgagtagtaatcaagttcgccgcacgggccgaccttcaccggcttgagttgtttttagctgggaggcacgcagaagctccacaggaggcactgcaagttcttgatattgtgctgcgagagctaccatcagcaagatatgcgccatttggacgttccttcttttcggcttacttgggtaggaggcaaccccttggtgagggattggaaagctggcgtggattttaccagagcattcggcctactcagatgggcttatcactgaatattgatatgtcagctacagctttcattgagccgttacctgttattgattttgttgcacaactattgaattctgacatccattcaaggccgctttctgatgccgaacgtgttaagatcaagaaagccttgagaggagtaaaggtggaagttacccaccgtggcaacatgaggcggaagtaccggatatctggtttgacaattcagccaactcgtgagctaacttttcctgttgatgaaggaggcacagtgaagtcagttgtacagtactttcaagagacatatggctttgccatccaacacacctaccttccatgccttacagttcagcgattaaattacctgcctatggaggtctgcaaaatagtggaaggacagagatactccaagagattaaatcagaatcagataagagctcttttggaggagacatgccaacacccacgtgatcgggagcgtgatattattaagatggttaaacataacgcttatcaggatgatccttacgcaaaagagtttggcattaagataagtgatcgtctggcatcagtagaggcacgaattttaccggctccacggcttaagtacaatgagactggtcgagagaaggattgcttaccaagagttggtcaatggaatatgatgaacaagaaaatggtaaatggtggtaaagtcagaagctggatgtgcgtcaattttgcccgtaatgtgcaggaaagtgttgttcgtgggttctgccatgaacttgctctgatgtgtcaagcctcaggaatggatttcgctccagaacctatccttccaccactaaatgcacatccagatcaagtggagcgtgctctaaaagctaggtatcatgatgcaatgaacgttcttggaccccagcgcagggaacttgatttgcttattgggatactacctgataacaatggctcgctttatggtgatttgaagcgcgtgtgtgaaatagatcttggaatagtttcacaatgctgttgcacgaagcaggtgttcaaaatgaacaaacaaattcttgcaaatcttgctctgaagataaatgtcaaggttgggggcaggaacactgtgctggtggatgctgtgtcaaggcgtattcctctggtaaccgacagacctacaattatatttggtgctgatgttacccatcctcatcctggagaggacagcagtccctcaattgctgctgttgtagcctcccaagattggcctgaggtgacaaagtatgctgggttggtttctgctcaagcccaccgacaagagctgatagaagatctatataaaatctggcaggatccacagagaggaacagttagtggtggcatgatccgtgagctgcttatatccttcaaaagatcaactggtgagaagccccagcgaataatattttacagggatggcgttagtgaaggccaattttaccaagttctactttatgaattgaatgcaatccgaaaagcatgtgcctccctggagacaaattaccaaccaaaggtgactttcattgtggttcagaaacgtcaccacacaagattatttgcacataatcacaacgatcagaactcagttgacaggagcgggaacatactccctggtacggttgtagattcaaagatccgtcatccaactgagtttgacttctacctgtgtagccatgctggcattaagggtactagtcgtccagctcattatcatgtcttgtgggatgaaaacaacttcacagctgatgcattgcagattcttaccaacaacctttgctacacctatgcaaggtgcactcgctctgtatcaattgttccacctgcttattatgctcatctggctgccttccgtgctcgtttctatatggaaccagatacatctgacagcagctctgtcgttagtgggcctggtgtacgtgggccactttctggctcatcaacatcacgtactcgggcccctggtggtgcagctgttaagccacttcctgctctgaaggatagtgtgaagagggtcatgttctactgctgaagctagggcctacatagctaaagctcttcgtttcttggcaacctgcctatgatggttgtaattatgtgtcaaaaaatcccataataatctgccagctgctatcttctccattgtactatgctggtcatgtttgccaaagttaccctatatgtatgtatattatgctattgttttttttttttttgcggggactattgttatcatgtattatgttttactgtcatgtctgtagttatgattcgaggagtttgcg

SEQ ID NO: 1695 - DNA, 3414 bp, Oryza sativa
  Predicted polypeptide sequence is orthologous to G1146
gatcaaccctctctctctctctctctctgcctcggcgacctcgcctccgcttactctcccacccagacaaaaccctctttgcctctcatggcgtcacgcggcggcgacggcctcgtcggaggagggcgcgggcccctcggtgggcgggacggtagagggcgcggcccggccggtgggcgaggcggcggaaggggaggcggccacccgcagcagcagcagcagcagcagccgggctacggccgcggcgacgggggcggccgtggtcctgcccctgctgctggtggtgtcgttggtcgaggaactggaggcggcggcggcggcgggcgcggggacggcggacgcggccgtggccgtggcggcggcggcggagatggcgttcgccctgctatggccgcggctccggcggcgtcgactcctggtccggttgctgttgctgctcggagtactcctcctcctactcccgcggtccagatccccgcggtggcgtcgtcgtcgtcagcgcagccagcggcggcggcgcagcctcctccggcagccgcggcggtttctgccctcgcgagggacgttgggaggcagctggctgtcgtggcgggcggcggccgccccgctccccccgcggcgccgccggcgcccatcccggtgtcgagcaagggcgtcgcgccaccgtcgcggccggggttcgggacggtgggggagaggatcgtggtgcgcgcgaaccatttcctcgtccgcgtctccgacaacgacatgatctacctctacgacgtgagtttgagtcccccaccaaagaccaggcgcatcaacagggtagtgatgtctgagctggccaggttgcaccgtgagtcgcatctcggtggcataagcttcgcgtacgacggaagcaaggccctgtacactgcaggaaaactgccgttcgactccatggacttcaagatcaagctgggcaaagagctcagggaaatcgagtacaaggtgacaattcgacgtgctggccaagcagatctgcaccacctgcacgagttcatcgccggccggcagagggactctcagcagcaaacgatccaagcactggacgttgtactgagggagtcaccttctctgaactatgtcatcgtttctcggtcgttctactccactatgttcggccgacaagacattggtgatgggctggaatgctggaaaggatactatcagagcctgcgcccaactcagatgggactctcattgaacatagacatatcctctaccccattcttcaaacctatcagcgtggtagaatatgtcaagaattgtctgggcacacctactaatgctaatggccctgaccctaggcggcctctttctgacattgatcgcctgaaggttaagaaagcactacggggagttcgtgttgaaacaacacaccaggggaagagcagcaagtacaagatcactacgattacatctgagccactgagtcagctgaacttttctatggatggaactacccagactgttattcagtacttctcgcagcggtacaaatacaggctgcagtacacgtcttggccctgtctgcaatccggcaacccttctaaccctatatatttgccaatggaggtatgcaccattgtagaagggcaaagatactccaagaagctcaatgacaaacaagtgactggcctcctgagagcaacatgccagcctccccagaaaagggagcagaaaatcattgagatggttcaacacaacaactacccggctgataaggtggtgagtgattttagaattaatatttccaatcagatggccactatgccagctcgcgtgctgcctgcgcccacgctgagataccatgactctggaaaggagaaaacttgtaatcccagagttgggcaatggaatatgatcaataagaaaatggttggtggagctgtggttcaaaagtggacttgcgtgaatttttcacgcatgcatattgatgccgtgcacagactatgcggcgaactagtttatacatgcaatgctattggcatggttttcaatgaaatgccagagatagaggtggggtcagctgctcctaataacatcgaagctgccctgagcaacattcacacaagggctcctcaactccagctgctcattgtgattctcccagatgttaatgggtattatggaagaattaagagggtgtgtgagactgaacttgggatagtatcccagtgcctcaagccaggccgcaagctcttgagcttagacaggcagttcctggaaaatgtctcactcaaaatcaatgtcaaggctggaggacgcaactcagttcttcagagacctcttgtacccggtgggcttgaaaacacaacaataatttttggtgccgatgtcacccatcctgcttctggagaggactcatcggcgtcgatcgcagctgtggtggcctccatggactggcctgagatcaccaagtacaaagccctcgtctctgcccagccacctcggcaggagattatacaagatctcttcaccatgactgaagttgcgcagaatgctgatgctccagcacagaaggctgaaggttcgaagaagaatttcatatgcggcggaatgttcagggagttgcttatgtcattctacagtaagaatgctaaacgtaagcctcaaaggataatattttacagggatggtgtaagtgatggacaattccttcatgttctgctctatgagatggacgcaatcaagaaggctattgcatctttggacccagcatacaggcccctggtgacatttgtggttgtccagaagaggcaccacacaaggctcttccctgaggtgcatggaaggcaagatctgacggacagaagtggaaatgttcgtccaggaaccgtggttgacactaacatttgccaccctagtgagttcgacttctacctgtgcagccatgccggaatccagggaacaagcagaccaacccactaccacgttctccatgacgagaaccgttttagtgccgatcagctgcagatgctcacttacaatttgtgttacacctacgctcgatgcacccggtctgtctctgttgtccctccagcctactacgctcacctggcagcattccgggcgaggtactacgatgagccccccgccatggacggagcttcgtcggtcggcagcggcggcaaccaggcggcggccggcggccagccaccggcggtgcgccgcctcccgcagatcaaggagaacgtcaaggacgtgatgttctactgctgatcgaatcggcgcctagcttgggttttaactacaaacattttgttggtcgctcgtcagtattcattcaggctgttagtgtactgtgctatctctgaaattgtgatggtgtcatttgggacatgttaacctgttgttgaacttgtgatctgtgatgttgatgcagctgct

SEQ ID NO: 1696 - DNA, 3636 bp, Oryza sativa
  Predicted polypeptide sequence is orthologous to G1146
aggtctgctctcctcaatcctcccccactccttgggtaaatcgttagcctagccgccacccgtactgagcgctccgccatggcgctcgtctgaacttcccctttagcgcccgccatggcctgccgccccatgtgagtaatgcggttatgtgtagcagggtagttttttcctattgctggagaagatcctccacttaaatggagaaaatcgacggggagatcgctcttttgttgctggatttctgtttattccgatctgttagactgctagtccctaaataggtgtagctttcgtttctgggcattctatttttcatggttgcggcgtcactttcatatctctttcacccatgaatcgactccgatagtgtgtgttactcgtaacctgtactactgcatttccattacatctagataatcagaaccgccactcaagtttcagtagtttggtcttgtaatggtggttctaattctgttggttgactgctctctgaaattaattttattcgtttagttattattatgtgatcttgaggtgtaggttcatgacttcatgttaagtagctccaaattattcttcattcccccctcctccccctgaaaatcttgttctgaattccaatagaaaagttattcttcctttttcccctgaaaatttcgttctgaattcccaataaaaaggttataaatttatatgcatgaagttcatcgagttgttctgaaaatcttacagttcgttatcaatacaaagactacttcaagtcaaacaagcaggattctacctgatgagctcatcaagttgcacgggttcacaactcttggtggcaaacggccagcatatgacggaagagagagtctctataccaatggttcacttccttttgaatcaaaggagtctgtggtcaaagtatttgatccagaaaagaatgctaaagaaagggcgcaaaaggaatttaagatcacaattgaaattgttggcaaaacaaacttgtaccacctccagcgctttctgctcggaaagcacaggggcatagcccaagaaatcatccatgtttttgatgttatcctcagtgataaactttctcggaatcatgtcacagggcccagatcctttctttgtactcagattggtcaccagggttacattggtgatggacttgactcttggagaggttaccatcaaagcttgcgcctgagaaagatagggatttcactcaatacggatatgtctgcagcatcctttatgcctgtgagaattatccaaattatagatgggttcctgaacataagttacacctcaagacctttgttagagcggaaccgtgtgcagctaaagaaagtattatgtcatgtttgcattgaaacaaaccaccatgatgaccaaatcggaagatataagataacagggatcacccctattcctatgagcaataacatatgtcctgttggtgaggaaggaacaacaatgactgttcttcagtacttctgtgatatggagaaaacaggtgtgcctagtgttggacattggaacatcgctgaagagaaaatcattaatggaggagctttggataattggacttctctgaatctttcacgaatgcgcccggaggaagtacaaaggttctgcagcgacctgattcagatgtgcaatgccactggaatgtccttctatccaagaccagttgtggacttccggtcatcacatcctaacaacatacagaatgctctgagggatgttcacaggccaatgcattcctatgttgattgtgatgagaatcatttttatgctgatgctcattgcaactgtaccgtgtctgtggtcccctcatcatcgaacgacaaagttgctgtggaacaggaggaattacaatttgcctcaacccctggcaacagtggacagggcaaatttcaggttggtttcctgctgaacagacagacgatactagtagatacagaaaatgacgactcagtttctgctgttatccagcaggcaattgaaaagacaaattattggccaaaggatgtgtattacacatactccatgggcatgattgacaaaaagaagatggtgaaggaatcacatctctataaaggttctctcatatttgtcaattccagaagccggggcggtggagagcctcctgctggttgcgagaggattgttgatagaatgattaaggcaaacaaaattcctctactggatcatatccatagtgtgaaggggcatgatccctgggctgaatggtttgagcgtgtgaacttaccaagatcccttttaacatcttcacaagaatggggtggtgtacttttgcaagatgcagcagctaaagttggacagatgttggctctctgtctggaaagggcccattgttctgggaaatgttttggtggctttgacatacgtgatgtctattatatagagtattaccagttgattgacattaatgcccccatgacggatttcacaagtagaagatatataaatgattggttatcgttcaataagattattgatgaccactttagatacactgatccaacctcaggttatctatcatatacactgtacgtggaagattttatgttcagaatatctttacttgaagatgtgccatctactggacgttcttggagggaaagggctgtctttttcaagaatatcagccttgaatcatcagagaggagagtccagattgttgaaggacttgtggggttttatcgtgaaagactcacttcagacagagaattattcgaggaggtattgcaggattgtggctattggaaaagacaaacaagaacggtgcctcgtatgatttctgcgttgacatattctgtaaagaatgaattgcaggactgggtacctgctaatcattactttgagaattgtgggtattcccagctttatttctgtagatgtttctttggacattatacagtaccaggaaggatcacgaagaaggaactggatacagctgtaggcatacttttgccaggtcatatcccaagggctcaaaaaagactgatggtcaactatgagaagacccaagtagatgctgcagtattgtcaccatcaggaaatactgcaaggttcagtgtgcatcatatttttggcattggttctgttggaaatgacctggctctcccacaaataaaaaaggctcttcctccctcgcaaagaaaaaggaaacaaacttgtgacaagtaagtctaactagcctactatacacatgtagctgcttctctgcaaacttcccgttggtagcagagagctctgatggcagcagcgggcaagctgtggaggtgcgttaacttcccaaagatcaaaggttcccaactgcttatatgatgagatgttggcgattcccatagagatgtggttgatgaagtttagttgaagattcccaactgcttataagacttctcttgaactggttgctggtagttttttttttgctgctcgttgtagtagattgtcagtgagcttctgtggtatgcaaggcactcagcttgacacaatgcaactatgccaagtatgttaagttcccagtagttttgttatctaacctttgttctctgtatgatatttgcctcatcagctgctctgctcaaaatgcttccttttatatttgtagttttg

SEQ ID NO: 1697 - DNA, 2503 bp, Oryza sativa
  Predicted polypeptide sequence is orthologous to G1146
gtggagctgtccggcagcaggaagttcaaggtggccatccggcacgtcgcgccggtcagcctgcaggacctgcggatggtcatggccggctgccccgccggcatcccgtcgcaggcgctgcagctgctcgacatcgtgctgcgcgacatggtgctcgccgagcgcaacgacatggggtacgttgcgtttggtcggtcttacttctcaccggggctcggatcgagggaactcgacaagggcatctttgcgtggaaggggttctaccagagttgccgggtcacgcagcagggcctttctctgaacatagacatgtcttcgactgctttcattgaacctggtcgggtgctgaattttgtagaaaaagctattggacgtcgaatcactaatgctattactgtgggatattttttgaacaattatgggaatgaattgatgaggacccttaagggtgttaaggttgaagtcactcaccgaggaaatctacgcaagaagtacagcattgctggcttcaccgagcagtctgcagatgttcagacgttcacatcatctgatggtatcaagactgtcaaggagtatttcaacaaaaaatacaatctgaagttagcttttggttatcttccatgcctgcaagttggcagcaaggagagaccgaattacctgcccatggagctttgcaatatagttcctggacaacgatacaagaacaggctcagtccgacacaggcttccaatctgattaacataaccaacgatcgtccttgtgaccgtgagagctccattcgtcagactgttagcagcaaccagtataacagtacggaacgcgcagatgagtttggcatagaagttgactcttatcctactactttaaaggctagagttttgaaagctccaatgctgaagtaccatgattctggaagggtgagagtatgcacgccagaggatggggcgtggaacatgaaagacaagaaagtagttaacggtgctacaattaaaagctgggcatgtgtcaacttgtgcgagggtttggataatcgtgttgttgaagcattctgccttcaattggtcagaacgtccaaaataactggactggactttgcgaatgtgagccttccaatattgaaagctgatcctcataatgttaaaactgatcttcctatgcgctatcaggaagcatgcagctggtcgagggataacaagattgacctcctacttgttgtaatgacagatgataaaaataatgccagcttatatggtgacgttaaaagaatctgtgaaacagaaatcggtgtattgtcacagtgttgtcgagcgaagcaagtctacaaggagaggaatgttcagtactgcgcaaatgttgctcttaagatcaatgccaaggctggaggaaggaactcggtatttcttaatgtagaagcaagtttaccggttgtttcaaagagcccaactattatatttggtgctgatgttacccatcctgggtcctttgatgaaagtaccccttccattgcttcggttgttgcttccgcagactggcctgaggtgaccaagtataattctgttgttcgtatgcaagcttctcgtaaggagattatacaagatcttgatagcattgttagggaacttctcaatgcattcaaaagggactccaagatggagccgaagcagctcattttctacagggacggcgtaagcgagggtcagttccagcaagttgtagagagcgaaataccggagatagaaaaggcttggaagtctctgtatgctggcaagccacgaattaccttcatagtggtgcagaagaggcatcatacaaggctgttccccaacaattacaatgatccacgcggcatggatgggactggaaatgttcgtccaggcacagtagttgatacagtgatctgtcaccctcgagagtttgatttcttcctgtgcagccaagccggggatcaaagggacaagccgtcctagccattaccatgtgctgcgcgacgacaacaacttcaccgcagatcagcttcagtctgtcacaaacaacctgtgctacttatatacaagctgcactcgctcggtgtctattccacctcctgtttactacgctcataagctcgcattccgcgctcgtttctacctcacccaagttcccgtcgccggtggagatccaggtgctgctaagttccagtgggtacttccagagattaaggaagaggtgaaaaagtccatgttcttttgctagtcgtccttgtgcccccctgaaactgaagcctggagccagccggcaagctctggaaatgctctgaataatcaaacttggaagaataagcacctgcccaggttgccattcgtttccatgtggcatggaggatggcatcctgaaaaggatattgtcatgtttgtgtggtttttaaacgacattgaagtttatctccggtgttactatctcagcactttggttgttttattttgttatgtctgaagatatagacacaaaacttcatttttgttt

SEQ ID NO: 1698 - DNA, 3177 bp, Oryza sativa
  Predicted polypeptide sequence is orthologous to G1146
atggcctaccgcggcggaggccgaggtggccgcggcggcgagcagcggccgccctactccggccgcggcgacgtccctggccgtggtggcggtggtggtgggggtggagccccgccgtaccgtcccgcctcgggcttcgtgtggccgccgccggggatgacgccgcggccggggcctcctcagccgcagtacccgcggccggggccgccggccgtcgtctacggcgcgccgatgccggcggcgcaccaccagggcgcgtaccagcccgggggcgtgtaccgtgcgccctccccgggggttccggtgatcggtggctacgcgcgcagcacgcccgtcaccatccgggcgcctccgccgtcgcactcgtcggctccggctccgtaccagccggcggcggccgcgccggctccctcgtcgtcctccacggcgccgtccgctacggctctggccaaggagttcgagcagaagctgttcgtgtcggagaccgcgctggcgccacccgcggcggtggcgtcggccgcggccgcgccggctggcgaggcgtcggtggagtcggacaaggatctggcaccggtgtcgaagaaggggctcgcccaccctgcgcggccggggttcggagcggccgggaagaaggtgatgatccgcgcgaaccacttcctcgtcaatgtcgccgacaacaacctcttccactacgatgtttcaatcaatcctgagtcaaaatcaagagcaacaaatagggaagtactcaatgagctcatcaagttgcacgggaagacatctcttggtggcaaattgcctgcctatgatggaagaaagagtctctatactgctggttcactcccttttgaatcggaggagtttgtggttaagctaattgatcccgaaaagaaggataaagaaagggcggagagggagtacaagatcacaattcggattgctggcagaacagacttgtaccacctccagcagtttttgcttggaagacagagggatatgccccaagaaaccattcaagttcttgatgttgtccttagggagtcaccatcttggaattatgtcacagtgtccagatccttcttctctacccagtttggtcaccggggtgacattggtgagggacttgagtgttggagaggttactatcagagcctgcgcccaacacagatgggcctttcgctgaatatagatatatctgcaacgtccttttttaagcctgtgacagtgatccaatttgtggaggagttcctgaacatacgtgacacctcaagacctttgtcagaccgggatcgtgtgaagataaagaaagcattacgtggggttcgcattgaaacaaaccaccaagaggaccaaatcagaagatacaagataacagggattacccccattcctatgagccagctgatatttcctgttgatgataatgggacaaggaagactgttgttcagtacttctgggataggtacaattacagactgaagtacgcttcttggccctgcctacagtctggcagtgattctcgccctgtatacttacctatggaggtgtgcaagattgtagaagggcagaggtactccaagaagcttaatgacaaacaagtgaccaacatccttagagcaacctgtcaacgcccccagcagagggaacagagcattcatgagatggttctccacaacaagtatacagaggataggtttgctcaggagttcggtatcaaggtctgcaatgacctagtctctgttccagcccgtgtgctgcctccacccatgttgaagtatcatgattctggaagggagaaaacttgtgcacccagtgttggacagtggaacatgattaacaagaaaatgatcaatggaggaactgtggataactggacatgtctgagtttttcacgaatgcgtcctgaggaggtacaaaggttctgtggtgacctgattcagatgtgcaatgccactggaatgtctttcaatccaagaccagtcgtggatgtccggtcaacaaatcctaacaatatagagaatgctctgagggatgttcacaggagaacatcagaactgctagccagagagggaaagggaggcctgcagcttttaattgtaattctgcctgaagttagtggttcttatgggaaaattaaaagggtctgtgagactgaccttggcattgtatctcaatgttgtttgccaaggcatgccagcaggccgaacaagcaatatttggaaaatgttgcactcaaaatcaatgtcaaggtcggagggcgcaacactgttcttgagcgagcctttatccgcaatggcataccatttgtgtcagaagtcccaacaatcatctttggcgctgatgtcacacaccctccacctggagaggactctgcatcatctattgctgcggttgtggcatctatggattggcctgaaatcaccaaataccgaggtctggtctctgctcaaccacatagacaggagataatagaagatctctttagtgttggtaaagatccagtgaaggttgtaaatggtgggatgatcagggagttgcttatcgcattccgcaagaagactggcagaaggcctgagaggataatcttctatagagatggtgtaagtgaaggtcagttcagccatgtgcttcttcatgaaatggatgccatcagaaaggcttgtgcatctttggaggagggatatctaccacctgtcacatttgtagtagttcagaaaaggcatcacacaaggcttttcccagaggttcatgggaggcgagacatgactgacaagagcggaaacatccttcctggaactgtcgtggaccgtcagatttgccatcctacagagttcgatttctacctgtgtagccatgctggcatacagggtactagcaggccaactcattaccatgtcctttacgatgagaaccattttacagccgatgcacttcagtccctgaccaacaatctttgctatacctatgcgcgatgcacccgggcagtgtctgtggtcccaccggcctactatgctcatcttgctgcattccgcgctcgctactacgtggaaggagagagttcggatggtggctcgacccctggcagcagcgggcaggctgtggcgcgagagggccctgtggaggtgcgccagcttcccaagatcaaggagaacgtcaaggacgtcatgttctactgctga

SEQ ID NO: 1699 - DNA, 3644 bp, Oryza sativa
  Predicted polypeptide sequence is orthologous to G1146
gggtagaagcagaggtaagcagggcagagagtagaaacaggagcactgcattactggtagtgggagcgtaaagctctctcctctcttcttcttcttcttcttggcgttttccctcatctccttctactagtactagtacatcaccctcccactcttcttcatcttccgcccagcgaggttcgtctggatgtgagctgaatctctccgtctgcccaagttgattgagttggtcgactgaatgggatcaaggagaccaagactgcctgggtttggtgaggactgtgagcctcgtggtggtgggagaggaggaggtggccgtggccgtggcagctactacccacaggcacagcaataccacccacaaggacatggtggccgtggaggagcaggctactaccatggtgctgctcctcaacctcgcggcgcaatggtggtgcagcaatggcgtcctgctactgctgctgctgagcatttgggccatcaacagccctacaacagcagtgtgagaccacagcactattatggtccgtctgccatagctcccgagctgctccaagcaatggatgctccacatgagcctcctgccaatgtctcctcaccagaagcagcctctccggaggcatcatcaccacggtctcttgctcttgaggtcacagagcagcttcaggacttgtctgtgcagtaccaattaagtgagagccaggaagagattgtccaacatgttcctgtgtccaccaaatcatttaaatttcctcaccgccctggaagtgggagtattggaaccagatgtttagtgaaggcgaatcacttctttgctcaactgccagacaaggatcttcatcagtatgacgtttcaatcaccccggagcttacatcacgaattcggagccgtgctgtgatggaagagttggtgagactgcacaagatgtcatacttgggaggacgtcttccagcctatgatggtaggaagagcctttacacggccggtccattgccgtttacttcaaaagaatttcgcatctctttgcttgaggaagatgatggttctggttcggagaggcgtcagaaaacatataacgtggtgattaagtttgctgcaagagctgatcttcaccgtcttgagcaatttctagctggaaggcaggcagaggctccccaggaggccttgcaagttcttgatattgtcttgcgagagttgccaacagcaagatatgcaccctttggtcgatccttcttctctcctgacctggggaggagacgatccctcggtgagggactagaaacctggcgtgggttttatcagagcattcgtcctactcaaatgggcttgtcactgaatattgatatgtcggcaactgctttctttgagccgttaccagtcatagattttgtcatacagcttttaaatactgacatccgctcgaggcccttatcagatgctgagcgtgtcaagatcaagaaggccttaagaggagtgaaggtaggagttactcaccgtggcaacatgcgccggaagtatcggatatctggtttgacatctcaggcaactcgggaactgacttttcctgttgatcaaggaggcacagtgaaatctgttgtacaatattttcaagagacatatggatttgcgatccagcatacctatcttccttgtctgcaagttggcaatcagcagcgtccaaattacctaccaatggaggtctgcaaaatagtggaaggacagaggtactccaagagactgaaccagaatcagataagggctcttttagaggagacatgtcagcgcccacacgatagggagcgtgacataattcagatggtgaatcacaactcctaccatgaagatccttatgcaaaggagtttggcattaagatcagcgagcgtctggccttggttgaggcacggattttacctgcccctcggctcaagtataatgagactggcagagagaaggattgcttgcctagagttggtcagtggaatatgatgaacaagaaaatggtaaatggtggtagagtcaggagctggatatgtgtcaattttgctcgaaatgtgcaagagagtgttgctagtggattttgtcgtgaactggcccgcatgtgccaggcctcaggaatggactttgctttggagcctgttcttccatctatgtatgcacgtcctgatcaagtggaacgagctctgaaagccaggttccatgatgcaatgaacatacttgggccacagcacaaggagctcgatttacttatcggactgcttcctgataacaatggttctctttatggtgatttgaagcgtatatgcgaaattgaccttggattggtttcccagtgctgttgcacaaagcaagtgtttaaaatgaacaaacaaatcctagcaaatcttgctctgaagataaatgcgaaggttgggggaaggaacactgtactggttgatgcagtgtcgagacgcattccgttggtaactgacaggcctactattatattcggtgctgatgtcacccatcctcaccctggcgaagatagcagcccatccattgctgctgttgtggcctcccaagattggcctgaagtgacaaagtatgctggtttagtttctgctcaatctcacagacaagagttaatagatgatctgtataacatcacgcatgatcctcatagagggcccatctgcggtggaatggtcagggaacttcttatatccttcaaaagatcaactggtcaaaagcctcaacggataatattctatagggatggtgttagtgaagggcaattttaccaggttctattgcatgagcttgatgcaatccgaaaggcttgtgcatcactcgaagcaaattaccaaccgcaggtgactttcattgtggttcagaagcgccaccacacgagattatttgcacacaaccacaatgatcagaattcagtcgacaggagtgggaacatattgcctggtactgttgttgactccaagatttgccatcctacggagtttgacttcttcttgtgcagccatgctggaatcaagggcacaagccatcccgctcattaccacgtcctgtgggatgaaaacaacttcacagctgatgcgttgcagaccctcaccaacaacctctgttacacttatgcgaggtgcacacgatccgtatctattgttccaccagcatactatgctcatctggcggcgttcagagcccgtttctacatggagtcagatagctcggacagtggttcaatggcgagtggtcgtggaggaggttcgtctacatcgcgcagcactcgtgctgcaggtggtggagccgtcaggccccttcctgcactcaaggacagcgtcaagaatgtcatgttctactgttagaattctactactgcttcgcttggctactactatcagttagcctttaaattgcctcccatttgattgcacttagttgttcatcatgggaagcctcaaataagaagtatgcaagacttctgaagccacatgctatcatgttgtgtgtttctgggacacaccattctatttcacattatctgtagactctatcccactatttcataaaagctgggcttcccctggctctatttgtactctaattcgtatggacctgtttcatcatttcaaaatggtcaattgtcttgtttgc

SEQ ID NO: 1700 - DNA, 3746 bp, Oryza sativa
  Predicted polypeptide sequence is orthologous to G1146
ttgaggcggaggcagcagcagcagtgcggtagtgcaagcgctagtggaggagttgggaggaggccccctagggtttcccgagaccgcctccccccgcgcctgcgccgccgctcgccgagcgcgcgctccgtgcccatcatggtgaagaagaaaagaactgggtctggcagcaccggtgagagttctggagaggctccaggagctcctggccatggttcttcacagcgagctgagagaggtcctcaacagcatgggggaggacgtggttgggtgcctcaacatggtggccgtggtggtgggcaataccagggccgtggtggacattatcagggccgtggagggcaaggttcacaccatccaggtggagggcctcctgagtatcagggtcgtggagggccaggttcacatcatccaggtggtgggcctcctgactatcagggccgtggaggatcaggttcacatcacccaggtggtgggcctcccgagtatcaaccgcgtgactatcaaggacgtggtggtccacgccccagaggtggaatgccacagccatactatggcggacctagggggagtggcggacgtagtgttccttcaggttcatcaagaacagttcccgagctgcaccaagccccacatgtccaataccaagccccgatggtttcaccaaccccatcgggagctggctcatcctctcagcctgcggcggaggtgagcagtggacaagtccaacaacagtttcagcaacttgccacccgtgatcaaagttcgaccagccaagccattcaaatagcaccaccgtcaagcaaatcagttagattcccgttgcgccctggcaagggtacatatggggacaggtgcattgtgaaggcgaaccatttctttgctgaacttcctgataaagaccttcaccaatacgacgtatctattactcctgaggttacttcacgtggcgtgaatcgtgctgttatgtttgagttagtaacgctgtatagatattcccatttgggcgggcgtctacctgcctatgatggaaggaagagtctttacacagctggaccattgccatttgcttctaggacatttgaaattactcttcaagatgaggaagatagtcttggtggtggccaaggcacccaaaggcgtgagagactatttagggtggtgatcaagtttgctgcccgtgctgatcttcaccatttggctatgtttctagctggaaggcaagcagatgctcctcaagaagcccttcaagtccttgacattgtgttacgtgaattgcctaccacaaggtactcaccagttggtcggtcattttattctcccaatttagggagacgccagcaacttggtgagggtttggaaagttggcgtggtttttaccaaagcataaggcctacccagatgggtctctcactgaatattgatatgtcatcaactgcatttattgagcctctacctgtgattgactttgttgctcagcttctgaacagagacatctcagttagaccattatctgattctgatcgtgtgaagataaagaaagctctaagaggtgtgaaggttgaggtgacgcatagaggaaacatgcgtagaaaatatcgtatatctggactcacttcacaggcaacaagggagttatcattccctgtcgatgatcgtggtactgtgaagactgtggtgcaatattttctggagacatatggttttagtattcagcacaccactttgccttgccttcaagtgggcaatcagcaaaggcccaattatctgcctatggaggtttgtaagatcgttgagggacagcgttactcgaagcggcttaacgagaaacagattactgcgctattgaaagtgacttgccagcgacctcaagagcgtgaactggatattttgcggactgtatctcacaatgcataccatgaagatcagtatgcgcaggaatttggcataaaaattgatgagcgtcttgcatctgttgaagctcgtgttctgcctcccccaaggcttaaataccatgatagtgggagagaaaaggatgtattgccgagagttggccagtggaacatgatgaataagaaaatggtcaatggtgggagagtcaacaactgggcatgtattaacttctctagaaatgtgcaagatagtgctgccaggggcttctgtcatgagctggctatcatgtgccaaatatctggaatggattttgcactggaacctgtgctgcccccacttactgctagacctgaacatgtggaaagagcactgaaggcacgctatcaagatgcaatgaacatgctcagaccgcagggcagggaacttgatttactgattgtaatactgcctgacaataatggttctctttatggggatctcaaaagaatctgtgagactgatcttggattggtctcccaatgttgtttgacaaaacatgtttttaaaatgagcaagcagtatcttgcaaatgttgcccttaaaataaacgttaaggtggggggaaggaatactgtacttgtggatgctttgacaaggaggattccccttgtcagtgacagaccaactatcatatttggtgcggatgttactcatcctcatcctggagaagattccagtccttccattgcagctgtggttgcttctcaagactggcctgaagtcactaagtatgctggattggtgagtgcccaagcccatcgtcaagaattgatacaagatcttttcaaagtatggcaagacccgcatagaggaactgttactggtggcatgatcaaggagcttctcatttctttcaagagggctactggacagaaacctcagaggataatattttacagggatggtgtcagcgaggggcagttttatcaagttttgttgtatgagcttgatgccattagaaaggcttgtgcatccctggaacccaactatcagcctccagttacctttgtggtggtccagaagcggcatcacacaaggttgtttgctaataatcacaacgaccagcgtactgttgatagaagtggaaacattctgcctggaactgttgttgactcaaagatttgccatccaaccgagtttgatttctacctgtgtagccatgctggcatacagggaacaagccgtcctgctcattatcatgttctgtgggatgagaacaaatttactgcagacgagttgcaaaccctcacgaacaacttgtgctacacgtatgcaaggtgcactcgctctgtatcaattgtgcctcctgcgtactatgctcatctggcagccttccgagctcgcttttacatggagccagagacatctgacagtggatcaatggcgagtggagctgcaacgagccgtggccttccaccaggtgtgcgcagcgccagggttgctggaaatgtagccgtcaggcctctacctgctctcaaggaaaacgtgaagcgtgtcatgttttactgctaagagcttgggctgtaccccgtatgcgccaaggaatgtagtactatgttatgttattttagcacttgcactctgtcgttgatcccgttaaaacgggtatgctaccataagctgttggactattctgggtattgtagtactacttgttttgtatttgtgtttgtgacgctgcagagcgtgaacaacgcaagtctggtacttgtatcgttgtgtttgtgggaacctaaatcttgttggacctttgttgtgcttgaagaaccaagttaaataatcctgtcagtatagggatttaattgctgcttggc

SEQ ID NO: 1701 - DNA, 3747 bp, Oryza sativa
  Predicted polypeptide sequence is orthologous to G1146
gaattatttctttgttctcctcctcctgattcgtcgtccgtccctaggaagcaaaggagaaagtttccactctgtctgcgggatatatcatatatatctcaatcgatccgccattggcgatcgacgaagtgatcaggggctagctcctttgcgctgcggctttgaccgcggtgtcgaagcttcttgcacatggccttccagttggacaacgggtactactcccatcaagctttagccatgatgagaaagaaaaaaactgaaccccgtaatgctggggaaagttctggaactcaacaagccactggagctcctggacggggtccttcacagcgacctgagagagctcacagcatggaggtggtggttggcaacctgccaatcctcaatatgctcaacaagctggtcgtggtggtggacaacaccagggacgtggtggacgttaccagggtcgtggagggccaacatcacatcaaccaggtggtggtccggttgaatatcaagcacatgagtactatggccgtggtgtccaacggcaaggaggaatgccacaacacaggagtggcagtggtggacatggagttcctgccagtccatcaagaacagttcccgagctgcaccaagcctcacaagaccagtaccaagctacggtggttgcaccatcaccatcaagaactgcaccatcttcgctgcctgttgaggccagcagcgaagaagtccaacatcagtttcaggaacttgccatccagggtcaaagccccactagccaggccattcaaccagcaccaccatcgagcaaatcagtgagatttccaatgcgccctggcaagggtacatttggtgataggtgcatcgtgaaagccaaccatttctttgctgaattgcctgacaaagaccttcaccagtatgatgtgtctataactcctgaggttccttcacgtggtgtcaatcgtgctgtcattggagaaattgtaacacaatataggcagtctcatttgggtggccgtcttccagtctatgatggaagggagagcttatacacagctggtccattaccatttacttctaggacctttgacgttattctgcaggatgaggaagagagccttgctgttgggcaaggtgcacagaggcgtgagagaccatttaaggtcgtgatcaaatttgctgcacgcgctgatctccaccatttagccatgtttttagctggaaggcaagcggatgctcctcaagaagctcttcaagttcttgacattgttctacgtgaattgcctactgcaaggtactctccagttgcaaggtcattttattcgcctaacttaggaaggcgccaacaacttggcgagggcctggaaagttggcgtggtttttaccaaagcatacgacccacgcagatgggactttctctgaatattgatatgtcatcgacagcattcattgagcctctacctgtgattgactttgttgcacagcttttgaacagagacatctcagttagaccattatctgatgctgatcgtgtgaagatcaagaaggccctaaggggtgtaaaggttgaggtcacacatagaggcaatatgcgcaggaagtatcgcatttctggccttacctcgcaagcaacacgagagttgtcttttcccattgataatcatggtactgtgaagacggtggtgcaatacttccaggagacatatggatttaacattaagcacacaactttgccttgcttgcaagtgggcaatcaacaaaggccaaattatctaccaatggaggtctgtaagattgtggagggacagcgttactcaaaaagactaaatgagaagcagataactgctcttcttaaagtgacctgccagcgccctcaagagcgtgagctggacattttgcagactgtgcatcacaatgcataccatcaggatccatatgcacaggagtttggcataaggatcgatgagcgacttgcatctgttgaagctcgtgttctaccacccccctggcttaagtaccacgatagtggcagagagaaggatgtcttgccaagaattggccaatggaatatgatgaataagaaaatggtcaatggtggtagagttaacaactggacatgcatcaatttttctcgtcatgtccaagataatgctgctaggagtttctgtcgcgagcttgctattatgtgccaaatatctgggatggacttctcaattgatcctgtggttcctctagtgactgcaagacctgaacatgtggaaagagcgctcaaggcacgctatcaagaggccatgaatatactgaaaccacagggcggggagcttgacctgctgattgcaatattgcctgacaataatggttctctttatggcgatctcaaaaggatatgtgagactgatcttggattggtctcgcaatgctgtcttacgaagcatgtttttaagatgagcaaacagtatttagcaaacgttgcccttaaaatcaatgttaaggtgggaggaagaaatacagtacttgttgatgctttgacaaggaggattccccttgtgagtgataggccaacgatcatttttggtgctgatgttacacatccccatcctggagaagattctagcccttccattgcagctgttgttgcttctcaagactggcctgaggtcaccaaatatgccggattagtgagtgcacaggcccatcgtcaggaattgatacaggatctttttaaagtatggaaagatcctcaaagaggaactgtaagtggtggaatgatcagagagcttctcatttctttcaagagggcaactggacagaaaccccagaggattatattttacagggatggtgtcagtgaaggacagttttatcaggttctgttttatgagcttgatgccattagaaaggcatgtgcatctttggaagccgattatcagccacccgttacctttgtggtggtccagaagcgtcatcacacaaggctgtttgctaataaccacaaggaccagcgcactgttgacagaagtggaaatatactaccaggcaccgtggttgattcaaagatatgccatcctactgagtttgatttctacctgtgtagccatgcgggcattcagggaacaagtcgccctgcacattatcatgttctgtgggatgagaacaagttcactgctgatggtttgcaaactctgacaaacaacttgtgctacacctatgcaaggtgcacccgttccgtatcaatcgttcctcctgcatattatgcccatctcgcggcatttcgagctcgattttacatggagccggatacttcagatagtgggtcgatggcgagcggtgcccatacccgtggcggtggcccccttcctggtgcacgcagcactaagcctgctgggaatgttgctgtaaggccgcttcctgatctgaaggaaaatgtcaaacgtgtcatgttctactgctaagtttgggaatatttgtgtatgggggaaaacgtctgacggtttgagtcgccccctgttatctaagacggaacgacctatagtgtgtgtacgttaatgattgtggtgctgtgaactatcgaccatgatctggttgtttatctattatcaacactagaagttgaggattctagactctttcagtgtggctactcaaatcatatcgtcgaagaaatgtaataattgacaattacattgctgccatgtttccaggacaagctgatctcagctactgcggttcctttccacttgttggatgcgcaccttgattcgc

SEQ ID NO: 1702 - DNA, 3168 bp, Oryza sativa
  Predicted polypeptide sequence is orthologous to G1146
atgtcttcgcgcggcggcggcggcggaggccgccgcggtgggcgaggcggcggtggtgggcgggaaggaggcggaggtggaggtggaggtggcgggaggggtggccagggtaggggcgatctcggcgtcgtcggcgagcggcaaggcggtggtcgaggggcgggtgagcgcggaggccgtcacgacgcgccgcgcggccgtggcggcgtcgctgtgggcgccggggctgggcggcagcagcagcagccattccacgccccggccccgccatctggcggcggcggacgaggcggcgtgcaggtgcagcccaatgcggcggcgcgtcgacccgtaggcggcgggcgcggcggcgtcggagtgccggcgcctgcgccggcggttgcggtgggggctctgtgcggcgagatgaaggggaagatggttgtgtcgggtggagcgccgccagcaggccagggttcgtcgttggcggcggcgcagggcacggacaatgtcaagagagagccatctcaggtcgccgcaccggcgcccgcgcccccgcccgcgacgctgccgccgtcgtcgagcaaggcggtgaccttcccggcgcgtccggacgtcggcacgatcgggaggcggtgccgcgtccgcgccaaccatttcctggtgcaagtcgcggacaaggacatctaccactacgacgtggtgatcactccagaatcaacttatcgtgagagaaatagatcaataatcaacaaacttgttgcgttgcacaaacaattcttggatggtaggttacctgtctatgatggaagaaagagcatatatactgcaggtccactacctttcaaaaccaaagactttgttgtcaagcacattaatcctttgaggggtaaccaacgggaggaggaatacaaggtgaccataaagcaagcctccaaaacagatctgtacagccttaagcagtttttggttggaaggcagagggagttgccacaggacactattcaagctcttgacattgctcttagggaatgccctacctcagtaaattttacttgtgacaggtatgtatctatctcaaggtcatttttctcccaatcatttgggcatggtggcgagattggtagtggtacagagtgttggagggggtattaccaaagtctgcgccccacgcagatgggactgtcgctaaatatcggtatggatttacctcaaaatatttctgcaacagcattttacaaggcccagccagtgatggactttgcagttcagtatttgaacatccgagatgtttcaaggcgcttgtctgatcaagatcgtattaaactgaaaaaggccctaaaaggagtccaaattgtggcaactcactggaaagagaaatccatacgttacaagatcactggaataccctcagctccaatgaatgaattgatgtttgatctagatggaaacaggatatcagtcgtccaatactttaagaaacagtacaattactccttaaaacatgttaattggccatgccttcaagctggcagtgatagcagaccaaaatatttgcctatggaggtctgcagtatacttgaaggacaacggtattcgaagaagctaaatgagcatcaagttacaaacattctaaggatgacatgtgaacgacccgcacaaagggagagcagtatcatagagattgttaatacgaactcttatggcaatgatgattgtgcaaaagaatttggcatcaaagtcgctaaccaacttgccgtggttgatgcccgtgtactgcctacccctaggcttaaatatcatgactctggaagagaaaaagtatgtaatccttccgttggacaatggaacatgattaacaagaggatggtaaatggaggatgtatcaaccattggacctgcctatcttttgcttctcggatgcatgtaaatgacattaggatgttttgtgaagacctggttggcatgtgcaataatattggcatgcaaatgaatacgagaccatgtgtggatatcatacaaggacagcaacgcaacatcgagggtgcaatcagaaatatccataggcaatcttcagaaaagcttgaccagcaagacctgacagggcagcaacttcagttattaattgtaatattgactgaaattagtggttcttatggaaggataaaacgaatttgtgaaacagaggttggtgtgataactcaatgctgtgcacccaagagtcttcagaaaggtgggaaacagtatcttgaaaatctggccctaaaaatgaatgttaaggtcggggggcgaaatacagtacttgaagatgcgttgcacaagaaaataccaattctgacagatcgtcctacgatagtgtttggagcggatgttacacatccatctcctggggaggatgcttctccatccattgcagcggttgttgcatccatggattggccagaagttacaaagtacaaatgcttggtatctacacaaagtcatagggaagaaatcatatctaatctttacacagaagtgaaagatccattgaagggaattattagaggtggaatgattagggagttgctcaggtctttctaccaagaaactggacagaaacctagccggattatattttatcgagatggtatcagcgagggacagtttagccaagtgttgctttatgaaatggatgcaattcgcaaggcatgtgctagtttgcaggagggctaccttcctccagttacatttgttgttgtccagaaaaggcatcacacccgcctatttccagaaaatcgtcgagatatgatggatagaagcggaaatatccttcctggaactgttgttgacacaatgatctgccatccgagtgagtttgacttttacctctgtagccattctggtatcaaggggacgagccgtccaacacattatcatgttcttttagatgaaaatgggttcaaggctgatacgctgcaaaccctaacctacaatcttagctacacctatgcccgatgcacccgagcagtctccatagttcctccagcatactatgcgcatctgggagccttccgagcacgctactacatggaggacgagcattctgatcagggctcttcttcctccgtaacgacgcgaacggatcgatcgacgaagccgcttcctgaaatcaaggagaatgttaagcggttcatgttctactgctga

SEQ ID NO: 1703 - DNA, 690 bp, Oryza sativa
  Predicted polypeptide sequence is orthologous to G1146
gtggatccccgggctgcaggttttttttttttttttttttttgaggtcaaaacgacttatagtatagaaaggagagagtacaaccctaggagacaggtcaccacagtccacaagcatttaacagtagaacatcacacctaggacacgatcagcaatctttggaacattcagaaactcaggcaactcagaagacacttcattcctgatgcttgatccatcgccaaacttcccgagatagcttcgtcctcgggctgcagcaagatgagcatagtatactgggggaactatagaaacagcacgggtgcatcgtgcatacatgtaacataggttgtgcgtaagcaactgaagcccgtcagcagtgaaatgattttcatcgaagataactgtataatgcgtaggtctactgtttccctgagaagtatggctacacaaataaaaatcaaaacccgaaggatggcatatgtcttggtcaatcacagttccagagggaatctgtgcaacttgttcagtataattactgcaaagtgtgtgagggaaaatcctggtgtgatgccttttctggacaatcactaatgtgatgggtggcagataatcctcttgtagagagaggcatgccttcctgatggcatctacttcatgaatgataacctggctgaattgactttcgcttattccatctctgtaaaagat

SEQ ID NO: 1704 - DNA, 1548 bp, Oryza sativa
  Predicted polypeptide sequence is orthologous to G1198
actcactatagggctcgagcggccgcccgggcaggtgtcgctcgtcgacccctctccgccgccgaggctcgctgtcccaagctaatccgtccgcttcgttgaggattccattgaatgcttggctgtggtggagtgctacactgctagtagcagcttgcatctcagcaatttgggtgaaccccccacattcttgaggcagtaacaattggatctacatcttgccactacaaaaggatcaacgatctgtactagccttcatttgtgggttcctcattgggaattgggattctttacaatggcagatatgagccctaggacagatacatcaacagatgataccgatgataaccacatgcttgaaccaggtcagcttgctcttgctgctgcttctgactctgacagatccaaggacaaacatgaagatcaaaagacattgcgtcggctcgcccaaaatcgcgaggctgcaaggaagagtcgtttgaggaaaaaggcatatgttcaacaattggagaatagcaggctaaagcttacacaactagaacaagaattgcaacgagctcgtcagcagggcatttttatatccagctcagtggaccagactcattccatgagtggaaatggggcattggcttttgatatggagtatgcacgttggttggaagaacacaataggcaaattaatgagctaaggtctgcagtcaatgctcatgcaggtgataatgagctccgtggtgttgttgacaagatcatgtcacactatgaggagattttcaagcagaaaggaaatgcggccaaagcagatgtctttcatgtgttatcaggcatgtggaagacaccagctgagaggtgtttcttgtggctaggaggattccgaccatccgagcttttaaagcttctttcgacacagcttgaacctctcactgagcagcagctgtcagggatagccaaccttcagcagtcttcacaacaagctgaagatgctctttcacaaggaatggaggcccttcagcagtccttggcagaaacattggctgggtctcttggttcttctggatcaacgggaaacgtggcaaactacatgggccaaatggcaatggccatggggaagcttgggacccttgagaatttccttcgccaggctgacaacctgcggcagcagactcttcaacagatgcaaaggatactgaccactaggcagtctgcccgtgcgcttcttgtgataagcgattactcttcgcggcttcgtgcccttagttccctctggcttgctcggccgaaagaatagcaagcgcaagtaacttgactgcaaccacatttttcgggtttgggaggtgatggtgatcttacctggaagagttgacaatcctgcaaaggacttgattcggagatatttgcacatactataatccaaaagagatccttgtgttcaggtagcttagtcttatggttaagtgcattaggccctggcccatgttgtactgttagccgctgtaaaatactgttccattattacttatgtatctgtaatatcctaattttcagagaatg

SEQ ID NO: 1705 - DNA, 2155 bp, Oryza sativa
  Predicted polypeptide sequence is orthologous to G1198
tcgagcggccgcccgggcaggaaaccgctcctcctcctcctcccaaatccaccacggcgacgccgccgccgcagagcccctagctcccggaggtccctcgcccccgccagctccgacggcctcacggaaggaggagtaacgtgggcgttgattggatttttttgttttccccccaccttgagtgagtctgtgccgtttccccggcggcgagggagggcagagggctgatcatggtcgtgcgccgccggtgccttgccgagatttcccccaaccgccaccgacgatcgttcacttggcacaaaggggagtagcactgtccaagctgttgtggtccgtcagggagattggccaacctgtggggtttcagatcgacataagtacgtcagtatttcagccatcgatcaatctggcggttatagggctgtgcttgcaacctttctggcagaaaggagagagcaaagtgatttgctgtctcctgttgattgtggcctgttgaggcccagtaatggcagatgctagttcaaggactgacacatcgattgttgtagacaacgacgacaaaaaccaccagttagaaaacggacatagtggtgcagtcatggcttctaactcttcagatagatctgacagatctgacaaacttatggaccaaaagacaattcggcggcttgctcaaaatcgtgaggcagcaagaaaaagtcggctgaggaaaaaggcatatgtgcaacaactagagagcagtaagctgaagcttgcacagctagagcaggaacttcagaaagctcgtcagcagggaatcttcatctctagctctggagaccagacccatgccatgagtggaaatggggcattgacttttgacttagaatacactagatggctcgaggagcaaaataagcagataaatgagttgaggacagcagtgaatgctcatgcaagtgacagtgaccttcgtcttattgttgatggcataatggcgcattatgacgaggtattcaaggttaagggtgtagctgcaaaggccgatgtgtttcatatactttcaggcatgtggaagacacccgcagaaagatgcttcctgtggcttggtggtttccgtccatctgagcttctaaagctcctagcaaatcacctcgaacctttaaccgagcagcagttgctgggattaaacaacctccaggaatcttctcagcaggcggaggatgcactttcacaaggtatggaagcactgcagcaatctctggcagatactttggctggatctctcggttcatcagggtcttctgggaatgtggcgaactacatgggtcagatggcaatggccatgggtaaactaggaacgctcgagaatttcctttgccaggcggacaacctgcgacagcagacattgcatcaaatgcaacgaattctgacgatccggcaagcctcgcgtgctcttcttgccatacacgattacttttcacgcttgcgtgctttgagttcgctgtggcttgctaggccacgggagtaacaaaatggtcatgtgtgcctgtgacgaggttagacgctcattttgatggactgcagataattgggtttttccctgtacaattgtgtttggcagctgtggactaaagttaaaaactgtacctaaagtggtgtatgcaaataggtgaagcctctaagtaattataacgattgcattattgtgttagcaataaaagttgggtaattcaggatgtgtcctgagttgttttgttgtagtagaagaactgcatgtagtggctggaaatgcagtgttgaatgtaactaaagctctgctgctcacgttgcataatgttgtgtagtaatagttagctagtgatgcccattttacctgcactcctctgggaagctgaaactgcaacctgaagcaaccacggtgcagaagaccgcatgcatggtaaatgattaaaaggatatatatgggctcaacatcgctgccaaatcctgagataatgaacaggcatgctaaactgctacttccacatgaaacctcccagttgacatgaagaatgagctgttcagttttatggtttctgtgttgcactgtacataattcctgtacgggtctgaatttatcctgaaatcatgctaaactgcagaagcatatgaaatctccagaccggttgacatg

SEQ ID NO: 1706 - DNA, 1654 bp, Oryza sativa
  Predicted polypeptide sequence is orthologous to G1198
tcgagcggccgcccgggcaggtcgcctcgcctctctctcttccttctgaccaacccgacctcggcgcctccccccatttctctctctctctcttcgcgttgccgtctcgaccccgcctccaccgccgaagccgcccgaggcggcggccgccggcagctgggctcctccgaatccgaacacggcggggtctctcccctcgctccccacggcggttggcacctgctggctctcgatccaacgtgtacagctaatttgatctgttggcgccttagctagaaaggtggcgactctggcatctcagtgatcatagggcatttgaaggtggcctgcatccctgttacaagtaagggacaacaaagcaatttgttgtctctttatttggagctgggaagaacccggcatggcagatgctagttcgaggactgacacatcaacagtcctggataccgacgataagaatcagatggtagacgggcaaagtggagctattgtgccttctaattcatctgatcggtctgacagatctgacaagcccatggaccaaaaggtgttacgccggcttgctcaaaatcgtgaggctgcaagaaaaagtcggctgagaaaaaaggcatatgtacaacaattagagagcagtaagctgaaacttgcaagcttggagcaagagatcaataaagctcgccaacaaggaatttacatttcgagctcaggagaccaaactcatgctatgagtggaaatggagctatgacttttgatttagaatatgcccgttggttggaggaacaaaacaagcagataaatgagctgaggactgcagtaaatgctcatgcaagtgacagcgacctccgtctcattgtagatgggataatggcgcattacgatgagatattcaggctgaagggtgttgccgcaaaggctgatgtgtttcatatactttcaggcatgtggaaaacacctgctgaaaggtgcttcttgtggcttgggggttttcgttcctctgagcttctaaagcttcttgtgaatcagctcgagccattaactgagcagcagttgttgggactatcgaacctccaacagtcctctcagcaggctgaagatgctctatcacagggaatggaagcgttgcaacaatccttggcaggtacgttggccgggtcccttggtccatcaggatcttcagggaacgtggcaaactacatgggtcaaatggctatggccatgggcaaacttgggacccttgagaatttcctccgtcaggctgacagtttgcggcagcagactttacatcaaatgcagcgaattctgacaatccgacaagctgcccgtgctctacttgcaatacatgattacttctcacgtttgcgtgccctgagttctctctggcttgctaggccacgggagtaacaacacatagggtgcatcaccgttaatgcttcatgaactgatctgggaggaacggcggagcgggactgattgcggatgcatttgcagaagattggtggctcagttccctcggcacaagttgtattgacaccttttggtttcatgttgtacctgatgttgtacaagtagggtaaagcttgtaacttgtaagttatggtgaatttatgattggcagattgtacaattgtattagcaataaaataaaaggtaggt

SEQ ID NO: 1707 - DNA, 1565 bp, Oryza sativa
  Predicted polypeptide sequence is orthologous to G1198
atcatcttcttcctcctcccgacctcccgctcctccgcactagtccgaatccgagctccaagtcgtcgagcaacctcaccgccggaggacaccttccgccgctcgccgtcgccgccgccgccgccgccgcgcagcatggcgtagcggtggtgggcatggcggcgcaccaggggatggcggcggcgacggcggcggaccggttctgcctgccgaggatggcggcggcggcggcggccgcctcgcaggtggagaactggggcgactccggcgtcatcgtcagcagcccgttcaccgacgacacctccaccgacctcgacgacagcgccgacaagcaccacctccacgctctagtgggcggcggcgatggcggcgacgacgccggcgagcagcgaggcgcggattcctccgccgtgtccaaggaaagaagaggggatcagaagatgcagcggaggcttgcgcagaatcgcgaggcggcgcggaagagccggatgaggaagaaggcatacattcagcagttggagagcagcaggtccaagctgatgcaccttgagcaggagctccaaagggcaagacagcagggaatcttcattgcaactggaggctccggcgatcacgggcactcgatcggaggaaatggtacgttggcgttcgaccttgagtacgcgcggtggctggacgagcaccagcggcacatcaacgacctgcgggtggcgctgaacgcgcagatgagcgacgacgagctgtgcgagctcgtcgacgccgtgatgatgcactacgaccaggtgttccgcctcaagagcttcgccaccaagtccgacgtgttccacgtcctctccggcatgtggatgagccccgccgagcgcttcttcatgtggctcggcggcttccgctcgtcggagctcctcaaggttcttgccagccatcttgagccgctgacggatcagcagctgatgggcatctgcaacctgcagcagtcgtcgcagcaggccgaggacgcgctgtcgcaggggatggaggcgctgcagcagacgctgggggacacgttggtgtcggcggccgccaccgtggtcagcggcggcggcggcgccgacaacgtcaccaactacatgggacagatggccatcgccatggccaagctcaccacgctggagaacttcctccgtcaggctgatctgctgaggcatcagacgctgcagcagatgcaccggatcctgaccacgaggcaagcggcgcgggcgctgctcgtcatcagcgactacttctcgcggctccgggcgctgagctcgctgtggctggcgcggccgagggactagactgactaaagaggatcaatatcatttgcctgagttctgagttctgacgatggatggaggtgaacctgttttttgattgctgaatcctgagagagcgttaactgcgatcggcattgtaaaatcagttgctttggtgatgaagcagtagtagtaggagaatattttagattgggctcttgggcctgtaacgtgttgtagtgttagcgtagtaagaactaatccgcgtacaatgtcaaaaggagaagttttatt

SEQ ID NO: 1708 - DNA, 1831 bp, Oryza sativa
  Predicted polypeptide sequence is orthologous to G1198
tattatgctcaggttattcatcattatccacagatatgttttttcttctttgcaaatattctccttttcccagagccgcattggactccaatacaagagtcagagggtggaagcaaagaaatcgtagtaaatgatctctactggcctctgtagccaaaggattcagcaaatctgcgaagacctcacgagtcaggagctttccaggagttgcaacctgcagctgctgcttactttggtgagttggagaaggcccttatccatggcaccagtgctggtgctggtgtcgatcatggcatgatccaaagtgacgcgtacacagagtcagcaggatatcttgcagctaggccccccacactggaaatcttcccttcatggccaatgagtcatctacaggagccatacagtaactcgcagtcagtagggagcaccactgactctagctcagctcagaacacaatgtcacaggccgagttggtgtccccagcgagcatgaggtccgactctgggcaggaacagcaacaacaggaggtattgatggtgaccattgatgattacaactacaaacaaggacttggagcagcaatagctactgcaccaagctttcagcaacatgcaggaggcctagacatgaggaagcatggatccactagaaaagacggaaaactgttagatgccaagactgaaaggcgattggctcagaacagagaagctgcaagaaagagcaggctgaggaaaaaggcttatgtgcagcaacttgagactagccgcataaggcttcagcaaatcgagcaagagcttcagagagcacgctcacagggcttgtttcctggaggatgcagtgcacctggagatatgagctcgggtgctgtaatgtttgacatggattacacccgatggatagacgacgacagcaaatgcatggcagagctccagggcgcgctacaggcccagctccccgacggaaaccttggtgccattgtggaagaatgcatgcgccactacgacgagctcttccaccttagggccgtgctcgccagctccgacgtgttccacctgatgactggcatgtgggcggcgccggccgagcggtgcttcctctggatggccggtttccggccatcagaaattctcaaaatgctgatacctcagctcgatccactgacggagcagcagctgatggggatgtgcagcctgcagcagtcgtcggagcagaccgaggaggcgctcgcgcaggggcttcaccagctgcaccagtcactggccgacgcggtgggcggcggtcctctcaacgacggcgcagatgttgccaactacaccggcctcatggccctagcacttggcaggcttgagaacctcgagagcttttatcgtcaggctgataatctgaggcaggaaacgttgcaccacatgcggcgaattctcacaaccagacagacagctcggtgttttctttccattggagagtataatcgccgtctccgtgctctcagctccctctgggcttcacgtcctcgcgaaaacttcattgcgacagagaatgtcagccctacaggaactgaatttcaggttattcagcaatctcagcaaaatcaattctccggtttctgagacctcttctccaggagggtacaaattctgcatttctgccagtagcaaggtggagagagagagagagagagagagagagcgaatgtaatgttctatcattatgatattgagaaaggaacatcactaggaaaaaaaaagatggcagaaagttggaaactggggcggctcgatcacttgctatgttccaatggctcttgaattgaatgaagggttagctctaagc

SEQ ID NO: 1709 - DNA, 1974 bp, Oryza sativa
  Predicted polypeptide sequence is orthologous to G1198
ggatgcgtcgtcgccattagcggggagaggagcgggagagagctcgtcgggattattccgagctccatatccattgaaccgaaccagctctgagtgagagagagagagagagatcggagctgttgtttcttctcgtttctttgattggtggcggtgttgaattgaattgaattgatcgatcgattgtttcttggtgtggtggtggcggcgacggcgagcagcgcgccaaggtacatgacctcggcggcgccggcggccgcgcagttcgctgcgccggcgccggcggcgatggggatctacgaccgccggcaccatcccctcgccgccggcgtctggggagaccaccccttcatccgcccggacaccaccgccagcaccagcaacgccgccgccgccgccatggtcgtcgcgccgccgccgctaacagagcccaagttcgagagccagctagctctgcctctgcagcatggagacgatcaagacaacgctgcagctctgcaagaatcgccgaggcatgcgtcggacagcttcgagcaggaggcgtccaagcctcgagacaagatccagaggcggctcgcgcagaacagagaagcagctcgcaagagccggctacggaaaaaggcttacatccagaacctggagacgagccggatgaagctggcgcatctggagcaggagatcacccgagcaaggcaacagagcgcgtacatcaaccgcagcagcaacccagccaccctaccagcgcccatcgattcaggtgtggtgacgttcgaggtggagtacgcgcagtgggtggaggagcaggggaggcagacggcggagctgagggcgtcgctgcaggcggcggcggaggggccggagctccgggcggtggtggaggcggcgctggcgcactacgacaggctgttcgcggcgaagcgtgaggcggcgaggcgcgacgtgttcttcgtgatgtccggcgtgtggcgcaccggcgccgagcggttcttcctctggatcgccgggttccgcccctccgaggtgatcagggtgctcgcgccgcagctggagccgatgacggagcggcaggccgccgacgtgcaggggctccagcagaaggcgcgccacctcgaggacgcgctgtcgcagggcatggacaagctgaagcagacgctcgccgactcgctgctcgccgaggccgtcgtcgtctccacctcctgcgacgcctcgccgccgccgccgccgccggaggaggaggagccgtcgtcctccgccgccggtgacggcggatgctacatggcgcagatggggagcgccatgggcaggctcagcaacctcgtcgcgttcgtcgaccatgtacgccatcgccgatcaccaccacctacctcccatctccatgtccgacgacgagcagagctcggctgacatcttgctgatgacgtgcaggccgaccatctccggcaggagacgctgcagaacatgtacaagatcctgacgctgccgcaggcggcgcgcgggctcctcgcgctcggcgactactgccagcgcctccgcgcgctcagctcgctctgggcggcgcgcccgcgcgagccggcgtaaagcgagctgagctcgccgccggcaacggccagcctgatcgatcaccggaggaggagcaagatgtcgtcgctgagctcgccggggaagacgacatggagctcaagtggctcagtttgagttctctgcattttcatttgcaaggacaggaaagaaattaaacggacgtgttcacttcatcataggatagcagcagcagcagtagctaggaggaggaggaggaggaggagaatttgaatttgaatttaaaagacgtgtaaatatttactacagtaattaacttgcttgggtagttatttgcgtcgctcaacttgtaattgctgccatttccatggataaaaaaaatgtcagggatggtcatatgaaaaattgggagtgattccaggcgcctgaagtttg

SEQ ID NO: 1710 - DNA, 4510 bp, Oryza sativa
  Predicted polypeptide sequence is orthologous to G1198
gtccttgcgccatctcgcggctgaaccggggaggggcgccgatctctatccgacgagcagaccaagggaggggaggggatcctgggttcacccaaatatttgaagacccaagcgtttggtgattggcaaagatgggttgggggatatcccggttgattggactgaaagcagctgtgttcctctctgtggcttatttcttccatagattggacatgacactgctttcttttcccctcatatatgcctctgtgattgcgatgcttgtttctattgcttcacatccatcaattgaccttcctttgctccttggcaaggggtcgaatggaagctttcctgtgtggtcatggatcatgttctcaccatttcttcttttcatccatctgtttgttctgttacgaagatttgtgaaaaatgagcccttgtacactgagattgctgatggagtgtatgttggagggtggccctcttcagttgagcgcctgccccctggtgaacctgcagtcatagactgtacgtgcgagctcccaagaagctctactatatccgagaattcatatttgtgtgttgccacctgggatacaagggctcctcaaccatcgcagattgagtctgccgtgagatgggcactgagaaagcgttcgcagaacaaagctgtatatgtccactgtgcctatggccatggaagaagcgtctgcgtgatgtgtgcacttcttgttgcattgggattagctgaggattggaaagctgctgagcaaatgattcgtgagaagcgaccttctattagcatgaattctcttcatcgtaaaagtttagaggaatgggcaaaacacttgctcactccctcaaaaagaagtggggaatcagatgtgagttatgcgattctttcggatcatacccgaaaaaggcattgatctcgcaagaaaactaacttgctcagtggctgtgataattgagatgaagtttaaatgctctggcattatctactgttatcctagtcatgtccaaggcatttcattctctaagttaattgtttgggagtatgttgtaaaacttctactactgtggcttacaacgccagctcttttaggcgctctgttggctgcgtttgttgccctgacttgggattagggttcacagatggaatttcgcgaaaaccaatcggatttcttgaaactgctaggtctcggtttatgaaaaccggaccagttttgtaccgcattgaccgaaagtcatcggtttttaccggtttttggtcggatttcggtaaaccggtgaggagcggtttttacttcgaaattgaaaagtaaaacccttgttgggaacctttccttccccttcggcacaaaaaatagagcaactcattagcgcttgagcaattaagttagctcaaactaacttaaaaaatggatttaatatgatttttaaaacaactttgctatagaagagttttgcaaacaccatttagcattttgaaaaacgtgtgtgtggaaaattgagaggtataagttgggaaagctcgttgccgaacgcagcctaagaacaagttttataatagagccaactttaagtttatagcttatattagaattaacatgtatagtgatgagctataaggttatctctctatttttctcctctctctatctctctcatgcatatgcatttaatgtatttatcttgaagtatgtgaatagctatctcttgcataataagagccaatctttttcattttctaaattctctttcctccacataagtttatttgccttatagtgtactattaaacttgctctaatgatcttccctgtcattgaatgcttgccagagacgtggtattgtcggatctctctttctgaaaaagaggggcctctgctagcctgctagattctcatttatagcgaaatgtggtatgtttttcatttttggtagtttgcatctatctctctgttaggttcttttcatctggcctgaaataaatgctcaactattcaccactttgctgtacccctgtattctgtggacatttcatacttgactcatgaaaattttcatgtttgtatctcatgttttgtgtgtaatgatcgtggctaagctgtagtgtactcatcccatcatgctatcttgtgtggagtatgctcttctggccttttcataatttttgccatttttctgcccttgtctcaagcaccagtttgccagttgatggatcaaaatcaagagctgcactattggaacaatctacatcctacggaaagtcgcatgcctggcaagaaatatctcaaatggtcttggtagatgtcacatgacaaaagggttgcttttcacctttctagttctttgatcttcttatcagttgaattcactgatctgccctttcttccatttatttggtctttgaaaaaagggacttccatctatttgtttcttgttttactaataagcattgtgacattccttgtgacttgcgttgtttttctgtgtcctgttttttacatgtatttcagatgtacctcttagtgacaactattttgtctgtcaattgatggtattagatttgtcctccgtgatttcagagttcagacagttatcatctctcttccatcagtgccattagtgccaggttgggaaagccttatttgctggcacgttttcttttttcttttttttttttggtagtgttgatctgcgtcatgttctgttgttatctgtagatgtctattttcaaagtaagcttgggaacatcctacctttaaaaaaaatggcttgttcagcagaaatattagaggttgttttatgcatcgtcttttgggaggattttgtctgctcaagtcatgagcagccacgcatctcctgcctttgcattgctctggtctgcaacaattatttctgtgctaactcttcagcctgttcaagagccattggaagtttggaacaagtgagccagtgaccagcattgcattgcacctcaacaaatttttgcctcttccttttcctagtgatgttgctttctcaatactttaataatagaacattacaacccctctccctctcccaccctctctttctaacatcacttttggccggagtttacatcctccaggagaagctctcaaaatcctgagtactgattctgctgaggctgattatgcatcggttgcagctcggttcctgtgggactgacgctctcggtgccaatgaagttcctgttgcaagagaaaaaagagtcaatgccagccatgttcatctgtttctccgactagaagagatattgcacgaatatctgtcctcgatataacacatcaaatgatcaaatcaaccatccaccctatgaacactagtataattcatcgcttatctaatgactcgctggagataagcagttctgagtcttactcgcgaggacgtgaagaccagaggttgctgagagcacggaggcggcggtaatactccccaatggagaggaaacaccgagccgcctgccgggttgttagaatccgccgcagctgatgcaacgtttgttgcctcagattgtcagcctgcacatttgccaggaatgaagaagaaaaaaaaagtaagttctgcatgaatgatcaacggaacgggatgacaatgctaagctgttgacgtacctgctggtagaagctttcgaggctggcgagcttgtccagggcgatggccatgaggctcatgtagttgggcacgccggggccgtcgttgagcgtgccggcggcgacggtgtcggcgagcgactggtgcagctgctgcagcccctgcgcgagcgcctcctccgcctgctccgacgactgctgcaggctgtagatccccagcatctgctgctccgtcagcgggtccagctgctgtatcagtatctgcatatatagtcgacgatgagtatatattcgtgacacgcccatgcaggcaacgccggcgatgcaggcggcggcggcggcggaggcgaaccttgagaaggtcggaggggcggaagccgcccatccagaggaagcagcgctcggcgggggtagcccacgtgccggtgaggaggtggaagacgtcggagcgcgcgagcgccgccttgagctggaacagctcgtcgtagtgctgcatgcactcctccacgatgaggccaaggttggtgtccagcaggtgcgcctgcaggccgccacggaggtcggtcagccgcttgctgtcgtcgtccagccagcgcgcgtactccatgtcgaacatggccgcgcctgcaaacgattttactgcgccgtggtgagaactccgaggcacaccctcgtctgcaagctgcaggcttgcaggctgcagctgctgctgctcaacgcatcgaaaaaagaaacggacggctctgattaccagaactcatgtcgcctgctgctctgcaccccccaagaaacaggccctgacgatcaatcaagcaatgcgggtaccatattaaattcctgctaatttatttcatttctggatagtagaaaaaaaatagtactagtactagcatcagaaattc

SEQ ID NO: 1711 - DNA, 2225 bp, Oryza sativa
  Predicted polypeptide sequence is orthologous to G1198
gtgactccatgacaaaacaccttcaagtagagacaagacctatacctctctctcctttcctctcttcaaagaagaaaaaaaccagcataggagaaaggaaggacaagatctttccatcaactgtgtgattagcatgccccagaccggaaggtgaagctgctacactttcagatactccatatcaagattcaagagagagctaaagctataggagtgagcagcaatagcaagagccaagaacagctagctactccagctgagagccaagaaccggtcaagctttgcttcttgcacttcttgctagctaaagctactccggtcacttttctgctatagtagctcttggctcttgcttatcacaagagaccacaatcttgatcgaagaaatttgagctagcgcttcgttctgattcttggagatactgggagatcgagctgtggttttgtggctcgtaggatgggagaggctaggagagggcagaatcctcatcatgttcttggctatggcttccatggcaccaccttgcccaactccatggcttctgcaaacctcttcgagcaaggaggaggaggaggaggtggcgctgcctattttggagagctagaagaagctcttgttcatcaggttgccacactcaggaggagggctcaacaaactgcaaccaccaccacctctcaccatggacacaccactcccttctccactgctgctgctgcagctacagcaacagcaacagctaggcctcctgctacactggacatcttcccatcctggcctatgaggaggagctctcttccaacaccgaaggatggatgttcaaatgtaacggcagacacaacggactccgagagcagcagcaagaacaacggcgatcagggtgcagcagcagccgacatggcgagccagtttgatcagatcccacagcagcagcagaagcagcacaagaagatggcagcaagttccactcacagtgaccacaggatgacaaagacacttgatccaaagataatgagaaggttagcccagaaccgagaggcagcacgcaagagccggctgcgaaagaaggcttacatccagcagcttgagagcagcaagttgaggctggctcagatggagcaggatctcgagagagctcgttcccagggcctcttgctgggaggatcaccaggtggaaacaccagcgcaggagcggcgatgttcgacgccgagtacgggcggtggctggaggacggcgggcggcggatggcggagctgcacggcgggctacacgcgcacctgccggacggcgacctgagggcgatcgtcgacgacgccctggcccactacgacgagctcttccgcctgagggcagccgccgccaaggccgacgtgttccacctcatcactggcacgtgggccacccccgccgagcgctgcttcctctggatgggcggtttccaaccgtccgatctgctcaagacagtggcaccccagctagaccctctgactgaacagcaagtggttggcatctgcagccttcagcaatcatcgcagcaggcagaggaagctctctcccagggcctggagcagctgcatcagtcactagctgagaccgtcgccaatggcggctccgtggtcaacgaagccagccttgggagcttcatgggttacatggcccttgccctgggcaagctgtccaaccttgaaggctttgtcatacaggctgataacttgaggcaacagactcttcatcagatgcacagaattctgacaattaggcaggcagctcgatgtttcttggcaattggcgagtaccataatcgcctccgtgccctcagctccctctgggcttctcgtccccgagagatattggtggcagatgaaggcaactgtggagagctaagcatagcagcacaaccatctgaaagccaattttcagctttctgatttacaaggactttgaagactaaccttcagataggagcagaagtaagcaaaactgggaacaaattttggaagtaatctgacacgtgtgggaaacactgatatgagctgggaaacaatgcaagctccagaactaggaagatttctcagaacccagattgcatagaactcacatggtaatttgcctgagatgtcaaatgatttaatgtcctgcccagtgacaacaaaaaggggttagctagattttgttgctgaaatactacttatttatgtgatttagtggcaaattatgtttcccgtg

SEQ ID NO: 1712 - DNA, 1899 bp, Oryza sativa
  Predicted polypeptide sequence is orthologous to G1198
gagtggatgaaactccaaggctgattcaatttgccagtgtgtgagaaacgagaaacaaccaagaggctcatcaggatcaagtggctgatcatcatcatctctctctaggatgtagagctagtggtgatcatggtgcaaggtgaggagagttcttggaggatggcagcaagcacccaccatgagagagcaatacctctcaaccaagcacttgcctatggagtccaagcccatgcttctccttctgttgctgctgcaccacctgccagcttcttggacttccagcctgctgccgcggcagctgcctacttcggcgagctggaggaggccctcatccatggcgccaacgccggcggcgtcgtcgatcccggcatgatcagagccgacgtgcacagcaagtcggcggcagcggcagcgacggcaggatatctcgcggccaggccccccacgctggagatcttcccttcatggccaatgaggcagcaacagcagctacacagtgggaattcgcagtcagtcgggagcaccactgactcgagctcagcccagaacacaatgccgcagatggagttggtgtccccagcgagtatcagggcctcctccgagcaccagcaccagcagcagcagccggggcaggaggtcatgatggtgaccactgatgattacagctacaagccaggcctcgctgctgcctccccaagctttcagcagcagcatcagctccagcaccaccagcagcagcagctgcacggaggaggagaccatgacaagaggaagcatggatccacaagaaaagatggcaagtcagtggatgccaagacagaacggagattagcgcaaaacagagaggctgcgaggaagagcaggctgagaaaaaaggcttatgtgcaaaacctagagaccagcagggtcaggcttcagcagatcgagcaagaactccaaagagcacggtcacagggcctgtttcttggggggtgcagagcagcaggcgacatgagttctggcgcggccatgttcgacatggagtacgcgcgctggctggacgacgacagcaagcggctgaccgacctccgtggcggcctgcaggcgcacctgctggacaccaaccttggcctcatcgtggaggagtgcatgcagcactacgacgagctgttccagctcaaggcggcgctcgcgcgctccgacgtcttccacctcctcaccggcacgtgggctacccccgccgagcgctgcttcctctggatgggcggcttccgcccctccgaccttctcaagatactgatacagcagctggacccgctgacggagcagcagatgctggggatctacagcctgcagcagtcgtcggagcaggcggaggaggcgctcgcgcaggggctgcagcagctgcaccagtcgctcgccgacaccgtcgccgccggcacgctcaacgacggccccggcgtgcccaactacatgagcctcatggccatcgccctggacaagctcgccagcctcgaaagcttctaccagcaggctgacaatctgaggcaacaaacgttgcatcagctgcggcggattctaacaacccggcaggcggctcggtgtttcctctccattggggagtattaccgccgcctccgtgctctcagcaacctctggtcttcacgtcctcgcgagaacttcattggcaccgagagcgtcagtcccacaggaaccgagctgcaaccgatgcataatcagcctcagcagaatcagtactcaggattttgagagcttctcctggaggatgtaaactccggccaaaagtgatgttagaaagagagggtgggagagggagaggggttgtaatgttctattattaaagtattgagaaagcaacatcactaggaaaaggaagaggcaaaaatttgttgaggtgct

SEQ ID NO: 1713 - DNA, 2027 bp, Oryza sativa
  Predicted polypeptide sequence is orthologous to G1198
gtcatgacaaaaaccttcgagtgaagacaagaccctagaccgtctctctctctctctgaccaaggctagctagggaaggaagaacaaaaacagcataggaaggacaacatctttctctgaactgtgggattagtacgcccaagaacgtgaagctattacaccgtcagatatatcaagaagatgcaggcggagcaagagcaactgcgcacagaaacggtcaggcatgcctgctctccctcctgcttgtcataaaagggaagccacaagctgaagccagattgctagaaggtagttcttgaggactgaagcaaggtagaagaacttgagcttctggttcgtgtggagctactgggataagttggctgctgattgctgaagatgggagaagctagcagtagttcaggacatccaaggcagaatcctcatgttcttggctatggcttccatggagctatgcccaactccttgccttctgcaaacttgttcgagcagcaaggaggtgctaactattttggagaactagaagaggctctgatgcaacaggtggccacactcaggaggactcaacaaactgcaaccaccacctccacccttcatcatggagacaccacccccttctccaccactgctactgctgcggctacagctaggcctcctcctacactggacatcttcccatcctggcctatgaggtctctccacacacccaaggagggttcaaatgtgacagcagacacaacagactcggagagcagcagcaagaacaacagcaaccaaaatgcctcatcagaccagcatgtgctagtaggagacatggcaggccagttcgaccaaattccacagcaggaacaacacaagaagatggcaactaacagtcccactcatagcagcaagactggcaaggcgcttgatccaaagacgatgagaaggctcgcccagaaccgagaagcagcacggaaaagccgactgcgaaagaaggcttacatccagcagcttgaaagcagcaagctgaagcttgctcagatggaacaggatatccacagagctcgttcccagggcttactgcttggagctccaggtggaaacaccagctcaggtgccgcaatgttcgacgtcgactacgcccggtggctggaggaagacagccagcgcatggctgaactgcacggagggctgcacgcacatctgccggacagcgacctcagagccatcgtcgacgacacgctaacccactacgaccacctcttcaacctcaagggcatggcggccaaggccgacgtgttccacctcatcaccgggatgtgggcgaccccagctgagcggtgcttcctctggatgggcggattccggccctccgagctgctcaagacattgacaccccagctggatcccctgactgagcagcaagtggttggtatctgcaatcttcaacagtcatcgcaacaggcagaggaagctctctcccagggcttggatcagctgcatcagtcattagcagaaaccgtggctggagggtccccgttggatgaccccaacgtcgggagtttcatgggtcacatggctattgccctcggccagctatcaaatcttgaaggttttgtcatacaggctgataatttgaggcagcagactatccatcagatgcacaggattctgacagtcaggcaggcagctcgatgtttcttggccattggagagtaccataatcgcctccgtgccctgagctcactttgggcttctcgccctcgagagatactggtggcagatgaaggcaattgtggagagctaagcattgcagcacatccatctgagagccaatattcagccttctgaaatcctgtttcaaatgtattttgcaactaaccttcaaagtagggagcaaaagcttgttttttaaatgaaatctagcactctagcagatatgtgagaaactcagaagagagttgggaaacaatggaaggctccagctgcactagcaaaattttcagatggaatgaatgggattgcatgattttcagttactgatc

SEQ ID NO: 1714 - DNA, 3130 bp, Oryza sativa
  Predicted polypeptide sequence is orthologous to G1198
gacccaacccaacccaacctcaacctcaacctcaagctctcctcctccttcctcctctgctcctgctcctgctcctgctgctgccgtgtgctctgctggctgctcctgctggtgaggtggtggtctctctccccccacttcaccatctcctcctctccttcgccgccggcgcgcttgcttcctcctcagcacgccacctcctcgcccctcctcatagctcaatcagattactcgaccgtgcaaacatcctgaccattttctacagccccgcgctttagcgttcttgtttttttttttttggctgctgctgatttggtggcggcggctatcttggagagagatacagaatccgtgcttcttcttgagcgagctggttggttggtggcatgaggcgtggagagcttcagagtgagtgccatggcgcgtgttgattgctgttggtggtgagatggagggtggtaggctaggaggagcggcggcttcagcatcggcggcggcggcggcggacgcgcgcggcgggatgtcgggcttcgcggctcctcagcacgccatccatacaaatttgaacaacgtgcaacctactcaagttactgattttggggcacttgcgcagtctgctggattccgaatagaagatctcgctaatctcagtacaaatggtttgttcaatctgaagtcaaatgctcataccattatcaatgaccccctccaatttgagaattatgtaaagtctatttctccgtctaatattactacaacagcaacagtaacagtagttgaccctcagacactggtcccacaaaagggagcacaactgaatttggtaactataaggactggtaacgttgagaattggggggagtcgactattgctgatacaagtccaaggactgatacatcaacagatccagacactgatgagaggaatcagatgtttgaacaaggacagttagctgctcccactgcttctgattctagtgacaggtcaaaggacaaactagatcataagacacttcgccgccttgcccaaaatcgtgaagctgctaggaaaagccgtttaagaaagaaggcatatatccaaaaccttgagagtagcagattgaaacttactcagatagagcaagagcttcagcgggctcgtcaacagggcatttttatatcaacatcgagtgatcagtcccactcagcgagtggaaatggagctttggcatttgacatggagtatgcacggtggttggaggagcataacaaacatataaatgagttgagggctgcagttaatgcacacgctggtgataatgatctcaaaagtacagttgatagtattatggcacactacaatgaaattttcaagctcaagggtgtggcagccaaagcagacgtttttcatgtgctgtcgggaatgtggaaaacccctgctgagaggtgcttcatgtggctaggtggcttccgatcatctgagcttcttaaggtaagaatatactattattatattgcgcctacttattttgaagcctcacccggaggcaaaatgctgacctgaatatatattattttaattgatccaatatttttcttaggctctgttttttttgaaaggaatactaccaggcaatggcccagtagtgtattttatagaagccaacaaagtttttacagggaaaaaaagaaaaaatacaaaaggctacaaccccctatagaagctataaagtttgtaaccaattagaaaccaattgtctaagatcatcattcatcctacacatatgtagaagaatttcatgcttaaaagaattccaccagctgtcaaatgaaggatctatattctggaaaatctttccattcctttgcttccaaatgtgccaacacgcaatgaaataaatctccaagaatccttttttctgaaatctcaatcttgctagcaccagcatccttttttctgaaagaattctagagaagtgttccaagatattcccagcttctgccaacattttctactaaaagggcattgaaagaacaggtgagacaaagtttctctgtcatgcaaagggcataagacacaagtaagatcagcatttaggggggcgtattttctcctgtccaacatgtctctcgtgttcagcctatcagagaaaagaagccatatgaaaacttttatcttcatcacacatttgctcttccagatccatcggaaaggtctgggaggttgcgtggatgcaaaattcaacttgtaaaaagcttttgaggtgtaattgttcctgccccatataaaactccaattatccccctgctgacttgctaaggacagagcatccagctctccctttagcagcagaaattctgtgtaagcttcctgggtcagtggcaacttaaaacaatcctcaaaaggtttagcacaggtgacagccaaggaatcatttctggcaatggcatggccacatagatgtggttactggcagggcaattagagcctcttacagagcagcagcttgctggcatagccaacctgcaacaatcctcccaacaggctgaagatgctctttctcaagggatggaagcactacaacagtcgcttgcagagaccctggcatcaggatctctcggccctgcaggatcttctggtaatgttgcaaactacatgggacaaatggcaatggctatggggaaacttggtaccctagaaaacttcctacggcaggctgataatctgcggcttcagactcttcagcaaatgcagcgcatattaaccactcgccagtcagcacgagctctacttgcaataagtgactacttctcccggcttcgtgccctgagttctctttggctcgcccgtccaagggaataaataaattgaattgattcgtaagtaggatattgttaggtaatgtatctctagtgttatatcagataggaattgaggtattccctacttcctagattcttcacaatgttcatgtattggtgacagactcggatcactatctttccatgtatgtcttcaagtgaatgttcaatgcatattgtagtctgtatatgacatcatatgatgagttgttgggcaaatttgtaacatttttgagaaaagtggggatgtaaatacttgcagaataattttagagcttatccagtgatt

SEQ ID NO: 1715 - DNA, 2651 bp, Oryza sativa
  Predicted polypeptide sequence is orthologous to G1198
gtgcgctgttcctgcctacgagcgagagagagaatctcatctcgatgctgaacaagtaattttcccggttctgaatccgttcaatcatccaggaaaaatgtccggaattccaggtaagtaattttctctaatttcttatcctgatcagatttatagtgagattcaggggaatagagatctgctggctttttcatcggaaaatttcgctgaattgcgttcgcgaaaaaaaaaattcgctgaatttcgtacagcggatgatgaggattgaaaaggttgggtgctgcaaaagcgagagggggtggggaaagaagggcgcaagaccaatcaagccaaaaggaaggcaatgccacgaaggaatcggctagggttagccatccgcagccacagccgaggggttagcgggtttagccctagcccaccatgactgttgcggcgcatttcatctcctcctcgccgaggggaagaaaaaaccgcatcgcgacggcgacatcgggggggcctctttaataatgcttccatcagagagcatggccatggccatggccacgaccttgatcttgaggttagccggggtcgaaaggttcttcttcttttgcgcctttatggcaaaggggaattcttcgtcgtcacgcaccaagcgttacgcaattcgcaaaagaggagggagggcagctgtggctctttatataaccctgcatcacttcttctggctaactggtgtcctttggagctgagctacatagcacatccgtggagtctcttgtgctaagcaatttaccgttccagtgctctactttgtaggccatccatattagacggaagaactttatcagtattattattggaggagaccaattcaagaatgatataatggagctttaccctggctatcttgaagaccattttaacatccacaagcttagtatcagcagcgcctctcctccggagtacatgacctcggcgtcgacgcagttcgcggcaccggtcagaatgggggcgtacgaccggcctccgccagttggcatgtggagtcacgagcagttcaaggttgacaacggccaggccacgagtgcatccacgatcatggaggcagagatgaaatttgagaataggctagaagaaattccccaagtagttctggaggaagggagaaatgttgatcaggaggcaagcaagccgccagacaaggtcctcagaagacttgcacaaaacagagaggctgcacggaaaagccgcctgcggaaaaaggcttatatccaacagctggagacaagccggttgaaactagcgcagttagagcaagagcttcaacgggccaggcagcaggtacacggataacaatttgttgtgcagccacttcagcttacacttgtgtcactgactccattgcaaatttgcaactgctctgatgcaggctgtgtatgcaaatgggagccttcgagaaccaaatcttggatttacaggaccgatcgatccaggtgccttaggttttgagattaagtacagccattgggtggacgagcagaatcgcaacactggtgagctgaggaatgcgctgctgcaggggcagacgacggaccaggacctggagctcaagttgctcgtcgaggctgggctcgacaactacaaccgcctcttcgagatgaaagaggaagccgccaactccgacgtgttctacatcatgtcgggcatgtggaagacccccaccgagcggttcttcctgtggatcggtgggttccggccatcggaggttctcaagaatttgagaccgcagctggagcctctgacggacaagcaggtcgtggaagtgggcggcctgcagcaaacctcgatgcaggtcgaggacgccctctcgcagggcatggacaagctgaagcagacgatcgcggactccctgacggcggccgacccgttcgactcccccgaggcctacatggtgcacatggccaacgccgtggagcagctcagatccctcgtccagttcgttacccaggcagatcatctccggcagcagacgctgcaggagatgctcgatcctgacgacgcggcaggcggcgagggggctcctcgcgctgggggactacttccagcgcttccgagcgctgagctcgctatgggcagctcgcccgcgcgattcagggataagctaaacaccgtaatatggtcacggtagaagctactgatatcagtagcaattcgtcgtgttagttcgctacttcagtgtcaggtcaatggccagtgaaggatgaagagatctttctacctgtgcttcgtcgaagaagaacaactcgtgatcgactttctgcagcgccgctgcaactgcaatccaaggaatggtgtatgttcgcctgctgagatgaagaaataaccaaaattaactttggtctttctgatgtgggcacaagagaagatgtaatataatatgtaaatatatacatgttttgggtatcattgccagaggcctctacagctggttttatagacatgtgatgtaattatctgtaactagtgttgctcggttcctcctccctagtacggcagacataggtgacatactgccattgtattgtatgggagaacaaattagttcacttgagaactagaaaaacatgcagtgatgttttgctgaagttgaagtagtttctgccacc

SEQ ID NO: 1716 - DNA, 1605 bp, Oryza sativa
  Predicted polypeptide sequence is orthologous to G1198
atgagctctgtgcgctactgcttgggcagggacttccagcctgctgccgcggcagctgcctacttcggcgagctggaggaggccctcatccatggcgccaacgccggcggcgtcgtcgatcccggcatgatcagagccgacgtgcacagcaagtcggcggcagcggcagcgacggcaggatatctcgcggccaggccccccacgctggagatcttcccttcatggccaatgaggcagcaacagcagctacacagtgggaattcgcagtcagtcgggagcaccactgactcgagctcagcccagaacacaatgccgcagatggagttggtgtccccagcgagtatcagggcctcctccgagcaccagcaccagcagcagcagccggggcaggaggtcatgatggtgaccactgatgattacagctacaagccaggcctcgctgctgcctccccaagctttcagcagcagcatcagctccagcaccaccagcagcagcagctgcacggaggaggagaccatgacaagaggaagcatggatccacaagaaaagatggcaagtcagtggatgccaaggcttatgtgcaaaacctagagaccagcagggtcaggcttcagcagatcgagcaagaactccaaagagcacggtcacagcagcagctgcagcctgcaagcctgcagcttgcagacgagggtgtgcctcggagttctcaccacggcgcagtaaaatcgtttgcaggcgcggccatgttcgacatggagtacgcgcgctggctggacgacgacagcaagcggctgaccgacctccgtggcggcctgcaggcgcacctgctggacaccaaccttggcctcatcgtggaggagtgcatgcagcactacgacgagctgttccagctcaaggcggcgctcgcgcgctccgacgtcttccacctcctcaccggcacgtgggctacccccgccgagcgctgcttcctctggatgggcggcttccgcccctccgaccttctcaagatactgatacagcagctggacccgctgacggagcagcagatgctggggatctacagcctgcagcagtcgtcggagcaggcggaggaggcgctcgcgcaggggctgcagcagctgcaccagtcgctcgccgacaccgtcgccgccggcacgctcaacgacggccccggcgtgcccaactacatgagcctcatggccatcgccctggacaagctcgccagcctcgaaagcttctaccagcaggttcaggattgtagtgatcattctgcaaaaacaagtcctctacgatgcatggtgaatagatcaggttgtgttagatatacttgcatgagaaaaaaggtgactaacctggcaaatgtgcaggctgacaatctgaggcaacaaacgttgcatcagctgcggcggattctaacaacccggcaggcggctcggtgtttcctctccattggggagtattaccgccgcctccgtgctctcagcaacctctggtcttcacgtcctcgcgagaacttcattggcaccgagagcgtcagtcccacaggaaccgagctgcaaccgatgcataatcagcctcagcagaatcagtactcaggattttga

SEQ ID NO: 1717 - DNA, 780 bp, Oryza sativa
  Predicted polypeptide sequence is orthologous to G1198
atgaggtcccgcatcttgtggatgagccacgctgagcgcttcttcatgtggctcggcggcttctgttgctctgagctcctcaaggtacttgagagccatcttgagccgctgacgaatcagcagttgatgggcatctgcaacctgcagcagtcgtcgcagcaggccgaggacgcgctgtcacaggggatggaggctctgcagcagacgctaggagacacactggcatcggcggccgccaccgtggtcgtcggcggtgtaggcgccgacaacgtcaccaactacatgggacagatggccatcgccatggccatgctcaccacgctggagaacttcctcaagcttcggcagcagatgcatcggatcctaaccacgaggcaggcggcgcgggcgctgctcgtcatcaacgactacttctcgtggctccgagcgctaagctcgctgtggctggcgcggccgagggacgcgcgtcacggcatggcagagcgcgcatcgcaccgaccgcgcccccggcggcacggccaggtacgcgccgcagccactgcatcccgctgtcggcgaccacctccccacccaccggccggcctgcccaagaggagaaaagtgagagagagagagaaagagagagaggaggaagggagaggaggggaaagagatagggtgatgacgtggaatcctggcatgtggggcccacatgggttccacgctgattcagccgtcacgtcagacaaaaccgcggtcaaaaccaccgagggacctaaagtgaacggttttgtaagttga

SEQ ID NO: 1718 - DNA, 1193 bp, Oryza sativa
  Predicted polypeptide sequence is orthologous to G1275
aagagagtcggccaacccacatgcacgtgtaccgatgtacatggcggcggcggctgcgggagcaagcacacccttcaatttttgccgccacggctcgcacgccgagtacgacgccgtcttcagcggcagctggatggcgcgccgcccctccgcggcgccgcacggtggcggcgcctccggctccggctccggcagcggctacggcgccgcctcgtacgttgctcccaccttcggcgcggcgtttaggcagcagcatctcgacctcctcgactacctgtccgacgatcagggcgttccggcgccaccaccagcggctgtgcccagcgcgtcgtacgtgacgccggcgccggcgatggcccccgctgaaccggtcgtgccggatgctgttgccgccgccggcggctatccgaggagcgtggctgcggcggcggcggccgtggccggcgagggaagagatcggacgacgacggacaagatcgcattccggacgaggtcggacgatgagatactcgacgacgggtataagtggaggaagtacgggaaaaagtccgttaagaacagccctaatccgaggaactactaccggtgctcgacggaggggtgcaacgtgaagaagagggtggagagagacaagaacgacccgcggtacgtggtgacgatgtacgaggggatccacaaccacgtgtgccccggcactgtctactacgccgcgcaggacgccgcctccggccgctttttcgtcgccgggatcagtcacccagaccttaattaagctaggatatgctttgccggcccagctgtggcttagcttgatgtgcagctctagttattgtatgggctgtacggttcagttatttgaagcgggttatacttatatgttgttaatgtttgcctactgattttaattaatttcttagagttagactcaatttggcggagggattcccttcaaaaaaagaaatcccttcaaaaaatttggcggagggacgactgatatatatggtgacattagctaggtttgctcacttttggcaaaaataacaagtttcctttcgtgccactctccgtccctaggtcagtgtttggcaaaacgcccaaaaaaatgtccgtgttgccaattaatttgtcgattgtgtacttcaatttcaagccaaatttcggcaaagctagtactttgtgtgttttagatgttg

SEQ ID NO: 1719 - DNA, 1091 bp, Oryza sativa; identical to SEQ ID NO: 663
  Predicted polypeptide sequence is orthologous to G1275

SEQ ID NO: 1720 - DNA, 839 bp, Oryza sativa
  Predicted polypeptide sequence is orthologous to G1275
ctgtcaaacactcaatcagcagcagcagcagctagcttagcttagctaacgcacagtgacgcgagcatggcggcttcgctgggactctgccacgagacgtcgtacgcctactcgtacccggcgtcgaacacctcctcctccttgtgcttccctcctctcatggcggaccacatcgtcgacggcggcggcggcggcggctgttcctttggtgaattcctggagctcggccattccgtgtactcgctgccgcttccgccgccgccgtcgcagccggtggtggtcgccggcgggaacaatgatcagtatggcgtgtcgtcgtcgtcgtcggcggcggcgacgacgagcaggatcgggttcaggacgaggtcggaggtggaggtgctggacgacgggttcaagtggcgaaagtacgggaagaaggcggtgaagagcagcccgaacccgcggaactactaccggtgctcggcggcggggtgcggcgtcaagaagcgggtggagcgcgacggcgacgacccgcgctacgtcgtcaccacctacgacggcgtccacaaccacgcgacccccggctgcgtcggcggcggcggccacctcccgtaccctacttccgctgcgccgccgtggagcgttccggcggcggcggcctcgccgcctcccgcgcacgcgcaggcgtggggggcgccgctgcacgccgccgcggcggcgcactcgtcggaatcgtcgttctgaacgctgaatttacttctgtttttgtttttcttggttgcttgttagttgtaccgccgttcgtgatcgatcgatcggttcttgtatgcactagacttactacttaaaaaaaaaaa

SEQ ID NO: 1721 - DNA, 666 bp, Oryza sativa
  Predicted polypeptide sequence is orthologous to G1275
atggcggcagtcggcgcgcacgcagcggtctaccaccacccggtctcgggcctctcggcgccggcgggcgacgccgcctactcgatgtcatcgtacttctcccacgggggaagctcgacctccagctccgcgtccagcttctccgccgccctcgccgccgcaacgacgccgccgcttcccgacccgtcggggtcgcagttcgacatctccgagttcttcttcgacgacgcgcctccggccgccgtgttcaatggcgcgcccaccgccgcgctgccggatggcgccgccgcaaacgcaacaaggagcgcggcggaggcggtgccggcgccggcgccggcggccgtggagaggccgcggacggagcggatcgcgttccggacgaagtcagagatcgagattcttgacgacggctacaagtggcgcaagtacggcaagaagtccgtcaagaacagccccaacccaaggaactactaccggtgctcgacggaagggtgcaacgtgaagaagagggtggagcgggacaaggacgacccgagctacgtggtgacgacgtacgaggggacgcacaaccacgtgagccccagcacggtgtactacgccagccaggacgccgcctccggccgcttcttcgtcgccggcacgcagccgccaggttctctcaattaa

SEQ ID NO: 1722 - DNA, 1042 bp, Oryza sativa
  misc_feature (845)..(845): n is a, c, g, or t
  misc_feature (892)..(892): n is a, c, g, or t
  misc_feature (894)..(895): n is a, c, g, or t
  Predicted polypeptide sequence is orthologous to G1275
agtcgccgaggtcggcggaatccgggtgaccacgcgtcgcccacgcgtcgagaaaatcacggtgaaaaggttcagcactgtgcaatggcggcttccgtaggactgaaccctgaagctttcttcttcaacaactcctactcctactcctcatcccctttcatggccagctacacgccggagttctcggccgccgctatcgacgccaacttattctccggcgagctcgatttcgactgctctctcccagctccggcccaggagtacccggaaaatgaaaacactatgatgaggtacgagagcgaggagaagatgagggcgagggtgaacgggaggatcgggttcaggacgaggtcggaggtggagattcttgatgatggcttcaagtggaggaagtacggcaagaaagctgtcaagaacagcccaaatccaaggtacacgaatattgacgtcactgccactatgcccatttggctatcaatcttaattaattagtaccacaagtttaatcactagcttaattactggcgttctgcccaatcaaagttttataatcaccttttctgaaatatcatctgttcagggttaaaaattttagaatgcaaaaaaattgcggagatcttgaactgaattttcagacaaattttgtaatttgaacaggttttcactttacttgaaccgaatttgagaaaatccctcacatccgagggttgggcggattacttccaccgggaccctgttacccaatgattctttgaactgtacttgagggtcggaattgtccatatggtgggggaaatcaccctcatttgaacaacggggcgaggggcgcacgggtgaggggaganttccagggacaccgccggttcgtacaccccccgcgtggcaatacacntnngcgaacgtgcgtaaacaccgaggagacagctcgagaagagcaggacactggagacatatgaggaagaagcgacaaacatagaacattcgaacacaagcatgcggacgaacggtgagagaaagcaaaacagccagcacgaagcgaacg

SEQ ID NO: 1723 - DNA, 2119 bp, Oryza sativa
  Predicted polypeptide sequence is orthologous to G1290
cctcgcctcgcctcgccacgccgcgccgcgacgcgacgcgccgtggtcagctggtcgccggtgcgggtgcgggtgcgcaatggagccgccgaccagccacgtcaccaacgcgttctccgactcggacagcgcgtccgtggaggagggggacgccgacgcggacgccgacgtggaggcgctccgccgcctctccgacaacctcgccgcggcgttccgctcgcccgaggacttcgcgttcctcgccgacgcgcgcatcgccgtcccgggcggcggcggcggcggcggcgacctgcgggtgcaccgctgcgtgctctccgcgcggagccccttcctgcgcggcgtcttcgcgcgccgcgccgccgccgccgcaggcggcggcggcgaggatggcagcgagaggctggagctccgggagctcctcggcggcggcggcgaggaggtggaggtcgggtacgaggcgctgcggctggtgctcgactacctctacagcggccgcgtcggcgacctgcccaaggcggcgtgcctctgcgtcgacgaggactgcgcccacgtcgggtgccaccccgccgtcgcgttcatggcgcaggtcctcttcgccgcctccaccttccaggtcgccgagctcaccaacctcttccagcggcgtctccttgatgtccttgataaggttgaagtagataaccttctattgatcttatctgttgccaacttatgcaacaaatcttgcatgaaactgcttgaaagatgccttgatatggtagtccggtcaaaccttgacatgattactcttgagaagtcattgcctccagatgttatcaagcagattattgatgcacgcctaagcctcggattaatttcaccagaaaacaagggatttcctaacaaacatgtgaggaggatacacagagcccttgactctgacgatgtagagctagtcaggatgctgctcactgaaggacagacaaatcttgatgatgcgtttgcactgcactacgccgtcgaacattgtgactccaaaattacaaccgagcttttggatctcgcacttgcagatgttaatcatagaaacccaagaggttatactgttcttcacattgctgcgaggcgaagagagcctaaaatcattgtctcccttttaaccaagggggctcgaccagcagatgttacattcgatgggagaaaagcggttcaaatctcaaaaagactaacaaaacaaggggattactttggggttaccgaagaaggaaaaccttctccaaaagataggttatgtattgaaatactggagcaagctgaaagaagggacccacaactcggagaagcatcagtttctcttgcaatggcaggtgagagtctacgaggaaggttgctgtatcttgaaaaccgagttgctttggcaaggattatgtttccgatggaggcaagagtagcaatggatattgctcaagtggatggaactttggaatttaacctgggttctggtgcaaatccacctcctgaaagacaacggacaactgttgatctaaatgaaagtcctttcataatgaaagaagaacacttagctcggatgacagcactctccaaaacagtggagctcgggaaacgctttttcccgcgatgttcgaacgtgctcgacaagatcatggatgatgaaactgatccggtttccctcggaagagacacgtccgcggagaagaggaagaggtttcatgacctgcaggatgttcttcagaaggcattccacgaggacaaggaggagaatgacaggtcggggctctcgtcgtcgtcgtcatcgacatcgatcggggccattcgaccaaggagatgaacaccattgctcccaaatagttgccatattgatagctaactgtcctcctggagctactcacctgatggttgccttctgtcaattgccccccaaatatattctcaatggtttaggcttgtacagtattagttcttacagctattgccccgtcaattgtgaaacgcagaagtttcactagtgcttgtactcgaggtgtaatacaagtgcttgaattttgagttgtacttggaatttccagtggtttgctcgtaaaaatgagatgatttcttggcaaaaaaaaaaaaaaaaaaa

SEQ ID NO: 1724 - DNA, 496 bp, Oryza sativa
  Predicted polypeptide sequence is orthologous to G1290
ccagcgcctcatcttcgccaacaccgctgcagcagggagactgtaggccttgaggtgctaatatctgtcaggcctatccaggaggtagccagccggcggcaacggctgttccacgccgacatgtgatgtgtgcaattatgtctgtagacactaagtaatgtttatcgtcgatgacttatatgtaccgtggcttatctgtatgagacactttgtaatgcttgctatatactccctccattttaaaatgtttgacacggttgactttttagtatatgtttgaccattcgtcttattaaaaaaatttaagtaattatttatttttttcatatcatttgattcactgttaaatatattttcatgtacatatagttttacatattttacaaatatttttgaataagacgaacggttaaacatgtgctaaaaagtcaacggtgtcaaacattttgaaacggaggaagtatgtggcttgtgctagttgtgcaaattctgtcca

SEQ ID NO: 1725 - DNA, 1553 bp, Oryza sativa
  Predicted polypeptide sequence is orthologous to G1361
ggttccctcctctcctcctttctctctccctcctcccgcgcgcggggtctcgccttaacgtttgccgcatatgggggcgacgagcaaagcgtaggccggagggagggacagggagagagagagagagaggctttctggctcgctctctctgcacgatctctcgtcttgttggattatacagccatgacatggtgcaacagcttcaacgacgtgcgcgccgtggagaacaacctggccaccgccgccgccgtggccgcggccaagaagcagcagcagcagcagcaggtctcccagcacgtcaacctcatcaagacctgcccctcctgcggccaccgcgcgcagtatgagcaggcagcggcggcggcgacgatccaggacctgccggggctgccggccggggtgaagttcgacccgacggaccaggagctgctggagcacctggaagggaaggcgaggcctgacgcgcggaagctccaccccctcatcgacgagttcatccccaccatcgagggcgagaacggcatctgctacacccatcccgagaggcttccaggagtcggcaaggacggcctgatccggcacttcttccaccgcccgtcgaaggcgtacacgacggggacgcggaagcggcggaaggtgcacaccgacgagcagggcggcgagacgcggtggcacaagaccggcaagacgcggccggtgttcaccggcggcaagctgaaggggtacaagaagatcctggtgctctacaccaactacggcaagcagcgcaagccggagaagaccaactgggtgatgcaccagtaccacctgggctccgacgaggaggagaaggacggcgagctcgtcgtgtccaaggtgttctaccagacgcagccgaggcagtgcggcggcggctcggcagcgacggccaaggacctctccgtcgacctcgtcgccggtaacaacatcaaggctagcaatgctgctgctgaacaccaccataacgacggcgtcggcggcggcggccacggtggcaacaacagcagcatgctgaaggaagctgcaggcattgtagatttctacaacccagcggcggcgctaatcggctacagccaggcggctcctaacaacagggcggctgcttctgctcatttgacgatgcctaactttgaggtgcacacaggaggtgcaggctttggcccctgatggatggaagaaaacaaagcaaattaaacatatttgactgatgatatatataggttagatggagagggcagggcaggtatatgatggcaaatgtgcatcatgcatgctagcatggtgtaatttgcatcgagtgaaaaaaaaggagtttactaaaccgtctacgtacgtattactggacaataaggagtgtgtcgagtgagttgctgcacagatgttgaagcgtaggggggtcgatattcttacagtgttcattattgttacatgtgtacacatatataacttgacattctcaatttttttgtttaatgatatatatatatatatatatatatatatatatatatatatatatatatatgttgttctat

SEQ ID NO: 1726 - DNA, 1539 bp, Oryza sativa
  Predicted polypeptide sequence is orthologous to G1361
gaagctttccttcttcttttttccccctctcgacgatctctctctcatcaggaccccggccttaagttgtttcttccctatcagctcaggtctctctcgatctctcctagctagatagatagcttaattagcagctagagatgtgtctctagctaagctaactagctagtaggcttcttcttttaatccggcattgttcttggctgctggtcttagtttttggctgtcatgtatggagttagtggtaaaatactaggttaattaataatataaggcgtgtgtatatattggtgtggaggaggaggagaaagggggttggccggagagatcgatgacgtggtgcaacagcttcagcgacgtccgcaccgccgtggacagcagcttgtcgccggccgccgccgtggccgccgccgcggggaagaaggcggcggcgtcgctcgccgtcctcgtcaagatgtgcccctcctgcggccaccgcgcgcggtatgaacaggagacgacgacgatccaggacctgccggggctgccggccggagtgaagttcgatccgacggaccaggagcttcttgagcatttggaagggaaggcgaggccggactcgaggaagctccaccctctcgtcgacgagttcatccccaccatcgagggcgagaatggcatctgctacacccatcccgagaggcttcccggtgtgagcaaggacgggctggtgaggcacttcttccaccggccgtcgaaggcgtacacgacggggacgaggaagcggcggaaggtgcacagcgacgaggtcgacggcggcgagacgcggtggcacaagaccggcaagacgagaccggtgatggccaacggccggcccaggggctacaagaagatcctcgtcctctacaccaactacggcaagcagcgcaagccggagaagaccaactgggtgatgcaccagtaccacctcggctccgacgaggaggagcgggacggcgagctcgtcgtctccaaggtcttcttccagacgcagcccaggcagtgcggctccaccgccgccgccgccgccgccaaggaggcctccgccgccgtcgccgccgccgtggtgaacagcaactactccatcgtccatggccatcaaggtggtggtggtggtagctttctcaaggaggcaaacgttgtgcacgagttctacgacccggcagcaacgatgggttaccggccacctgctcctgctgcgcacttcgcgccaaacttcgcggtgcacgcggcaaggaacagctttggtggcccttgaaggaaaaaccaaaattacacaaaatctaaacattaccgtttataccgatatgattcacataggtgccattatattacattcttaaccttacattcatccatcagttatttgcagttttgttcaaagttgttatatcgtttccgatgctatactgtgcaaagattattactacacgccgttctaactcgaaaatgtcaattaatgtatcagtttgtacatgtatacatgcacacggaagaggtcctgatgatgcatcacttcat

SEQ ID NO: 1727 - DNA, 717 bp, Oryza sativa
  misc_feature (20)..(20): n is a, c, g, or t
  Predicted polypeptide sequence is orthologous to G1361
cttcgccaagaagcgcaagncggagaagaccacctgggtgatgcaccagtaccacctcggcgagctggacgacgagaaggaaggggagctcatcctctccaaggtcttctaccagacgcagacgcggagcgccgccgcagcagaggcaccggtaagctcgggtgctgccatggaggtgcagggacagcagcagcaagtgctgaagctgcaggctgatgatggtcacttcagctcagctcctaccaagaagagactgcatcaggatgttgtagcacaagtaaaagttgatcggggtcaccactgcatgccagcacaacgccaagtcaacttcaatttgaaagtaactcctgtgcccaccaccagttcattccctgtcgttgtcgacaaacagttgtattctcctgtggcgctattccgaagtgaacatcttcatggaagaacttcaattcatcagccccaaaaagcagattggcctcaccagcgctggcctcctgacaaccaagatcaacatggataacttcctggattcacagtagatgaacttaactggtaaatggttctagtgttgattttgaaacgtacaacagaaactggctgtaatatcttcggctactgctagagtgctagtgctagtaacctatctacttctgttcttagcccgtagggcagtattgtttcttattgagaatgactgtctatatacatgtcaaatctctt

SEQ ID NO: 1728 - DNA, 1206 bp, Oryza sativa; identical to SEQ ID NO: 783
  Predicted polypeptide sequence is orthologous to G1421

SEQ ID NO: 1729 - DNA, 1817 bp, Oryza sativa; identical to SEQ ID NO: 775
  Predicted polypeptide sequence is orthologous to G1421

SEQ ID NO: 1730 - DNA, 1089 bp, Oryza sativa
  Predicted polypeptide sequence is orthologous to G1421
cgagtgaagcactagctccacccatcatcttggatcgtgccatgtcccggtcgcgcacggtgcggatcttctgggacgaccccgacttgacagactcgtccggcgaggacgaggggtgcggcggccggagggtggggagcatggtgcgggagctgccgcctgcccagatgcccgtggcgcaggcagccgctgctgctgctttgccggagcagtgcagcggcggggacggtgatatgggaagaagggtcgttggtggcggatgcactgtgggtgtgggacggaggaggttgacgaaggacggagggcctggcgcgccgagcaccaagttccgcggcgtcaggcggaggccgtggggcaagttcgcggcggagatccgcgacccgtggcgcggcgtgcgcgtctggctcggcaccttcgacaccgccgaggaggccgcgcgcgtgtacgacaacgcggccatccagctccgcggccccagcgccaccaccaacttctccgcctccaccaactccgcgggtgcacaagatccggtggcagttggctacgagtccggcgcggagtcctcgccggcggtgtcgtccccgacgtctgtgctccgcaaggtcccgtccctgtgctccctggccgaggacaaggacgactatgaggccggcccctgcgagcccgcaactgccgccggttccaacctcaccgttctcgaggaggaggagctcggcgagttcgtgccgttcgaggacgcgccggtctacggcggcagcagcttctgggacttcgagcccgagtccggcttcctgtacgccgagccgtcgtcgcctgagacgccgtgggacgccggcgccacgtcctccggcgaggcccaagactacttccaggacttgcgcgacctgttcccgctcaacccgcttcccgcaattttctaaaaacgggatcggcttcttcaatcacggaactgcttttttgggtgttgttgagtattcgtgcctactgtgtgtacttcctgtacgtgctcttctggtgtctgcttgtgttgagtgagtcgatgagaaatgtattgtcctgagagtagagtttttttccgaaaaaaaaaaa

SEQ ID NO: 1731 - DNA, 312 bp, Oryza sativa
  Predicted polypeptide sequence is orthologous to G1476
atggacggcgagggggcgccggcgaggcgggcgccggcggcgtcctactacgagtgcaccttctgcaagaggggcttcaccaacgcgcaggcgctcgggggccacatgaacatccaccgcaaggaccggagcgccggcggcaagtcgcagggcggcggccagcaccacgaaggcggcggcagcggcagcggtggcggcggcggccagcagcacggcagagatgtccacctgggcctcaccctggggaggaacgaggaagagagggacggcgtcgacctggagctcaggcttggccatgcccactatccttga

SEQ ID NO: 1732 - DNA, 1380 bp, Oryza sativa
  Predicted polypeptide sequence is orthologous to G1482
gagcttattatatttccctccacttcgtcctcttcttcctcctccatccccatcctccatcggatgcactagtagctggccttgtaccctacctagcttagctacccacccatgtcctcctcctcgtctcctctcgctgtctgcctttgacttggagacctagctcgtcgatcgccggccatgcgggtgcagtgcgacgtctgcgccgccgagccggccgcggtgctctgctgcgccgacgaggccgcgctctgctccgcctgcgaccgccgcgtccaccgcgccaaccgcctcgccagcaagcaccgccgcctcccgctcgtccacccgtcctcctcctcctccggcgacggtggcgccgccgccgcgccgctgtgcgacgtgtgcagggagaagaggggcctcgtgttctgcgtcgaggaccgcgccatcctgtgcgccgactgcgacgagcccatccactccgccaacgacctcaccgccaagcacacccgcttcctcctcgtcggcgccaagctctcccccgccgcgctcgccgaacagccgctcccgtcctccgactgcagctccgacgacgacgccgccgccgccgccaccgaggaggagtaccactcctccgccgcatccaccggcgccgcagtgagcgcgcctcttgacgcctccagcaacggcgccggtggcggaggaggagtaggagggagcagcatctccgactacctcaccaccatctgccccggctggcgcgtcgaggacctcctccccgacgacgacgccttcgccgccgccgccgcgcaggcggggaaagagaaggacgagcgcgtgccgttcctcgacgccgacctgttcgacgtggtcgccggccggccggagaagaagggcggcgcgtgggcgccgcacgtgccgcacctgccggcgtggtgcctcgacgaggtgccggtcgtcgtcgccgcgtcggcggcgccagcggcgacacctgtaaaggcgaagcagggacacgtgcgggacagccactggagcgacagcgacgcgttcgccgtgccggagttctcgccgccgccgccgccggccaagagggcgcggcccagctcgcagttctggtgcttctgaacgccgccgccgccgtacaatctggccgccggcgagctcgacgaacacctcgatggatcgatcgaacacctgtgtaatcactcagctggtcactactacaagtagcaatcagcaagcttgatgtgccactgttactagctgctgctgtttaattagtgagtactaagctactactagttaattttggtgaaaactatgctactttgttactatataatgaagtatgtgtatcaaactaaactgagatgttggtaattaattatcgtattttgt

SEQ ID NO: 1733 - DNA, 1200 bp, Oryza sativa
  Predicted polypeptide sequence is orthologous to G1482
gatatcttttgtacacgggcgtactacgtgttacggctgaaccaatctatccccgtgctcgctgtgaggccattgaccagaggaaacggaggaggagagagcgatcgtggtcgtacgtacgttgggagagaagaagggacgcgcgcgcgcgcgccggagcggcagggcaggatgaaggtgcagtgcgacgtgtgcgcggccgaggcggcgtcggtgttctgctgcgccgacgaggccgcgctgtgcgacgcgtgcgaccaccgggtgcaccgggccaacaagctcgccgggaagcaccgccggttctcgctgctcaacccctcggcgtccggccgctcgccgacatcgacgacggcgccgctctgcgacatctgccaggagaagaggggtttcctgttctgcaaggaggaccgggcgatcctgtgccgcgagtgcgacgtgccggtgcacacggcgagcgagctcaccatgcgccacagccggtacctcctcaccggcgtgcggctctcctcggagcctgccgcgtccccggcgccgccgtcggaggaggagaacagcagcagcttctgctgcagcgccgacgacgccgtgccggccccggcggcgcccgccacgagccacggcgggagcagcggcagcagcagcatctccgagtacctcaccacgctgcccgggtggcacgtcgaggacttcctcgtcgacgacgccactgccgaggccgccgccgccgccgccgccacctcttccggcatctccgcgaacgggccgtgtcagggggtaacacggatcggagggctgcaagaatccgccggctaccctgcgtggatggcgcagcagcagctgtgctgcgacggcctcgtcgccggcgacgcgtcgccggctagccgggagcggtgggtgccgcagatgtacgcggatcagcttgccgccggcagcaagagatccaggacgtccactgcttcttcctactcctactggtgaaactaaagcaattgaggccatggtttgtacgtagtagatgttgtttcgggcttaattaatgactgcattttgcgcttccggacgggagtgtttgtgcgttatttttgaggcgcagaggaaaatctgagccttttgtatcccttcctttttgctcgtcacgactagtactgtatgttttttttctacgcaataacgagaatttttcctcttttccaatgc

SEQ ID NO: 1734 - DNA, 1220 bp, Oryza sativa
  Predicted polypeptide sequence is orthologous to G1482
accactcgtccactcctaataacctaccactctacttctccttgcaacatcgtcgttagtcctctaacccaaggcattgacctgagcttgttgtgcgcttctgccttatctgcatcccctcccggccgagacgcgaccatctttctttcccgcttcgttagctgtctctgccgatcgatcggactggacggggagacatgaaggtgcagtgcgacgtgtgcgcggccgaggccgcctcggtcttctgctgcgccgacgaggccgcgctgtgcgacgcgtgcgaccgccgcgtccacagcgcgaacaagctcgccgggaagcaccgccgattctccctcctccaaccgttggcgtcgtcgtcgtccgcccagaagccaccgctctgcgacatctgtcaggagaagagggggttcttgttctgcaaggaggacagggcgatcctgtgccgggagtgcgacgtcacggtgcacaccacgagcgagctgacgaggcggcacggccggttcctcctcaccggcgtgcgcctctcgtcggcgccgatggactcccccgcgccgtcggaggaagaggaggaggaagcaggggaggactacagctgcagccccagcagcgtcgccggcaccgccgcggggagcgcgagcgacgggagcagcatctccgagtacctcaccaagacgctgcccggttggcacgtcgaggacttcctcgtcgacgaggccaccgccgcctcctcctcctcagacgggctatttcagggtgggctgctggctcagatcggtggggtgccggacggttacgcggcgtgggccggccgggagcagctgcacagtggcgtcgctgtcgccgccgacgagcgggccagccgcgagcggtgggtgccgcagatgaacgcggagtggggcgccggcagcaagcgacccagggcgtcgcctccctgcttgtactggtgaaaaaaaaacgtgcgcttatcagccacagccagtacgaaatgtacgatgcttgtgtaccagtgtactgaggtagtagcgttagaagattaggaatttagtagtggatgttgattttgagcttaacgcgtgtcttggatgaatccctgactcctgaatgtttggggaattaatgtgagtggtagtgtcctctttgggcggcaaagaattatacgccccttgcgaacatgtcgaactgtacggtctgccatttaatctgcacgttcacccctc

SEQ ID NO: 1735 - DNA, 258 bp, Oryza sativa
  Predicted polypeptide sequence is orthologous to G1482
atggtgatccagctggtgctggccgacgacgacaagccaacgtttgcactgctgacgaagcttcacttatcggagactgtcatcaccgatgacgagggcgggtacgtatctcagcgaggtcatgtcgtagggctgtcctcgcctgcagatcctcgagcttccaatctcacaaagatgcaagtgaaggattgcttcgtcattgaattgaaggactcggccatgtcactctcgatgccggcgatggaggagttctgctag

SEQ ID NO: 1736 - DNA, 1199 bp, Oryza sativa
  Predicted polypeptide sequence is orthologous to G1482
catatcttttgtacacgggcgtactacgtgttacggctgaaccaatctatccccgtgctcgctgtgaggccattgaccagaggaaacggaggaggagagagcgatcgtggtcgtacgtacgttgggagagaagaagggacgcgcgcgcgcgcgccggagcggcagggcaggatgaaggtgcagtgcgacgtgtgcgcggccgaggcggcgtcggtgttctgctgcgccgacgaggccgcgctgtgcgacgcgtgcgaccaccgggtgcaccgggccaacaagctcgccgggaagcaccgccggttctcgctgctcaacccctcggcgtccggccgctcgccgacatcgacgacggcgccgctctgcgacatctgccaggagaagaggggtttcctgttctgcaaggaggaccgggcgatcctgtgccgcgagtgcgacgtgccggtgcacacggcgagcgagctcaccatgcgccacagccggtacctcctcaccggcgtgcggctctcctcggagcctgccgcgtccccggcgccgccgtcggaggaggagaacagcagcagcttctgctgcagcgccgacgacgccgtgccggccccggcggcgcccgccacgagccacggcgggagcagcggcagcagcagcatctccgagtacctcaccacgctgcccgggtggcacgtcgaggacttcctcgtcgacgacgccactgccgaggccgccgccgccgccgccgccacctcttccggcatctccgcgaacgggccgtgtcagggggtaacacggatcggagggctgcaagaatccgccggctaccctgcgtggatggcgcagcagcagctgtgctgcgacggcctcgtcgccggcgacgcgtcgccggctagccgggagcggtgggtgccgcagatgtacgcggatcagcttgccgccggcagcaagagatccaggacgtccactgcttcttcctactcctactggtgaaactaaagcaattgaggccatggtttgtacgtagtagatgttgtttcgggcttaattaatgactgcattttgcgcttccggacgggagtgtttgtgcgttatttttgaggcgcagaggaaaatctgagccttttgtatcccttcctttttgctcgtcacgactagtactgtatgtttttcttctacgcaataacgagaatttttcctcttttccaatg

SEQ ID NO: 1737 - DNA, 942 bp, Oryza sativa
  Predicted polypeptide sequence is orthologous to G1537
atggagacgacgacgacgacgttgggcggcggcggcggcgggcgggcgggaggcttctccgatccgccgtctccgctctcgccgccgctgtcgccggcctcggcggcggcggcggcgctggcgaacgcgcggtggacgccgaccaaggagcagatcgcggtgctggaggggctgtaccggcaggggctgcgcacgccgaccgccgagcagatacagcagatcacggcgaggctccgggagcacggccacattgagggcaagaacgtgttctactggttccagaaccacaaggcccggcagcggcagaagcagaagcagcagagcttcgactacttcagcaagctgttccgccgcccgccgccgctgcccgtgctccacaggccactcgcgcggcccttccctctcgccatggcgccgacggcgatgccaccgccgccgccgccgccggcgacgacgacgacggccgcatgcaacgccggtggtgtgatgttcaggacgccaagcttcatgccggtcgcgacaaataacgccagctactacccgcagcagcagacgccgttgctgtacccagggatggaagtgtgtccgcacgacaagtccacggcgcagccaccggccaccaccaccatgtacctgcaggcaccgccgagcagcgcacacctcgcggcggcggctggccgcggcgcggcggaagcggaaggccatggccgccgcggcggcggcgccggtgggcgcgagaccctccagctgttccccctgcagcccaccttcgtgctgccggatcacaagccgctccgcgccgggagcgcctgcgccgccgtgtccccgacgacgccgtccgcgtccgcgtcgttctcgtgggagtcggagagctcggacagccccagcagcgaggcgcctccgttctacgacttcttcggcgtccattctggaggccgctga

SEQ ID NO: 1738 - DNA, 624 bp, Oryza sativa
  Predicted polypeptide sequence is orthologous to G1537
tttttttttttttttttttttttttgcaataaattgagaaactgcatatttgattgttctatttcctctgtgctttgattggttaggatgtcattttctgatacattgccatcattcggttcaattttttgcccccagaccttgtactgacatgttgcttccataccattacgatacggctacacccagaaaaaaaaatcaagattactttcactttacatcagtacttgactaacttaatactttccctttcccaagtccaggtccaggtcaacgttcttgtgagttgtgattatccctgatgtggtgttttaattcatgtgcacataataggaggtttttgtgtcatgaatttatttccttacatgagaaccaagcagttcattttgcagagcccaaaggaagaacctcctctggtcaaacaatgcccccttatattatccctctgtgcctgattctcttcatcatccaagctagtcattccatgggagctcagatcaatgagacaagcattcctcaagggtctgaaatcaacacagctgtgccccaaagttgggtttcccctctaggggcattgcgcgtggggtttaaacccaagggggaggatttccaatggtgtgtcgc

SEQ ID NO: 1739 - DNA, 1482 bp, Oryza sativa
  Predicted polypeptide sequence is orthologous to G1539
ggtttctatttgattattactatgttcaattcgacggaatcttagaggaggaaaatccaaatgaatggatgattgatctaatcgcagctgatataccacctatgaggcacacggatgatcctggcgcaatatatgccaagtgctatgacgcggtgcgggtgtactcggtcgaggtgaagcaaatcaagtgtgggttgcggtggcctatcgaggtgtttggccatgtcgccgtgcgagacagcgtcgatcgcaagcgcaacctcgtcttcaatcgtggccgggacgattgccaaacgctcacggcggaggtgatcgatcgaccttacctcaaatcagctacctgaaaatttgctcgcacacgcacattattattgcaacatccagtgctaacgttgccttaatcagctctagctaaacattgctcacccttgcacaacactatttttctcccaagtttttcctgctaacgatgtcatcttgttatttgcgtggtacttactagttcttctgctgttatggttgtactagcttgagcaatatagatatgcagtacatactaccacatcagtattcagatagcattgcttttgtttcttagcatatgcgtgttaaatactctacagataaattgatgtcatctattaaaaaacggaggtagtacaacttaaagtagctacactatggttccccttgttttactgtgtttcatatttgaaaacaaatttgtcttggatcgaaatatatgtgtataacacatatggctgtaatcaatatttgcaggactcctctttggtgttaacagggcctagtcgatatgtcttggcaatggacaatccggactttgaagttgagctaaaggtcaagggaattgcggagactgaagacaaggttttgagctctcatgcctttacattcaactgcatctatgacgatggtagtagtgttaagaggcgcgtggcttccaacaagcgcagcacggtgcagatcacgtttgctttaattccagagacagtggaggcgacatttgaggttaaagtcgttgatgggtcattggatccttccctacgcccacatttctttgcttctactcaccaccatcccagcacggaatgtgtgttgcttgatcctcgagagggtgcaacggtgatcagcgacaataatagtgtcaaacttactcgatctgttgtttccgttgaagtgctggggggattgaagcttactgcagaggctctagatgatgaaaaagctgttgttcctaggacaacaattatcttcgaaccacaaagggatggtagagtgtatggatttcttgatcttaattgttgtaagatggtggttaaagtttcctggtctcgactttccatttgttgactgaacattattttgtagccggtgctatgttgatatgtaggaacttgtgctatccttttttatgattaatgttagctatgtactgatgtatatgatcttttgccatctact

SEQ ID NO: 1740 - DNA, 1174 bp, Oryza sativa; identical to SEQ ID NO: 593
  Predicted polypeptide sequence is orthologous to G1543

SEQ ID NO: 1741 - DNA, 2217 bp, Oryza sativa
  Predicted polypeptide sequence is orthologous to G1560
cggcgtgatggacctgcctcgtccaatggagggcctcggcgaggccgggccgccgccgttcttgtgcaagacgtacgaggtcgtggacgaccccggcacggacaccgtcatctcgtgggggttcgccggcaacagcttcgtcgtctgggacgccaatgcgttcgccgccgtgctcctcccgcgctacttcaagcacagcaacttctccagcttcgtccgccagctcaacacctacgaaggtcgatccggatagatgggagttcgcgaacgaggggttcttgcgggggaagaaggagctcctgaagacgatcaagcgacgccggccgccgccgtcgagccccccgtcgtcttcgtcgtcgtcgtcgtcgtcgcagcaccagcagcagccggcggcggcgtgcctggaggtggggcagttcgggcgcgacggcgtggtgaaccggctgcagcgcgacaagagcgtcctgatcgcggaggtggtgaagctgcggcaggagcagcagacgacgcgcgcgcagatgcaggcgatggaggagcgcatctcggcggcggagcagaagcagcagcagatgacggtgttcctggcgcgcgccatgaagaacccgggcttcctccagatgctcgtcgaccggcaggccggccagcacggcgcccggaacagggtgctcgaggacgccctctccaagaagcgccgccgccccatcgagtacctcctcacccgcaacggcgagacctgcgccgccggcgagtcggcagctatgctggcggcggacggcgtggcggagccggacggcgacaccaccccgcgcggcgacggcggcggcggcggcggcggcgacaccgagagcttctggatgcagctgctcagcctcggcctggaggagaagcagcgagaggacggcgtcgccggcggcgtccaggagagtaacagcggcggcgctgacgtggacaacgacgaggaggatgacgacgatgacgtggacgtgctcgtgcagagcatatatcacctcagccccaagtgaaaggtcgagaaggttccacggcgaaaacgaagggtacgtttcgtttcgtagggtgacgtaatcgcaacagtagcgagtagtaggaatgtaggggtagcactgcacttgtctttctttccatttttttatagtttcggacatcttgtcgccgccctgcaagttgccaaaaaaagcagccaagccccactgccacaggcgacggaaggttcaagaagtcgagaagcttctcccgcgggggaagcttctagaggtgtccagtaagacagcacagtagctgcgggtgttcaagaagctgggaagcttctagatgtcctctaggacggtggcttcgaatgttcttcttctggaatttgcacctagtatcagctaattatgtgcgctgtattttgcccatgctactgccatatgcaactggtgcctcttatcccccaacagctactgctgcccttttaaaatttgaaagttacggagtaatttcagctgatttttaagtttcttcattagtagtttactttctgtattggttgtcaaatcttaaataaagttctacttataaatatcttggctatactagttcattttccccttgtcttttgtcatggaaggctgcctgttttgtcgtgtggtgacagttctgaacttttcatctatactggagtgctacgtggagtatatacatacaaagtgctccattttgtttgagccgtgccgtgagcgcgtgtccttgaccagggaaaaaaaatgttttgctttcaggttgcagaggacaagaggatgtcggtgccaaagatattttcaaacatactaaccgaaaagggcaccaaaatatcatcatctgaagatcttaacagtatcaagaaagtggttcccagctcatcaaatctaggagtactacgtggtaggagtatcaggctccacctgtacctggtgtcttaattaaggaaaaaagaacagagaaacgctcggagagatgattcagaagcttgacagcgagtatttcaggagtacgggtgtcgcttgctgcgagatttcacaacaggagactgtctgtcacggcgttgctgtaccacctctttaaaatggatcgtgggacaggacagttgacacgtagagtaacactcgtactacccgtttccgctaaatgtcaaaatcttgtacggagtactatctggattaaaattaaagtttatctatg

SEQ ID NO: 1742 - DNA, 2561 bp, Oryza sativa
  Predicted polypeptide sequence is orthologous to G1560
gagaagcttctccgcggccagtggcgacgctaccctacgcggcgtctagaaccttccacacctctcccgacgcctctcgacgtacggcgagggtatttttatctctccgaccaccctccgccctcgctcttcttccccccgcacacgaagaatttctcgcttcgtttcatccccaccattttttttttgtttgacctcgaaagggaaagcagaagaagaaaaaaatatcccaaaatatccccgaaattccaccacctgtagcagcagcgatcgcgtgtgttcttggttccaattcgtcgcctgatactccgattcgagttcttgatcaaagttgctggggttaatttgggttcttggttgtgaaaggcgggagggggggtcatggacccggcggcggcgggcattgtgaaggaggagatgctggagtcgcagcagcagcagcggcaggaggatggcggggcggcgccgcggccgatggaggggctgcacgaggttgggccgccgccgttcctgacgaagacgtacgacctggtggaggacccggccaccgacggcgtcgtgtcgtggagccgcgcgggcaacagcttcgtcgtctgggacccgcacgtcttcgccgacctcctcctcccgcgcctcttcaagcacaacaacttctccagcttcgtccggcagctcaacacctacatggaacaagatactggatgaagtacaagaaccagattgtttttgttctagaagactcaactgatcaccttcaaatgatataatatactgatgggcttcagaaaggtcgatcctgataggtgggagtttgcaaatgagggttttctcaggggccaaaggcatctcctgaaaacgataaagagaaggaagcccccgtccaatgcacctccgtcacaacaacagtccctcacatcttgtctggaagttggtgagtttggattcgaggaagaaattgacaggctgaagcgtgataagaacatcttgatcacagaggtagtaaagctaaggcaggagcagcaggccactaaagatcatgtgaaagccatggaagataggctacgagccgctgagcagaaacaggtccagatgatggggttcttggcaagagcaatgcgcaacccagagttcttccagcagttggcacagcagaaagagaagaggaaggagcttgaggatgccatctcgaagaaaagaaggcggcctatagacaatgttccattctatgaccctggggaaacaagtcagactgagcaacttgattcgccgtatttgtttgattcaggtgtgcttaatgagttaagtgaacctggaatccctgagctggagaatctcgcagtgaacattcaggatctggggaagggtaaagtagatgaagagaggcagaatcaaactaatggtcaggcagagctcggagatgacttctgggcagagctgttggttgaagatttcacaggcaaggaggagcagtcagagttggatggcaaaattgacggcatcgacgaactggctcaacagttggggtatctgagctctactagtccaaaatagagttgattttgtgattgttcatccaacaactactgctgcttcagtgcttttgaagatcatcttgaacaaactggaatgttggctgtgtacatccgtttggatgtagaggccggtttaatccattatctaaaaaaaatctgcaggaatgtggattagagtagtgattggatctttgccatcggggctgaatattgataatgccgatttttcattccattttttcgaatatatgtttctccatttcagccctgctacttgcttctgaattgctctgttgcttgttaaacagatccaattgactagtggaaatatgaccaactacggaaggtgttcatggtgtttcccagactatggacgccactgtctagaagctgtataaacagtctgtttgccgagcgcgggtggaggcgatggccgggaaggcggcgacggcgacggcggcggaggcggcggcgagggtttacccgtggagggagaagcttgcaaagtacaagggggagctgacgaagggggtgtgggggtactgggagctcggggcatggaagccgctcggcctcagcgcccggaagcgggcgcgcctcaggaaggaggtcctcctcgccggcgaggactggacctacgaccctccccgcggcgagatgcgcaccaagcggaagggccacaagtgcgaccgcatctccgccgagaagcgtgcgaacacggttgagctgatgaagaagatgccccagatgctccttgactacaagaaacgtagatgggagaaaaagatgaaagaggaggagagtggaaagagctgagctcaagctactcgataagaatgctgctctgcctaaataagtttgaatctgatatagtggcttcaaatgatggctggaggtgatctgtttctttcccttgttggccaccagctttcctgctgcctaaggcactttgtagtgctgatatttgattgcttctatagttcccaacacttgggtcaatgaatcatgatcttacccaggctcaacttc

SEQ ID NO: 1743 - DNA, 1994 bp, Oryza sativa
  Predicted polypeptide sequence is orthologous to G1560
gaattccactgcttccagaagcgagcgagctctcctttcctttctcctacgcctaggcttctagaagcttcctttccaaataggggctaatctcctgagctcgaagctctcctcgtcagcttcaggtggtcgggtgctgcctcctcctcctcctcctcctcctcctcgtcctcaaatctccccgagagttcgtgctttgccgcgagcagcgagctgcgatctcgcctgaatccttcgtcggcgggggggatgaattgatcacgcggtgtgcgctttctgattctgtcgggttcctttcagatgcacgagcacgtcggtgtccgcctcctctttgcttgatttgcttccgctgctgctgttaggtgcgcgagagctcgtgatggggtgaagcgtgtgttcacaggattagattgcgctcgcctgattcgctgcatcttgttcttcttgctgccgcctacgcgacttgatttcgtcacgccaaagccgtgacaggctgattgctaccttgcttggcgacctgtgctttaaattccaccattgtttgctggtgctggatgagcaaattcttggttcgtgtggctctagttggtagttcttgattgaggtgaggttctgagctgccatgaactaccgagtggtgaacccggtgaaggtggagagcgggccgtcgacgggcgtggcgaatggccagccgccgaggccgatggacgggctcgccgacggcggcccaccgccgttcctcaccaagacgtacgacatggtggatgacccgaccacggacgccgtcgtgtcgtggagcgccaccaacaacagcttcgtggtgtgggatcctcacctctttgggaacgtgctgctgccgaggtacttcaagcacaacaacttctccagcttcgtccggcagctcaatacctatggcttcaggaaggtggatcctgacaagtgggaatttgcaaatgagggttttctgagaggacagaagcatctccttaaaggcataaagcgtcggaaacctccgaattcatctccaagtcagcaatctcttggctcattccttgaggtagggcacttcggatatgagggagagattgatcagttgaagagggacaaacatctgttgatggctgaagtggtgaagctgaggcaggagcagcaaaacacaaagtcagacctgcaagctatggaacagaagctacaaggtactgagcaaaagcaacagcacatgatggcattcttgtcacgagttatgcataatcctgagttcatacgccagctgttctcccagagtgagatgaggaaggagcttgaagagttcgtctcaaagaaaagaaggcgccgcattgaccagggacctgaacttgatagcatgggtaccggttctagccccgagcaagtgtcacaggtaatgtttgaaccacatgatccagtggattcacttttcaatggtgttccatcagatcttgaaagttcatctgttgaggccaatggaggcaaggcgcaacaagatgttgcttccagtagctctgaacacgggaaaatcaagccatctaacggagagttaaatgaggatttctgggaggacctgctgcacgagggtgggctcgatgaggataccaggaaccccgctatagatgatatgaacttgctgtctcaaaagatgggctacctcaactcaagcagcaccaaatcgccacagtagtagctctggtctgatcttgctgcagctccaacgacccttgagtacttgttaatcaagcttgtcattatacttatccgctttgaggatgatcaatttgagtaggtctcctcccccatggtgatgatcttatggtagcatcagctgtacatactattgccgcaataattaccatcgtattctgttcagctttgtggaattagttttggatctgaatgtatggtactttgacagtggacttgagggtgctgtatgtacatataacagtctaactaaatgcagttgtgcgttgtaatgatgt

SEQ ID NO: 1744 - DNA, 2272 bp, Oryza sativa
  Predicted polypeptide sequence is orthologous to G1560
ggctgccaagctcgccggattcttttcttggattggagcagattggggggtgacgatggagaagatgatgccggggatggtgaaggaggagtggccgccgagctcgccggaggagggggaggcgccgaggcccatggaggggctgcacgaggtcgggccgccgccgttcctgaccaagacgttcgacctggtggccgacccggccaccgacggcgtcgtctcgtggggccgcgcgggcagcagcttcgtcgtctgggacccccacgtcttcgccgccgtcttcctcccacgcttcttcaagcacaacaatttctccagcttcgtccgccagctcaacacctacgtgagtccccccaatttccattgccaccactagtgttgttccctgcttgtcttcagttgttgggaaattgtgtgttctgttttcttgttttggatgttgttgttcagttcttggtccggacgaattacctgaacaagcgatcacatttctacagtttgagatttcaggttggattgttagataattaaaatgggtgtgttctcacttttgtggttgccattatgttttgtgccacatcgtgtgtgttgagtattgataggaatcttgacactagaattaaatggatggagcattgtaaaattttcagtgcaaattgtaaacccggcggtattggttaaataaatcggttgtattgtgcatttttccactcagtgcaagaactttgtgcatgcacaaatgcacaattatgtagcaatggagctagaaactgggatttacttattggtgctgacctgttggttgtagaaaattacgatggctacaattgttcaacggactgttttgtggacttgacattatttgcccaaactcagctatgtccaatccttttcagacacatgcatataaaccctcaattcctgaaatgttctcaatgattcagaaagaggaaaaaaatctccatggacgaactactcagtttctgacatgctgttttcttcaatttgttactgtgtagctagatggatcaagacagcggatgaagctacaagaatctgcttgtttgttctagaagactcctttgatcaccatcaaaaaaaagaaaaagtgatgtagtatactgctacctgttctcttaataatgctatgataaattttgtcgcaaaactatgtgaaaccaaccgttttacatactttgtgtgacttgctatcctaattgagttttgtctgtggcttctgtacttgaactaactatacctgtaatattctttgtgtttgcaatttgcagggtttcagaaagattgatcctgacagatgggaattcgcgaatgatggtttcctgagaggccagaggcatcttctaaagatgattaagaggaggagaccattgtcttatctccctggatctcagcaggcacttggcacctgccttgaggttggtcagttcggattagatgaagagatcgacaggctaaagcgtgacaagaacatcttactcgcggaggttgtgaaactaaggcacaagcagcaaagcacgaaagccaatatgcgagccatggaagagaggctgcaacatgcggagcagaagcaggtccagatgatgggtttcttggcaagagcaatgcagaaccctgacttctttcaccagttgattcaccagcaggataaaatgaaggggctcgaggacacattctcgaagaagaggacgaggtcgatagacatagtgccatttctcaaccccggggaggtcagccagggcgatcaactcgagtcgacattgctgtttgatccaaggccatttgctgaactgaatgatgagcctgcaaagtctgaactggagaatttagcactgaacatccagggtcttgggaagggcaagcaggatgtcaacaggactcgaaatcagccacgaaatcaggctagcaacgaaaccgagttaaccgacgacttctgggaggagcttctgaatgaaggagcaagagatgatgctgggattccagggatggagcgaagaagacctagatatgtcgatgcattagcgcagaagctgggttatctaagcaatagtagccaaaagtagatcaagtggctccgatttgtccaaccatttttgtgatagctcttattgtatatcggtgtaattgtattatagtgatagttttatagcgataggtccaatttatattgcggatccggcgtgctgtgtagtatatgtctggtgatgtaaagttgagccatcattcttaatggtatatattgacaattttttgc

SEQ ID NO: 1745 - DNA, 1956 bp, Oryza sativa
  Predicted polypeptide sequence is orthologous to G1560
gcagtagcattcaccttctccgccctcccccctccgccgcctccgccgctcccccaccttccagaaccttcctttcccgaaatagccacccctaccctaccctaccctacccacccccgccaagatccccgccgccggcgagctcgagcccttggtggtgctccggcgggcgttgtcgcggtcggatcagctgctgctggtgctggtgatgccgctctctctttcttgcgtgtacttccgggtgggaggttgatggcgatggtgaggtgttctttggcgcggttgccctcgcccccactcttatctcctctcctcgcccatgctacctaccttcctcccccgccggagctgctctgctgctcgtactagcgtgggagctgcctcttcttgttgagccatttcttgcctacaaggacagggtgcctcgccgtcgccattgccggcgtcggagccggacaaggaggttcagtgtactgtaccgtggttttgggccttctgagctatggatgatccaatgctgaatgcggtgaaggaggaggagagccacggggacggaggagggttggaggtggtggcgggagaggatggggcggcggcggtggcggcgggggtggcgccgaggccgatggaggggctgcacgacgccgggccgccgccgttcctgaccaagacgtacgacatggtggacgacgccggcaccgacgccgccgtgtcgtggagcgcgacgagcaacagcttcgtggtgtgggatccccacgccttcgccaccgtcttgctccccaggttcttcaagcacaacaacttctccagcttcgtcaggcagctcaacacctatggtttcagaaaggtggatcctgatcggtgggaatttgcaaatgagaattttctgcggggacagagacatcttctcaagaacatcaagcgtagaaaaccaccttcccatactgcttcaaaccagcaatcccttgggccataccttgaggtgggccactttggatatgatgctgagatagaccggctgaagagagacaagcaattattgatggctgaggtggtgaagctaaggcaggagcagcagaatacaaaggcaaatctgaaagccatggaggataggctgcaaggaaccgagcagaggcaacagcagatgatggcattcttggcgcgtgtcatgaaaaatcctgagttcttaaaacaacttatgtcccagaatgagatgagaaaggagctccaagatgccatttcaaagaaaagaaggcgtcgcatagatcagggacctgaagttgacgacgtcggcactagcagtagcatagagcaagagtcaccggccttgtttgatccccaggagtcggtggaattcctcatcgatgggattccctccgatcttgaaaactcagctatggatgctggaggtctggtggagccacaggatttcgatgtcggcgcctccgaacagcagcagatcgggccccagggggagttgaacgacaatttctgggaggagctgctgaacgaagggcttgttggtgaggagaacgacaacccggtcgtcgaggacgacatgaatgtgttgtcggagaagatgggttacctcaactcaaatggcccaacggctggggaatagctaatttcattcaaattataccacattgctgtcagctttcgccatgtgaatttaactgaattttagttgaatttctgcttgctactggcatgcctccctccctgtgttactgaccgtagtgatttgttcgttgttaggccatatagcctgccagtcatgtaaaatgagtaaaggtgttgatgatccacaaatgttctgttccgtgttgtcagatggtctgcctgtatttgtagtcgtgcttagtgtgtgcaatgttgtaatgatatctaatattaatctgtacttctcgtaatgacatctgatcttaatctgattgcagaagtgctttgaattgc

SEQ ID NO: 1746 - DNA, 1273 bp, Oryza sativa
  Predicted polypeptide sequence is orthologous to G1594
gaattcccccatgagcctctgcctccctgcctgcccccgtatgtagcaagaacaagaacaccagcgagtaacacaggctcgctacagtggtactagattaccgcttgtgcgggcatagtgatcgtctatagttgtgaattgcgatgcagcagcataggtggtgagctgctgcggctgctgctgctggtacgtagatggaggatctgtacagcatccacccggggatctcgcgggtcggcggcgcggcgagcgaggcgtccggcgtgggcgtcgtcgtcggcggcggcggcgggtcgtcgtcgtcggatctgacggagctcatgaaggctcagatcgccggtcacccgcgctacccgaccctcctctccgcctacatcgagtgtcgcaaggtgggagcgcctccggaggtggcgtcgctgctgaaggagatcggccgggagaggcgcgccggcggcggcggcggcggcgccgggcagatcggcgtcgaccccgagctcgacgagttcatggaggcgtactgccgggtgctggtgcgctacaaggaggagctgtcccggccgttcgacgaggcggcgtctttcctcagcagcatccagacgcagctcagcaacctctgcagcggcgccacctcgccgccggccaccaccgccacgcactccgatgaaatggtggggtcctccgacgaagaccagtgctcgggggagactgatatgctagatatagggcaagagcaaagctcccgcttagctgaccacgaactcaaggaaatgcttctgaagaagtacagtggctgcctcagccggctccggtccgagttcctgaagaagcggaagaaagggaagctaccaaaggacgcacggtcggcactgcttgaatggtggaacacacactaccgctggccatatcccacggaagaagataagctgaggcttgcagcgaggacaggtcttgacccaaagcagatcaacaattggttcatcaaccagaggaagaggcactggaagccatcggacgggatgcggttcgcgttcatggagggcgtggcgggtggatcgtccgggacgacgctctacttcgacactggcacaattggaccatgaattcatttttgagcaatgccgcctcttgagaaaattggccatttaggcagtaatagtaggacatggtatttggtggtgattgtgtctagctatgatcaatctttcagcaggtcagtgttattcagttcagggtaaagtaattgcctcattgttttggcaaaaaaaaaaaaaaa

SEQ ID NO: 1747 - DNA, 1785 bp, Oryza sativa
  Predicted polypeptide sequence is orthologous to G1594
gaatctttgtttccatgtctgtctgaattctgatctcttcttctctctgcctgcagacacaagcaggtgactcctccatcctcccaaagcaaagcacccatgtatcccgctgctgccgctgctacctacaagtgcaccctgcagaagctgcttctccttctccttctgatctgaggagctgcagctgctgctccagcagcagaggctgcagtgcaatccgctgccaaattcctcttcttctccttcctactagcttttctcttcttcttcttcttcttcttggaaagctggaacttggagctgcttaagcttacacctgctgattcatctccagctgctgctgctgctgattcagtattattatgtgtggagatgtacagtagatgaggaggaaggaagtagctactggatagctagctgagctgagctaagctgagctaagcttcttggctaggtaggtagctagaggtgaggtgaggtgggggaagaggggattggacatggaggatctgtacagcatccacccgggaatctcccgcggcggcggtgggggaggaggaggtgcggccagcgaggcgtccggggtcgccggaggggggagctcgccgccgcatcccccaccgccggcgacgacggcggcggcggcggatctgacggagctgatgaaggcgcagatcgccggccacccgagctacccttccctcctctccgcctacatcgaatgccgcaaggttggtgcgccgccggaggtgaccacgctgctggaggagatcggccgggaggggcgcggcggcggcggcggcgcgacagccggcggggaaattggcctcgatccggagctcgacgagttcatggagacgtactgccgggtgctggagcggtacaaggaagaactcacacggccgttcgacgaggcggcctccttcctcaccggcatccacacccagctcgcctccctctgtggcggcgcgccgccgcccaccgacaactccgatgaaatggtggggtcttcagaggatgagccgtgctcaggagacgccgatgcagcagattttgggcaagaacacagctcccgcttggctgaccatgagctcaaagagatgttgctcaagaagtacagtggctgcctcagccgcctccggtccgagttcttgaagaagaggaagaaagggaaactaccgaaagacgcgcgatcggcacttatggactggtggaacacacattaccgttggccttaccccacggaagaggataaggtgaggctggccgcgatgactggcctcgacccgaagcagatcaacaactggttcatcaaccagaggaagaggcactggaagccatcggaggacatgcggttcgcgctcatggagggggtcaccggaggatcctcctccgggacgacactgtacttcgacaccggcacaattggtccatgatcagattgcactccaaattaaatgtagcaccttgcaacagacattggcaggtattacctgctgctacaccctctgtgaggagcaagggatgatcatatattaaaaggaaaaaaagatgaaatcaatcaataacctcatcattttgtcgaaattattgtgtatatggtgttgtaagagggagttgggatgacctgtaaaaacttgcctgcattcagctaccataacattaattaattgtttgtatccctgacaactgcatccccagttaaaaccattttagacaggaaagagtgaactatgagtaatagtaacatgtagcaataataaagatacttattttttcccttgc

SEQ ID NO: 1748 - DNA, 2016 bp, Oryza sativa
  Predicted polypeptide sequence is orthologous to G1635
gattttccccttcctgccttgcctcctcgtctccttctctgctgctctccaagctcttcctgcttccatcaggttgtctcgagaaagattggagtttttggtggtttgggttgtgcggttcttgcttttgttggcgcaagcgcatggctggttctgggacatagtgagctgagatagagttcttgtgttcggtggagtttggctttggtgaatcttcgattcaagtctggagatggcgcgttttcaggaaaccaaggcgaggaatgatcaaggacctgttgctgatcatgttgggcaccgaaacctcatggaaaacctcacagatcctctggattccagtggcatggacatgatggacgaagcgcgaattcctaaggcgcggaagccatacacgataacgaagcaaagggagaaatggaccgaggacgaacataagctgttcttggaagccctgcagctccatggccgagcctggcgacgcatccaagagcacataggcaccaagactgccgtgcagatcaggagccacgcacagaagttcttctccaaggtcatcaaagaatcatctggggacaattgcaacagcttgggtgctgcatcatcaattcagattcccccgccgcggccgaagcgtaagcctgttcatccgtacccacgcaatctagggagcacagccagcaagaacgtccctgcactgaaacagctagagaagcctcagctgcaggtgcagtctctctacgaccaggacaatgggtcgccgacgtcagtgttaacagtaccacagatacgggctgatacactgggaagtgagagtggtgggtcgccaacctcgacgattgatattgaagagagatgtcctacaccaagcatagcaactgctgagttagctatggagttgcctcctacaaatgacgaggaggtcaagggcaatggcgatcatgaagaagttacatgtgacagatcaggagttccagtccttaggctatttggcaagagggttatggtgaatgatttacatcagatgtcagcccctgatgccgggaacctgcaaactgtggcagacatggaagtggacgcttcagctgagacaccaactagtggaactgggaaattctcttcccatggtgcagcagaagcaaatacatggaacccatggctgactaacacacagcagtttctgtattatcttcctaacggacaaattttctccgtgcattctgctctcccatgcttcacctaccataatgagggtgttacttgcacccagttttcaaacccacaggtggtagcctcagatcagcagcatcaacaccaaacttctgaagctgtagattacaagggtatacagagggaaggatcttggacggagtcaaatacatcctcaagcagtgtgcctgaaacagcaactcataattcagagactacagaatcatatagaaacggaaacagaaacgaagatgaaatggtaccttctccagattcaagaaaatgtgtgagcccaggttccaactgcaggcgaggctttgtgccgtacaagagatgtgttgctgatagtgaggcgctgctgaagtcacaggcgcctcaggaggaggcagacggagagatgacgaggctgtgcttataaatttttggagcctcgtagatcactgcaactatagatgcttgctactaatattttgttcacagatgagtaggaactgatgtactgcaggaggggctgctttcctgttacaagaggcagattgaaaccgcgttagtactccacaaaacagggagtggccgtggttcttgtctggccatgtacagttcaaatattctatgtttccattttcctcgtcgtgtgtttgtaatttcgctcccattgcgggagcgttcagaggtcaatggctgtcatgcaatgacaagtattttgatagagttgtagaagggttgtactgatgtaaattatacagtaacttattatctgtaagacaataacaggcgagctaaagaaaacaacgttggaaagctttgttc

SEQ ID NO: 1749 - DNA, 1146 bp, Oryza sativa
  Predicted polypeptide sequence is orthologous to G1635
atgggtggggactgcaaggactctctgaagaatcgcatccggatattcactgaagcagtagtggtcatggtatgcccagtccttctctcgttcgcgctaaagaaggtggacctgacggccaatcgaagcaaacaaatcgtggacagcatttccccgattggagcgttaactctggaagctggcatactccctttcctcggcctctgcctctccacggtgctcggagagaggctcgcgtggctcgtattggcctcgaagctgctcatccacctatgtgtcattctcctcatggctctagcctttgtgattctgctgctcatcagcaagagtaacattgtctgcctaagcatctggatccccttcgtccccttcatcctatggctaggctacaactccgtgaaggatgaggagcatgagaacgccgacgacgccacgaaatcagcccaccacgggaagctggaaatctcggttgatttctctgctagtatcacctcccttctgttcctgggattaaaaggtcttgcgttggagggacaggccagcgccatcaaggggctggatgctcacctttccgactccctcatcgtcagtttcgtgacctgcgtcctgggtgtagtcttcatgcttgttggaacggctccaccggtgtacggcatgggccgcttggtggattccttgaggatcttggatacctctctggcaatagcgttcggggtgatcgtcgtgctaatcacaattgcacctctgaaggaggcggcgtggttagtatccatcccgtggatcctttcctttttcgtgtggttgttcatccgtttgttcgaccacgacgagggagaggacagggatgtgaagccggtgtctctagagctgaccaaggccgcgttcacagggttcttggccgtctccataccgagcttcagcaatagctccaccagcggcggctacacccacgctttcatagtgcttactgggtcagctgtcctcgctggcctcgcgtggaggctgatcacgcacgtgaagaagccgtcgcgagccatggtctgggctgaaaatgtagcttcttcgtgtgcgcacatctgtgttgcggcggctgttgttccatttgcaagcatatccatgacggtgctcaggtctctcgaaagttag

SEQ ID NO: 1750 - DNA, 2083 bp, Oryza sativa
  Predicted polypeptide sequence is orthologous to G1635
tgagtgcgacggggcctacgtaacgctcgcttctttgcctcctcgttcccttctcctcctcatctccccccatctcgtcgtcctcatcaacaacatcgaggagaaaactcgcaaagattgcggggtttgggaggcgctgattttttggctttggtgtggcgatcctgtggagtgtggtttggtttgggaggagttcggttttttcagaatggagatggcctgtttgccgggaaacgccatggcaaccgacgaaaacggtgccgacgatcgcgccggcggcgagagcaccgtggatcatctcaggagccatatgaactacggcgacatggatttgtcaggggaagagcacgtgccaaaggcgcgaaagccgtacacgatcacgaagcagcgcgagaagtggacggacgaggagcacaggctgttcttggaagccctgcagctgcacggccgcgcatggcgccgtatacaagagcacataggtaccaagactgccgtgcaaatccgtagccacgcgcagaagttcttctctaaggtcgtcagagaatcttcggggagtaacaccggctcgggcggcgcgtccgccgcggcggcggcggcggccatccagatccctccgccgcggccgaagaggaagccggcgcacccgtacccgcgcaaggtggacggcgcggccaagaagcacgtcccggcgctcaggcagctggagaagccgccgttgtggatgcagtccctgtccgagcaggaggagggctcgccgacgtcggtgctgacggcggcgcaggtaggcaccgaggccctgggcggtgggttctcgaataactcgagcggcagcgggtcgctggctccgtcagccgccggtacggatgagcatgtcgacggtggcggctcgccggcgtcgtcggtggacagagaggacgggtgcctctcaccgagcatcccgactgctgagttggctatgcaggcgccaaatactaagatgtcaattgcaaccacggatgccaaagaagcatcctcagaagcatcagtcttcaggctattcggaaagagcgtagtggttaaggattcagaccagctgcacctgcttaatggcagtaacattgcaacgagtggttcagttgagagagcaaccagaaacatactagtaccttcttttgctgctgccccagaagggagctcgtcgaatccatggccgagcagcatgcaacagtttctctacttccttcctcgatcggatggtttcgccgcgcaacctgtcatgccatggttgagctacaacgggagccttccatgcgcgctgttctacccggcggcggcggcggctgcgaaccagcagtgccaccgtgattcagagggcgtagagttcagagtctcgcagagggaaggatcgctgacgggctcgaacacggcctccagcgtcgtgcttggatcgtcggcggcggtaccggcggcggcggcggcggctcagaattcggacgtcgcggagtcccgtggccaagggaacagcagggaggcggcggcctcgccacggccgaccaagtgcgagagctcggcgtccgtcaccctgctgcagaggggcttcatgccgtacaagaggtgcgcggcggagagcgagctgctgcgatcggaggccgccggaggagaggaggccgtcgccgacggtgagctgacaaggctgtgcttgtgacaactgactcgtcgcacggacacgtcacgccacagtacttctattcgtaggtgacaaataacaaatctgacatgagattaaggcgggaagaagaggcatgtcctgctgttaggatgttgctcgagaccactttagttttccagaaaatggaagagcaattctggtttttactcgtcgatatagtattgtataatctgtaagataacaacttttgtacttttttttttactttgcctgtaattttatccccaactcgaatacgttcagagttgagtggctgtcaatgttgccttttatcaacctgaatctcggacaggggttgccataggctaactacatgtaatctaggcttgtatctctccacaaaatgcaatggaaagacgaggaaatgttggatgc

SEQ ID NO: 1751 - DNA, 2082 bp, Oryza sativa
  Predicted polypeptide sequence is orthologous to G1635
tagtgcgacggggcctacgtaacgctcgcttctttgcctcctcgttcccttctcctcctcatctccccccatctcgtcgtcctcatcaacaacatcgaggagaaaactcgcaaagattgcggggtttgggaggcgctgattttttggctttggtgtggcgatcctgtggagtgtggtttggtttgggaggagttcggttttttcagaatggagatggcctgtttgccgggaaacgccatggcaaccgacgaaaacggtgccgacgatcgcgccggcggcgagagcaccgtggatcatctcaggagccatatgaactacggcgacatggatttgtcaggggaagagcacgtgccaaaggcgcgaaagccgtacacgatcacgaagcagcgcgagaagtggacggacgaggagcacaggctgttcttggaagccctgcagctgcacggccgcgcatggcgccgtatacaagagcacataggtaccaagactgccgtgcaaatccgtagccacgcgcagaagttcttctctaaggtcgtcagagaatcttcggggagtaacaccggctcgggcggcgcgtccgccgcggcggcggcggcggccatccagatccctccgccgcggccgaagaggaagccggcgcacccgtacccgcgcaaggtggacggcgcggccaagaagcacgtcccggcgctcaggcagctggagaagccgccgttgtggatgcagtccctgtccgagcaggaggagggctcgccgacgtcggtgctgacggcggcgcagataggcaccgaggccctgggcggtgggttctcgaataactcgagcggcagcgggtcgctggctccgtcagccgccggtacggatgagcatgtcgacggtggcggctcgccggcgtcgtcggtggacagagaggacgggtgcctctcaccgagcatcccgactgctgagttggctatgcaggcgccaaatactaagatgtcaattgcaaccacggatgccaaagaagcatcctcagaagcatcagtcttcaggctattcggaaagagcgtagtggttaaggattcagaccagctgcacctgcttaatggcagtaacattgcaacgagtggttcagttgagagagcaaccagaaacatactagtaccttcttttgctgctgccccagaagggagctcgtcgaatccatggccgagcagcatgcaacagtttctctacttccttcctcgatcggatggtttcgccgcgcaacctgtcatgccatggttgagctacaacgggagccttccatgcgcgctgttctacccggcggcggcggcggctgcgaaccagcagtgccaccgtgattcagagggcgtagagttcagagtctcgcagagggaaggatcgctgacgggctcgaacacggcctccagcgtcgtgcttggatcgtcggcggcggtaccggcggcggcggcggcggctcagaattcggacgtcgcggagtcccgtggccaagggaacagcagggaggcggcggcctcgccacggctgaccaagtgcgagagctcggcgtccgtcaccctgctgcagaggggcttcatgccgtacaagaggtgcgcggcggagagcgagctgctgcgatcggaggccgccggaggagaggaggccgtcgccgacggtgagctgacaaggctgtgcttgtgacaactgactcgtcgcacggacacgtcacgccacagtactactattcgtaggtgacaaataacaaatctgacatgagattaaggcgggaagaagaggcatgtcctgctgttaggatgttgctcgagaccactttagttttccagaaaatggaagagcaattctggtttttactcgtcgatatagtattgtataatctgtaagataacaacttttgtacttttttttttactttgcctgtaattttatccccaactcgaatacgttcagagttgagtggctgtcaatgttgccttttatcaacctgaatctcggacaggggttgccataggctaactacatgtaatctaggcttgtatctctccacaaaatgcaatggaaagacgaggaaatgttggatgc

SEQ ID NO: 1752 - DNA, 534 bp, Oryza sativa
  Predicted polypeptide sequence is orthologous to G1655
atggcgtcctcgccgacctccacggcgccacacgaccgcaagctcgatcccgccgcctcgccggcagccaggtggcggacgaggcgggagcaggagagctactcctccaagctgctcgacgcgctgcgcctggtccgcgccgccagcggcagaccatcacccgcgtcgtcgcgcgaggtgcgccacgcggccgaccgcgccctcgccgtggcggcgcgagggcggtcgcggtggagccgcgccatcctcgcctcccgcgcgcgcgcgtgcgcgctccgccgcgtgcgcctcggcgcgccgcccccgccgcccgccgcgcgtccggcgccgcgctcgcggccgccgctggcgagcaaggcgaaggtgctggggcggctagtgcccgggtgccggaagctggcgttcccggcgctcctggcggaggcgtcggactacattgctgcgctggagatgcaggtgcgcgccatggcggcgctcgcgcaggcactccagtccgtggcacccgcgccgccgccgccgccgtcgtcgtcgtga

SEQ ID NO: 1753 - DNA, 512 bp, Oryza sativa
  Predicted polypeptide sequence is orthologous to G1655
ctgcgggcggcggcggtggcgcggagggtgcgggagctgcggcggctggtgcccggcggggaggcggtgccggccggccgcctgctgctccgcgccgccggctacgtcgcggagctccgcgccagggtggagctcctcagggcgctcgccgccctgctgacggcctcatgcgccgccgccgacgacgacggcggtgcgtgtacatgacgagacggcggcgccatggccggcggccggcgacgacggtgaacaacgacgatcgatcgactcctcccgatcctacgaatacgtagagagattcggcgtataattaagagtataaatattcagagaaattaatatatgtatatgtacgtacatgtcgtcatgcatatataggctgaggaatttcgggggttaatttttgcctcaaatactccttaatatttaagtgttcggccgattcgtattctttgtaatgtttatgtgtatacatgttatgatatttttgagcgcttgatttttttttaaaa

SEQ ID NO: 1754 - DNA, 1390 bp, Oryza sativa
  Predicted polypeptide sequence is orthologous to G1662
gtgaaccaaagaaccatcacttggtaccagtagtgcaacaacttgttcagtcgagaggaataccttctagccttctagtagccaggatggccatggagagagcttggaagccaagggaaattgctgacacttttggcattgagatggatgaagaggaggctgcggctgcggcgataccgcctccgcagacgccattggagcccatggagtacctgtcgaggtcatggagcgtgtcagcgtcagagatatccaagatccttttcaacgggagcaagaagagctttgccgccaagcgtctgccggagatgaccataccggaaaactctgtggtcgctgcgtccattgttcccagccatctgcaacatatagacacaagaaggaattcaatcagcagccaccacctgccaattgggaggtggttccaacacaaggaggcaagccgggtcaagcagagcagcaaagagaagctgcgagccgagaaggcccatgtacacgccatggtgtcggtggcccgggtcgcagctgccgttgctgcggttaccgcggccaccacgagctcagatatccagacctccaagatggccgcggccatggtgtcggccaccgagctattggcttcgcactgcgtggagatcgcgcagcacgcgggggcacgccatgagcaggtggcctgtgccatccagtctgcagttggtgttagaagctctggtgatctgatgacactcacagcagcagcagctactgctcttcgaggagccgcaacaatgaagcagagagtgcagcgagagatgagaagcaatgcgagtgttcttccgtatgagaagggtcactcatggagtcctgacatctggtgcaaggagggggagttactgaaacgcacaagaaaaggagatttacacaagacacgagtatctatatacatcaacaagaggtcacaggtcatattgaagttgaagagtaaacacataggaggagcactatcaaagaagaacaagagtgtggtttttggtgtgtacaacgagcttcccacatgggttgaggcagggaaacatttcacagaggagagatgctgctttggcctgagcacggcacaaggtctggtagagtttgagtgtgagaacagcacaagtaaacagaggtgggtcgatgatgtgaagaatctgcttcggcaggtcgctgcagaagagcaagtggaaaataagttgggatcagtgaagctcagttgatgtagttcatacatgtgtacactattttcatgttggcaggtggtataccatagaaggtgccttattgatgccaggcgtatatattgttgtactcttaaattgtcaggtagttttgtactgtacacacaaaatgataagatacataatagatcatatgttagtcc

SEQ ID NO: 1755 - DNA, 1206 bp, Oryza sativa
  Predicted polypeptide sequence is orthologous to G1662
atggaagggcacatgttggggaggatgaggaggagggatcacctgctgctcatggatgctgctcctcctccggcggcggtggcggcggcggtgcagacgctgatggagcccatggagttcctgtcccggtcgtggagcgtgtccgcgtcggacatatccagggtgctcaccggcggcgtcggcgcgaggcggagcaccaacttcgtggtggatcgcctctccgggatgctcatgccggagacgctcgcgctcgccgccgcctccagcacaaacctgagcccccgcaaacgctattccaggtgcaggagcgccatctccgcgcaccagcacacgatcgggaggtggttccaccacagggacgggagcagcagcagcagcagcagcagggtcgacaaggcccgcgccgagcgggcgcgcgtgcacgccgcggtcaccgtggcgagcgtggcggccgccgtcgcggccgtggcctccggcgcggcgaacgacccggacgacctcgacgacgccaagatggacgccgcgctggcgtccgccacacagctgctggcctcgcactgcatcgagatcgccgagctcgccggcgccgaccacgaccaggtcgcctccgcggtggaggccgccgtcgacgtgcggagccccggcgatctcatgaccctgaccgcctccgcagccacagctctgagaggagcgacggcgctgaggctgagagcgcagcgggaggcgaggagcaaggtggcggcggtggcgccctacgagaagaccggcagctgccgcggcgacatatggtgcaaggaagggacgctcctgaaacgcagccggaaaggcgctttgcaccggaagcgcgtggccgtctacatcaacaagaagtcgcaggtgatcgtgaaactgaagagcaagcacatcggcggcgccttctccaagaagaagaagagcgtcgtgtacggcgtcgacgacgacgtgcaggcgtggccggcgccgcacgcgtgcggcggcggcgccgtgcctcctgctccggagacggcgtcgtcggagaagtgccagttcgggctgaggacggcgcagggcgtggtcgagttccagtgcgagagcagggcgcagaagcaggactgggtggagtcggtgaagaatctgctccggcaggcggccggcgggacggctcagctcgagcactccttcgaatctctccggcttagcgcctcgtaa

SEQ ID NO: 1756 - DNA, 882 bp, Oryza sativa; identical to SEQ ID NO: 677
  Predicted polypeptide sequence is orthologous to G1795

SEQ ID NO: 1757 - DNA, 660 bp, Oryza sativa
  Predicted polypeptide sequence is orthologous to G1795
ccaatcggcgtcgtcaggcctctcgcgtgtgcgagcggttgcgtccgcatggaggacgacaagagtaaggaggggaaatcgtcgtcgtcgtaccgcggcgtgcggaagcggccgtggggcaagttcgcggcggagatccgcgacccggagcgcgggggagcccgcgtgtggctcggcacgttcgacaccgcggaggaggccgcgcgggcgtacgaccgcgccgcattcgccatgaagggcgccacggccatgctcaacttcccgggagatcatcatcacggcgccgcaagcaggatgaccagcaccggctcttcttcgtcctccttcaccacgcctcctccggcgaactcctccgcggcggcgggccgcggcggctccgatcggacgacggacaaggtggagctggagtgcctcgacgacaaggtcctggaggacctcctcgcggagaccaactatcgtgataagaactactagtgataagaactactagctagctagctactatggctacttagctagtacataccgatccgtcggtattagcaagacggacatggagcagtcgtgatctcgtctgtatgcgctccttgaaacgatcgagaccatgagcttgctagctagctacgcatagtagtagcaataacagaggaaaaaaaaaaa

SEQ ID NO: 1758 - DNA, 375 bp, Oryza sativa; identical to SEQ ID NO: 481
  Predicted polypeptide sequence is orthologous to G1795

SEQ ID NO: 1759 - DNA, 1406 bp, Oryza sativa
  Predicted polypeptide sequence is orthologous to G1798
catttcggggggggtagtttataagggcttgcgcgaggagggggaggagtagcgggtagcggcgggctcgagtcgagtcgagtcgccgtcgtcgtcgggcggcggcggccgagagagatcgggatcgatggtgcgggggaggacggagctgaagcggattgagaacccgacgagccggcaggtgaccttctccaagcgccggaatggcctcctcaagaaggcgttcgagctctccgtcctctgcgacgccgaggtcgccctcatcgtcttctccccccgcggccgcctctacgagttcgccagcgcccccagcctacagaaaaccatcgaccgctataaagcatacacaaaggatcatgtcaacaataagacaattcaacaagatatccagcaagtcaaagatgatactttaggtttggccaagaaacttgaagctcttgatgagtccagacggaaaatattgggagaaaatttagaaggatgctctattgaagaactgcgtggtctagaaatgaaacttgagaagagcctccacaacataagactaaagaagaccgagcttctggagcggcagatagccaagctgaaagagaaggagcggactttgcttaaagacaacgaaaatttacgcggaaagcatcgcaaccttgaggctgcggcgctggtggctaaccacatgacgacgacgacggcgccggcggcgtggccgcgggacgtgcctatgacgagcagcacagccggcgccgccgacgccatggacgtggagactgatctgtacattggattgcccggcactgagcgctcctccaaccggtcggagacaggttgaagaaggccagccacagcaacagctgctatatagcatgcagtagcagcaacgacgccagtgacatcctgttcatctcacaagaataaccagagctctacgcatgcgcacatgaaacccaggcatgcagttctcggtgggtaaattattatctcgcattattagctatatgcgtgtccttgtctttttctttaggcaatggaataaaatttccggtaagtacaaacacaaacggaaacaaagaattaacaaagctgtagcagaccagatcggcaaattgaaatgccaggtaatccagtatatatttcgctaaagttattcatgttggtgtgatgggcctgtgagtgtgggtgcttgggaggagatttcttgggttttttccccgagcaaaatcaatctgctcgtgcccttgagatttcagttccgcccataagaactccgacgcacatttagcattcggagagtaattttgttaggttaaaagtatggtaagttataggtggtatgttatgtttttctttttcttttctcaatgttatctggtacctaagtttgtcaagaaaatcatagtggacaagtc

SEQ ID NO: 1760 - DNA, 257 bp, Oryza sativa
  Predicted polypeptide sequence is orthologous to G1798
cttagcttagctagggttcgtggtcgatcggtggaggagttggggaatggagggaggagggaggaggaggaagagggggaaggtggagctgcggcggatagaggaccggacgagccggcaggtgcgattctcgaagcggcggagcgggctgttcaagaaggcgtacgagctgtccgtgctctgcgacgcccaggtcgccctcctcgtcttctcccccgccggccgcctctacgagttcgcctcttccacctccagca

SEQ ID NO: 1761 - DNA, 1117 bp, Oryza sativa; identical to SEQ ID NO: 741
  Predicted polypeptide sequence is orthologous to G1798

SEQ ID NO: 1762 - DNA, 583 bp, Oryza sativa
  Predicted polypeptide sequence is orthologous to G1798
ctgcatctctcgctgctcctcctcctcctcctccgccgtgcaggccgcagccgctcgtgtggttggttggttcatcggcgatcgaagatggtgcgggggaagacgcagatgaagcggatagagaaccccacgagccgccaggtcaccttctccaagcgccgcaacggcctgctcaagaaggccttcgagctctccgtcctctgcgacgccgaggtcgcgctcatcgtcttctccccgcgcggcaagctctacgaattcgccagcgccaggaaaattcggcctgaaaagacggcaaaaactatatttccccgtgtggcgattgattgccgtctaaacagtcacactacttccataaagaaattagttgtgagactggcaaggttagaaattctgaaaacataggcaacttagtactggcattccggagggcaatatgatatgagcactaattagttaatgataatgtacgttgcagtaatcttgccgtgcatatgaatttctatgcgtaacatgcatgaaagcacactaacgggagtttccagggagcctccaatcttattaatgctgtacaactaaaaaaaaa

SEQ ID NO: 1763 - DNA, 437 bp, Oryza sativa
  Predicted polypeptide sequence is orthologous to G1798
gaggtttgggatgctttcctttgcgaggaaaatcagccagcagcgacatagatcgatctgttcccggccggcgagccggagtagatctctcgcataccctgcacgcacgtactgcttatggcggcggcgggagggcagcagaggcggcgcggcgggcggcgagagatgcggcggatcgaggacacgacgaggcggcaggtgacgttctcgaagcggcggaaggggcttctgaagaaggcgtcggagctgtcggtgctgtgcgacgcggaggtggcgctgctcgtcttctccccgcgcggccgcttcttccacttcgcctccgctccctccctggaggggacaatcgaccgctacattagccacacccaagaggcgcctgcaaacaagaagccccgtgaacttactaatatgaaatctcaatccgaaaccttagcaat

SEQ ID NO: 1764 - DNA, 648 bp, Oryza sativa
  Predicted polypeptide sequence is orthologous to G1902
atggaggtggcggaggggaggacggtggcggcggcggcggcaggtggtggaggattgggaggaggggcgaggacggaggcggaggggttggcgtgcccgaggtgcgagtccaccaacaccaagttctgctactacaacaactacaacctggcgcagccgcgccacttctgcaaggcgtgccgccgctactggacgcgcggcggcgcgctccgcaacgtccccgtcggcggcggcacccgcaacaaggtcgccccggcgccgtgcaccggccgccgcaagcgcgccgcccacgccgcgcacgccgcggcgccgccgccgacgacgacggcgtcgtccgcgccgctgccgctcatgccgccggcggtggcgtacgagctgccgttcctgccgccgccgccgccgctgccgctggcggccgtggaccccgaccgccgcctgctcgacctcggcggcagcttcacctcgctgctcgcgccggcccagctgcacaacggccacttcaccaccggcttcctgctgggcaccatgtcgtcggcgccgccgccgccgccgccgccggccacttctacaccgtctcccgcgccggccgcacacccgccggtgtcggacagcatctgggccatggggtggccgcacctctccatctag

SEQ ID NO: 1765 - DNA, 680 bp, Oryza sativa
  Predicted polypeptide sequence is orthologous to G1911
tttttttttttttttttttttttttttttttctagcaggcacaactttataatcactagcacacaagtacagaagtcttacatcactgatgtttactacataatttagctggaaggtttaacaaccacacacaatgccaaaggcaggctagtttctgcaaaatcgacactgatttgctttacaacctaaagtatgtacaaacaaggcttttcttcttttatttataaccaagcgaccacaatctttttaggcaataacaatatcaatatacttccttgattccttcagtaacttagccacagctagcagggaatataatttatatgggaatttttttcctgttgtcgggaacctcaaatgcttccacccctatcagttccatgctccctgggtattgtacttggggaacgggactcttcttgcctctatcagcttgaggtcgccctcgaggatctcataggggcggcacacctcatcggctgtcttggtgcctcccatggcgcgagacaccttgtgaaagaggtcaggcgcaccctcgccgtattaggcaagagcctcctcgaacagcttgttctcctttttgctcactctgagcccatgttgacactgttgctgttgcgggaggagctgtttgacctagaaaaatccttggattggactacggcttttctttggaagga

SEQ ID NO: 1766 - DNA, 598 bp, Oryza sativa
  Predicted polypeptide sequence is orthologous to G1911
aatatcaaaacacagcagagatcgatagatctcttctgaagtccaaaaaaaacttcagtctagctgcacactagttagcaagttacttagcgttcaacttccaaagaagacagtagctagctagtttaatcaaatccaagctgcaggatgtcttctgctgggtcacgtagctcgtcccgcaacagcaacatggcgtcagagtggagcaaagaggagaacaagctgttcgagcaggccattgcctactacggcgagggcgcgcctgatctctggcacaaggtgtcccgcgccatgaggggcaccaagacagccgacgaggtgcgcctccacttcgagatcctcgtggacgatatcaagctgattgaggcaaggcgagtcccgttccccaagtacaatacacagggagcatggaactgaccgactgaggggtggaagcatctgaggttccagcaaggaaataactccaatataaactatattccttcctgtggctagttgttgaaggaaagcatattgatatattgttactgtgttaagaagattgtggtcgattgcttggttataaataaaagaagaaagggattgtctgtatatactt

SEQ ID NO: 1767 - DNA, 282 bp, Oryza sativa
  Predicted polypeptide sequence is orthologous to G1911
atggcatccagctccaaggcctcgtcctcgtcgtcggcgtcggcggcgtcgtcggagtggacgaagcagcagaacaagcagttcgagcgcgccctggcggtgtacgacaccgacgccccggaccggtggcacaacgtcgcccgctacatgggcggcgccaagtccgccgaggaggtgcgccgccactacgagcggctccaggcggatgtcgagcagattgaggccggcggcgtgccgttctccttgggctacggcgccacgccacaggccggccgccgctag

SEQ ID NO: 1768 - DNA, 666 bp, Oryza sativa
  Predicted polypeptide sequence is orthologous to G1911
atggactcagagtggagcaaaaaggagaacaagctgttcgaggaggctcttgcctactacggcgagggcgcgcctgacctctttcacaaggtgtctcgcgccatgggaggcaccaagacagccgatgaggtgcgccgccactatgagatcctcgaggacgacctcaagctgatagaggcaagaagagtcccgttccccaatggtatgcacgatgcaccattttgtgattattggtttgcacataggctgcgcgacgaggccgcgggcgaccggcggtggcggtggcggtggcggtggcggtgcgccccttcacctgcggcggattcgcccttgccgggacgacttttgagccgcccaaccaccgagcgcccaaggcctgatgggcttatttctcccaacggcccatataccttcacgggccgtcctgcttcgctggaccaccggatgggtcacgtcgccggccccgctaaactcggtgacggcgacaaaagctcctcaaaggatgccatgggccggggtgctagcttgccgacaacactcctcgtccgatgggcagtgacatgtaccaccaccaccactcgcaggagaaatgatcaggcatacagtcgcggcgcgccgtatcggatccccgtggcgttggccattgccattgccatcctgggttaa

SEQ ID NO: 1769 - DNA, 919 bp, Oryza sativa
  misc_feature (919)..(919): n is a, c, g, or t
  Predicted polypeptide sequence is orthologous to G1911
atcggccatttggccgggggctgcaaacactcgataaccagttcagaaagagaattgctgtgtgagactcgatggcgtcgatgtcggtgagctcgtcgagggcgccgcagtggacggcgaggcagaacgagcagttcgagcgggcgctggcggtgtacgacagggacacgccggagcggtggcacaacatcgcgcgcgccgttgcggggaagtccgccgacgaggtgaagctctactacgacctgctcgtggaggacgtcaagcgcatcgagaccgggaaggtgcccttccccgcgtacaggtgccccccgcccgcgattgcaggctgaaagcacctcgatctgaacgactgcacctggagatctagctatgcggcatgaataatatcctagtctgcactctgtactacgttgatcaatcgatctcccgcgagcgtgcttatttgtaaatttatgcacgcgtgcaataatgtaattaatatatgtgtaatagcatatttgggggtaatgaatgacactcctaaagctattaagttgaagtgccaaaaaaacacgaccgagcacgcacacaacatgtcggacgtctcggaccaggcgagtctaactccaggcaagataatgctatgggacgacattcaactccctgggcaaacgccccatatgagcggcccaccaaccaggcgcgcgtacaaccgcgcgagggaaagtggccattcaattaccggatagtaccgtcagggtcacatagagacgaatctactacgaagctagtgaggagcgtaaccagtatacgtacagaacacagagacatactaacatgatgtcatttctttcttttttgccgcctctcattctcttctctctctccctcgtcatgatggctagcaatagagagaaggcaacaacaaaaggtaagacan

SEQ ID NO: 1770 - DNA, 577 bp, Oryza sativa
  Predicted polypeptide sequence is orthologous to G1911
cgtcgaagacacagcaagatctttacattagagctttcagtagtcagtgtcttaccaaggccactcttgaagatgtctgggtcccggagctcctcccccaactcgaagtctgagtggagcaggaaggagaacaagatgttcgaggaggcgctcgcctactacggcgaggacacgcccaaccggtgggacaaggtggccagcgccatgggaggcatcaagtccgctgaggagatccgctgccactacgaagacctcaccgatgacgtctagacgatcgagtccgggcgagtgcagttccccaagtacaagacgcagggatactggacctgaggatgaaccattggaagctccgatagacagaagatgaagttgtataaactagatccctaagaaagacttgctctaggaggaaccaaattaagtaatccagcattgcttagagaataaaggaagagaaggggtgtgtatgcatatagtattgggttatgagcaaggttaagtccccatgctgttgtagattctcgtctacattcgtcaactgcagtattcattaactctgtgaactaaattatgaagt

SEQ ID NO: 1771 - DNA, 661 bp, Oryza sativa
  misc_feature (147)..(147): n is a, c, g, or t
  Predicted polypeptide sequence is orthologous to G1930
ccgtcgtgggcgcgggagccactgttcgagaagccgtgacgcccagcgacgtcggcaagctcaaccgcctgctggtgcccaagcagcacgcggagaagcacttcccgctgcgcggacgagctccgacgcctccgccaccgccgccancgccacctgcaactctgcaagggcgtgctcctcaacttcgaggacggcgaggggaaggtgtggaggttccggtactcagtgctggaacaagcagccagagttacagtgctgacacaagggatggagccagattcagtgagggagaagggcctccagcagcacggcgacaccatagtcttctccggctcaggcagtatggccccgacaagctgctcttcatcgactgcaagaagaacaaacacggcggcaggccaccggcgacgagaagccaaattacaagcaggcgaagcaacacagcgtcagtgaggctgttcaggcatggacatcaccggcggcggcggcagattgccaggaagcgggagaggcaggtggaaatggggcaagaggcagttcttgatgaagaggcaatgcagtggttcatcagcagtactcctgcccttggtgcccctgctgttataacatcaaatcaattcatatatacatcataaatcttccatctaaaaaaaaaaaaaaa

SEQ ID NO: 1772 - DNA, 801 bp, Oryza sativa
  Predicted polypeptide sequence is orthologous to G1930
gttcttctctcccccttttctcttccccgttcgaacgcctcggcggcagcggcggccgggggccggagtggcgacggcggccgcgccaccgcctgccctgtctccaagctggcctaccatcgcgcaagctccgccaggggctccgccgggggcgcggcatgggcgcccgcgcgcagcccacgccgtcgtgggcgcgggagccactgttcgagaaggccgtgacgcccagcgacgtcggcaagctcaaccgcctgctggtgcccaagcagcacgcggagaagcacttcccgctgcggcggacgagctccgacgcctccgccaccgccgccgcggccacctgcaactctgcaagggcgtgctcctcaacttcgaggacggcgaggggaaggtgtggaggttccggtactcgtgctggaacagcagccagagttacgtgctgaccaagggatggagccgattcgtgagggagaagggcctccgcgccggcgacaccatagtcttctccggctcggcgtatggccccgacaagctgctcttcatcgactgcaagaagaacaacacggcggcggccaccggcgacgagaagccaattacaagcggcgaagcaacacgcgtcgtgaggctgttcggcatggacatcaccggcggcggcggcgattgccggaagcgggagagggcggtggaaatggggcaagaggcgttcttgatgaagaggcaatgcgtggttcatcagcgtactcctgcccttggtgccctgctgttataacatcaaatcaattcatatatacatcataaatcttc

SEQ ID NO: 1773 - DNA, 1512 bp, Oryza sativa
  Predicted polypeptide sequence is orthologous to G1930
gatcatcttctttggcttctccctcttcactgccctaattacaacccatttgcttatctctctcctctctctctctctctcgctgcagccatagcttagctagagctagagctttcttggtgccgagatgggggtggtcagcttctcctcgacttcctccggcgcgtccacggccaccaccgagtccggcggcgccgtgcggatgtcgccggagccggtggtggcggtggcggcggcggctcaacagctaccggtggtgaagggagttgactcggcggatgaggtggtgacgtcgaggccggcggcggcggcggcgcagcagtcgtcgcggtacaagggggtggtgccgcagccgaacgggaggtggggggcgcagatctacgagcggcacgcgcgggtgtggctcgggacgttccccgacgaggaggcggcggcgcgggcctacgacgtggcggcgctccggtaccgggggcgcgacgcggccaccaacttccccggggccgcggcgtcggccgccgagctcgcgttcctcgccgcgcactccaaggccgagatcgtcgacatgctccggaagcacacctacgccgacgagctccgccaggggctccgccgcggccgcggcatgggcgcccgcgcccagcccacgccgtcgtgggcgcgcgagccgctgttcgagaaggccgtgacgcccagcgacgtcggcaagctcaaccgcctcgtggtgcccaagcagcacgccgagaagcacttcccgctccgccgcgcggcgagctccgactccgcctccgccgccgccaccggcaagggcgtgctcctcaacttcgaggacggcgaggggaaggtgtggcgattccggtactcgtactggaacagcagccagagctacgtgctgaccaaggggtggagccgattcgtgagggagaagggcctccgcgccggcgacaccatagtcttctcccgctcggcgtacggccccgacaagctgctcttcatcgactgcaagaagaacaacgcggcggcggcgaccaccacctgcgccggcgacgagaggccaaccacaagcggcgccgaaccacgcgtcgtgaggctcttcggcgtcgacatcgccggcggcgattgccggaagcgggagagggcggtggagatggggcaagaggtcttcctactgaagaggcaatgcgtggttcatcagcgtactcctgccctaggtgccctgctgttatagcatcaaatcaaattcatatatagatcaaatcaaatcttcttctcttccatcttttttgttgttcatcgtctgttgtttcatcttcgatttagagctgttctatcttcgactttctttttttgttttttgtctttattttgcatagaagtttgtcaggtcagagattgcaaatgatcgatcaagatcgagctgtatatgtacagccttattaggaaattaagtctagagatcattcaagtatgtacaattatctaatagtacatagtaataagttctgtttctttccg

SEQ ID NO: 1774 - DNA, 1182 bp, Oryza sativa
  Predicted polypeptide sequence is orthologous to G1930
atggacagctccagctgcctggtggatgataccaacagcggcggctcgtccacggacaagctgagggcgttggccgccgcggcggcggagacggcgccgctggagcgcatggggagcggggcgagcgcggtggtggacgcggccgagcctggcgcggaggcggactccgggtccgggggacgtgtgtgcggcggcggcggcggcggtgccggcggtgcgggagggaagctgccgtcgtccaagttcaagggcgtcgtgccgcagcccaacgggaggtggggcgcgcagatctacgagcggcaccagcgggtgtggctcggcacgttcgccggggaggacgacgccgcgcgcgcctacgacgtcgccgcgcagcgcttccgcggccgcgacgccgtcaccaacttccgcccgctcgccgaggccgacccggacgccgccgccgagcttcgcttcctcgccacgcgctccaaggccgaggtcgtcgacatgctccgcaagcacacctacttcgacgagctcgcgcagagcaagcgcaccttcgccgcctccacgccgtcggccgcgaccaccaccgcctccctctccaacggccacctctcgtcgccccgctcccccttcgcgcccgccgcggcgcgcgaccacctgttcgacaagacggtcaccccgagcgacgtgggcaagctgaacaggctcgtcataccgaagcagcacgccgagaagcacttcccgctacagctcccgtccgccggcggcgagagcaagggtgtcctcctcaacttcgaggacgccgccggcaaggtgtggcggttccggtactcgtactggaacagcagccagagctacgtgctaaccaagggctggagccgcttcgtcaaggagaagggtctccacgccggcgacgtcgtcggcttctaccgctccgccgccagtgccggcgacgacggcaagctcttcatcgactgcaagttagtacggtcgaccggcgccgccctcgcgtcgcccgctgatcagccagcgccgtcgccggtgaaggccgtcaggctcttcggcgtggacctgctcacggcgccggcgccggtcgaacagatggccgggtgcaagagagccagggacttggcggcgacgacgcctccacaagcggcggcgttcaagaagcaatgcatagagctggcactagtatag

SEQ ID NO: 1775 - DNA, 954 bp, Oryza sativa
  Predicted polypeptide sequence is orthologous to G1930
atggagcaagaagctgccatggtcgtcttctcctgcaactccggctccggtgggtcgtcgtcgacgaccgattcaaagcaagaggaggaggaggaggaggagttggccgcaatggaggaagacgagttgatccacgtcgtccaggcggcggagctgcggctgccgtcgtcgacgacggcgacgcggccgtcgtcgcggtacaagggggtggtgccgcagccgaacgggcggtggggggcgcagatctacgagcggcacgcgcgggtgtggctcgggacgttccccgacgaggaggcggcggcgcgcgcctacgacgtggcggcgctccgcttccgggggcgcgacgccgtcaccaaccgcgccccggcggcggagggcgcgtccgccggcgagctcgcgttcctggccgcgcactccaaggcggaggtcgtggacatgctgcggaagcacacctacgacgacgagctccagcagggcctccgccgcggctcgcgcgcgcagccgacgccgcggtgggcgcgcgagccgctgttcgagaaggccgtgacgccgagcgacgtcggcaagctcaaccgcctcgtggtgcccaagcagcaggccgagaggcatttcccgttcccgctccgccgccacagctccgacgccgccggcaagggcgtgctcctcaacttcgaggacggcgacggcaaggtgtggcgattccggtactcgtactggaacagcagccagagttacgtgctcaccaaggggtggagccgattcgtgagggagaagggcctccgaccaggcgacaccgtggccttctcccggtcggcggcggcgtgggggacggagaagcacctcctcatcgactgcaagaagatggagaggaacaacctggcaaccgtcgacgacgatgcccgtgtcgtcgtcaagctgttcggcgttgacatcgccggagacaagacgaggtaa

SEQ ID NO: 1776 - DNA, 1185 bp, Oryza sativa
  Predicted polypeptide sequence is orthologous to G1930
atggacagcacgagctgtctcttggacgacgcgagcagcggcgcgtccacgggcaagaaggcggcggcggcggcggcgtcgaaggcgctgcagcgcgtgggcagcggcgccagcgcggtgatggacgcggccgagcctggcgccgaggcggactcgggcggcgagcggcgcggcggcggcggcgggaagctgccgtcgtccaagtacaagggcgtggtgccgcaaccgaacgggcggtggggcgcgcagatatacgagcggcaccagcgggtgtggctcggcacgttcaccggcgaggcggaggcggcgcgcgcctacgacgtggcggcgcagcggttccgcggccgcgacgccgtcaccaacttccgcccgctcgccgagtccgacccggaggccgccgtcgagctccgcttcctcgcgtcccgctccaaggccgaggtcgtcgacatgctccgcaagcacacctacctcgaggagctcacgcagaacaagcgcgccttcgccgccatctccccgccgccccccaagcaccccgcctcctctccgacgtcctcctccgccgcgcgcgagcacctgttcgacaagacggtgacgcccagcgacgtcgggaagctgaaccggctggtgatccccaagcagcacgccgagaagcacttcccgctccagctccctccccctaccacaacctcctccgtcgccgccgccgccgacgccgccgccggcggcggcgattgcaagggcgtcctcctcaacttcgaggacgccgccgggaaggtgtggaaattccggtactcctactggaacagcagccagagctacgtgctcaccaaggggtggagccgcttcgtcaaggagaaggggctccacgccggcgacgccgtcggcttctaccgcgccgccggtaagaacgcgcagctcttcatcgactgcaaggtccgggcaaaacccaccaccgccgccgccgccgccgccttcctcagcgcggtggccgccgccgccgcgccgccacccgccgtgaaggctatcaggctgttcggtgtcgacctgctcacggcggcggcgccggagctgcaggacgccggcggcgccgccatgaccaagagcaagagagccatggacgccatggctgagtcacaagcacacgtggtttttaagaagcaatgcatagagcttgcgctaacctag

SEQ ID NO: 1777 - DNA, 802 bp, Oryza sativa
  Predicted polypeptide sequence is orthologous to G1930
ctctcttctctcccccttttctcttccccgttcgaacgcctcggcggcagcggcggccgggggccggagtggcgacggcgaccgcgccaccgcctgccctgtctccaagctggcctaccatcgcgcaagctccgccaggggctccgccgggggcgcggcatgggcgcccgcgcgcagcccacgccgtcgtgggcgcgggagccactgttcgagaaggccgtgacgcccagcgacgtcggcaagctcaaccgcctgctggtgcccaagcagcacgcggagaagcacttcccgctgcggcggacgagctccgacgcctccgccaccgccgccgcggccacctgcaactctgcaagggcgtgctcctcaacttcgaggacggcgaggggaaggtgtggaggttccggtactcgtgctggaacagcagccagagttacgtgctgaccaagggatggagccgattcgtgagggagaagggcctccgcgccggcgacaccatagtcttctccggctcggcgtatggccccgacaagctgctcttcatcgactgcaagaagaacaacacggcggcggccaccggcgacgagaagccaattacaagcggcgaagcaacacgcgtcgtgaggctgttcggcatggacatcaccggcggcggcggcgattgccggaagcgggagagggcggtggaaatggggcaagaggcgttcttgatgaagaggcaatgcgtggttcatcagcgtactcctgcccttggtgccctgctgttataacatcaaatcaattcatatatacatcataaatcttc

SEQ ID NO: 1778 - DNA, 1397 bp, Oryza sativa
  Predicted polypeptide sequence is orthologous to G1935
ggcctcgcctcgccgatcgatcgacggacgacggccggaacatagctgtagatcgagctgaatcgccggcggcggccatgggacgggtgaagctgcagatcaagaggatcgagaacatcccgaacaggcaggtgacgttctccaagcggcgaaacgggctgatcaagaaggcctacgagctgtccgtcctctgcgacatcgacatcgccctcctcatgttctccccctccggccgcctcagccacttctccggccgccgcaggatcgaggacgtgctcacaaggtacatcaatctcccagaaagtgacagaggaggaactatccaaaacagagagtatttgatcaacatgctcacccagctcaaatgcgagagcgacgtcaccgaggatctcactaacacgagcagtaaggcgccggttaactccaacattgaggagcttcagcaagagatcaggagatgccagcaccagatgcagctcacagaggagcaattgaggatgtttgagccggacccggccaggtctgcatccatggaggacgtcgaggccagcgagaagttcatcgccggcatcctcagccgcgtcgaggagaggaagaggtatttgctgtgcagcatgggctcgttcgacgtgacggcgtcaacatctgccatgcagcatctgtatctaccgcagcagcatcagcacggggacatcactgataatgggtttggaagcgatgaggtggcctcgtgggtctctgaggggatgccgccgacaacctcgtcggtggcgtcgatattcgccggaacttcagattccatgatgtcttttagagatcaagcggtgtacgacacgatgagacaagatgcatgtgtggatcagacagtggtcccggagatggggatgtgccatgtggaccagcagaaccagagtgacgactggcaggcgtacacgtcggcggagttcctcaacgcgctaatcccgcccacgccgttccctctcgacgacgaggatacgatgggcccgatgttggcgtcatcaccgctattgatgcccggcatccatgaccagcagccgccggtggaggatatggcgacggcgggctgctcgcaagcgccggctaacgatggcaacgggttatacgcagctgaggacattgctccggttaacgttggttaattagatgcttttgtactagaaatttatggaatatatagtgttgtcatgttactagtgtgccaggaattgaagctaaggatttttagtttggaattttttttctttgatcatgatgggctgggtgtgccacaattaatgttatatgatccatataatacaccatgcacaatgtaagataatgttacgtactagcatgtaataagatattatccagtaagatcgagttatttatcatct

SEQ ID NO: 1779 - DNA, 1014 bp, Oryza sativa
  Predicted polypeptide sequence is orthologous to G1935
atggggagggtgaagctgccgatcaagaggatcgagaacacgacgaacaggcaggtgacgttctcgaagcggcggaacgggctgatcaagaaggcgtacgagctgtccgtgctctgcgacatcgacgtcgccctcctcatgttctccccctccggccgcctcagccacttctccggccgccgcggggtggaggacgtgattctccggtacatgaacctctcggagcacgacaggggagaagccatccagaatcgggaggagattcagcaagagatatattcttcccagcaacagctgcaaatcaccgaggaccgccttaggatgttcgagccagatcctgcggcgttcggcacatccagcgaggtcgacggatgcgagaagtatctcatggaattgctgacccgagtcgtcgaaaggaagaacaacttgttgagcagtcacatggcgccgttcgatgcaacgacagctgcgatgcagggtgcagatgggacgcagatgtacgtgagccaggcggacgggttggccacgttcggtggtgacgctgccatgtggggcccagatggaggcgcggatcctggccatccgatgttcagtgcatctgatccgttgatctacctcagggaccacgacgtgtacgacgccaactcacaggtggccgggctgcacggcggcgacccgtgcgcggccggcggcgccgcggcggcggcggccgcggtggggtgcgtcgacgacgacgtcgccggaggccacgccgccgccgccgacgcgtggaggcaggcgtacacctgcaccgagctgctctccacgctcatccccaccacgccgttccccctcatgccgcattgcctggggccggaggaccagtacctgtcgatggagcatggcatggtggcggcggcgcaggagccggtggaggcgtcgacggcgagctgctcctacgttcccagcgacgagaactccggcacgccggtcatggcgtacgacagcaacccgccgccggcgaacatcgcctga

SEQ ID NO: 1780 - DNA, 1847 bp, Oryza sativa
  Predicted polypeptide sequence is orthologous to G1944
ggctcttgctgctcctcttctcctcgcttcgtcttcttcctcctctcgcctcttcgttgcgagtagagagatttttgttgtgatttttgagggaatatttttggatttttggtttatttttgtgtgggtttttttggaggtgtatttattttgtttttttggtggtgatttatttttgagaggttttaagggattaagggaggtgtgtgaggaagatggggttagtgtgtgtgagctccaatggcgagagctcgtggcggaaaccctactaggttgaggaggaggaggaggtcgtcgtcgcgctcgcgtgtggaccatggaggccaagtcgggggaagcgagcgttgcgccggtggccgtggcgaccgaggcaacggcggcgacggtgagcttccagccgcaggcggcggtggccgagcagggtagctcgagcggtggtgtgctggtgccgccgccgcctatggcggcgggaggaggaggagttgtggtggcggcggcgccggtggcgggggtggtgaaggtggggaagaagagggggaggccgaggaagtatgggccggacgggagcctgatccggccgctgaacgcgacgccgatctcggcgtcggtacccatggcggcctccgcggtggggccctacacgccggcgtcggcggtgggcgccgccatgaagcgcgggaggggtcgccccctcgacttcgcctccacggccaagctccatcaccaccaccaacaccagcaccatcaccagcagcagcagttcggcttccacttcgactccattggtgaaatggtggcttgttctgctggtgcgaattttactcctcacatcatcactgttgctcctggagaggatgtgactatgaaggtcatatcattttctcaacaaggaccacgagctatctgtattctatctgctaatggtgtgatatcaaacgttacactgcgtcaacctgattcctcgggtggcacattaacttacgagggacgttttgagttgctatctttgtctggatcgtttatgcctactgaaaacagcggaacacggagtcggtcaggtgggatgagcgtttctcttgccagcccagatggccgtgttgtcggtggtggagttgctggccttctggtggcagcaagtcctgttcagattgttgtcggaagcttcctaccaagctatcaaatggaacagaagaataagaagcctagggtggaagcggcacccgcccttgcacagactcctcctgctgttccaatctctagtaccgatacgcacagcagcgagcaagggcagcacagctccgtcgccccaagaacaacaaacatcgtaacctcagcatacaacccagaccagagctgggcatctcctgctcagtcgatacctgacagcgcgagaacaccatcgggcgatgtgaaggtcaccgcctctggagcctgaaactgagatgaactgaccaggatccatgaaattcctggtctgtcactgctgcagccgcacaccatgatcgccggtggcggccaaagatggcttcatttctttctgacttgtaaaagatgtatctgagttccagtaggttttccatcttcaggcagaagagtctaactgcaattgctgtagctgtcccgatattagtcactgtttaagcatcaggctaccctgcttccttgtaacaccatgtcggtcttattggagattggagagttctgtagttacaaaattgtactattagttctgtgtgtgtgtgtgtgtgtctctaggcttctttttcattttgttggattactccacttaatttgctcctggtgtaccccttattaaattagcattagaattttttttcactctaatt

SEQ ID NO: 1781 - DNA, 1167 bp, Oryza sativa
  Predicted polypeptide sequence is orthologous to G1944
atggagcccgcgacggagaccacggcgacttcgccggctgcggctgccgctgcgcagccggaggcggaggcggaggcggaggcggagtcggcggcgacgccggtggcagtggcggcggcggcggcggcaacctatcagccgccagcgccggtggttccagtcgccgtggcaggtgcggcggcggggagagggaacgggaagaggaagagggggaggccgaggaagtacgggccggacgggagcctgctccggccgctgaaggcgaccccgatctcggcgtcggtgccggacgactccggcggggggcagtacacgccggcggcggcggtgggggccgtcatgaagcgcggcaggggccgccccgtcgggttcgtcagccgcgcgtcgccggtgtccgtggccgtgacggccgccacgtccaccgccgcggtggtcgtctcgtctccggccacccacacccagacgccgctcgggccgctaggtgaattggtagcatgtgcttctggtgcaaacttcacacctcatatcattaacgttgctgctggcgaggatgttaatatgaaggtcatatctttctcccaacaaggtccaagggcaatttgcattctgtctgctaatggggtgatttcaaatgttacattgcgtcagcaagatactttaggtggtacagtgacttatgagggccggtttgagctgctctccttatccggatcattcacgccaactgatagcggtggaacgagaagccgctccggtggaatgagcgtctcgttggcggccacggatggccgtgtcatcggaggcggagttgccggcctccttgtggctgcaagccctgttcaggttgtggtaggaagcttcctgccgagctaccagctggaccagaacgccaccaagaagcccgtcatcgagatcacgacggtgccgccgccgccgccggccatcggcttcaccatctccagcggcgaccctatggaggactcctacagcggcagccatggccagcaccgctccggcgccgccgcggcgacgacgacgacggcgaaggccaactcgacgtcggcgttcagggtggagaactggacgccaccggcgccgccggcggcggaggcggcgaggacgaagacgccgtcgtcggaggccaaagtcccagtccccggagcctga

SEQ ID NO: 1782 - DNA, 1104 bp, Oryza sativa
  Predicted polypeptide sequence is orthologous to G2052
tcttcttctgcccacgagaccggaagtatccgaacgggtcgcggacgaacagggcgacgagcaccgggtactggaaggccaccggcaaggatcgcaagatcgcctgcgccggcgaggtcttcggcctccgcaagacgctcgtcttctacaagggtcgcgctcccggcggcgagcgcaccgactgggtcatgcacgagtaccgcctctgccaggacctcgcccatggcgtctccaacttcatcggggcgtacgcgctgtgccgcgtgatcaagaggcacgaggcgggcctccatggcgagccgccggcggcgaaggcgaaaggaatgatcagcaaggtgtcgagcagctcgtcccttgtcaccgtcgaacaccagctcagcagccggggcaacgcctcgccgtcgttcacgcccaccaacaatggcagcccgctcgtcgacgagatgttcgtcggcggcggcggcggcgacccgttccagctgcttccgagctgcgtcccgtaccatggcggcgacgcgtgcgggttcgacttgccgccgctgtgcatgcctcagactcaggacccgttcttctccgacgccggcttcacgcaggcagcgcctcctctctacggcgacgtcatgggaagcgtgtcggagcacgagctcaagtgggacaccctgggcggctactccggcggcggcggtggggagctctggaacgcggcggcggcgccgctgctgtgcaggcaggccagcgacggcgacgacctcacggcgtggttcacggccgccgacgacaacatgtccgtcttctgaacgagtcaaccatgacacgtgtgctcccgggttagttacacatggcggtatatttttgagccattcctaactggggccccacgtgtcagccactacagacatatgtcatctattatatatgcataaatatgcctataatctgtatggatacagaggtgatgagctttcttttagttactggctgtaatacatcttctctgtagcatcatacagcagagctgggttatgtatcctcttcagttaatgtacttgtaacactgatctgtaagctaaaaggtagtgttgctggtagatcaatcttcatctc

SEQ ID NO: 1783 - DNA, 2323 bp, Oryza sativa
  Predicted polypeptide sequence is orthologous to G2141
gaaactgatcagatcacacacttcagactacagtcaaacagagcccttgcttgctttgcttgtgtcttcaacttcagagaccccctcctaccctcaaaaaatttcccctttcttttcctccgtttcttgcagcgacaagagaaatactaatactcctcctcctactactgctactgtgcaaggggaaggacacgacgacgaattggagagcggcgtcctctctgatccttttttttcctttattgcatctctctctctctctcgccatttttcttctaggttggtctctggatcaggccattgagggggaaagaaaaggtgcgggttttggggggaggttgttcttgcgggaggccgttgatttcgccgtgtgatcggagggagtgaaaaggagatgaatgagaaggacgccactgatttggaggagaggagtgaggccagtgagcacggccaagctctgagtttccatggtggtgccatgttcttgcaagaggctcagattgcttctcctgcagctgcaaataatgcattgacctccatggcgaatcctttccctatccctcctgggttgtggaatccaccttcacacaacatgggtttaggcgaaaccagtttttcatccttgttggggatgctgtcggccggcgcgccgccaccgtttgtggctactcccgggtttgtagattccacggcggggtttccttgctacaatggaggcaatcttggagccatgatcaatcaccctttccctggtatccaccagcctttgggtgatttccaaaacggcgtcgagccatgtagggagattgaggatattgagattgaaggatccaagaatgtgtcacaaactggtgagaagcagcaaggggatggtgagacaacgcatgccgtcgattcctcctccaaggagctaagcatgccagggcgcaatggtggcgctggccatgatgaggggactagggtgtcttgttccaagaagaggaaaagatcaggacaggatggtggggtgaagcatgcagaaggtggtgagcaattagcaactgtcggttcagcgcagaagaatgaggatgatgaaaagggtgaaccagagaggtcttctgtggcgtccgggaaatccagtgggaagcaaataaaggataatgcaggttcaccaaaggaagactatatacatgtaagagcacggcgcggtcaggctacaaacagccatagtcttgccgaaagggttaggagggagaagatcagtgaaaggatgaaatatcttcaggatcttgttcctggttgtagtaaagtaactggtaaggctgttatgctggatgagataattaactatgttcaatcattacagaggcaggttgagtttttgtcgatgaagctagcaagtgtcaatccaacactggacttcaacatagaacgcattttatctaaagatatttttcaatgtcgaggcactactgcatcatctgcctttggcttcttcccagacattgttcatccccgattacacccaccaaaatatacacaagttgggatgcccagcattgtgaaccccactgatgcatttggaagagtaatccatgctccattaggaactaacagtgcattcaaagaacctaaacatcagatgcccaacaatttgaatggagagttccaggacgtcattgagatgccttttactcatgaccatcatggatcaaatgatcaaccctgagattgattccacaactgaagcaagagatcaatatgtgccatgggctttcagcaaaactgtgatatatgagcatgttgatatcatggtactagctcacggctgatcactgaagtataagcatccaaaatgcttagttagtgctatttttctcatgttcatagcagcaattgacctcctgtggaagcctctctttggatgttccatttgctgttatagaaagttgggagataaaaaaaaaaggatgttcacatggagatctcaagcaatttgttctccactgaagtagtctacagtcttgaaatggcgagaagcttcattttgcaagaaggtgatttttctgtggtctcgtcaaccccaggattattacatacactagctagcattgtgaggctacagaaattgttctttgttgtacttgcttagcccatgttccatctgacaagcaacataggcagaaatgcagtcactgattttgtatttgttgaaaaaaaaaataaatgggcttggcctgatgtagcaagcatttgaattttgcaacgggtgcctattggcacagatgtttttattccagcaaagctgtgaattctgaaagagaagaaaagagaactgtgatcc

SEQ ID NO: 1784 - DNA, 2140 bp, Oryza sativa
  Predicted polypeptide sequence is orthologous to G2141
gaatatgaaattttcttgattcttgaaggatggtggggtgaagcatgcagaaggtggtgagcaattagcaactgtcggttcagcgcagaagaatgaggatgatgaaaagggtgaaccaaagaggtcttctgtggcgtccgggaaatccagtgggaagcaaataaaggataatgcaggttcaccaaaggaagactatatacatgtaagagcacggcgcggtcaggctacaaacagccatagtcttgccgaaagggttaggagggagaagatcagtgaaaggatgaaatatcttcaggatcttgttcctggttgtagtaaagtaactggtaaggctgttatgctggatgagataattaactatgttcaatcattacagaggcaggttgaggtatgatgtttgtaaaacttgtagggccattttcagttttacttgcatagtcctgctgcgatgtaatctggtatacccaatgtgtgcatgttgggcagtttttgtcgatgaagctagcaagtgtcaatccaacactggacttcaacatagaacgcattttatctaaagatatttttcaatgtcgaggcactactgcatcatctgcctttggcttcttcccagacattgttcatccccgattacacccaccaaaatatacacaagttgggatgcccagcattgtgaaccccactgatgcatttggaagagtaatccatgctccattaggaactaacagtgcattcaaagaacctaaacatcaggtttgtaccatcacttgcatttggctaaatggccattttcatttcatgctctttataccaaatactgtgttcatgaaaaataggacaagtttctgcaagatgttccaagacctaatttagtgttatatggcttggtgtttcgagaatactgctccacagatagtcgttgaaaagaatgtccacataatattttaaaccaagaaaagctagtcccctttatatccttttgctgggtcttgcttcactacccatctttccaaaaagttcgtgggtcttaaaagcaaagcaaactagataacataactaaactgagacattttagacaacaaacaaaattcctactatctgtttttcataactagccagattgtgcctgattcttttggccatgcaagctgtttgaacctagtccatcaatcagtctctttagcttctgactcattaaccctcttcaacctgattttagtgggaagagcattgttgatgttaaccgacattgtaacctcagtagcactaaccatttcactagtaaaccaactaaaaatgtacaaatgcagcttgttatatatctaattgtatcttcatcactacatatttgccttcacagttatctaaaacatatgctttcatattcataaacatttttttggaaagcggagtaccaaagcactgttttagtattttgcaatcctcttattacttgtgcattggacagatgcccaacaatttgaatggagagttccaggacgtcattgagatgccttttactcatgaccatcatggatcaaatgatcaaccctgagattgattccacaactgaagcaagagatcaatatgtgccatgggctttcagcaaaactgtgatatatgagcatgttgatatcatggtactagctcacagctgatcactgaagtataagcatccaaaatgcttagttagtgctatttttctcatgttcatagcagcaattgacctcctgtggaagcctctctttggatgttccatttgctgttatagaaagttgggagataaaaaaaaaaggatgttcacatggagatctcaagcaatttgttctccactgaagtagtctacagtcttgaaatggcgagaagcttcattttgcaagaaggtgatttttctgtggtctcgtcaaccccaggattattacatacactagctagcattgtgaggctacagaaattgttctttgttgtacttgcttagcccatgttccatctgacaagcaacataggcagaaatgcagtcactgattttgtatttgttgaaaaaaaaaataaatgggcttggcctgatgtagcaagcatttgaattttgcaacgggtgcatattggcacagatgtttttattccagcaaagctgtgaattctg

SEQ ID NO: 1785 - DNA, 2079 bp, Oryza sativa
  Predicted polypeptide sequence is orthologous to G2141
gagtggtagtctatgatcttctacctctcttctccctcttgctggaacatatagcatcagaatcctcactgggcatctttccttttcttgccatatctggccataggctacaataagagttcttgcttgcttctcctcctcctcctatcgcattgttcatacagctctgatcaagctctctaagcatcgatcacttggttcttgctcatcatctttcgcttgctcgtcagctaggaattcgtagtcttgagccgaggttgggtgattcgatggacatgagcgagagcagtgagaaaggaatggagagcaatgcgtcgtctggccctggcaatggcatcccggtggagtggcagagccaattcagcagcgccttcgcgtgccagccgtcggtggcggcgcagcaccagcagcacgccatgatggactccttcgcggcggcgtccgccggcctgtgggcgtcctccgacgtcgtcagcgccatgtcatcggccgcgccgccgcggggcgcggggttcttggcgccggtgcccgggttcctccagcaggggctcggccatttcccggtggactccggcttcatcgagcgcgcagcgcggtcgacgtgcttcggcggcgggatgatggccggcggcccatacggcgcagctgaccaggccatgggcgacgctttcggtggcaccgcggagggtctcatggatcatcacaggaacgttggcaacgacaaggccgaggagttcgccggcaacggccacgacgaggtgccgagctcggaggtagccggtggagactgctcctccaaaggttcagactccaagaagaggagaaggcctaacgaggtgatgggaaccgatcaagtccattcttccaacttgccatctgattctgcgaacgagagtgttcacagcaaagacaaaggcgaggagagcagcccggcgacgacgaacggcggcaagtcgaaagggaagggagcaaaggagacctctgagtcacagaaagaagagtacattcatgtccgggctcggcgtggccaggcaaccaacagccacagcttagcagaaaggttgagaagggagaagatcagtgagaggatgaaacttcttcaggacctagttcctggctgcagcaaggtcaccggaaaagcggtgatgcttgacgagatcatcaactatgttcagtccctgcaaagacaagttgagttcttatcgatgaagcttgcgacagtaaacccaaggcttgacctcaacatagaagggcttctttcaaaagaccttcttcgcttccctggagttccttcatcctctatcggattctccccagaaatgatgcatcctcaactacaattgtcacaaccaggactgattcatggtggtaccgctggcatggccaaccccgatgtgttcagacgaataatacaagcgcaattaggtgcaaaggatggatctcagatgccccactcattgaatggatcattcagtgacgtttcccaaatggcgtacccgtccctcggttctcaggacctaagcatcaggccatctcaggatgggtttcaaatgtgaagaagacgaagaagaagaagatgatgatgatgagggggccaattccatgtacgtgcaattgcttctggcatctggtgaacaagggcaggcacacgcacatgactgaagcttgctactactgctggagaagcagcgtttgcagtgctgctagctcatcgcgtaactgaagtctgaagggcttttaattccttccgtggctagctgtatatccatcgaggttttattgtgttcagaactgaaactgaaaggcttttgagccccacgtacagggacgctggaaacgaaaaatctgcgtccttgatggctggaaattctgtctggggagcgtgcatttacactgcagcacgaggagcagcaggcaggcagctgaatttgctgcagggctggcacaatgcaagatcactcatccggtggctttgttaagttacttccgattcattgttggttgcgaaaacgattaaacaactcatcataaacgtggcgctgaatggtgttaatgttaagatcaaacacatttgactcc

SEQ ID NO: 1786 - DNA, 1098 bp, Oryza sativa
  Predicted polypeptide sequence is orthologous to G2141
atggatgctaatggcggcaatgggtttggagtagagagcaacgcttcggctgtccatggtggcatggcgatggcttggcaatggcatggcggccagatgagcggcggcagctcgtgcgctgcggcgccgccgccggtgcaacagccggcgatggattctctcgcgtggtcgtcgacggtctcgccgagcaccggcgctgccacggcggcgagcggcgccggcttcttgctgccaccggcagccgtgcgcggcggcttcggcagtttcccggtcaactccggcggcatcgtcgagccggccggtgactgctcgtcggagtccaagaagaggagatcagacgagattgctggaacggatcacgcgaacgcatcgaacgcgcttgccgattctgggaacgagaccgagtgtagcaaagatgtcaacggcgaagtgatcggcccgccggcgacggcggcggccggcggcaagtcgaaagggaagggagccaaggacgccggcgaggcgcagaaggaagggtacagccatgtcagagctcggaaggggcaggcaaccaacaaccacagcttagcagagaggctgagaagggagaagatcagcgagaggatgaagctcctgcaagaccttgtccctggctgcagcaaagtcaccgggaaggcgttgatgctcgacgagatcatcaactatgttcagtccctgcaaagacaagtcgagtttctgtcgatgaagctctcggcagtcaacccaagaatcgatctcgacattgaatcacttgtcaacaattccaaggatgttcttcgttttcccgggcagccttcctctgctcccatgggattctccttctccacggagatgatgccggggctacaattatcacgaccgggcatccttcagggaggtgtccatggcatgatcaatccagatgtgttcaccagcctcatgcagaagcagcagcaaaatgacaagggagcattcagagagcctcagatgcatcagactttggatggatcattccgtaacaccgcacaaatgccgtatccacaggtcatgagttcagaagagctaagcatcaggcaagatcaagatgggtttcacatgtga

SEQ ID NO: 1787 - DNA, 753 bp, Oryza sativa
  Predicted polypeptide sequence is orthologous to G2146
atggcgaaggtgcgggggaaggcgggtgcgggtgcgggcgccgcggcggcggcggcgacgaggaccaagtggaggagcggcgcgcaggagaggatctacgggcggcgcctgctcgacgcgctgcgggccacgcgggacggggctgcaggcgggggcgggggcgcgccgccgcagccgcgggcggtgaaggccgcggcggactcggcgctggcgctcaccgcgcgggggcagtcgaggtggagccgcgccatcctgctggccggcgcggcgtcgtccaggcgccgcgtgctcgtcaaggccggcgggaagatccgccgcggcggcggtggcaacagctgccgccgcccgcaggcgcgcgccgcggcggcggcggcggctaaggcggccgcggccgcctcctccgccggcgagcccccgatgctgaaggagaggaaggtgaaggagcgcctccgcgtgctgggccgcctcgtccccggatgccggaagctccccgcgccggcgctgctcgaggagacggccgactacgtggccgcgctggagatgcaggtcaaggccatgcgcgccctcgccgacgcgctcgccgccgcgcagctctcctcgtcaactccgcagcaggcggaggccgccgccgacgagaccgagatggagagggtttgggatttgaggagggtaattgcgatgattgatgctgctgataatgctgctgctgctgctgctgctgatgatgatgatgatgacgatgatgatttgtaa

SEQ ID NO: 1788 - DNA, 644 bp, Oryza sativa
  misc_feature (2)..(52): n is a, c, g, or t
  misc_feature (589)..(644): n is a, c, g, or t
  Predicted polypeptide sequence is orthologous to G2146
tnnnnnnnnnnnnnnnnnnnnnnnnnnnnnnnnnnnnnnnnnnnnnnnnnnntttttttttcctagcaacaaaattcaataaaatctggtgccatgcattcacaactcctaagcaccagcagctagctaatctgcatttgttgctgctacttccatgttccgacgacaggggcaacagcaccaggaggtggaaaattcaagtggcagagcttacactagaattcctacttgcatctagcttgttgtcccactatacaaaataacatgcgtttgcctgccagcctagcaagaggtgaaagggaacaagtaatgcgtacgaagagtagaaacgaacgaaactcactacagaagattcaaacgcgcgcttacacgagacctcttacgagacacacgtaacctgtggcgcccacgcatcattctcatataggcttctccggcgtgacggatatttctttctccggcggcgagccgaggccggacaggaggcaggcgagcgcgcgcatgacgccgacctgcgcacgcaaagcggcaatgtagtcggccgtctcgtccagcagccgctccaccgccatcgcctcgccccccgggnnnnnnnnnnnnnnnnnnnnnnnnnnnnnnnnnnnnnnnnnnnnnnnnnnnnnnnn

SEQ ID NO: 1789 - DNA, 809 bp, Oryza sativa
  Predicted polypeptide sequence is orthologous to G2146
ctgcggtacggtctggaatccgggcttatctctctggattggatcggcgggcgagcggcgtcgggcgggcgctgcgacgacgatgtgcgggcgagggctgaagcggcggtggcctcggcccgcacgcccgggcctacaatgcctccaagcataccatcgtgatgccgcctgcgagctcggcgcccatagcatccgcggccgtctcctccgccggtgagccatcgatggtgaaggagcggctccgcgtgctgggccacctcgttcccggatgccggaagctccccgcgccgatgctgcttgggccaactatgtggccgcgctggagatgcagtcaaggccatgttctcatagacctcttggccgccaccgccggtgacgcgtgcgacaggggacgccgcgtcaacgggcagcgagcggcacatgacgtcggagatcgagcagtaccgccgcagcgacggcggtggggcgggcgcgaacatgcgcttgcgggtggcgatcgatcccctcgtcgattaggataatgagaaaggtaattacccaaagccattttgatttactatcaggcttggttacgggcagcaatcaattggttggtttgccttgttgatcaatcggagaaggaggtgcaggtggcggcgttaaaaacaaaaacaaagggcggcggacaaaaggaccaaggttagaacgcgttaattaaggcaaaaccttcatagttcaccaaaatcatcacggcggcgttaacagttgcagtgacaactgcttcccatatctgcttaaaaaccattagatggtaaagaaaacgacgaaca

SEQ ID NO: 1790 - DNA, 491 bp, Oryza sativa
  Predicted polypeptide sequence is orthologous to G2150
ctagtggatccccgggctgcaggttttttttaagggtagaaaaaatctgagtgatttttggttagaaatcatccgacaaagggatagacagttccagtcagaaaaataaaaagaaaatgaaagaaatgaaggcctcgaagcctcgtcgtcatcgctgcttgacggagaccgccgctcgccgttcttgattcttcccctggtgccccgccgttctcggctcttccccctggcgcctcgccgttcaccaccgtcgtcagagtttgaggccgctgaatccagatcctttggagccatggccaccggatctggcccgtcgcaccttgtgaaggacagaggtgcagtggtggctagcgaggaacacatcaccggcaatagcaagaccgaggggaagacaatggaggcggcagcaacatcttccatcaagtgccgagatccgggtattctcgtcaagcccttcttcgtcctgtcctcttcttcctcctggatctgtc

SEQ ID NO: 1791 - DNA, 582 bp, Oryza sativa
  Predicted polypeptide sequence is orthologous to G2226
ccacctcgctcccccgtaaaacccgaaattacaatcaggtcctcggcggacgccacccccaaatctgaaaccctcgccgccgccgccgccgcgcgatcccccccggaattccatcggatcggcccccgcctctccggcgagatgggcatctcgagcatgccggcgcccaaggacagcgtggtggcgtacctgctgtacaacacggcggtgtcgatcgccatcctggcggacatggtgcgggcggcgctggtgttcctcggcctccccgtgccgccctcggcgtgggaggacggcgacgaccagctggcggcgatcgcggcggccgccgcggccgcggccgcggcggcggggggcccgagcctggcggacaggttccggagcaggttcaggccggcgaggttcgggcggcggcgaggcgggggcgcgggcgcggcctactgccgcgtctgcctcacgcggttcgagccggaatcggtggtgaaccgcatcccctgcggccacctcttccaccgcaactgcctcaagaagtggctcgactacgaccacgccacctgcccgctctgccgccaccgcatcctcccc

SEQ ID NO: 1792 - DNA, 609 bp, Oryza sativa
  Predicted polypeptide sequence is orthologous to G2226
gggggggaggacgcggccgtggccgtgtcggtctccgcggcggcggcggcggcggggcccagcctggcggacacgttcagggcgaggttccgaccggcgcggttcggccaccggcgctgcggcggcggcgcgacggcggactgccgcgtctgcctggtgcggttcgaggcggaggcggtggtgaaccgcctcccctgcggtcacatcttccaccgcgcctgcctcgagacatggcttgactacgaccacgccacctgcccgctctgccgctcccgcctcctcgccgcctcctcctcgccgccggccgccgccgccgccttggcccggacttagcgagtggattcgattcgactcgattcgattctccgacgagccgccccgcgctggctacgcgccaccgtctccgggtggcctccccgtgtgggcgtaggaaactagagagagagctctttgccttttttgcactttcacccctcactttgtcccttttttttccgtttcgggcggtttgtgcctgtaccgtgtaaatacctcgcagcaagagagtgctcctacgggtgtagcactttttgtgagctttgtgtataaaaccttctcggaatagcaacc

SEQ ID NO: 1793 - DNA, 992 bp, Oryza sativa
  Predicted polypeptide sequence is orthologous to G2226
gtaccatctcccgtgtcctcctcccacctcgctcccccgtaaaacccgaaattacaatcaggtcctcggcggacgccacccccaaatctgaaaccctcgccgccgccgccgccgcgcgatcccccccggaattccatcggatcggcccccgcctctccggcgagatgggcatctcgagcatgccggcgcccaaggacagcgtggtggcgtacctgctgtacaacacggcggtgtcgatcgccatcctggcggacatggtgcgggcggcgctggtgttcctcggcctccccgtgccgccctcggcgtgggaggacggcgacgaccagctggcggcgatcgcggcggccgccgcggccgcggccgcggcggcggggggcccgagcctggcggacaggttccggagcaggttcaggccggcgaggttcgggcggcggcgaggcgggggcgcgggcgcggccgactgccgcgtctgcctcgcgcggttcgagccggagtcggtggtgaaccgcctcccctgcggccacctcttccaccgcgcctgcctcgagaagtggctcgactacgaccacgccacctgcccgctctgccgccaccgcctcctccccgccaccaccgagtccccctcgccgtcgccggcgacggcgaccccccatttcgcccggatttagagagatctccccccttcaatccgccactgggccgtgtgcgcgtaggaaaattgagaggatcatttagctctagtgctagctccatttagtgctcctttttccccccactttcttaatttttttttcacctctttgcagtgtttttttttaccatcttcgagtggccttttcttttcttttctttctttttttacttctttgtgttgctgctgtaccattgtaaatatttgcagagtgctccgatcgatggagaggtgtagcacttgtgtacagggcttttggaaagcgaagagatgagaaggagagaaaaaaaaatcattgccc

SEQ ID NO: 1794 - DNA, 1223 bp, Oryza sativa
  Predicted polypeptide sequence is orthologous to G2251
ctctctctctctctctctctctctaaagattccatctttgatttcgtttctctctctagaaggaaggaaggaggtcgccggcggcgatggggttcccgtcggtgtgctactgcgtgatactgccgcagccgctggtgctggtgctgcagctgctcgacctgctgcgccacgccttcctgctctgcctctccgcgctcggcctcgccgcgccgccgctcccggacgaacaccccgcctacgcgccgcccccgccgccgccggcgtcgatggcggccctccccgccgacctcgtctgggcgttccagcccgcgccggagccggccgccatcaaggcgcgcctccccgccgtccgctacgccgacttcgtcaggtgccgccgcgccgccgcggcggccgcggcgtcgtgcgtcgtgtgcctcggcgcgctcgaggcgcgtcaccgggtgcgcgagctcggcaactgcgcgcacgcgttccacaaggcgtgcatcgacaagtgggtcgacaagggccaggccacctgcccgctctgccgcgccgccctcctcccctccgccgacgacgccgacgccgccgccatcgccgccaccaccaggcaccacctcccctccttctgatccatgtcgccaagaacccatcttgcttagcacccaacacccccttccaccccaagagcaacaagggttccctcctcctttctccaccaatggatcaaatccaatcaaaatggaagaacacacaacacaagagaagagagatagagagagaaatcaatggaggaagaagatgagaggagagagagggggtgtgtgtggtggaggagtattattggtaggtgaggcactaattatgaggaggacaaggatggctacctgcactgcattggatctggtgaatttcagccctagctagctatagatccaacatctcctctcttcccttctcttctcttctcttcacttcacttcacatcaactttttctttgcttttcttttttctactttactttcttcttttgttgccttcacctcctttttgaaattttgctttctttctctttaatttttctccctctttttccttcttttttttgagggtttcctctccccttgtcattaacttaatttgtaaggggggattaagagagagagatgtgtacatacctgcctccactttgacaaatatcggaataataatttataatgatgatgatgatgatgat

SEQ ID NO: 1795 - DNA, 1039 bp, Oryza sativa
  Predicted polypeptide sequence is orthologous to G2251
gtcactcgtcaccatcctccccctttgctttccacgactctctttcgccgcagtctctgcttccgtgcatccatcggcgttcggcgactcggtgtatagtagtattgccaactgtgcgtagcaagctcgatacagcggcgatcatggggttccctctggtgtgctactgcatggcgatccccaagccgctcatcgccttggccaagctcctcgccgccatcagggaggccctccagctgatgctcttcgtcgtcgggatctgccaccacccggagcgatcgggccgcccggctgccgtcgacgccccgctgcccgacgaggtgaaggaccgcctcccgcccctcgagttcgcccagctgctcgcggcctcggagcacggctgtcatggctgcgacgacgacgaggcggtggcggggtgcatcgtgtgcctggagaggctggaggcggatgacgtggtgcggcggctgggcaactgcgcgcacgcgttccaccgcggctgcatcgaccggtggatcgacctcggctggttgacgtgcccgctgtgccgctccaccctgctgccgcgcgcgcgccccgccgccggcccgcgcgggcgactgggccgcctcgccacccgcctcacgggcgtcgtttggtgaatcaatatttggcccgcgcgaccgcgacgcgacacgggatcggttgggtgggagggcagtcgcgccatttcacagcctaagctagcttactgctgctgttaatcaacggagacaaagctctctttccctttcgtttcctttttctttttctgccgaggattatccagctggaggagagtggtacgtgtcggaatgcggtggaatatatcgatgattagacggtaggaacaattaattagaagcaggcaagcagctggttggttggcccggcctggcacctggcatgatcattgggaggttcatgtaattactgcgatgattagatactgcatgtaagtaaatcatgtcatagagataatacacctgtgtacagtggtataatgataaacggttcatttggt

SEQ ID NO: 1796 - DNA, 494 bp, Oryza sativa
  misc_feature (52)..(52): n is a, c, g, or t
  Predicted polypeptide sequence is orthologous to G2346
tttttttttttttgtacaatcctaatttcactcacctccaacaacaatgatncggttgtacatcacaatttacataagacaatttacataagattctttgttatacatcactcataactccaaagttcacttgtctactacttcctctgtttcacaatgtaagactttctagcattgcccatattcatatagatgttaatgaatctaggcatatatgtgtctagaatcattaatatctatatgaatatggatctagaaagtcttacaatatgaaacggagggagtatcagttagcagatcaatgaaccaactatgacacaattgtagaccagagaatattttagaaattgacaacattacagctacgattgaacaaatgctaagaaggataaagaacacataccagccttatgtcctcttcatttgagtagtaactcttaccttttggatcaacaacttctagggaccaccacacagtgctggcgtgtaaatct

SEQ ID NO: 1797 - DNA, 1269 bp, Oryza sativa
  Predicted polypeptide sequence is orthologous to G2520
agcgctctctccctctcgtcaccgctactactagtgtacagtgccactgcgagctctcctctccgcccccgatctggtcgcctcgctcgcctcaaaccctagagctccatccaccggcgagccctcttgggcggaggtgcttcattgctgctgctgctgccatggaccccgcccccacgctcgccgccgagctctggcgaacgccgtacctcggtggcggtggtggtggaggaggaggagggcgtgggttggaggcggcggcgtccggggtcacggagcagagcaatgggagccgcgggggtggcggaggaggaggcgcagggcggaggaggcagcgggaggcccccgcgctcgaggacgactcgtccaggatcgtctccacttccggaggaggaggcggcggtcaggatttgactgattcagaagcaaagcgtttcaaggcaagtaaatcaagtggagataatagcagtttaagaacagaggctgaaactgattcaagaaatgctagcaagtctggtgatcaaaatccgccaccaccagaaccaccaaagcaagactacatccatgtgagggcaagaaggggtcaagctactgacagccatagccttgccgaaagggcacgtcgtgagaaaataagtgagcggatgaaaattctccaggatcttgtccctggatgcaacaaggttattgggaaagcatcagtacttgatgagataattaattatatccaggctttgcaacggcaagttgagtttttgtccatgaagcttgaggctgttaatgctcatgtgaataatggaatcgaagcatttccacccaaagattttggtgctcaggtatacaacacggctcctggattgacgtttgatccacaaacaccaagagaatacgcccagggatcaacaccatcggaatggctccacatgcagattggtggcacctatgaaagagtgacatgaacagaacaaagtcaggatggtggcccaaaataaagcataccatgagttcagtcagaaaccacggctttagattatttttcgaaactctcgtgctccaaattcgatttcattcatagcatggagctcatgtatttagagactgcgagcacagtatttttacatctgtaccgggatacaattctcatcagattcatgtattccacggaatttcggcaggtcacgctcattcgtagcatgaaagaaaagtaataaccatcaataattctcttgctataaatcctaaagcccttcatttaaaaaaaaaaaaaaa

SEQ ID NO: 1798 - DNA, 422 bp, Oryza sativa
  Predicted polypeptide sequence is orthologous to G2520
attgttgcttttccatctaaagattttggtgctcagccatataacacagctgctggtttgacatttgatccacaaacaacaagggaatttgcccagggttcaacatcagagtggcttcacatgcagattggaaatgcatatgaaagagtgacatgaataaagcaagcaaaaccataaaacataattccttgtagtggcaataaagtgtactgggatcgatcaagcctgtggtcctaggattatttttttttctcaacaatttcttctcattatcatgtcaccaagttatttttttgttcctaatttggtccatgatgccatagatacattcatcttgacctgttgatactcaacggtctatctgctttgcttgtatcccatggtctttgtagctcggatttgaatagggaaagaagaggatg

SEQ ID NO: 1799 - DNA, 455 bp, Oryza sativa
  misc_feature (346)..(346): n is a, c, g, or t
  Predicted polypeptide sequence is orthologous to G2574
aattatgattagatgaacgatgggtgtcagtggcggaaatacgggcagaaaatctcaaaggggaacccttgcccgcgcgcctattaccgttgcaccgttgcacccaactgccctgtacgcaagcaggtacgtatatacgcgtataaatacgtatttacgtttacaaatacgtatatgattcgaatgatgcgtacttaaattgaagcgaaaatttaaatttgtgttggttttgtgttaatcgatggatcaggtgcagagatgcgcggacgacatgtcgatcctgatcacgacgtacgagggcacgcacagccacccgctgccgccggcgggggggcggaatggcgtncacaacgtcggccgcggcggcgatgctgacgtcttggctcgaccaactccacgatgcaccggcagcggcggcgttcaccacaactgccgttcgcctcggccgttggggg

SEQ ID NO: 1800 - DNA, 1383 bp, Oryza sativa
  Predicted polypeptide sequence is orthologous to G2574
gctctctccatgcccaggcgagggagtccgccgcctcgcctcctcacgcgagccactgctgtcgccgcaccatcgtactgtcgtcgccatcctcctctcgctccggtcgatgcatccgccaacgaggaggccgggaccgtcggatccggtgaccccggcctcctcgtcggcggaggggagaccgactgtcaccctctctactcttctccttctacgtccggcaccgctacaacgacggccgcgcggatcgcgtgaggcaacgggtggctgctccctactcttctccctctccctctccattctcttcctttgcagatcggcggaggcttgcaacaacaacaacggctgcgtgggtgagcaatcgaggaggccaggaatcaccagatccggaaggacggcggcccggttcggagagggagcatcccgatctgtggcattgaggcccattgtaagtgtcgatggcggtcgttccttcacagtgatccagggccgctgggtctattgagctcggtatcgacggcagcagcagctcgggcaagatggaagaaatgtgtcagacactgcctcctccgagagcatacaccagcgacgaggccaaagtcgatcttccgcaaccccgtctggcattataacttaatcacttcagcttcagcttgcttggagcacgccggcgcagggtttcctcgacgggtcttggctctgccgtgccctcctcgcgccgccctttcatactgacagttgttcgaggttgcctcccccgctcatggcgacctccacctcagttggagttgggaagctcctttcccgacgtccccacaacacggtgaccttggcctcaacccggtgctgctacgctcagctcaacgattgctcaaactacaatgggcaataacaatattgcatttgagggcctcatttttggttgccctcacctgagcatatgtaggatacagcctgtgatgatgccgttagtacagagttgttccctctctcagcctcccaccatcttctcctgtctctctctgagcatcacctccattgctgtcaaggtgatgtttgagctcaatcggtcaaagaaggttgaatatgtaaataatttgccaacatgattttctcatattgggtggtttagtaagttaacacttaataccaatcacttcatttcagcttctcactaacaagcagccaaggtctcttcacggattattgtccatggatggccaagcttttcagcaaaatgaaaaggtgaaatataatgaaatattattcccttgctccataaagcttcagatgtggagtgagcttgctgctctgcaagctgacattccatttttaaatgtagagtgtgcttgaattaatcaaagaagcagatttatatacatc

SEQ ID NO: 1801 - DNA, 600 bp, Oryza sativa
  Predicted polypeptide sequence is orthologous to G2574
atgaaacttttgaagagaatggattacccggccaggcggtcaagcgaagaaagaaaaagttctgctgtcgaggttggcggcgaaagaggtgcgccgccgcccagcagcggcggctctgtcgtctcgcggaggggacgttgtggccccatgcacggcagcgacgcgcgcggctgcagccggcgtccggcggcaacgccgggcatgcacgagagacatcagccatcaagttgggccaaagctcgtgcggtggcgcatcccagatgcgagcgaagacagaggaaggtcgtgggcgtatcgctggcgtatcttgatttatttatttttttgcaaatcacaaatatgtgggatacgtacgggatacgtattggagcgtatccgatacgtatccgtatccgttgccgtatccgacacggatacgtgactatacaagcatatcaggatgggacaggcggcatcgcacccacgtcctaccctgtgtcaggcggcgtggggcaaggcgaaggacgacgctggggcccacctgaggacgagcggccaccttactttcggcctaaggcatgggcggtagctcgacccaggttgatgtgggcccctctctag

SEQ ID NO: 1802 - DNA, 483 bp, Oryza sativa
  misc_feature (297)..(297): n is a, c, g, or t
  Predicted polypeptide sequence is orthologous to G2574
ttttttttttttttttttgtcctttgaatcttatcgatctttaccgaagtggacatcccaggaccacaaaacccacagcatcttcagaacattcgacgaattcatgacatgttacactgagtatgaatcacacaaaactcttgactaacttataccggtaccttcccactcttataaccataacgagaaccagcacttaaggcggaactcccgacttcggtagtaagaattcttaatttggccaaaaggccaagtcccccactaatggaccaaaggggaatcaccaaatatacttgngctggaattctctcgatttattccaatcttcccgaggcggtccttaggtccgacgccctttggtaccctgctgtgctctgccctatagcgctccgaaacccgttagctttacgctaccctcctacgcacggtcaatctcgtcgcgccttgttggtccacactggttctcgccccccaccgttactc

SEQ ID NO: 1803 - DNA, 673 bp, Oryza sativa
  misc_feature (11)..(75): n is a, c, g, or t
  Predicted polypeptide sequence is orthologous to G2574
tgcgcgatgtnnnnnnnnnnnnnnnnnnnnnnnnnnnnnnnnnnnnnnnnnnnnnnnnnnnnnnnnnnnnnnnnnttttttttttcagtagatcatcaacttaatttacaggtggaaaattaaggcgagctatgtagttaaatgcccctatgtgatgtggtggcaaatcttgaccaacaaaaagaagaattcaaagaagaagaagacatattactggcttgatccatacatatagcacagccctagagcacagcctactacccgccggatcttgaatgtgcagcgccgtgcgagcgacccgacactgaacgaacagaacgagcacgtgacgcgaccccattgtgacccattctgtgcgaacatctggcacctcgaaatctaccttgacacagcatctactaccagactcacaccaacaccgaatatctagacaatccgtatacataggacaaagcggttataccaggaccatctgcacgcccatgcataccattactacgctcccatggacgtccaaggtccacagctccgaggcagcggctagcacgactgacgatcgatccttcgctacgagctgtctcgccgcacagcgcgatccaaggggccccttagacccccgcaccccggacccagcggttgacccccctctcggcacagaagaacagagcgagcg

SEQ ID NO: 1804 - DNA, 1524 bp, Oryza sativa
  Predicted polypeptide sequence is orthologous to G2574
atggacgtcgtcgtcgagagcccgccggtgagggacgagaagaaagtcgacgtcgccgcgattggaggcgcgcctccaatagtctttgagagttttgcaccatcgacgcagagagattcaaccatcatcaagaaggaggagaagatggaggcagcgaaggcggagatgggcgaggtgagggaggagaacgagcggctcaagacgatgctcacacgcatcgtcagcgactacaagtcgctgcacacgcacttcctcgacgtcgtcaaggtcaaggagcaaacggcggcggagctctccggagacgacgacgacgacgagcccgacgacctcgtctccctgagcctctgcacgaggcccaacgccgccgcgacgcgccggaagggccacgagaggacgccgtcgtccggcggcggcggcgacgacgggcggctgtccctcgggctgagctgcgctcgcggcggcgttgcctccgacgacgacgacgacaagcaggcgagccgccgcgcgttgccgccgatgcccgtgctgaacctcagctccgacagcagcggggacgccgccggcgccggcgccggcgagcctacccagccgaacaaagcgtccaggagctcgagcggcggcggcgatggcgccgacgacgaggtgctgcagcagcagcaggccaagaaggctagggtttccgtcagagtcaagtgcgacacccccacgatgaacgatgggtgtcagtggcggaaatacgggcagaaaatctcaaaggggaacccttgcccgcgcgcctattaccgttgcaccgttgcacccaactgccctgtacgcaagcaggtgcagagatgcgcggacgacatgtcgatcctgatcacgacgtacgagggcacgcacagccacccgctgccgccggcggcggcggcgatggcgtccacaacgtcggccgcggcggcgatgctgacgtctggctcgaccaactccacgatgcacggcagcggcggcgttcaccaccacctgccgttcgcctcggccgtcggcggcggcggcggcgtcgggctgctcggcccgaccaccatctccaccgccacgtcctgccccaccgtcacgctcgacctcaccgcgccgcactcgctcctgcacccgtcgtcggcgtcgccctacgccgccgccgccgcggggtacgagtccagcagggcgctgccggcggcgtggagcagcgggtacctggcgtacggcggcgcggcggcggcgcagccatactacgccaagggcgttgcgccgtcgccgttcggccatcatttcggcatgatgggcatggcggcggcggcggcgaggccggcgccggagcagctgttcggcggccagacgacgtcgccgtacctgcagagagccatcggcggcggcggcgtcgcgccggcggccgtgacggacacgatcgcgaaggcgatcacgtcggacccgagcttccagtcggttttggcggcggcgatcacgtcctacatggggcgcggcggcggcgcggcggcgccgaacaagtga

SEQ ID NO: 1805 - DNA, 255 bp, Oryza sativa
  Predicted polypeptide sequence is orthologous to G2590
atggcgcggcaggcaacgacactagatccacttgtcccgaggtcgtcgccggcggatctgcccttcccttggccattggcagtggatctagccctcccgcaatggtcgccggcggatccgcccctccccgcctccgctatccgcgggcgttgctgcgccgctgtatgccgcagcgtcttcactgtctacgggcattatgctgtgcaaccgtatgtcgcagtgcctccgccgtccgccggtagcgccgccgtctga

SEQ ID NO: 1806 - DNA, 1394 bp, Oryza sativa
  Predicted polypeptide sequence is orthologous to G2719
aacgaacgaactagcaccaaccccacagcaccagccaccaccatgtcgtccgaaaccgccgcttcgccgccgccgccgccgccgaatccaccggccgccgactccacccattccagccccgcctccatgaccgacgagacgcacggcgcaggagcccatcccgacgagtcccaaccgcatcgctcctcatcgtcgtcctcctcccctcccgtggccgtcgacggcgagacgcgcgtcccactcccagtccggtccctgccccaacctagccacccatcgccgcctccttcgggggaggacgaggatgacgtcgtcatcaccggccaaatcgcagtgggtgacgccgcgggggcggcgatggaggagcgggtgaaggggccctggtcctcggatgaggacacgctgctgagcaatctggtggagaaactcgggccgaggaactggacgctgatagcgcgcgggatacccgggcgctccggcaagtcctgccgcctccgctggtgtaaccaactcgacccccaagtcaagcgcaagcccttcactgaggaggaagaccgcattataatggctgctcatgcaatccatggaaacaagtgggcggctattgcaaagcttttggttgggagaaccgataatgcaatcaagaatcattggaactctaccctgaggcgtcggcactgcactggtggccgatgcacacaaggtggtgttatgaagagagctattccggagaggcctaggtcggtttcagaagaaccttggccattgggcaatcttagttccttaaatgttagggaagcaatggaagctcccgcacaaacagtatctgaaagttatgttggggcatggcaaatcggggatcagagttgcaaaactgaagttgttgatccaccttatcttgcccgaccagttgcaaaggttggtgcattcaaaccatacaatgtaggacctgctcaatcatcacaaaaggaaatgctgagctttgccaccaagtttgactcaaaccttcatcctttcaagcctgaaaatggggtctgcaagtttgttgatcctacaagttttgctgctgaggtgccaaataaatgtgggcatggctgctgcagttctcatgggcaacttcgtaagaactcattgctgggtcccgagtttaatgagtttgaagatcatccaccaatttcagatagtagttttgcttcgttggtgtcagaaattagcagcattgcctggatgaaaagtggtttgcaaagcagtgacaccttagcgcggtctgttccaccagcttaacagattaggataatgtaaattagtgagatgaaacttttggagtcaatttttatatattaaggtgtaatcaagtcaaatcatggttattgttgtatttttggtagatggac

SEQ ID NO: 1807 - DNA, 2363 bp, Oryza sativa
  Predicted polypeptide sequence is orthologous to G2741
ggccgacgcgccattgccctcgtcctcttcctcttcctcttcctcgtcgtcgtcgtcgccgagccgtcgcatggtggacgccgctgcggcctccggggacgcgtgcggccgcgtgacggagtgggagaccggcctgccggctccaggcgagatgacgccggtctcgcaccagctcgtcccgccggcgctcgccgccgccttcgggatcgacctcgcggccgtgggcgtgctcctcccctctccctccgtcgactcccctgtctcccacctcttcttccccgtcgacgaggacgacgacgaggatgaggagggggagggcgaggggggtaacgatgacgcccccgccgccgccgccgcgggcggcggcggcgggaggtgcgggaagaaggcgaggatggtgtggacgcccgagctgcaccaccggttcgtcgaggcggtggcgcacctcggcgagaagggcgccgtgcccaaggccatcgtgcgcctcatgaacgtcgacggcctcacccgcgagaacgtcgccagccacctccagaagtaccgcctctacctcaagcgcacgcgcgtcgccgccacgccgcctccttctccaccaccacctcctcctcctcctccgcccctgccgccggcgatgtacgtcccctgcttcgccgcgaaaccacctctcgacgcagctaaccgcagcgattcccctccttccagaacctcggacgcaacgactaagcagtaagctttatattttgcaaatttttttccccaaaagatagccaaaatcagatagtacgttttttttcctttttttttctcatattttcgaggatccaagtagatatattgagtatttaatttcgtcaggaatcaagtgaaaccaatcaaagaggtacaatatattgaactcctgtcgtctgcaaaatcgaaatttggcttaccgtccgatggcaagttgagggatagtacatttcaagtacagttatgcacatatcgggaacaagatatagaccacactaaaatgccgctccttgcaaaaatttatcaaaccattgcatatattagttttctcttggtgatagagttcattcttttcggtaccagtgttgtcctcctggcgaaaatgtttttagccacagacatccttgggccgtttagctagaattactctcttttttttttctctgcgcttgatccgtatagaatgtttgttgtttatacttttgtaaatataatacttactactagttacgagtactatattatattaaaaaaaacttaacgtttacatgtcttccttctttcttctgtaacttaaaagccaacttttatgtttggcatacatatccattgttgtcgcaaccaaaattcattagttagatagcaaaatatagtagtttctgttttcagtaacgcgatgatagactattgaaagcaactttatgctcacaccaccttccctttaagagcaatttaggtatttaagttctttgaaggaactgctgtaatgatacccagttgatgattgaatggtggtggggttatctgtaatgtgcttccttgaatcagaagacttgggtatatggttaggagtacttccctcccttgccaccaccttgatgttgaaatggactgcccatttcaatgattatttgatgctttctggggcaatcaatcattgttagaggaattatttgttcctagcatgatttatactttaatataattaatattagtaaaggtcagcactatgttaattccatggtttgggggttctggcttctagcagtattccccacattcatggagctagcaaaggcatatgtctaaccttttactatgtgtgttcactcttaatagttgatacagtttctgaattgtttcctcgttttattctaactggttagctagctcaaggctagagaaggaaatgcaccaagagtgaattatattcagaagttgtgtctcttaagaattaggggacagaacatacaatatttttggatcatttcaagtgcatgctttccatgcatgctcccatcaaaagggataacgagacttgtccacgaggctacgacgcaaaactcggctaaaataaatatggaaatgctgctcatatccaagaacggcctcaggaaagatgcaaagtttttttctgtgtgagctgctaatgctcgaggtattgtctgaaggctacaggcacaataaggtttaccaaaggaattgtaattaggtttcctctgatctagattcagtttcaaattcatgcagcgtgctgtatcaaatgctgcctagatgtaacatcatttttcctcatcatgtatgtgtaagatgctactctttctaacctggtgacatcggcaaagctgctcccc

SEQ ID NO: 1808 - DNA, 579 bp, Oryza sativa
  Predicted polypeptide sequence is orthologous to G2741
atgacgccggtctcgcaccagctcgtcccgccggcgctcgccgccgccttcgggatcgacctcgcggccgtgggcgtgctcctcccctctccctccgtcgactcccctgtctcccacctcttcttccccgtcgacgaggacgacgacgaggatgaggagggggagggcgaggggggtaacgatgacgcccccgccgccgccgccgcgggcggcggcggcgggaggtgcgggaagaaggcgaggatggtgtggacgcccgagctgcaccaccggttcgtcgaggcggtggcgcacctcggcgagaagggcgccgtgcccaaggccatcgtgcgcctcatgaacgtcgacggcctcacccgcgagaacgtcgccagccacctccagaagtaccgcctctacctcaagcgcacgcgcgtcgccgccacgccgcctccttctccaccaccacctcctcctcctcctccgcccctgccgccggcgatgtacgtcccctgcttcgccgcgaaaccacctctcgacgcagctaaccgcagcgattcccctccttccagaacctcggacgcaacgactaagcagtaa

SEQ ID NO: 1809 - DNA, 1243 bp, Oryza sativa; identical to SEQ ID NO: 751
  Predicted polypeptide sequence is orthologous to G2741

SEQ ID NO: 1810 - DNA, 1780 bp, Oryza sativa
  Predicted polypeptide sequence is orthologous to G2747
gctctagcccctctcttgttcaaacaccttcatctgaatctcttgagcctgaattttcccaacacaagcaagcactacaattgagctaagctatagcacacacacacacacacaaaccctgaattcccacttcctaagttcctatagctaagcatatagtagccacaaggagctagctaattcttattagctatagctccagatccctcacaattctaaatttccaatcccaaaagacccaattaaacaagagatagttgcctcctaatccatataataagccctcaaattaactggtagccatatactatcaatagtaacaaggcagcacaagcagcataccataagcatacatcgggtcaaagccgaggtcaagtccaccggcaggaggacaagccggcggccggggcccagaggaggagctgaggcatcatcgatcgatcgatcggcatagtgcacgtacatggagtccatcacgccaatcgtgaggccggcatcggcggcggcgggcggcggcgaggtgcaggagagtggtgggaggagcttggcggcggtggagaaggagcacatgttcgacaaggtggtgacgccgagcgacgtggggaagctgaaccggctggtgatcccgaagcagcacgcggagaagcacttcccgctggacgcggcgtccaacgagaaggggctcctgctcagcttcgaggaccgcacggggaagccatggcggttccgctactcctactggaacagcagccagagctacgtgatgaccaaggggtggagccgcttcgtcaaggagaagcgactcgacgccggggacaccgtctccttcggccgcggcgtcggcgaggccgcgcgcgggaggctcttcatcgactggcgccgccgccccgacgtcgtcgccgcgctccagccgcccacgcaccgcttcgcccaccacctcccttcctccatccccttcgctccctgggcgcaccaccacggacacggagccgccgccgccgccgccgccgccgccggcgccaggtttctcctgcctccctcctcgactcccatctacgaccaccaccgccgacacgcccacgccgtcgggtacgacgcgtacgccgcggccaccagcaggcaggtgctgttctaccggccgttgccgccgcagcagcagcatcatcccgcggtggtgctggagtcggtgccggtgcgcatgacggcggggcacgcggagccgccgtcggctccgtcgaagcgagttcggctgttcggggtgaacctcgactgcgcgaattccgaacaagaccacgccggcgtggtcgggaagacggcgccgccgccgctgccatcgccgccgtcatcatcgtcatcttcctccgggaaagcgaggtgctccttgaaccttgacttgtgaagagggtacggccgtacacgtacacgatctctgctactttatgcttcaattctgctactacgtactgacacaaatggaaatcgtcgacgaagagtgtgaccggagaagtaaacaaaggcggcgatggcggcgcgcagcggcggcggtggcggcggaggtggaggcgcttggagcatctagcgccttcgtatttcgtatatagctcatcatctctcttaaattagtcagtgcagtgtgagggggaacagtttaagaaaaaagaacgaagcagcaacgtacccaaaaaaaatattctttctaggttgatggttttttcttgcttcgatttgctttgcctttttctcttgtgcttaattataattaagttttcttagctgctcg

SEQ ID NO: 1811 - DNA, 939 bp, Oryza sativa
  Predicted polypeptide sequence is orthologous to G2747
atggagttcaccccaatttcgccgccgacgagggtcgccggcggtgaggaggattccgagaggggggcggcggcgtgggcggtggtggagaaggagcacatgtttgagaaggtcgtgacgccgagcgacgtggggaagctgaaccgattggtcatccccaagcagcacgccgagaggtacttcccgctcgacgccgcggcgggcgccggcggcggcggtggtggcggcggtggcggcggcggggggaaggggctggtgctgagcttcgaggacaggacggggaaggcgtggaggttccggtactcgtactggaacagcagccagagctacgtgatgaccaaagggtggagccgcttcgtcaaggagaagcgcctcggcgccggcgacaccgtgtcgttcggccgcggcctcggcgacgccgcccgcggccgcctcttcatcgacttccgccgccgccgccaggacgccggcagcttcatgttcccgccgacggcggcgccgccgtcgcactcgcaccaccatcatcagcgacaccacccgccgctcccgtccgtgcccctttgcccgtggcgagactacaccaccgcctatggcggcggctacggctacggctacggcggcggctccaccccggcgtccagccgccacgtgctgttcctccggccgcaggtgccggccgctgtggtgctcaagtcggtgccggtgcacgtcgcggccacctcggcggtgcaggaggcggcgacgacgacaaggccgaagcgtgtccggctgttcggggtgaacctcgactgcccggcggccatggacgacgacgacgacatcgccggagcggcgagccggacggcagcgtcgtctctcctgcagctcccctcgccgtcgtcctcgacgtcgtcgtcgacggcggggaagaagatgtgctccttggatcttgggttgtga

SEQ ID NO: 1812 - DNA, 1968 bp, Oryza sativa
  Predicted polypeptide sequence is orthologous to G2832
gaagcggcgcggcgagcagcagccggcgaggcaggatgaacctggcgcagtgtcgcgtccagattcataggccgcgccgacctataagtacactcgcggggcacgctctctctctctccgaggattgcggttgcaagcaggataaacggccaccggtaggcgtcggcggagaggagaggagcaagagagggtgggaaggagaggcacctccggattaattcctccgcgggagctggatattgtgagggaatcgagcgatcgagtcgtcgtcgtcttcccctgagcaatccggacgcacgcgccccccgcctgttctgcttccatcttctccacgcggatcggcgagacaagaatcaggaagcacccagcgattgagtcgtcatctttccctgagcaacccggagtgccccacctattctgcttcctcttctccacacggatcgtcgagacaagaagcaagaagcatccagatatggcaccaagaggaaagccttggaagcattgttgcaacaagtgcgacaagagcttccgttcagggaatgctcttggaggccacatgtcctgccacaggagtgttggtaatcagccaaagagcacgtcaagcccacccactgttgttgatctgcacatgccactgctgagttcctgtgatgataatcttttgcttttgcccccagaaacacaatgccagatgtgctcaaaggtgttctccacccccggatcgctgagggagcacatgatgatgcacggtggggagaaggtggtggtcaaggctgaggaagaagctgccgggctgattgaagcactgggcattgctgatagcatgcaagatgtaatggtgttttcttcagtgaagcgtaagcgatcattccgatcaaagaggcagacaccagcactcagtttggaggagatagaggctgcagatgctctcctactgctttcagggtgctttgacaagacttcagcttatgaggattgctatctgggagatatagaagacagtagcttgagatccattgtgctgacagaggttaacatgaatgccgtggatcgttgttcggttcgatctgttggctccaaggagccaataaatgataataactcaggttacaaggattgctatggacaaagtgacaaggaaaactgtttgatcgttcccaaggaggagatggatccaaatgattttgatcatgagctggttagagatgctgctctcaggaaaccaagaaccgacaattcagatgaggagatgaagtttggtgatcttccagctgctgctatgaaggacaacagccaccgttgcaatacctgcggaaagtcatttggatcagggcaggcactgggaggccacatgcgacgtcattatgttcggaagtgcaatcgtcaacggggggttgctgaccacgctggttctgttcttatgaaagtgcaaaagctgaagcttagattggaccccatcttgtttgatgtcacacttccagctctcactgatggagactgctgcatttctgtgggtgtgaagcctgaacctcagctgtggtgtgtcacgagcaatcttcagtgaaccaatccggtgctcgatgtggtctgaaactctctgttcttttggtgaaatctggggtgttgtctgaaactggtacagttccttgagctgtctgtagactgtaggtagttcatcagccaggaagcaaaaaaaacccatgttgtcttccgatagatagtcacaagctcacaatactgataggagtagttctcttgactgacaaacttccatggatagcaaaggccaggatcttgagtgatagcttggttactgaacagtgaagctgatttccatgttgcatgcaatgcaatggacgagcttgtcattttttttttgtaccaacaatctgtaaaatcagttttgctttgctttctgtaaatgtctgtaccttgattcttgaaaggaatgctggtcagaatgaggtg

SEQ ID NO: 1813 - DNA, 410 bp, Oryza sativa
  Predicted polypeptide sequence is orthologous to G2859
tcacctttaaggagcagtatcctgttcttaaccccctttggtagcttgcatccttgatccaacagcatgtccagcttggtaatgaggcatcccatagtgcctagggatgaactgattgcctgtattactctgtttttgcctccaaattgtgtaacatccaaagatgtggagttaattggcgttattgcatatacctgtaaatgcaaaagggaaaccatgtgaaagggaaatggatgaacacccacaagcaaatggaggcatgaaaatttggtgatggtgtttgtgaaaagcataacatcgtttatccatctatttttcttttcatcttttggggaaactaggtatgatagtttaattgtggatcagacatgagacttgatgaattaagggatggtaatgggattattgtt

SEQ ID NO: 1814 - DNA, 964 bp, Oryza sativa
  Predicted polypeptide sequence is orthologous to G2990
cttgcattcactgcttctgctcggctgtgaacttggtgcggaaccgcttcctcggcatcccggcgccgccggagggaggcgcggtcgccgccggcgacatcacctacagcgggagcctttgcgcctgcccgctcgagcccagcgagagtagcatgtgctgcgccgaagggtaatacggctggtgcaccaccggcgccggcaggtgcggtggcgacggcggggacacagaccgctcgtcgtagtattccgagccatccgagttgttgtcagactcgtcgccatcaaccccagggagccggacctcgggcgtctcctcctcgcggtgcagctggccgtggagcacgttcgccggcatgggcggcgcgggcagcgccagcggcggaggcggcggcggggacccctccagcagccagcagtggaagttgcagtggcagccgcacgcggcgcacatgagcgacgtcgggtcggtgggttcaccgccgacgacggcatgaactcctcgcagccgtccagcgccgtgtccgcccaggctcgctgcgtggttcttggggcactcctggtacaccgtctctcctccgcccaccgccggctgtgctcgtcgcagctgtagctacggaggggtacagcccacaagctccacctcagccatgtctccggcgacgacgcggacgaagctgggcgacagtggcgcggcgaggtcgggcggcggcacgaccttgcggtgcccggcgaggagtggcgtagcaagccgagcattgctcggcgcggcatcccgaggctgacgtacggcggaggtgcggctgctgaccgaggtggcggcggcgctgagcgctgtgacggagatgacggaaaaggagggggatagatggaaaacttgacgagagtggcacggttctaatttctgtaaaattttaatggcacgtttacgaataagcgaattataattgtatttttctgaatggcg

SEQ ID NO: 1815 - DNA, 1080 bp, Oryza sativa
  Predicted polypeptide sequence is orthologous to G2990
atggaggccgtcgtcggcgtcaagtacaggccggtggtgttccccaacggcggcgcggcggcggctgcggcggggaagagcaaggcgacgccggcgtcggcgacggcggcggtgtacagggagtgcttgaagaatcacgcggcgagcttgggcgggcacgcggtggatgggtgcggggagttcatgccgtcgccggcggcggatgccgctgatccggcgtcgctcaagtgcgccgcgtgtgggtgccaccgcaacttccaccgccggctccccgaggcgccgccctccccgcctctcctcgcgctgcctccgccgccgccgccaccgccaccgccaccgccgccgccgcagcctcagcagcatctgccgcggaccgcggcggtggcggtggcgccgcagctgctgctgcatgggagccaccagcgtcgcgagcagtcgccggagaccgaccgcgtgcgcgggcccgggcaccaccacgacgacgacgccgccgccgacgatgatgattccgaggactccgagatgtccgactacgacgacgaccgctccgcctcgccgctgcaggcgccgccaccggtgctctctccggggtacctcccctccgcgacgcacatgctgctgtcgcttggctccgcgtccgccccggccgtggcggcgtcgaggccccacgccgccgccgccgccatggggcccccgcctccgccgggcgccgcgacgtcggcgtcgaggaagcggttccggaccaagttcagcccggagcagaagcagcggatgcaggcgctgtcggagcggctcgggtggcgcctccagaagcgcgacgaggccgtcgtcgacgagtgctgccgcgagatcggcgtcggcaagggcgtcttcaaggtctggatgcacaacaacaagcacaacttcctcggcggccacagcgcccgccgctccgccgccgccgccgccgccgcgccactcgccccaccaccagtgctcactgacttcagcatcaacggctcatccacgcatgccgccgccgccgaccacgccgcggcaacggcgagtggcggcggcggcggctcgccgcagtcgacttaa

SEQ ID NO: 1816 - DNA, 300 bp, Oryza sativa
  Predicted polypeptide sequence is orthologous to G2990
gctatcaacaccaacaaacaccgcgcctcgcctcgtctcctccgatagctgacgccgccgccgccgccgccaccgacgccgggagtgacagcgagtgagatcgtcatgatggatcacctgagccttgtgccctacgagggcggcagcgccggcggggtgaggaggtgtaggtggaggtggtggagggaagtacaaggagtgcatgcggaaccacgcggcggcgatgggcgggcaggcgtatcgacgggtgcggggagtacatgccggcgtcgcccgactcgctcaagtgcgccgcgtgcg

SEQ ID NO: 1817 - DNA, 683 bp, Oryza sativa
  Predicted polypeptide sequence is orthologous to G3044
tttttttttttttttttttttttgaacttaaaatcttagcacagagccattccgtatttaatactcagattatccaattgcgcagctaataacactgttccaactcaacgatataaatgggtcctgaagtcatgacccccggtttagagaacacactctggcacatcggcggttttaaacaacatggccggcaactacgacgttttgttataaaagatgatctgctgcgccatgaacaatatcctgttggaggcaaaaacagacagggccttagatgggctcccaagaacatccagggataccttgagtgactcgcccatctgcaaagcgtcgacgatggcgtactggattgagccgactaaaatgggaagaatacaacgggctatttgccttgatagaaatcctaatcaatacacacggcaggtgcataatttgccttttctgcggtcagttcacgcgcaagtattaaaaccttcaatttcctctttactttcgcagccgctacttgagattgaacgacgggacgttgtgatagcagctcaccgattttgctcatagtgtaagcatgcttttttagatctcccttgtctcgtactaatctcgtttatcgatacacgttgcctaaagggggggcccggcacccagttaagcttatagtgagtggaattaaccgcgctcactgg

SEQ ID NO: 1818 - DNA, 1230 bp, Oryza sativa
  Predicted polypeptide sequence is orthologous to G3061
atggcggcggcgcaggagccgagagccaagaagaagaggagcctccccggcaacccagacccggaggcggaggtgatcgcgctgtcgccgcgggcgctggtggcgacgaaccgcttcgtctgcgaggtctgcaacaaggggttccagcgcgaccagaacctgcagctccaccgccgcggccacaacctcccctggaagctccgccaccgcgccgccgctgtctccgccgtgacgacagcggcgccggcgccgaggaagagggtgtacgtgtgcccggagccgacgtgcgtgcaccacgacccggctcgggcgctgggcgacctgaccgggatcaagaagcacttctcgcggaagcacggggagaagcggtggcggtgcgagcggtgcgggaagaggtacgccgtgcactccgactggaaggcgcacgtcaagaactgcggcacccgcgagtaccgctgcgactgcggcatcctcttctccaggaaggacagcctgctgacacacagggccttctgcgatgccctagctgaagagagtgcaaggcttcttgctgctgcaaacaacagcagcagcatcactactaccacctgcaacaacagcaacatcagcagcaacaacaacaacaacaacattaacagcattagcaatagcaataatcttctgatcaccagcagcagcagctcaccaccactgttcctgccattctccaccactcctgctgaaaaccctaaccctaatcagctcctgttcctgcaacaacaccaagcagctcaccaccagctgcttcttcctcagttccagcagccaccctcctcgccgccggcctacttcgatcacctcgcattcggcggcggcggcggcgtcatcaccggcagcagctgcaacgacgacaatagctcgatcgccggcgatgtcatggtggctgcaggtggtgacagtgtcagcttcgggcttacctcggaaggctccgtgaccatgcacgccggcgacgtcggacggcgccggctcactagggacttcctcggcgtcgatcacgacgccggcgaggtcgacgagctcgagcttgatgagctgccggctgatctgtccaccaccgccgccgcctgccagggttgcaacttcgccgccgccaccaccgccgcctgctgcgccaccgacttcaccaccggcagcaggcagtacctcggccggctgccgccggtgaacgagacgtggagccacaacttctaa

SEQ ID NO: 1819 - DNA, 919 bp, Glycine max
  misc_feature (1)..(2): n is a, c, g, or t
  misc_feature (14)..(14): n is a, c, g, or t
  misc_feature (25)..(25): n is a, c, g, or t
  misc_feature (521)..(521): n is a, c, g, or t
  misc_feature (725)..(725): n is a, c, g, or t
  misc_feature (735)..(735): n is a, c, g, or t
  misc_feature (919)..(919): n is a, c, g, or t
  Predicted polypeptide sequence is orthologous to G3
nncgctacgccctngtggattacgnctgcgcgcaactaaccctcactaaagggaacaaaagctggagctccaccgcggtggcggccgctctagaactagtggatcccccgggctgcaggctgagtctgaacggaatcccacttaaaagtcgttctccttcctcttcgcagctgttatatagtactattttcatttcatatgtttatgcacctctatatatacatagacacatgtaaatggttgcaaaggaagataagataggtaccagctatcacatagtttatttaatccgttatatgccacctgatatataggcatattagctagttaggtaggtatagtagtttaagttaattcaaccatggaagacagggatcactgttgttccaacaattcaacgatgatcacaacaacaaagaaaagaacgggtagaagaagtccaacatcggataagctcaagaatcaacaccgcgagaagcagtcgatgaaaccttaccgtggaataaggatgcggaagtggnggaagtgggtggcggagatcagagaacccaacaaaaggtcgaggatatgtgtgggttcttacacgacacccgtggccgccgcacgtgcctacgacaccgctgtcttttacctcccgggtcccaccgcgcgccttaacttccccgaactcttgttccaggacgacgaccaggaaggcagtggatcggtgcagcacggcgcagcanggaacatgtncgctgattcatttcgcgaaagccacgcagtccgtcgcagagtcgacgctctccaaaccgcgcttaccacccacgcgccagtacccactctctcaactcaagcccgacttgtacgagtccaaaactcgagaagcttcagatgaataaacaaaatcatatcaatccatataataatttctagtctn

SEQ ID NO: 1820 - DNA, 771 bp, Glycine max
  Predicted polypeptide sequence is orthologous to G3
gggggaaaaatatttgataaatattaaatttataatttatctcccccccccccaggtgggtagagcgctgtagcatcagcacgccaaacgctcaattaaccctcactaaagggaacaaaagctggagctccaccgcggtggcggccgctttagaactagtggatcccccgggctgcaggaattcggcacgagggcggagattagagaacccaataagcgttcgaggatctggctgggttcttacgccacccccgtcgccgccgcacgcgcctatgacaccgccgtcttccacctccgaggcccttccgctcgcctcaacttccccgaattgctgtcccaggacgacgacgtttcgacccaacaacagggcaacatgtccgccgattcaattcgcaaaaaagccacccaagtcggcgccagagtcgacgcgctccaaaccgcgcttcagcaatcctcgtcctcacactccgctaattccagccacgtcagcagctctgacaaaccagacttgaacgagtatcccaaacctgaagattagtaattttcttccaccttcaagattaatattgatccaccaatcacgcgtcctgatgtgacatatatatagggcttcaacttgccctcttcacctatgctaatttgaagaagaagaaaaaaaccttattatatttgtcatatgattatatatatatcttagtagatatgtttcttccaaataaaaaaaaaaaaaactcgagggggggcccggtacccaattcgccctatagtgag

SEQ ID NO: 1821 - DNA, 809 bp, Glycine max
  Predicted polypeptide sequence is orthologous to G8
gaggaaaacagaaacatcgctgtgctagtgcactaaaaatagcatttgcttcaaagatgatgtatccaaacatggggcattatagtttaagcaagagacagcaataaggtgtcgaatctcagtatacaccaatcagtggctgaattataaaaagaatttggaccgaaaacacttttgttttagtttgtctttaatctgtactgcaaaatcagctatggtggtgcctgtgggggcttaacctagtaataatattcagatgcattgcgggtaggcatgctggatgaagtaaaacagagactctggggaattgagttcatagaacttgttggaaagatggcagccgatggaaaggtagctgaaattgagaatcctgatgatgctgcagcagagaacgttggtactggggtagcattgacctggccatgtgtttgccacgcccagttggggagtccgtttgaaggatcaacgccgattctctctgctctttcctgcccattgggaaagaaattaggagacatgccattccataatgaaggacgatcttcagttgcaaccatccttttcaaagatggattaccaattccagaactaacattggtttccatcattgaacttcttccaccatgtgtattgtaagggaaggaggggaactgaagttgcccccaattttctttgggaggtcctggggttgctatgcccaaattgagatcaagattctgactgcctccttcattaatggctgcagatttcagctctccttcataagtacttggctcaaagttggtcactgcttcccttccgacagcaac

SEQ ID NO: 1822 - DNA, 742 bp, Glycine max
  Predicted polypeptide sequence is orthologous to G12
agggtgttatattaaactcggccgaataattaccaatttaatacgactcactatagggaatttggccctcgaggccaagaattcggcacgagggcttacccagatgacaagcttagtgcgcgagtctctctcccttataacccttcttccacttccgtgtcttttacgagttagatttctcattcgtcatggaacaacacattcactctctctctctttagtgattttttcgatttgattgacaaacacaacgaaccaaagttaactactttagagagagagagagagagagagagagagagagagagatggagagtgaaggaagaagagaaggaggagagagagaaacaacagcagcgacgaggaaggtggagggtgctgagagaagatacaaaggaataaggatgaggaagtggggcaagtgggtcgctgaaattagagaacccaataagcgttcaaggatttggctcggttcctattctacccctgtcgccgccgcacgtgcctacgacacggccgtcttttacctccggggaccctccgcacgcctcaacttcccggagcttctcgtcagagaaggcccggccgccctagtcgccggctgcgacatgtcagcggcttctattaggaagaaggccaccgaggtcggtgctagagtcgatgctcttcagggcacccttcaccaccactacgtgccccccgcggcaacttctcttctgcggggggtgggggtccgggatat

SEQ ID NO: 1823 - DNA, 628 bp, Glycine max
  Predicted polypeptide sequence is orthologous to G15
agttttcctctcatcgtacgaggaaaatgtttaatgtaacagttaacattttaaacatgggcacaagctccctattgtactagctggaaattcacaccctggtttagtaaacaagcattcaaaacaagcttttgccattttgatggaggtaaaaaaacataggattatgcatcggtccaagcagcaaaaattggcatctgaggaatagaaagcgaaggcctgagattggaagatagatccaaagaatccacgtcagccaataatttggacactgttgaaggcattccaaagagcattggcaagcttgtcttatctgggctctcttctcttgagctactcaaacttgtcaccagagaagaaggatttgacaagtgtgttcccatgttactcgattcctcaacttggtgatgaaacatgttatctaaagcagttgacaaggactcagttctactacactcaattctttgtggattctgatcaagctgttgggaggatggatactgaaccatcttccattctgattggcttctgcatcttttctgcatcagaacggtttcttgagtagtacaaggtttttggttaactgtagcctcgcttctagttccatcatccatctctcttttccgct

SEQ ID NO: 1824 - DNA, 423 bp, Glycine max
  Predicted polypeptide sequence is orthologous to G214, G680
atacagctccatcgaacacaagtgaaagtcaaaataacactgcacgatcttctgttcatcaatcatttcttccttatcctcccttcacacaacacaaccaagacgattaccaatcatttcttcacatgtcttcaacattttcaaatcttattgtctctaccttgatgcaaaacccagcagctcatgctgctgcaagtttcgctgctacattttggccgtatgcaaatccagaaacttcagcaaattctcctaggtgctcccaaggaggttttacaaatagacaaattggttcccctccaagcgttgcagctattgcagctgctactgtagcagctgcaactgcatggtgggcagctcatggattgcttcctttgtgtgctcctcttcatacttcttttgcctgtcctgcatcagtgactacag

SEQ ID NO: 1825 - DNA, 918 bp, Glycine max
  misc_feature (697)..(697): n is a, c, g, or t
  misc_feature (699)..(699): n is a, c, g, or t
  misc_feature (720)..(720): n is a, c, g, or t
  misc_feature (756)..(756): n is a, c, g, or t
  misc_feature (771)..(771): n is a, c, g, or t
  misc_feature (778)..(778): n is a, c, g, or t
  misc_feature (788)..(788): n is a, c, g, or t
  misc_feature (803)..(803): n is a, c, g, or t
  misc_feature (807)..(807): n is a, c, g, or t
  misc_feature (821)..(821): n is a, c, g, or t
  misc_feature (895)..(895): n is a, c, g, or t
  Predicted polypeptide sequence is orthologous to G214, G680
tttgtttgatgatccgatcaggattacgccaagctctaatacgactcactatagggaaagctggtacgcctgcaggtaccggtccggaattcccgggtcgacccacgcgtccggcaagaaatgcagttctatttgtgatggggtgcagaaaaatctgctatttgtcaaagataacaatgaggaggagggactgctaaccataggtcttggaccaggaaagctaaagactcgtcgaacagggtttaaaccttacaaaagatgttcggtagaggccaatgaaaacaggatcggaacagcctgcatccaaggtgaagaaaaaggtcccaagagattacgcttgaatggggaggcttcaacttgatgcctgatatttcccatgcaaccacacaaagaaaatctctagttttgcatatatttctaagtttccttgttcattgtctgtattgcttattttctaattctgcagctcacgaaacttgtcgtgtaggtctgtgtaccatattaaattactacatacacactttttaaaaaaaaaaaaaaagggcggccgctctagaggatccaagcttacgtacgcgtgcatgcgacgtcatagctcttctaagtgtcaccaaattcaattcacttgccgtcgttgtacaacgtcgtgacttggaaaaaccctgcgttacccaacttaatcgccttgcagcacatncncctttcgccagcttgcgtaantacgagaagcccgcacgatcgccttcccacagttgncagcctgaatgggantggacgncgcctgtacnggcattagcgcggcngggnggggggggttcacngaccttaacttgcagcgcctacgcccgtccctcgctttttccttctttttgcacgttcgcgttttccggaagcnttaaatcggctcccctttggtca

SEQ ID NO: 1826 - DNA, 825 bp, Glycine max
  misc_feature (1)..(3): n is a, c, g, or t
  misc_feature (14)..(14): n is a, c, g, or t
  misc_feature (720)..(720): n is a, c, g, or t
  misc_feature (759)..(759): n is a, c, g, or t
  Predicted polypeptide sequence is orthologous to G214, G680
nnnttatgaaacanggtacggggcaatttcacacgacttactatagggaattcggccctagaggccaacaattgtgatgctctacatatgaaatgggtccatgatgagaaaacagatggtctggattgtgcattaacaatagatgggatgcaaggcaatcagaattaccctagacatgttactgtgcacgttgttgacgggaaccttggaacaaatactcaaaatccatcacaagatatgttgtttcgagactctatgtttcagccaataggaggggttaatggacaacaaaatgttttcaccaattcagctccatcgaacacaagtgaaagtcaaaataacactgtgcgatcttctgttcatcagtcatttcttccttatcctcccttcacacaacacaaccaagacgattgccaatcattttttcacatgtcttcaacattttcaaatcttattatctctaccttgatgcaaaacccagcagcccatgctgcagcaagtttcgctgctacattttggccctatgcaaatccagaaacttcagcaaattctcctaggtgctcccaaggaggttttacaaatagacaaattggttcccctccaagcgttgcagctattgcagctgccactgtagctgctgcaactgcatggtgggcagctcatggattgctccctttgtgtgctcctctccatacttcttttgcctgtacttctgcatcngtgactgcagttacatcaatgactactggtgaagcaccngcactgaaggcagagcatgataagactactctacagaatcctcctcttcaagatcagatgcttgat

SEQ ID NO: 1827 - DNA, 844 bp, Glycine max
  misc_feature (414)..(414): n is a, c, g, or t
  misc_feature (416)..(416): n is a, c, g, or t
  Predicted polypeptide sequence is orthologous to G261
cyattccattttctctggaaaaaaaaaccaattcattaatactgtcgaaaaacatggtcagaatttgagcttttggcaactatggacagagatatgaactttccatatttggaggagaagcaatcccttttgtgtttcgctgtttccattttcagcttttttcttgtgtttgagcatttgaatctggacaaaggtttcacctttgggtgagtgattcaacaccagctatagctgggggagtgaaggtaaggttgtgagcattaatttgcttgamggagggtttgtgaattgaattggtaaaaagggtctctgttttatgggaattattaattggtgtttactgggattaatgaaaccyagatagaaaggaaaagggggaagaacaagggagtctattttttatataaatatgtntnttgttttgtagtggttaamtttgtgaaaaggtaaaagcgtttttttctttctttctgggtatactacagggcttttgagagttcactttgctgtgagatttgtgtttttgatgatggaggaagctcagggcaattctagttccctgccacctttcctcaccaagacttatgagatggtggatgatccttccactaattctattgtttcatggagtgccaccaataggagtttcattgtttggaacccaccagagttttcaagggatttgttacccaaatactttaagcacaacaacttttccagtttcatcaggcagctcaacacttatggctttagaaagattgatcctgaacaatgggaatttgcaaatgatgattttgttagaggcmgccacatcttttgagaatatcctaggcgcaacctgttc

SEQ ID NO: 1828 - DNA, 689 bp, Glycine max
  Predicted polypeptide sequence is orthologous to G261
attgaggggcatcacaagctaaaaggaataatcaattgcaactaagtttgctctgctttgctaagaatgccccatctgttctggagggttatttacattcctaatgttccaccaaaatttggcattacttctgccatcagaatcctctctttcagactgagcttcctgcatttctgacgaaccaggattctctgtcaagaatcgttcccagaatatgtcattaacaccagtagtcagaggagctgtttcgacaggttgttcttttgatgcatcaagatcaggagccgcaactacagctggctcagaactcacgttgattccatgtgacttaggctgatcttcaacttctagttgcacacaagatatagctggactatctgcacaacttgtagattcatcaaaatccaagtttaaatgactttgaacaaagacgtcaccaacatcatgtgtaatattctcccaaaacgtcatggatgactcaaggagatccaaccgttctgtgctcgatgagaaaatagaagcaccatctgcattttcccttggtaatacttgggaagtttccatatgatcttcaatgctagcgtcatcactaaagagaccacttcttggcaacctccgttttctatccatgttttctgtcaacagcaagagatttaaggcaatcccaggtttctgcaacacttgagaga

SEQ ID NO: 1829 - DNA, 952 bp, Glycine max
  misc_feature (1)..(1): n is a, c, g, or t
  misc_feature (13)..(14): n is a, c, g, or t
  misc_feature (19)..(20): n is a, c, g, or t
  misc_feature (27)..(27): n is a, c, g, or t
  misc_feature (33)..(33): n is a, c, g, or t
  misc_feature (111)..(111): n is a, c, g, or t
  misc_feature (941)..(941): n is a, c, g, or t
  Predicted polypeptide sequence is orthologous to G280
naaatgatacacnnaaacnnagcaaanccaccntactgcaggtgcgtatttagaccctcactcacgggaacaaaagctggagctccaccgtagtggcggccgctctagaanagtgcatcccccgggctgcaggaattcgggaccagctataggccacccctgccactggcaggccaagaggaaggcctaagaaggttgctcgctcaccggccgtgccgtctcccaccgccgtctccactggaaggcctagaggcaggcctcccaaagtgaagcctcagttgacagaagtcagggttgagtcatagaatggtttctgtctttctttctaattgatggcaaatgtagggatctactctcgtcgaagggatggcgcgtgtggtcttagatattgggtcaatataatttctttgtaaaatcaagtagtggtagcttgcttattaaaaaaaaaaaaaaaaaaaagtatcaccttgcagtgatctatataaaaaaaaaaaaaactcgagggggggcccggaccccaattcgacctatagagaggcgaattacgcgcgctaactgggctgaggtttacaacgtcgtgactggaaaaactctggcgttacccaactatattgccttgcagcacatacccttgtcgccagctggcgtaatagcgataaggcccgcaccgatcgcccttccaaactattgcgcagcctgaagtgcgaatgggactcgccctgttgcgtcccattatactgcgctgatagtgttggttacgcgcagcgtgaccggtacacttgcaacgcgccctacgtgccagttccttacggtttcatcatttgccttactcgcacgttcgcgcgctataccacgcaggctctaatgagtgcgtaccctcagggttccgattatgcgtacatgtcactcgaacgcaataattgatatgtggatggtcacgnatgtgcatgcc

SEQ ID NO: 1830 - DNA, 710 bp, Glycine max
  misc_feature (28)..(28): n is a, c, g, or t
  misc_feature (710)..(710): n is a, c, g, or t
  Predicted polypeptide sequence is orthologous to G280
ggtggcgggtcagctttggatgaatcgncaagcgcgcaattaaccctcactaaagggaacaaaagctggagctccaccgcggtggcggccgctttagtactagtggatcccccgggctgcagggaaaaagatcccaagccaaaatcaagagtatgaaatgtgtctgttcgtttcctttggctgtatggttaagaaatgttaatgaaacgaaaaaaattgtggtgatgctaagcctaagggtgggtcccatgttgagatgtgaatagaaggaaatatgggattgggttcacatcaccatttattgtaccacttgaaagatttgtcgtcaaacttgggtggggctcatcaaagcactactccttcccacgtaacttcacttcacatttctctcctgcaacatttatatttttttgaaaaatacaagctctatggtgtcggaggatgacatttttataatttcctttttaagtttttatgcctaagctaattctcttatttacaatgtaccccaaccaagaaggattagtatgcctcatatttcttttgcaatgcaagtgaacaagtaaagttcttccttgtaagcgtgtgtatatttgtagtgatttattcttgcgtgaagttctaagcacagaaattgctctgtggtgacaaaataaaacaaaaaaaactcgagggggggtcctggtcccaattcgccctatagtgagttn

SEQ ID NO: 1831 - DNA, 832 bp, Glycine max
  Predicted polypeptide sequence is orthologous to G280
attggaacctgcctctgttaaagtttgtatttttctgagtgggtgggttgattgagagtgctgtgcaagctttggaactttttcccaacctgctacttcaatggccactgaagaggttaacaaacctcaatcacttcctccataccctgagatgatagtgaaaacacttgaagcactgaatgagccaaatggatcgaacaagtcagcaatatcaaagtacatagaaaccacctacggtgagttgccagacgcaaccgttttggggagtcaccttaacaagatgaaagacagtggagagctttctttcaaacagaacaattacatgaaagctgacccaaatgccccaccaaagaggggccgtggaaggccaccaaagccaaagactccattgccaccaggcactgttgtgtcccctccaaggccaaggggtcgtcccccaaaagaccctaatgcccctcctaagtctcccaaggctaaggccacccctggaagtggcaggccaagaggaaggcctaagaaggttcctcggtctccggccgtcgccgctccgaccgccgtctccagtggcaggcctcgaggtaggcctcccaaggtgaagcctcagttgacagaagtcagtgttgagtcatagaatgacttctttctttctaattgatgtcaaaagatgtagtgttctactcttgaagaagtgatgatgggtgtgatcttagattttgtgttgatgtaatttctttgtaaaattatgtagtggtagctaacttatcatgaggttctgtgttggtttttcttcctaaattattatcaaagtgaacagtgacttgaactaatgtgc

SEQ ID NO: 1832 - DNA, 886 bp, Glycine max
  Predicted polypeptide sequence is orthologous to G481
ctgcaaatattatatattatataataatctaaagaaaacactcaaagcaagtgcttctcaccatgacaagctacatggcgaatcacatgcaataaccccaaacacatctctcccttgagttggtcaggcagctaaatatgacatgtataatgtattaataaaaatctaccttagtaccgtaacaaaattctgacactgatgccttctaaacgagaacctaaatattaaatcaccaaaccattgtttccacccattccatgcgtacaagcattcaagggaaataaataagatgcgtagaagcatctaaactattcatggccttgcattgaaggcataaccagatgttgtggttgcacctgcaaaccaatatagttcagcgaaccctgatgaacaagctgagcattttgacctgcaaggccaacttgatctggtctagcagatccatcaccacttctagcagatcctttagtgtcaccctccgcctctctgtacctagccaggtacaccttaagcggctcaatgtagtcttcaaaccctaaagttgccatggcccatagtaaatcgtctccattgattgtctttctcttctccttctggcatttctcactcgcctcgctggtaatgaagctgatgaattcagaaacgcattcttgcattgtgtcttttgcatccttcgcaatcttgccattgggaggcagagccttcttcatgatgcggctgatgttggcaatgggaaggtaccggtcctgctctctagccgcgccggacaacgagccgcgagggctctgctcgccaccactctcgtgactcggactcgccggtgcatccgacatctcacaaaccctacaaattacaatacaaaatatttctgatttccgacagcaac

SEQ ID NO: 1833 - DNA, 940 bp, Glycine max
  misc_feature (1)..(2): n is a, c, g, or t
  misc_feature (61)..(61): n is a, c, g, or t
  misc_feature (922)..(922): n is a, c, g, or t
  misc_feature (940)..(940): n is a, c, g, or t
  Predicted polypeptide sequence is orthologous to G481
nnaaggagggggtggggggggatgaggcgctcttctgtgggggcggctgtcgcgccttttnctcctcactcacgggaacaaaagctggagctccaccgcggtggcggccgctctagaactatttttatcccccgggctgcaggaattcgacacgagtctcccagttcatcagcttcatcaccagcgaggcctctgattagtgtcagagagaaaagagaaagactattaacggcgatgatttgctctgggcgatggccactctcggtttcgaggattatatggatcctcttaaaatttacctcactagataccgagagatggagggtgatacgaagggctctgccaaggctggagactcatctgctctgagagatgttcagccaagtcctaatgctcagcttgctcatcaaggttctttctcacaaaatgttacttacccgaattctcagggtcaacatatgatggttccaatgcaaggcccggagtaggtatcaagtttattattgaccctcttgttgtaacgcttgttttctacgccagttaccaagtgctcacggcatattgaatgtctttttatgttatgtgaatactgacaggagatgttggctcttgtgtccgttattcttttgacattaaggttcgtatattatctctggattcgaattattatttgatagctatgattatattgttaatcctagagccctgttgtctgaatccatcatgctgcttgttcaagaccgagatgttaggactgatcgaagcataataccgaatattctctgcctaattcctctcacaatgatcgatgatgaatgctcgaagctctctcatctagagaactaacattactcgaggaggggctcggtactccattcgcttatagggatctattatctcgctactgatctcgtttacacgntcggactgtaaactctgn

SEQ ID NO: 1834 - DNA, 906 bp, Glycine max
  misc_feature (538)..(538): n is a, c, g, or t
  misc_feature (683)..(684): n is a, c, g, or t
  misc_feature (702)..(702): n is a, c, g, or t
  misc_feature (706)..(706): n is a, c, g, or t
  misc_feature (709)..(709): n is a, c, g, or t
  misc_feature (715)..(736): n is a, c, g, or t
  misc_feature (739)..(739): n is a, c, g, or t
  misc_feature (741)..(741): n is a, c, g, or t
  misc_feature (745)..(745): n is a, c, g, or t
  misc_feature (758)..(759): n is a, c, g, or t
  misc_feature (767)..(770): n is a, c, g, or t
  misc_feature (780)..(780): n is a, c, g, or t
  misc_feature (786)..(786): n is a, c, g, or t
  misc_feature (797)..(797): n is a, c, g, or t
  misc_feature (867)..(867): n is a, c, g, or t
  Predicted polypeptide sequence is orthologous to G481
acatgatctgctgtagttacccccagcgcgcatttaaccctcactaaagggaacaaaagctggagctccaccgcggtggcggccgctctagaactatgtggatcccccgggctgcaggaattcggcacgagagaaggccttgccggcgaacgcgaagatctcgaaggacgcgaaggagacggtgcaggaatgcgtgtcggagttcatcagcttcataacgggtgaggcgtcggacaagtgccagagggagaagcgcaagaccatcaacggcgacgatcttctctgggccatgacaaccctgggattcgaagagtacgtggagcctctgaagatttacctccagcgcttccgcgagatggagggagagaagaccgtggccgcccgcgactcttctaaggactcggcctccgcctcctcctatcatcagggacacgtgtacggctcccctgcctaccatcatcaagtgcctgggcccacttatcctgcccctggtagacccagatgacgtgctcctctattcgccactccctagactttntatattatattatttaattaaactctcttctccactcaacctttgcaagatcactgggttggttagtcttgttacttgttactgtttctctctatcatacctatactcactcttcctcctcatctattatttacatccaatgcannatctcaaatatttctttntcanaanaaaaannnnnnnnnnnnnnnnnnnnnnaananaaanaaaaaaaaaaaannaaaaaaannnnacaaaaaaanaaaaanaaaatcctggnagcgggggagccggacccaatttcgccctataggagtcgataccgccgtactgtggcgggttttaaacgntgacatgaaaaaccctgcttaccaacttattcccttacc

SEQ ID NO: 1835 - DNA, 817 bp, Glycine max
  Predicted polypeptide sequence is orthologous to G559
cacactcttttagctgcacaacagtttcaacagctacaaattcaccctcaaaagcagcagcagcagcagcagcagcaacaacatcagcatcagtttcagcagcaacatcagcatcagcatcagcagcaccaacaatcaagtgacttgaaaatgagagaaacttcacctactccatgccccaaagacaatacttcgtcagatgtaaatccttctggagccaaggattgttgagagttgagactgctcacattgtcttctctatttgcttcgtagattttcctttgtcttgtgtcttagtgtgtttagcctttgttatattttttcattcttaaacagtacaaatggtcctagttagagattgagaataatacatttgcatctttggtattgtgtaatattaaagttgtttaatactctagttaatttctatggatatataggggtaggttcatgtgtgtttagtttgccttaaaagcagggagatataggtgaaggaaatcgtagaggctgcaaaggaaaagggggttggtatgcccactgtcttcttggatagcaggtcccctaaatgctatagcaggggggggggggcatatcagataaaaatcatgatgttttgggtgggttttgcggtttcagcccaggattgggtcttgggcctggggttggagatagtttgcggaaaggctggtgctaagccccccggggctttcatacttatttatggacagtttgggttgatgcttccgaaggttcagttaggagtgacttatgccctaacggtgggcccttgaaatccaagcttcttgaagaaaaattt

SEQ ID NO: 1836 - DNA, 936 bp, Glycine max
  misc_feature (901)..(901): n is a, c, g, or t
  misc_feature (916)..(916): n is a, c, g, or t
  Predicted polypeptide sequence is orthologous to G559
catttaaactcaaactcatatcactttcatttaaattcaaacacaaactcctgtatatgggaaacagaaaaaatagaaaataaatcctaataacaagaaacaaatcctaataagtaataatagtaaatcctaataaatgatagaatcctcattttaatagaagaaacaaaatttaaaaaaaattaaacaaatcttaataaaatcaatcataaatcctaatgaaatctatctcaaatcaccattagatttacaaataataactaaaaaacttaggcaataaaatcaacaattctacactttattttgagtcttcatataatcatatccttgggcttgcacaagtcgaactacaaccttattagataagaattgccttcacatgaactccttttgcctcttgtatcttttgaacttttcttttgttaacaggtcatcacttggaatcgagtcttttttttccttgagcttggccatgcaatatcctattctgattcatatcacaaacattgagtatacatggtagtagaatacttatgtacaatcaatgtaatcagtaagcagtagctttgccattgtggcgctgagactgagtctgtgtctgctcctgggaatgggtattgtgcacttgaacatgtctaagctggttagggtgctgctgttcctttaactgaaacacttgttggctaatagcaagctgttgagccatgcgacttgagagaagagactctccaccaagttctgaccgtgcatcttaaacgccgcacttcagcatccaaggtctcattcagagcatctttcagttgggactgctgttccaaggcttgaatccttaatttgtactcattattctcacttttaagctctgaattattcatctgtaatttggtaaactgagtagacnatgtggttgtctcantctgaagtgtttgaacttga

SEQ ID NO: 1837 - DNA, 972 bp, Glycine max
  misc_feature (830)..(830): n is a, c, g, or t
  misc_feature (931)..(932): n is a, c, g, or t
  Predicted polypeptide sequence is orthologous to G668
cacaatgaaatacactttattcatatcttactgaatttatttgagttgggtaggagtacaattcaaacaatatgaacattaactttacattgctaaaatttgttttgttttctgtatgtttaattacaaattattcttcctttttgagcagccttgtaaactccttcctagtacttctacataccatgattggttaggctgaaattgctacgtaactcattcccgggaatacaattcatgaaatcacttccatccatttgatttgttgactttatttgtgaattatagacctcagtggttgaactgtgaattagacgattatgatactcctcaccaaagttttcttctaacatatgcattatagcttcttggaaagttgaattttgatcaaattcattccccaagaccaaggaatcatcagaattcactgagattccaccatttacttgatccactgatagccactcagaaaataagagttttggtagtggtagagaactctgataagcctccttggaaaagttatagcttttcgagaaaaagttatcattttgtgctattgatttgtcaaggttttctaacaacccataacttgaatcttgtgttgcaagtttctgaggagagagtgcgttttccactgtgtctgaacttgagccggcatgttgaatttgtttatcagattccatttccttagctttgatgactttctttttcaaatatgaatgccagtaattttttacctcattgtcagtccttcctggcaaatgctgtgctatctgagaccaccatgccagttcatggtttgaccgtcttatctatttttccttagnatttaagtagaacccaattgcttttgtttcctaacatatggtgtagggccatgattgtatctttctcatgtttgctgaacacccctctctttcatcctggnnctcagtagttaatccaccttagtctgcagctcttcccatt

SEQ ID NO: 1838 - DNA, 854 bp, Glycine max
  misc_feature (727)..(727): n is a, c, g, or t
  misc_feature (796)..(796): n is a, c, g, or t
  Predicted polypeptide sequence is orthologous to G668
ggcatctaacacagtatgataacaataatcataatttcaatagttattaacatatacacgtctagcaccaaaggcttgaaaaacttctctctctaaggccaaagcgaagattaattgatgaggccctacctataacttatgaaataaaataaaaaattccacagtctcatatatgtcacaaaatgaacccaacttagaaaaacttggcatcatcaccacaaccaactaatttctcttggcaaccagcctcatcaagaagccatttctcaagcaaagagaatggcataatttctgcaccaataacatcaggcttgctttcatcttgcaaaacagtggcctcaggagacaatgaccgagagaattcatcagagtttgaagactccaaagactgatcaaaatcaaacaatgattcaaaattgttttcagacaattcagcactgcttggtggtccctttgctccaatactagaagcagtatcagcacctgctgcagcaaagttgttgaaggagttctgagtcacagatgatgagtttgttcttgaggactttggtgggtttttcatccaaccctttagcattctagctatgttgtcagcacttgaggcatagcacacagtttgtgttgttgttggttttgtggaagagaaggagctgctactatctgaagggtttgagtttgaggcagataaattacaagatggcttctctggtgaaagagcttcactganggctctcttttgcatttggatatcagtttggagccttcttttccactggcctctagggattgccttgangctgaaacccttctccaagctacccactcacaactactgcatcttctcagcttcttct

SEQ ID NO: 1839 - DNA, 822 bp, Glycine max
  Predicted polypeptide sequence is orthologous to G729
cccacgcgtccggtggatttgaatccgcatcatcatcaagtacaaggtgttccaagaagcttcaatcaccaccaccacctccttcaacctcacatctatggccgcgatttcaaacgaagcgcaagagtagttaatggggtcaaaagaagcgttagagctcctaggatgagatggaccacaaccctccatgcccattttgttcacgcggttcaacttcttggcggccatgaaagagcaactccgaagtctgtgttagagttaatgaatgttaaggatctaaccctagcacacgtcaagagtcacttgcagatgtatagaacagtgaagagcactgacaaaggcatcagtactgcaggtcatgggcagacagatattggattgaacccaaggctagggattaatgttcatctgcatgcaccttcacctatttgtgacacaccgaatttaccagacccaattcaaaattcacagaggacaccgtggcaatcatcaatagagacaaaaacagacaacagtagacaagaagaacccgaaatcggtttgacgtattctcacctcaagggaaataataataataatgaaaccatggtggatgggcacaacaattctggagggttggattcttcccctttgtcacgttcctccgaggcaatgcttgaccttgaattcacccttggaaggcccaattggcaaaaagaccaccccgaatcatcaagagagttaactcttctcaagtgttagaatcaaattaagggtgttgttaattattattcttaaagatattagttaaaggaccaaaaaaaaataaaagggcggccgctc

SEQ ID NO: 1840 - DNA, 785 bp, Glycine max
  Predicted polypeptide sequence is orthologous to G729
ggatgactgtagaaactgccagcgcgcaattaaccctcactaaagggaacaaaagctggagctccaccgcggtggcggccgctctagaactagtggatcccccgggctgcaggaattcggcacgagagaagatgacatgtctccaatgggaagcagtggtggaatgcgtcaattttcagaccaaagaagcctttctgatcgaccactgcaacaagatatggactactcttcaggcaacaacactctatggagtaactcttcaagtagagaaacatggcaacaaaataactctaatgacgtagatggttttcagacccccaatcttccagtcacaacaaatatcaggagggcatcaaattcaggagtgtgattcaacccaactcaagaacagtttgtcaggatcaaatttagagtgcaagaacccaagtttggagttcacattagggagaccagattggaatggcaaaggacaagcctaattttcattggttcccttattgtctctagctagtttgcttaattagtttaattacaacccacggtaacatgtgacaaacttcgtaatctttcctgaaatagagaggtgttgtactatatatatatatatatatatatatatatatatatatatatatatatatgtatacaatcagacaaataaaattaaaggcctatgtagtctataaagttgatcttgtttggaagtttacgagttccgcaacgagtgagctaggcttggcttgcgataattattaatgatgggtggaagatgcgccatggtagaa

SEQ ID NO: 1841 - DNA, 761 bp, Glycine max
  Predicted polypeptide sequence is orthologous to G729
cggaatgactgctacgctaagcagcgcgcgtaatacgactcactatagggcgaattgggtaccgggccccccctcgagttttttttttttttttttgttcatcaagccttgttaattgctacatcttaatttccctccttctcatcctcacaaataaataaaaacaaaataaaatataaacaaaactgttcataaactcaaaaacacttttcgaaagctagctaagtagaactacgcacggagggtcttttcttcctctcctagacaccaatttatatttatctaaataattagctctacatttcataagatgacgaagttgtcaccatggtttataaataaattgcaaaattaaaagaaattaagcaagggaaccaattatcaaaattattagctaggcttgttctttgccatcccaatctggtcttcctaatgtgaattccaagcttgggatcttgcactccaaattagaacctggcatgttgctcttgagttggattgaatcacactcctgaatttgatgccctcctgatattgtttgtgaatggaggataggtgatctgagaccatctatgtcgttagaactaggtcttagccgtgactccccacaacttgaagaataactccatagagtaatggtggtggaagagtagaccatgttttgttgtgccgccccactccgccgccctcttggtgtggaaatatgcagagaccaccacaatcttggtgccaattcttcagcccgggggaccactagttct

SEQ ID NO: 1842 - DNA, 740 bp, Glycine max
  misc_feature (7)..(8): n is a, c, g, or t
  misc_feature (421)..(423): n is a, c, g, or t
  misc_feature (495)..(497): n is a, c, g, or t
  misc_feature (634)..(638): n is a, c, g, or t
  misc_feature (646)..(648): n is a, c, g, or t
  misc_feature (701)..(704): n is a, c, g, or t
  misc_feature (721)..(723): n is a, c, g, or t
  misc_feature (725)..(725): n is a, c, g, or t
  misc_feature (727)..(729): n is a, c, g, or t
  misc_feature (731)..(731): n is a, c, g, or t
  Predicted polypeptide sequence is orthologous to G729
cctaaannaagttatgtatacggacaaatatgtaggaacctctagggaaaagtagagaaaaagaaggaaaagaattaaaaaggagggaacaaaggccttattatacatctggttccttcttttcttcaacttttactttaactacaacatttatataatgactaacacaacctataataagctttggcccaaaaagaatatacagagatgcttttagatttgtggaaaagtgcagacatctttgtcttgacaaaagcactacctatatattaatttatatacctgtgcatattaatcttttctattaatttggctagtaataaagtgatcatatatgtaaaccaattaaaattaggcatgttcactgttgtgccaatttgatctccctaaggtgaactccaagcttggattttgatccttnnngaagattcttgtttgtatatagctgctaccctcagaaagtttcccagtatgctgagatgataagatttcttnnngactaagctcatccaaatctcttgagttagcttgtatccgtgctcctctagcgctcgaagaagaattaacccatagattgcttgaagtgtagcccatatcattatctatagatgcatttgaagttcctctctgattnnnnnaaaaactnnnattttgatcatttggtactgttaaggacatgaaatcttcatccccatctgaannnnctgcaggtttgtcagtnnncntnnnantccgataca

SEQ ID NO: 1843 - DNA, 801 bp, Glycine max
  Predicted polypeptide sequence is orthologous to G860, G1760
gatcacacatatgtatttagaatttatataaaacaacaccagactcacttgtgttatgtttttattgcacaaaatttacaacggcagtcattatgtctgatccttaacagcaattaaatgcttcttgatagataatctcgtaccataaatgcgttgtactgttgaatggaactaatatggttgatgaactacaagatccaactcaaagaagcctgatcattctaaggagaagttgttgctttgttggctggcttggcacaaatgacaacctccctgattactgaacagttttgctaatgcagctgcaatccgagtttcattgctttggttgatggttcactgtatttgtattgagactgtggctgacttagctggagactgatagatgcaagtgaatcatatccatttctgacgttgtaagaaggattggatgccacattttcttcatttgtactccttgcttcataaaccttcttttgtagctctgcattttctttttggatctgctccatcttttgatagagttcaacattttcttgatgaatgatatttcccttttggcgtagttctttaatctcattagttaaaatttgatcctttttcatgcggacaccctttaaactcatctccagttggttttccagattttgtagttctttaatacccaaacccgtaagttcttcccccattaattgccttgtgcttgcatagtcataaagcttcccagtgctggagaacaccatcaatccgacttcagcatcacaaaagattgataattctctagctttcttcagcaatcca

SEQ ID NO: 1844 - DNA, 764 bp, Glycine max
  misc_feature (1)..(1): n is a, c, g, or t
  misc_feature (535)..(535): n is a, c, g, or t
  misc_feature (562)..(562): n is a, c, g, or t
  misc_feature (764)..(764): n is a, c, g, or t
  Predicted polypeptide sequence is orthologous to G860, G1760
naaggatgcagctggtagaagcattacgccaagctctaatacgactcactatagggaaagctggtacgcctgcaggtaccggtccggaattcccgggtcgacccacgcgtccgaaaatgaagaaactagcaaacttgaggatgcaaatattacattccaaatgatatttttcagtcaattctttttccacattcaggcatttctaatggtctatgcaaattatatatctcctaagtaattcatgtgaagattgtaaactcccatgcatatattggcgcaagatatctataataactaccttaatttctgaagctgaactcccaagttgacaaggttcttcttttgatttgttgtatcggtcaattactgatttcatgctggaaaaagtcattcaacaacaaaatgcgtcagatatgtgctctgttgactgtaacattcaacaaaagcaattaggttcatccaatgcagattgtaggaagaaatgtttatacctcaataatcttttatcaattataaacttgttcacatgtcttangaatatgagatttggggatggatgctntaattgatgtagtaattatatccggtctttactgtgtaacttcaaaattactctctctctcttcgagaagggggagtaaattgtgtaatatattagttcatgacaaaaaaaaaaaaaaaaaaaagggcggccgctctagaagatccaagcttacctacgcctgcatgcgacgtcatagccctttttatgggtcaccttaatn

SEQ ID NO: 1845 - DNA, 653 bp, Glycine max
  misc_feature (569)..(569): n is a, c, g, or t
  misc_feature (590)..(593): n is a, c, g, or t
  misc_feature (595)..(595): n is a, c, g, or t
  Predicted polypeptide sequence is orthologous to G860, G1760
aacaccagactcaattgtgttatgtttttattgcacaaaatttacaaaggtaaacattatgtctgatccttaacagcaattgtatgcttcttggtagataatctcgtaccatacatatgttgtactgttgaatggaacaaatgtggttgatgaactacaagatccaactcaaagaagtctgatcattctagggagaagttgttgctttgttggctgcttggtacaaaatgacaacctccccgattactgaacagtttttgctaatgcagctgcaatccgagttttattgctttggctgatggttcactgtattgaggctgtggctgacttagttggagactaataggtgcatgtaaatcatatccatttctgaccttataagaaggattggatgccacattttcttcatttgtactccttgcttcataaaccttcttctgtagctctgcattttctttttggatctgctccatcttttgatagagttcaacattttcttgatgaatgagatttcccttttggcgtagttcttcgatctcattagttaaaatttggtcctttttcatgcngacaccctttaaactcatctnnnntnggttttccagactttgtagttctttaatacccaaacccataagttcttcccccattaa

SEQ ID NO: 1846 - DNA, 622 bp, Glycine max
  Predicted polypeptide sequence is orthologous to G977
taaattttttttttttttgaagtggaaactgtagtctttgatgttacttactaatggtatctataatgtagtccacatcatacatgcatgcgtgtttttgtaagattgattacattctggttccacatgcttgaccattaattgaaactcatggtgaaattctcctatcctatggtactaaggtctaaagctcactatatattttattacatggcgcattagtaaatagtgccatccctctccctgaaaaggggtctgcattgttaatttataataaagagcttaggctgagtgaacaaaactaatctccattgagccataatcaagaagctcctgtatcatctgttcaatgtgatcatcttgaagaactggctgaaattgttgctgttgttctagcagttcaacttgtccttcctcttctggccatctaaactgggtgttatctgaacttgttcccgcaatggaattgcctgagtcgttggatgatccttgatgaggctctgtctgagattgtttctgcttgctcatttgaagggaaagagaggccatgtgacacttgtgtagcttcgcagtcagagtagcagagaggagcttcgatgaagatgactgtggctcattggga

SEQ ID NO: 1847 - DNA, 934 bp, Glycine max
  Predicted polypeptide sequence is orthologous to G1020
aattcaaactttccgtgttaatttcattgaaccaaattatggctgcaaccaaaaaacattacaccgtagtaaaatatcaatcaaaacgaaagaaaaaccggatgagcgcttcgtgatttaagaaaaaacagcatgaaactggtggttcctctgtcgcaaaaaaatagagacaatcataccgactacgtattcacatagtatttctttaccttcccttcccttccttccttatcgaacgctgctactttctctactttaaaaaacaaaattagaagaagaaaaactcaaggcatgagtcagattctggatcaagcgatctcatgtggaggaggatggttaaggtcgagatcgaacattctagaaccgttccccttaacaacgccttcgttatgattcagatcgataacggaggacgagtccgagtcgctcgtcgtcgcgtggtactcactcgccgcgacgggatgaggattgtagccaaacgcgaagccacgtggaccggccatgccggcgcgtaggacggcgtcgaagtacataacctggttcgccgccggcaccgcgccggggaaaaccgggaactggttccggaaggggaatcgagcggaggagacggcgacgggggcgaggttgaggtcgagcggagaggaatcggcggcgacgtcgcggtcgcggctggaggactccaccgtgctgctttggctagggctcgcgttcttaaaattttccgaagggagagggaagtttgtcttcgccttagggccgcgaaactcccgcgcggcggcgtcgtaagcacgggccgcctcctccgcggtgtcgaaggttccgagccagacgtcggtcttcttggcgggatctctgatctcggcggcgaacctccccccaggtctcttcctgactccacgaaaatgcaggtccttcaccccggcgttaccgctag

SEQ ID NO: 1848 - DNA, 891 bp, Glycine max
  misc_feature (508)..(508): n is a, c, g, or t
  misc_feature (615)..(615): n is a, c, g, or t
  Predicted polypeptide sequence is orthologous to G1020
ccccggcggtgatgatcgcctgtccgtgacaccgccagctctaatacgactcactatagggaaagctggtacgcctgcaggtaccggtccggaattcccgggtcgacccacgcgtccggaaaaataacgctaatggctccaagagacagccgagccaccgcgctcattgggcccggcccaagcctatcaccggcccacaaagagatccgctacagaggcgtcaggaaacgcccctggggccgctacgccgccgagatccgcgatcccggcaagaaaacccgcgtctggctcggcactttcgacaccgccgaggaagccgcgcgcgcctacgacaccgccgcgcgtgagtttcgtggcgccaaggccaagaccaatttcccgacaccctcgggactcatccttaacaataacaacataaacgctcgtagtcccagccagaccagcaccctcgactcatcctctcccccgccaccgccaccgctagaccttaccctcacccctctctccntcgctgtcttcccggtggcgcgtcctgttctattcttcgacgcattcgcgcgtgcggacaccatgggcgccgctcgcgccgcgagacctgcggcttcgaacgccccngccgcgatttccgccgcggcgactccgactctgattataaccgccgcatactcctgatcttgaccctgacggcctcctctcgccgagctgcctgattcatgcaaggagtctggttctcgcaaataatgtattttggtttttaacaatctgcactactactacgcattttccgataacgggccctgagtaacagcataggagcgacgatgaacgaggtctggattgtgaccatgcgagatgtgcagaatacaaccgacgtctgtacggcatgttagg

SEQ ID NO: 1849 - DNA, 815 bp, Glycine max
  misc_feature (13)..(13): n is a, c, g, or t
  misc_feature (815)..(815): n is a, c, g, or t
  Predicted polypeptide sequence is orthologous to G1020
ctaggcatagganatagcgagcgcgcaattaaccctcactaaagggaacaaaagctggagctccaccgcggtggcggccgctctagaactagtgtatcccccgggctgcaggaattcggcacgagaatagatccaacgttgttgttgttgccggagtatccaacccgacccataaagagatccgttaccgcggcgtgaggaagcggccgtggggccgctacgccgccgagatccgcgacccaggcaagaagacacgcgtgtggctaggaacgtttgacacggcggaggaggcggcgcgtgcgtatgacacggcggcgcgtgagttccgcgggacgaaagcgaagaccaatttccccacccacgcggcggtggcgcgtagtcccagtcagagcagcacgctggactcctcgtctccgccgccgctggaccttactcttgccgccccactcaccgccgcgggcgcgttggttttcccggtggcgcgtcccgtggtgttcttcgacgcttttgcgcgtgccgaggtgcgcgcgtcgttcgatcttcccgtggcggtgttcagcgactcggactcgttctcggtcgtgtactacgagcgggtcccacatcggaaagatgtggatcttgaccttaatgttcctcctccgcccgaggttgtctgaaccggtcaatagatctactctaacgccgcatcgattttttctctctatctgagattggagatgtttcaaattctaattgtagtttggtcatcgttgctttaaaaaaaggggggtttttcttattaatattgggcgcgcccccccccctcaccaccn

SEQ ID NO: 1850 - DNA, 906 bp, Glycine max
  misc_feature (1)..(4): n is a, c, g, or t
  misc_feature (342)..(342): n is a, c, g, or t
  misc_feature (562)..(562): n is a, c, g, or t
  misc_feature (710)..(710): n is a, c, g, or t
  misc_feature (760)..(760): n is a, c, g, or t
  misc_feature (828)..(828): n is a, c, g, or t
  misc_feature (896)..(897): n is a, c, g, or t
  Predicted polypeptide sequence is orthologous to G1020
nnnnaaggaatgactggtggtcgctgcttaccgccagcgcgcaattaaccctcactaaagggaacaaaagctggagctccaccgcggtggcggccgctctagaactagtggatcccccgggctgcaggaattcggcacgagatttcttcattccaccatcaccatggtcaaggagaagaagaacgtggtggtcaagaacaagaagccaaacaacaatgccgacgagcttcacttccgcggcgtccggaagcgaccatggggccgctacgccgccgagatccgtgaccccggcaagaagacccgcgtctggctcggcaccttcgacaccggcgaggacgccgnccgcgcctatgacgccgccgcccgcaacttccgcggccccaaagccaaaaccaacttccccgtgccccccgacgacaacaacaacaacaacgttaacgtgaacaaaaacaagagtgttaacgttaaatctcacagtcccagccagagcagcaccgtggagtccgccaccccggagcgtgaagccacgcgccgctccacctccgccgcaatcgaccgtttnccgtttctacccatccagcagcaaatcctcatgacccaccccgtcgcagcacccatgcgcccggtttctttctcgaccgggccacttcatgacccagtctttcccgcttcggtcgaaccggtccgtccagagcgactcgacttctctnccgcgcggcgatggcagcccaaagagactcaatctgatcttaactggctncggctatgaatataaacctttttttatctcttatttttcataaaaaaggaagcagaaggaaggactanggagattttttctttcttttttttttgaagatatcttccattaagagttattagtacatccttgatgnnaataggtga

SEQ ID NO: 1851 - DNA, 806 bp, Glycine max
  misc_feature (26)..(26): n is a, c, g, or t
  Predicted polypeptide sequence is orthologous to G1020
tggtggggcgattgatgaacgcctcngtgctaactacgccaagctctaatacgactcactatagggaaagctggtacgcctgcaggtaccggtccggaattcccgggtcgacccacgcgtccgctactctctgatcagttttttcttggtctccgaatcacaaactcttcgaaaaaactaacattaatggctccgagggatatcaatagatctaacgttgttgttgccggaggatccaacccgacccgtaaagagatccgataccgcggcgtgaggaagcggccgtggggccgctacgccgccgagatccgcgatcccggcaagaagacgcgcgtctggctaggaacgttcgacaccgcggaggaggcggcgcgtgcgtacgatgcggcggcgcgtgagttccgcggcgcaaaggctaagaccaatttccccacccacgcggagctgacgcacgcggcggcgcgtagccccagccagagcagcacgttggattcgtcctctcccccgacgccgccgttggacctcactcttgccgccccactcgccgccggtggcgcgttggtgttcccagtggcgcggcccgtggtcttcttcgacgcgttcgagcgtgccgaggtgcgcgcgtcgttcgatcttcccgtggcggcgttcagcgactcggactcgtgcacggtcatggattacgagccgggctcacgtcggagagtgtaggatcttgaccttaatgtgcctgcttcgccccgaggtgcctgaatccggaaaaagaatccggtttttgcgcactcggttagtctctctctatctgg

SEQ ID NO: 1852 - DNA, 893 bp, Glycine max
  misc_feature (651)..(651): n is a, c, g, or t
  misc_feature (671)..(671): n is a, c, g, or t
  misc_feature (677)..(677): n is a, c, g, or t
  misc_feature (694)..(694): n is a, c, g, or t
  misc_feature (706)..(706): n is a, c, g, or t
  misc_feature (711)..(711): n is a, c, g, or t
  misc_feature (722)..(722): n is a, c, g, or t
  misc_feature (724)..(724): n is a, c, g, or t
  misc_feature (730)..(730): n is a, c, g, or t
  misc_feature (736)..(736): n is a, c, g, or t
  misc_feature (781)..(781): n is a, c, g, or t
  misc_feature (783)..(783): n is a, c, g, or t
  misc_feature (805)..(805): n is a, c, g, or t
  misc_feature (815)..(815): n is a, c, g, or t
  misc_feature (817)..(817): n is a, c, g, or t
  misc_feature (819)..(819): n is a, c, g, or t
  misc_feature (821)..(821): n is a, c, g, or t
  misc_feature (834)..(834): n is a, c, g, or t
  misc_feature (871)..(871): n is a, c, g, or t
  misc_feature (890)..(890): n is a, c, g, or t
  Predicted polypeptide sequence is orthologous to G1047
ttcggcacgagctctgctcccttaattaattagccaccatgctctccgccctcactccttccgaccccttctctcccttctcccccttctccgccggcttcacgccgtgggatgacaacgacgattcccacgccctcttctcccccaaaccggtctctgcttctagctccgcctctgactataaatccgaaccgaacccaaccgaacacgtatgcgcctcgtcctcggtgatgatggacgagcggaaacggcgccgcatgatatcgaaccgggaatcggcccgcaggtccaggatgcggaaacagagacacctggagaatcttcggaaaccagttgaacaagtgcagggtcgaaaaccgggaaactcggtaaccggttgcagttcttcctgcaccacctgaaccgcctccgaaccgaaaacgaatggctccgctccgagcgaacctgctacgccaaaaagtcgccaatttaacacaaattttgattttccaacaattccaaaccaccttctcccctgctgcatggaacacatgcaccaacaacaacaccacctcgctcatgaaaattaatcaagtttaattaattaaataatatatatatatatatatatatatatatatatatatatatatatatatatatataaaatanggtcttggtaaaaatctaanaggccnagggtgtcctatgttantatcattaaaantttanataaagaaatntnttctanatggtnagggtgggattttggaaaaatattaggctggttttgggaaaatantnatttcattttttccaaaccatnggggtttttntntntnaccgaatataatnttttgttttaaaaaatacttttctttttttgtttccnaaaaaaaaaaaaaaaaaantcg

SEQ ID NO: 1853 - DNA, 740 bp, Glycine max
  misc_feature (1)..(4): n is a, c, g, or t
  misc_feature (740)..(740): n is a, c, g, or t
  Predicted polypeptide sequence is orthologous to G1063
nnnnaagtgagctggtcgatgtaccggcaagcgcgcaattaaccctcactaaagggaacaaaagctggagctccaccgcggtggcggccgctctattcttgtggatcccccgggctgcaggttcagaatggcggcgatgcagccgatacacatagacccggagtcggtgaagcagccgaagcggaggaacgtgaagatttcgaaggatccacagagcgtggcggcgcggcaccgcagagagaggatcagcgagaggataaggatactgcagagactggtcccgggagggactaagatggacactgcttccatgttggacgaggccattcactacgtcaagtttctcaaaacgcaggttcagtcactccaacgcgcttcctccgctaacaacaatattaggccacttggtactagtactgttaacgcaacaggaatagggttccctgttgctatgtctaccacttccaattccaccccttattttcctctgcctaaaccttaccaagctcgccacatggagaatatgcacgatagatatgattaaggttgtttagtgtgtacaactagctagttaatcaattcattatattttaagctgtagcctctgagattatatatatatatattgtgtacaattgtatgtaaaagtataaaaaaataactcgagggggggcccgggttccaattcgccctattgtgagttgtattacgcgcgctcactggccgttgtttaacacgtn

SEQ ID NO: 1854 - DNA, 770 bp, Glycine max
  misc_feature (1)..(1): n is a, c, g, or t
  misc_feature (758)..(758): n is a, c, g, or t
  misc_feature (762)..(762): n is a, c, g, or t
  Predicted polypeptide sequence is orthologous to G1075
ngcgtgagaaaccctttgagtgagcgcgcgtaatacgactcactatagggcgaattgggttccgggcccccccttgaagttttttttttttttttttaattatccaaaatatatattttggttattgatttgagcctatgatttattcaactcaaggttaatgcacaacagtctagtctaataactccagcaaccaagagaaaacgttttacagttgttcctagaaactgatcgtccttacaacaaacctagccaaacaaaacgattcttcaatagaaaaatcagtacttcttcacaagcaatattcagaggaaagattagagaagaccaatatatatgagatcaattcaacttctcacctttgtgcccccaaagactctggatcagtaagattgccttccaccagagttgccagcccaaccatcaacaggtaactgaggcatgtttagtggcaaattgaagaatggaagcccggaagacggatccggaaaagagttattactaactccaccaccatggtcaccgctaccatcaccagctgatgattgcccttgttgcatctgcatagattcatcttcatccaaaggcaacctctcatatgctacattagtaaaagatgaagcaataacaataacaggcccagaagccaccaaaggaccaacaacatttccttccaccacttgaccctgtcctccaccaaagaacacagtcaaacttgtagcacctggtggagcctgaagtgggaggatgatcctgancaanaagagatc

SEQ ID NO: 1855 - DNA, 737 bp, Glycine max
  misc_feature (2)..(3): n is a, c, g, or t
  misc_feature (9)..(10): n is a, c, g, or t
  misc_feature (615)..(616): n is a, c, g, or t
  misc_feature (656)..(658): n is a, c, g, or t
  misc_feature (673)..(676): n is a, c, g, or t
  misc_feature (708)..(710): n is a, c, g, or t
  misc_feature (716)..(717): n is a, c, g, or t
  misc_feature (721)..(723): n is a, c, g, or t
  misc_feature (725)..(727): n is a, c, g, or t
  Predicted polypeptide sequence is orthologous to G1075
anntttttnntatttatttgagcctatgatttattcaactcaaggttaatgcacaacagtctagtctaacaactccagcaaccaagagaaacgttttacagttattcctagaactgagtccttacaacaaacctagccaaataaaacgagtcttcaatagaaaaatcagtacttcttcacaaacaattcaaaggaaagattagagaagaccaatatatataagatcaattcaacttctcacctctgtgcccctaaagaagctggatcagtaagattgccttccaccagagttcccagcccaaccatcaacaggtaactgaggcatgttaaggggcaaattgaagaatggaagcccagaagacgggtccggaaaagagttattactgactccaccaccactaccaccaccgccagcagatgattgcccttgttgcatctgcatagattcctcttcatccaagggcaacctctcatatgctacattagtaaaagatgaagcaataacaataacaggcccagaagccaccaaaggaccaacaacatttcctcccaccacttgaccctgtcctccaccaaggaacacggtcaaacttgtagcacctggtggagcggganntgggaggaacgatcctgacaaagacaggatctcaaacctnnngtgcagcgtgacgannnnacctgctgcagctggctgtctcaacgtcacgnnntcttgnncttnnngnnnctcatcgtct

SEQ ID NO: 1856 - DNA, 838 bp, Glycine max
  misc_feature (1)..(2): n is a, c, g, or t
  misc_feature (560)..(560): n is a, c, g, or t
  misc_feature (562)..(562): n is a, c, g, or t
  misc_feature (565)..(565): n is a, c, g, or t
  misc_feature (567)..(567): n is a, c, g, or t
  misc_feature (570)..(570): n is a, c, g, or t
  misc_feature (573)..(573): n is a, c, g, or t
  Predicted polypeptide sequence is orthologous to G1082
nnttggtattgcaacttgcatgtgtaggaacgagcgcgcgcaattaaccctcactaaagggaacaaaagctggagctccaccgtggtggcggtcgttctagaactagtggatcccccgggctgcaggaattcggcacgaggcttgagagaaaagtgagaaatatggatagagatgaccagaagctgcaaagcaaattcaagcattagagcgaaaggtggttctggtatctggagaaggcaaaggtctctcagtttctgagaatatcatatatcagagtgacaaaagcagtagtctacaggctagcttgcagcgcatttttgaggccatggagagatttactgatgaatctgtgagagcttatgaggagttgctacaacggagcgaagaagaaagtgctgcccgaaatcatgagagaagttcataggggtggtggagctggatggagttggaagatattatctttgccatttgccgagaatagaaactagctgatctccctctactaactattctttacaacagagtcttgggaggaggggttgggcttgattcctccctncnctncnctnccncccttggtgctgattgatcctatgatatcggctggtgtgtcttttgtggcgcggtgtgagcgtgtgacggcgtaggcgacgacgtacctctcgttgcataatactcgggagggtggatgatggctgaaggtcgataggcgtacgatacgtctctgttgatcagagtgtagggctgggggtcgcaccgaacacgaaggtatcgacacaggaggtatgtttgtgatatatgacggtgtggggatgtgttatttggtgacgatctggt

SEQ ID NO: 1857 - DNA, 423 bp, Glycine max
  Predicted polypeptide sequence is orthologous to G1082
gaaaggtgaaaatgttggagagggaggagcaaaagatgcacaaagtgatgcgggctcatgagaggaagatggttacagttggcagagaagaatctgatgcacttttacgtggagatgctgtgcatcacgctgatatcgttgattctactaacctacaatcaagtttgaagcagatctttggtgccatggaaaagttcacagactccactgttcgcttatatgaagaactttgtcaacaaattaagcaagaggatcatgttttgggagaaaccaacaaaattagctagctttacactttttagattggatgaattttgtaggattgaagttatcagaattttctgaacctaatttttatgtatacagcatctcaaagtttcttccgggaaacatttgttaaaaaaaaaaaaaaaaaaaaaaaat

SEQ ID NO: 1858 - DNA, 693 bp, Glycine max
  misc_feature (256)..(256): n is a, c, g, or t
  Predicted polypeptide sequence is orthologous to G1084
tactaaattcttcttcctacaaagaagagaaaaaatgcaatttctgaaaattcaaacattgtaaatctgttcttacaataacagagaaaatatgaaagctattcttgaaagttgaaacttgaacctaactcaattctgaacactatgaaatgcagaagcatgctagaacactttcaagtttcaacaaacctgacagttcgttagatgttgataaatactgagctttcttggcctctaacaatgctgagacatcatnggctgcattgcagattattgtgaattgagcttcaagatcctggatcacttcaaccatgcttgtgggccttcggtttacataaacagtaaaaccaggtgtttcctcctttgcttcttgattaccagttgccatttcctggcccacagtttgagctttagatgcttgaaaacattcactgccattggcttgtgagtctgagacttcatttgcaattccagtttcagcacctgttgcctcctcttcctcttcctcctcatgttcataaacatcttcaactgcgacttcttcttgggaggggtttacatcaattttggctctttcttctgctacatttctctttatagcaaattcttctggttcagtttcatcttcttccaggtctggtattccttcttcttctcgaaccttcctcagtcctctgatctcatcatcagttc

SEQ ID NO: 1859 - DNA, 657 bp, Glycine max
  Predicted polypeptide sequence is orthologous to G1108
cagccaacttaagttccagcgagataaagaaaatatatgaacaaaaatgaaatggaatgattgacctcaggatcaaacatccatccaatgaagagttggtagcataggaaaagctttacaagactacaaagtgtgtatatgactctatgtatataaactacattacgatgaggtgttggtgaggccattctcaaccctgctttcaccctcatgttggttggcatctaccccagagactgatcctcttacgttctcactaacctcactcttgcaaagggggcataaagcatttatcttcaaccacttgtcgacacaatctttatgaaataggtgagaacaaggcaattctctcagctcatcgttattttcatacttagccaggcagatgcagcaagctgcatcttctccagagatcatacgttccttttcagttcctgcagccacaactccaccttcaccaacagctgagttgctttcccctttgcttttatttctcttcattttgaacttataagtcggcagagcattaattgattcagaggatgcacctcgggtttgtgccatatcctctctaactccaaggatggaaattatacaaggcaggcagcagcaaattgttgcacagagaatgaagggcatagcataaccgatgcagct

SEQ ID NO: 1860 - DNA, 760 bp, Glycine max
  Predicted polypeptide sequence is orthologous to G1108
ggatagagcttgagcatgattacgccaagctctaatacgactcactatagggaaagctggtacgcctgcaggtaccggtccggaattcccgggtcgacccacgcgtccggttgacaaatggttaaagataaatgcaacctgccctctttgtaaaaacgaagttggtacgagtaatggagggtccccttcagcctggaactccagtacgtagctgaaggcacgtatcccccatcaagttgcagcttttcaagtgtacatcatcaaacttttggattctgctttcaaggtgagatccaaggatagatgcaaatcaagtaattcctttaaacatgtgatgttacgtgctagtgaaaggttgagaatgtgtttctacccgctctggtcacctctctttttgcgcttttttcaccggttttacatactcaccaagtattgtttgtagaaaataggatgtttcaaatctttcttcgtttatcagttctgtatatataacaatttctagtgaaaatgttaatttttttttttaaaaaaaaaaaaaaaaaaagaaaaaaaagggcggccgctctagaggatccaagcttacgtacgcgtgcatgcgacgtcatagctcttctatagtgtcacctaaattcaattcactggccgtcgttttacaacgtcgtgactgggaaaaccctggcgttaccaacttaatcgcttgcagcgcatccccctttcgcaactgggttattaggagaaggcccgactgatgggccttgca

SEQ ID NO: 1861 - DNA, 842 bp, Glycine max
  Predicted polypeptide sequence is orthologous to G1137
aaaagaagccccccccccccccccccccccccccccgccatgggttagacggtcgctagatacgccagcgcgctattaaccctcactaaagggaacaaaagctggagctccaccgcggtggcggccgctctagaacttgttgatcccccgggctgcaggaattcggcacgaggctcgtaacttcaatgcaaaggaaaaactccctgctggccacgcgaaagatttaggcgaggaaattgcgccgaatggggaactgggtttccctcagaagcaattcctggttattgatcaaacgggtgatcaaacaactcttgttcatagttcaaggtttgggggtcctcttgcttcctggaattcaaagctgcatggtttcaacaatttgaacaatgggaatgaattgcttaatttaaggagagatgtgaatcatgtggttggacttggaccaactttgaacgataaagttgatgaaaatcaaagaactgatgatgacattgaaagcgagatgcatgaggacaccgaggaaatcaatgcattgctttactctgagagtgatggttattccactgaggatgatgatgatgatgaagttactagcacaggacattcacccagtacaatgaccacacacgatgataaccaggaagaaccggataggtgaaccgccaaagaagttgctagctccgttggagagacacagaagcgaaactatgggacggtgctcatgacgacagcgatatgcagttcatggacactgctaatgctctgaatgggacaagactgctcggagctggagatgatgccgaatgaaaatgctccagtggctgccactgtagtagagggta

SEQ ID NO: 1862 - DNA, 393 bp, Glycine max
  misc_feature (60)..(60): n is a, c, g, or t
  Predicted polypeptide sequence is orthologous to G1145
ttttttttttttttttttttttttttttacctctcaaggcatgattaaaagggctatatngtgaatggtataactagcaatatttttcatttttttctgaagaactttcacagaggagttataaagaacttcacaacaattaaaagcaagccattggatgcaaatgcatctcataactattcctggcataccagattcaaccgcacagtaatccacaaggagaattccctgatactcgtatatacaaacctctacaactaggtacagatctcagaatggagctgatgctattcggcgaagttgatatttaggttcaggagggggttcacatggcaacatcagctctagctcctttagtttcctcagcctttcattttcctcttcccctcgtgc

SEQ ID NO: 1863 - DNA, 595 bp, Glycine max
  Predicted polypeptide sequence is orthologous to G1145
tttttttttttttttttttaaatatacaataatggtaatgaagtttaaatttaagattccacattaattactaaaatcccaactactagaccatcttagtaaaaactccaaaatcaggttatcaaaaaattgaaaactcttcctctaaaaaaaaaattataagaattcaatccatttataatccttgtgtttgtttcccaaacatttgaaagttgaaaacatccaagagtcatgatgggttcctttccttctcaaaatggagatgatgaggttctacacagagcggccattctgggagtgggagggttatcagaggaggacaagcagcactgcaactctttcaattgtctttttagtctggaattctcttccgttaaacgggcaatttcaacttccaagccttttctataagcctgttttctagctctggaccgaaccgcggattctcgattttttattatacgcgcatggcgttgatctagcagggtggttttcttagagccggaggcttcgaaggaagtgttggagacagaaagaagagagtggtcatggtcatgtatgtgaaagacagaagaggaagtggaagtgaggttaa

SEQ ID NO: 1864 - DNA, 816 bp, Glycine max
  misc_feature (15)..(17): n is a, c, g, or t
  misc_feature (639)..(641): n is a, c, g, or t
  misc_feature (688)..(688): n is a, c, g, or t
  misc_feature (704)..(706): n is a, c, g, or t
  misc_feature (731)..(732): n is a, c, g, or t
  misc_feature (734)..(735): n is a, c, g, or t
  misc_feature (766)..(766): n is a, c, g, or t
  misc_feature (768)..(768): n is a, c, g, or t
  misc_feature (771)..(771): n is a, c, g, or t
  misc_feature (800)..(806): n is a, c, g, or t
  misc_feature (808)..(814): n is a, c, g, or t
  Predicted polypeptide sequence is orthologous to G1145
ttttaaagaaccttnnnagaggagttataaagaacttaacaattaaaagcaagtcattggatgcaaatgcatcacatagctattcttgacatactggattcaaccacacagtaatccacaaggagaattccctgatactcaaatatacaaaccgctacaactaggtacagatctcagaatggagctgatgctattcggcgaagttgatatttaggttcaggagggggtgcacatgacaacatctgctctagctcctttcgtttcctcagcctttcattttcctcttccaggcgcgagactttattctccaattcatttgtgtatgcctgtttccttgctcttgaacgggcagcagattcccgattttttatcatccttttctgtctcctctcaacagtcttctctatcatgtcctcagaagtgctcttttttcttccaggagtctgcgtatctgacattgttcccatcagagacgatggcattgccatctgattatctgcaaacgaaacatctaatgaagctccagcccccatgtgtaatggctgtaccataccttggctaggcatatacatccccattaaactttgtggtggatgctgatattgtgcttgtggatattgtatccactgtgcttgtgannnaaactgtggtactgccacgtttgaatcaactccagctatagtactgntatttgttctattagnnnatgcacctgcaacaacacctgcttnnannaagaaatcctccaatgtcatttctcccaaantnggntgtctgtcttggaacttcttctcccctannnnnnngnnnnnnngg

SEQ ID NO: 1865 - DNA, 838 bp, Glycine max
  misc_feature (552)..(552): n is a, c, g, or t
  Predicted polypeptide sequence is orthologous to G1145
ggggagatgatagcttcgtgtgattatcgcacgcgcgcaattaaccctcactaaagggaacaaaagctggagctccaccgcggtggcggccgctctagaactagtggatcccccgggctgcaggaattcggcacgagggagaaaactgtggagaggaggcagaagaggatgattaaaaatagggaatctgctgctcggtcacgggcaagaagacaggcatacacacaagaactggagattaaagtttcacgattagaagaggagaatgaaaggcttagaagactaaatgaaatggagagggcattgccatctgtgccaccacctgagcctaagccaaagcaacagcttcgcagaactagttcagccatcttttgatatcttaattgcaatgaattcctaattcttgcccatgctatcacattacaatacctctcatgtgcattatactcccgcctcttcaagtttggttatagatgggaggctattgtttgtgatgctatcagttctccccagcttgctctattctactaatgtttacctcttatgtatatnttgataagtttggcttacaacttaagctgctctataaatatacttactctaattttgggcccatttgtgggaattatgaaattataagtcttactttttatttaaaaaaactaaaaaaaaactcgagggggggcccggtacccaattcgccctatagtgagtcgtattacgcgcgctcactggccctcgtttacaacctcgtgactgggaaaaaccctgtcgttacccaccttaatcgccttggagcacatccccctttcgccaggtgggatattatccaagaagt

SEQ ID NO: 1866 - DNA, 847 bp, Glycine max
  Predicted polypeptide sequence is orthologous to G1146
tgcagaattttcttacaatatgaacatggataattttttcacctctaattagtttctgtctactatatatatgctgctgtttctctactttgaagccttttattgtgcctaattcaactgtaaaacataacattcttcaccctgctctattcaacagtaaaacataacattcttcaccttctctttcagagcaggcagtggccgaacaggcccttctttcaatcttgttcctcgcagttttgtaatctcagcaacatcaggttccatgtagaatcgagccctgtaggctgctagatgagcataatatgctggaggcactactgaaacagaccgtgtacatcttgcataagtgtagcacaaattattggttagagactgaatttcatctgcagtgaaattgttctcgtcccagaggacatgatagtgtgctggtctacttgtaccctgaattcctgcatgactgcataagtagaagtcgaattcggaaggatgacagatcttagaatctaccacagtaccaggtaagatattcccactcttatcagtgctatttctgtcgtcatgattgtttgcgaagagtctagtgtgatgccgtttttgaacaactacaaatgttactggaggttggtaactaggttccaaggatgcacaagccttgcgaatggcatcaagctcatatagcaaaacctggtagaactgtccctcacttaccccatccctgtaaaagattattctcaatggtttttgtcctgttgccttcttaaatgatagtaaaagctccctgcagtttcacaaagtagtatgaactaattagcatgcagacgttagataacatcaaataataaat

SEQ ID NO: 1867 - DNA, 975 bp, Glycine max
  misc_feature (801)..(801): n is a, c, g, or t
  misc_feature (898)..(898): n is a, c, g, or t
  misc_feature (957)..(957): n is a, c, g, or t
  Predicted polypeptide sequence is orthologous to G1146
acaaagattgacagagaatattttttacaatgctaaatttggcatctatataaaacctaataatgcttgtagaaattcattctaaactatggctcaagaactgtaatcatggatctaccacagcaaaacctacacgactaatgtacaaagtaatgtgaggtgaacattgcactccatgatttgaaaacttgcttatcatgttgatgcttgccccatatatctatcattctaccaaggccaagccactaagcagtctaacagtaaaacatgactctcttcacattttctttcaagtctggcaatggcttgacactataatcaccagctgctcgtgttgctttggcaccatgaccattaccgtcacctgcagagccattgtcttgcatatctggttccatatagaaacgtgctcgaaacgctgctaaatgtgcataatatgctggaggaacaactgatactgagcgtgtacacctggcatatgtataacaaaggttgtttgtcagagactgaattccatcaggtgtgaagttgttttcatcccacaggacatgataatgagctggccgactagtaccctggatgccagcatggctgcagagataaaaatcaaattctgttggatggcagattttggtatcaacaacagtcccaggcaatatattcccactccgatctgtactgcttctgtccctgtagttgtttgcaaataaccgggtatgatgtcttttttgcacaactatgaaagttactggaggctggtagtttggttctaaggaagcacatgccttccgaattgcatcntactcataaagtaaaacttggtaaaattgtccttcacttacaccatccctgtaaaatataatttcgtagtggcttttgtcctgttgcctttctgaangaaaacagtaaatctcggatcatgccaccactaactgtgccacgaacagggtcttgccnagttttgtacaatcttgt

SEQ ID NO: 1868 - DNA, 995 bp, Glycine max
  misc_feature (1)..(7): n is a, c, g, or t
  misc_feature (14)..(14): n is a, c, g, or t
  misc_feature (19)..(20): n is a, c, g, or t
  misc_feature (795)..(795): n is a, c, g, or t
  misc_feature (880)..(880): n is a, c, g, or t
  misc_feature (995)..(995): n is a, c, g, or t
  Predicted polypeptide sequence is orthologous to G1146
nnnnnnnaaccccnccccnnttaccgcccccccctataaaataaacaaaagctggagctccaccgcggtggcggccgctctagaactagtgtattccccgggctgcaggaattcggcacgagatcaggttctactgtttgagcttgatgctattcgaaaggcatgtgcatccctggaacccaattatcagcctcctgtgacttttgtggtggttcaaaagcgtcaccacacaaggctctttgctagcaaccatcatgataagagttctgttgacaagagtggcaacatattgcctggcactgttgttgactccaaaatctgccatcccaccgaatttgacttttatctctgcagccatgctggaatacaaggtacaagccgtcctgctcactaccatgtgttgtgggatgaaaacaattttactgctgatgccttgcaaacactcaccaacaatctttgctacacatatgctcggtgcacccggtctgtttcaatcgtgcctcctgcatactatgctcaccttgctgcattccgcgcaaggttttacatggaaccagagacgtcggatagtggctctatgacaagtggtgctgttgcacgccgtgcgatgggcggtgtatggcgtagcacgcgtgtacctggtgccaatgctgctgtgagaccattgcctgcactcaaggagaacgtcaagagagttatgttttattgctaagacatgactgccacagattactgttagaacctcgttagtggagtgcttcttttgcttcaacgttctccagcagtcgtcattangtattgagttttttgaactactccacgagtgtggtgcgtcgaattacgtgtgtcgccttgaaagcatctcctgcgacgagtgctntctactttgctgtgtgaggaatgaagttgatgcaatatgcttatgtcgaagtactcgtcgtgccgttggaggtgcataaataaaacaaaaaaataaacttaggtggtccgtcccn

SEQ ID NO: 1869 - DNA, 829 bp, Glycine max
  misc_feature (728)..(730): n is a, c, g, or t
  Predicted polypeptide sequence is orthologous to G1198
ttaaaaacttgtacagatcaacaagatgcagtaagtagcaacttccagagaagattatatcatggaaaacaagtattgttctcggtgtggctggcacctagtactctctaggacacgctaaccataatgaattaagagctctaagccgtgaaacgtaatcatttatcacaagtagcgcacgagcagcttggaaagtggtcaaaattcgacgcatctgttgcagagtttgttgcctcaataggtcagcctgatgaaggaaattctctagtgtggccagcttgcccagtgcaattgccatttggcccatgtactcagcaacatttccagaaccagagggccctaaagaggaggaagaaagtgtctctgaaagagactgctgcaatgcatccatgccttgtgataatgcatcctcagcctgctgggaagactgctgcagattgtaaatgcccatcaactgctgttcggttaacggctcaagctggtttctaactatcttgagaagttccgaagatcgaaaaccaccgagccatatgaagcatctttctgcaggtgtcttccacatcccagaaagtatgtgaaatacatcagcctttgcccctatgctcttcaacctaaataattcatcataatgtgccatcactccatctacaagaaggtgcagttcattctcatccatttgagaatttatagctgatcttatatcattgatcagccgttgatgctcatcnnnccaacgggcatagtccatgtcaaatgctagggcaccatttccaacagcagaatgactgcgatccccctggtttccagttgcaataaatgcaccctgctg

SEQ ID NO: 1870 - DNA, 873 bp, Glycine max
  Predicted polypeptide sequence is orthologous to G1198
agttagtaatgtctttctaatataccaaaagagaacgtataaatacatacaccatggagccttatgtgcaaccaaccacaaaccattaagcaggaaatgaaactaaagagaggtaaataccccctcaaataaaagctgatttctgaaatacaatgaacagctataacctaaaaatacagatacactatttctacatttttcccttcaacagcttctatctatcatacacctatataatcaaattattgagactattttaaaaccacaaaagcttaaagaaaaatgttgcaccacaccagcagttggcagagtagaaaaatcatagcatttaatgtttatagcatcacaactaggcttcaagaggaattcattgtcaaaagacaccagcttccattgaactcattcagagcacaagattcaatgatcatcggtgtttaagggagtcaggcatgaaagaagtccactaatggggctgtgaaatgcttcactcccttggcctggcaagccacaaagaactcagcgctctcagccgtgagaaataatcactgatggcaagaagagcacgagccgattgcctggtcgttaatattcgaagcatttgttgtaatgtctgctgccgcagattgtcagcctggtgaagaaacccctcaagtgtaccaagctttcccatggccatagccatttgccccatgtaatttgccacatttcccgaggagcctgatgagctgggcgaaccattagccaatgtctcagatagtgattgctgcaatgcatccatcccttgggaaagagcatcttcagtctgctgggatgattgctgcaagttgtaaatgcccatcaattgttgctcggctaaaggctccaactgactta

SEQ ID NO: 1871 - DNA, 968 bp, Glycine max
  misc_feature (864)..(864): n is a, c, g, or t
  Predicted polypeptide sequence is orthologous to G1198
ccccccccccccccccccccccggccgtggggcttgatgatcgcctggtaggatcgccgcgcgcaattagtcctcactaaacggaacaaaagctggagctccaccgcggtggcggccgctctagaactagtggatcctccgggctgcagggaaaacacctgctgagaggtgttttttgcggcttggtggctttcgctcatctgaactcctcaagctgctggttagtcaattggagcctctcacagagcagcagctgatgggtattaccaacttgcagcaatcctcccaacaagcagaagatgcattatctcagggcatggaagcattgcaacagtcccttgcagagacattgtccaccggagcacctgcctcatctggttcatcagggaatgtggcaaattacatggctcatatggccatggccatgcgtaagctagggacacttgaaggcttcattcaacaggctgacaatcttcgccaacaaactcttcaacaaatgcaccgtatactgacaactcgccaatcagctcgtgcactccttgctatacatgactacttttcgcgtctgcgtgctctcagttcactctggctagctcgccctagagattgatggacgcgctaaatagtatggcaaattaattatcatggatccatcactagcaatacttgctcatcataactcttgacatgtcttcttgttgttttgctgtcctctctgcatcactgacggtagtgcttcattgagtcagtctatatacgaaatcgatgacatgatgtatgaatattactactaatattgttcattgtaatgatgaaaacaaatagaaacactcgatgtgggcccggtacccacttcgcctatgntgagcgtatacgcgcgctgactggtcgcgctctacacgacggattgcacttccctgcgtacccaacttatcgctgctctcatcctcttcctcatgctgcgaatt

SEQ ID NO: 1872 - DNA, 793 bp, Glycine max
  misc_feature (1)..(2): n is a, c, g, or t
  Predicted polypeptide sequence is orthologous to G1198
nnaagtgaagtagcacctggacatgcttccgccaagcgcgcaattaaccctcactaaagggaacaaaagctggagctccaccgcggtggcggccgctctagaactagtggatcccccgggctgcaggaattcggcacgaggaagctctcactcaaggtcttgaacagcttcagcagtctcttgttgacaccatcgccggcagtcccgtcgccgacggtgttcaacagatggtggcagccatgggtaagcttggcaaccttgaaggatttgttagtcaggctgataatttgaggcaaataacccttcaccaattatgtcgattgctgacagtccgtcaagcagcacggtgttttcttgtgattggagagtattatggccgtcttagagcccttagttctctttgggcatcaagaccacgagagacattgataagtgatgataactcatgccaaacaaccacggaattgcaaatggttcaatcttctcaaaatcatttctcaagtttctgaaatacatatatatatattgtgtagtaattgaaacccggtgcaagtggatttctttgggctgctttagaaggaatggaaagagtgtcagcgtcatcaaagaattaatatctttttttttttcctttcaatcttctgctcttgtgtctcttatgttttgtataattaaatggaattcgggttttatgtgaatgaccaggaagcttctactttagcctaaaggagtagagaaaattaatgttaaacgaacaatatgacctgccagatgtagatttttttgtacccta

SEQ ID NO: 1873 - DNA, 1774 bp, Glycine max
  Predicted polypeptide sequence is orthologous to G1198
cgttcttctgcagttctgatagctagccatgttggcatgaagatttaagcgggaaaataataagacaacgtatataacgttttcacaaagtggcttttttttttattatcacaaggagtatgtgttgaatgattattgagttgcagcactgatcagttcttagaacatgaattcagcatccccgcagtttgtttccccgagaagtatgagtgtgtacgacccgatccaccagattagtatgtggggagaaggcttcaaaagtaatggaaatttaagtgcagccatgcctttaattgatgaggcagacatgaagtttgatagtcagtcagaggatgcttctcatggtatactgggagaacctaataagtatgaccaagaagctagcaaacctactgataagatacaaagacgtcttgcacaaaatcgagaggctgctcgtaagagccgattgaggaaaaaggcctatgtgcagcagttagaatcaagtcgtttgaagttgatgcagttggagcaagaacttgaacgtgcaagacagcagggaatgtatataggtggtgggttggattctaatcatctgggttttgctggatcagtaaattcaggaattacaacctttgagatggagtatggacactgggtgaatgagcaaaatagacaaatcacagaactgagaaatgctttaaatgctcatattggtgacgtagagctcaggattttagtagatggtatgatgagccactatgccgaaatgtttcgcatgaaatctgctgctgcaaaagcagatgttttctatgttatgtccggtatgtggaaaacaacagctgaaagattttccctgtggattggaggctttcacccctcggagcttctaaaggttcttggtcccctgattgaacccctgacggagcaacagcgtttgaatatctataaccttggacaatcatgtcagcaagcagaagatgccctttcacaaggtatggacaaactccgccaaacacttgctgatagtgtagcagctgggcagttcatggaaggaacgtatattccacagatgacttctgcaatggagaagttggaagatctggtgagctttgtgaaacaggctgaccatcttcggcaagaaaccttggagcaaatgtctcgaatacttacaatccgtcaggcggctcgatgcttgcttgctttgggggaatatttccaacgcctgagggctttgagctcactgtggtctaatagaccccgggaacctgcttagtctcacaacaagattacaagagcgcaaactcataacatgaacgtgatgtgatgatgaatatgggtcagtttctttggcaaagagcatcaaaaccatgtgtcatgagaggtccaggttgctcacatttttcctgcagttttgcgttatggagaagttgtaaatatgactgctagctcattttatgcatacgggcttgtaaataaattgattttggacgcatggtgtatatcggattgttgcaaaaaatgaaatatttagaatctgccatgagtctgtgtggaagttggtcatgtaaaattcatataatgttatgttgggtgttttggaaaatgaatcaactctagactctcttagtggacgtaatttattttttgtgattgctaagagtagtttattaaaaatatcagttgttattagtttgttagaaagttgttaactctaataggctctatatttagagcattcatacagtcttattgtatctttattcaatcaactacaaaatgattttcttatgat

SEQ ID NO: 1874 - DNA, 929 bp, Glycine max
  Predicted polypeptide sequence is orthologous to G1275
aggaggcaaaacttttattattaaacagagtacaagagagatactctaatcctaatacaagatacttacttttaagatttgaacaactttacacatggagaatcatgttccttgttacatgaactagcaaaggctgatttttaattgagagatatattaaacgtggaaccaaaaaaaggtatagaaactctcttcaacctattacagcatgaaaataaattatgattgattagacaatgcaatgatacatagcttcccctgctcgatcgaatcttccaagctttttcttggcacataattaagctagggaggtgtaaatgcccaaaagggtttgaagttggtgtcatttgaaagtagtatcagaatgtacgaaggagatggggctgtagtatgtggtaaatgggctctcatgattgtgcacaccttcatatgttgttatcacgtagctgtagtcatctctatccctttccacccttttcttcacactgcatcctccacttgaacatttgtagtagttccttagattgggactgctcttcacggacttcttgccgtacttcctccacttgtatccatcatccatgatctcaagctctgatttggttctaaacgcgatccttggacccactccacctttgttttcattaatcccatttttgcagtttatgttattattcttagaggttgcaccagtactgaatccgtgagtggcatcattgaaggttgctttttcagatgactcggtgctttgtgatgatcgagaatcttgatgatcaacatagtcatcgagcatgagataatcggatagtgcaatctcaggggaagatagagccatattaagagaattatgagcataattattgggataaggaggagagttccaaagtagaaagtcattgctgataactaaatatggtagcgacagcaac

SEQ ID NO: 1875 - DNA, 830 bp, Glycine max
  Predicted polypeptide sequence is orthologous to G1361
ataaacacattttacgaatatacatgtaccctaaaattaaaatcaaactacagtaccgcaaatatatataccttcttgcttgtctctcaacttcaaccagggtcaattatgggaaagtccatcatgcctgcgccatattgatctcaataattcaaggaaaaacctatatttttccaacccttggaattccttcagtctaatttcacatataaatactattactcaattagtaatggaaacaatatggaggacatgctgtaaatcattgtcactgcttgtctacctagaagctcttcccagtgttactttcaaatcttgctttctttgcatccattgttgagcgaatataagagccatcaacctgaacaaccgagctgggaattattagttgtgaggaactttccctattatgactcgcatgggcatgatcataatctatgtaaggagcattgtagcaatccaaaagagttgcagtagttttagttattgatgtatttgtgctgtcttggacacttccaccattcaacattttttcgtacgggtcctttatgataatgggattaacacattgtctaggttgtgtttggtagaagacttttgaaacaactagttctccatctttctcttcttcagtattgccaagatggtattgatgcatcacccagtaagttttctcaggcttcttttgccttccatagttggtgtagagtactagtattttcttaaaacctttcactgcaccaccagatgcaaaaactgctctagtttttcccgttttgtgccatcttgtttcattccttcatcatcagtgtgaacctttcttcttttcc

SEQ ID NO: 1876 - DNA, 740 bp, Glycine max
  Predicted polypeptide sequence is orthologous to G1361
atataataataataatggaagccttgtctttcttccaacttatcgtcccatatatagaataaatacatgttatatatataatagtaatataaaaaaaaaaaaaacatcaacatcaatatatggtcattgtcactactatatgttctaccaagaaagttcttccagtaaggagctattttctgtccatcttggctttggttgcatccattgctaatcgaatgaaagaagagctatcaccttgcatgaccaaatttggaataagttgaggtgaattttccctattactacaaccacccaattggtcataatttatgaaaaaaggattgtagtagtccataagagcacttgcattattatttctaggtattatattgttgtcatcatcattatggacactttggttagtcatcaatctttcttcatcataaagatcctgctttataatggaattaccacattgccgaggttgtgtttggcagaaaacctttgaaaccaccaattctccatctttctcttcttcgctagtgccaagggggtattgatgcatcacccaattggtcttctcaggcttcttttgccttccatagttggtgtagaggactaggattttcttgaaccccttcacagcaccgccaacaaaaacgggtctagtttttcctgttttgtgccaccttgtctcgcttccttcttcgacggtgtgaacctttcttcttttccttgttcctgttgagtatgcttta

SEQ ID NO: 1877 - DNA, 895 bp, Glycine max
  misc_feature (674)..(674): n is a, c, g, or t
  Predicted polypeptide sequence is orthologous to G1421
cgtagctcgacttctgctgattacgccaagcgcgcaattaaccctcactaaagggaacaaaagctggagctccaccgcggtggcggccgctctagaactagtggatcccccgggctgcaggaattcggcaccaggtacgacagagccgccgtcaaactcaagggccccaacgccgtcaccaacttccccctcgcgccggaggctacggcgcagtctccaccgctcgccgcggacaacctcagctccgacggcggcgcgtcgtactcggacctagtggcctcgccgacgtccgtcttggcctacgagtgcgactcgacgccgttcgacggtttccgttatctcgacgttgacgcgttcgggttccacatcgacgcgccgttaagtttgccggaagttaacgttaacgttgcgctgacgtgtcatcacgggaagaagcaggaggaggcgtttgatgaattcgatctggacgagttcatgacgtggccttactagtgataaaaatctcagggacagtttggtaaattacaccctgtttgcattgcggaagtgtgagttggaaatcccgaaattgcccccctccccctctcgttgtccaagtttgaaattttgtcgtactcgttggagctttggaagagtgtagagttgttggtacaaaattttatgtagtcgcattntactaccacctgaaacggcgattctttgtgtcgtatttggtagagtttaatttgtagttattatcatgaaaaaaaaaaaaaaaaaaaaaactcgagggggggcccggtaccccatttcgcctatagtgagtcgattacgcgcgctcactggccgtcgtttacaacgtcgtgactggaaaaaccctgcgtaccccacttatcgcctgcagacatcccctttc

SEQ ID NO: 1878 - DNA, 900 bp, Glycine max
  misc_feature (30)..(30): n is a, c, g, or t
  misc_feature (701)..(701): n is a, c, g, or t
  misc_feature (732)..(732): n is a, c, g, or t
  Predicted polypeptide sequence is orthologous to G1482
gtgtggaaagatgaatctacagtaagacanctagcgcgcaattaaccctcactaaagggaacaaaagctggagctccaccgcggtggcggccgctctagaactagtggatcccccgggctgcaggaattcggcacgagctccatcttccaccaccaccaccaccaccagcaacaacaacaacaacaaggttgctgttgaaggaactggttcaactagtgctagcagcatatcggagtatttgatagagactcttcctgggtggcaagttgaagactttcttgattcatattctgttccctttggtttctgtaagaatgatgaagtgttgccacggtttgatggtgaaatggaggggcatctgagttctttctcaaccgagaacatggggatctgggttcctcaagcgccaccaactcttatgtgttcttcacaaatggatcgggtgatagttcacggtgagaccaatatcaaaggtagcagcagatcaaagttgaaggatgataaattcactgttccacagattagtcctccttccaattccaagagagccagatttctgtggtagaaacaaataaacaaacaaacaagcctcagtttccattctcttgaggcagaattaacaaccctctttgttttgttttgtcccttttctctttttcttaccctggcttgtagtttactctgcccatgttttcaattnggttcagtttgacttttttttttttccaaanaaaaaaaaaaaaaactcgaggggggcccggtacccaattcgccctatagtgagtcgtattacgcgcgctcacttggccgcggtttacaacgtcgggactgggaaaaccctgccgttaccaacttatcgccttgcacacatccccctttttgcagctgcgttattacaa

SEQ ID NO: 1879 - DNA, 715 bp, Glycine max
  misc_feature (715)..(715): n is a, c, g, or t
  Predicted polypeptide sequence is orthologous to G1560
ggggggcgggggttgtgaacagcttgacatgattacgaatttaatacgactcactatagggaatttggccctcgaggccaagaattcggcaccaggccgcaggaatttttttttttttttttttttttgagtaaataacgattgctatcactaccatagattcttgtccaagcaacagctgcaacctacctaatcaaacagagaaaagtgagaaattttttaggttctacaaaaggacatgcatcatcatataatgggggggttagaaacaccaaaaagtaaatcatttccacatgtatcatgccaaatgggatgcctcctcctccattcaccacatgagtgcctccacttgaaccaaattaatgaacaatgttaaccaataataatcttgagtactatatgtggttggtttcatttaggacttgaacccaagtaaccaaagcgattggccaacacattgacatgatcttcttcttcttcatcttggtcttgggaattagttggattagtatccaattcaccctcaaaaccctcactgaaaagttcttcccagaacccttcatcaagctctttctccagcctctcttgtgagcagattccatggaaatggagctatcagaaacacaaaatagtcttcaagatgaaaacatgtcaatgaatgaatcagattctgaagaggacagcattgtggattcctatgtaataaagaaagaan

SEQ ID NO: 1880 - DNA, 834 bp, Glycine max
  misc_feature (47)..(50): n is a, c, g, or t
  misc_feature (817)..(818): n is a, c, g, or t
  Predicted polypeptide sequence is orthologous to G1594
cgtattgccatgaaataatgattcagtaacattgatcgattatcacnnnncgtcgcgtatattagctacagttttttacacttgcatatatatatatatatatagctgaaggacctacttagcatacaaatgtaggttcaaaaaattaatatctcgcggaatagaaggtatacacacatcacacgagcagaagatacaagtattgggaatcaacacggtccatctcgagaaataaatcacataggtcctcctaagccactgccacttacaccatccataatggcaaatcgcatgtcctctgttggtttccaatgccgtttcctttgattgatgaaccaattattgatctgcttttgatcaagtccggtcatttctgatagctgcactttctcttcctccgtaggataaggccacctatagtgtgtgttccaccagtccatgagtatcatccttgcatcctttggtagcttaccttttttccttttctttagaaattcctttctcaagctgctaagataaccaccatacttacgaagaagcatttctttaagctcttgatcacctggacgtgggccagaagattcgtcaccatcaactgcttccaccttctcccaacttaattcatcctctgatattcctgcagcctcatctgagcggttgttattcagtggcattgttagcgttcccttacaaagattgctgagttgtgattcgatactgcacaaaaacaaggtcgcttcgttgaatggcttcgacaactcctgcttgtatctatgaagaacttcgcagtatgactccatgaactcgtcaagctcannatcatttcctatctct

SEQ ID NO: 1881 - DNA, 802 bp, Glycine max
  misc_feature (15)..(40): n is a, c, g, or t
  misc_feature (49)..(49): n is a, c, g, or t
  misc_feature (58)..(58): n is a, c, g, or t
  misc_feature (736)..(736): n is a, c, g, or t
  misc_feature (785)..(785): n is a, c, g, or t
  Predicted polypeptide sequence is orthologous to G1635
gaggggggtaataannnnnnnnnnnnnnnnnnnnnnnnnnaaggggggngggtgtggnaaaaacgacctgccatttcctgccaagcgcgcaattaaccctcactaaagggaacaaaagctggagctccaccgcggtggcggccgctctagaactagtggatcccccgggctgcaggaattcggcacgagatgaagtctaattctctgaagtcgtcagactttgatcaagaaaaccaatctccaaaatcagtattatcaggagttggttcagacagccttggctcctctgattcagacacaccaaatggaagtttgtcgcccatgtcatccattagtggcttccatacaagcagttttacacgtgccaaacccaaaacaacaacatctgaggaagaagctgggatggacactgattcaactcatgatgagaaacctcttatgaaattcaagcttcctccaaatggatgtgtttccatcaaagaagacaacacagcagaagaatcttccggtcggactttcaaactctttggaatgactctatttgtaacagacacctgcaaaccatctccaacaatcgaggaatgctaaagatacctctaaacattcgcgcgcaacgcctttcctcctccatggaggatggcaaattggaacttgttggacactctagagcaagtgaaacatcagcaatatccaagctaaaggtgagagtggaacctgaagcatgtgggaaagggtntgtgccatataaaagatgcatatctgttgtgacagctgatgatagagcngagcaatgtattcatct

SEQ ID NO: 1882 - DNA, 764 bp, Glycine max
  misc_feature (1)..(2): n is a, c, g, or t
  misc_feature (764)..(764): n is a, c, g, or t
  Predicted polypeptide sequence is orthologous to G1635
nnaagagagacacaatgacatgcatcacgccagcgcgcaattaaccctcactaaagggaacaaaagctggagctccaccgcggtggcggccgctctagaactagtggatcccccgggctgcaggcttccccacaatactccatttatgccactgcacaaggagccaaaagggaagcatctatattctaatcttggagagtttgaacataaagaagttcaaaaggaaggatcatggactggttcaaacactagttcaattgatgatggagataacactgaaaaatcagatgatcaagccaaaagtcatgtacatggttttagcaaaagtgaaactttaactatatctgagctaagggtgaggcctaaaacatgtggaaaagggtttgtaccatataaaaggtgcatggcagagagggaaaaccagtgctcatcagtatattatgaggaaagggaagagcaacgtattaagctttccttatagtaccctcttattggcttttcttcaaagcaggttcccttttacaggtataatgtacctgtttctgttgctggatgaccttgcatgagaagaaagataacggagctgaaatttttgatatctctactgcatatgtaattctacacaagcctgtgtgttaacctatatgaacttgcagactttgggaaaacactatccaatgaattatcgcacctatctgtatttctttcatgcctagccctttggattgcttcaaatacttcctcagcctccactcggatatatn

SEQ ID NO: 1883 - DNA, 652 bp, Glycine max
  Predicted polypeptide sequence is orthologous to G1655
ttttttttttttttttttttttgataaaaggtactcctaacttttattatagattattgaatttttaaataaaatacaacctccacaccccaacattgaaagaagcccggtaatggtgttaaccttaccttcaccctttctctagaacccagatggtgtttttaaataggttgggtgcttaggagtttaggagtctccttttatactccatacaaattggacaaacaccttaggacagtgactttagcttcaagtagaagtatgtattgttcaatgctttggaaaaaattgtgcatgtccattacctcactcccaggaactgctccctgaagctccctaagcttcctttgcaaggaaggtttcactttcacagcattattattggccaaacaaactttcgcccttctcttccttcccctaactgttacatgtctcggccaacgccttgtgctcattttgcctagctaagggaaaaatttaagagagatgagagagagaactagtctcgagtttattttttttttttttaataacatttttctatatttcaattaaggaagaaaagaggagcaaattgcaactgtattgtttgacaagaccaaacagtccagcatatgatacacattacagatacacccgatctcctctctct

SEQ ID NO: 1884 - DNA, 833 bp, Glycine max
  Predicted polypeptide sequence is orthologous to G1655
ggaaaatataataaaattaatactccatatcatatatattagtacaattatatgtgtaaactaattatataccatatcatttatattattatgtaatataacaatatagaacatatcttactgtctattataacttttttaactgaaataataaaaaatgaagagaaaaaataaaataagtggcgaagatggaactgaaatctaaaaactaatataaacgatatatgaagaaacacctaatagtaagaattaacaacttcggtcaactcaaaccgatcggagctggcggcggagcaccggtggcgaggaggtcggcgagagccttcatggctcgcacttgcatctccaacgccgaaatatagtcaccggcttcttctagaagcttcgggaacgacaccttccggcaaccaggaattaactttccgagaacgcgcgctttcttctgcacagccggcaagcttctccgaatctcaggcgtcgtcttcttcatgaatttgttggcggagtacttcttgaccttcttgtggtgtctctgcttccagcggcagatcggatttgagagaatggcgcggctccagcgagttcggcctttggcagtggcggcgaggacgcggtcagcggaggcgcggacttcgagggcggcggtagggttgctgttgcggcggagcgagtggaggagcttggaggagtagaggcgctgttcggttagggaagtccaggagggagtgagagcgaaggagttttggtgtgtgatttggcggcgcttattgttaacggaatggaggtttgagtgcaaagacaaagagtccatgatgtgtgaatgcgacagcaac

SEQ ID NO: 1885 - DNA, 1038 bp, Glycine max
  misc_feature (1)..(3): n is a, c, g, or t
  misc_feature (13)..(13): n is a, c, g, or t
  misc_feature (447)..(447): n is a, c, g, or t
  misc_feature (596)..(596): n is a, c, g, or t
  misc_feature (682)..(682): n is a, c, g, or t
  misc_feature (791)..(791): n is a, c, g, or t
  misc_feature (798)..(798): n is a, c, g, or t
  misc_feature (842)..(842): n is a, c, g, or t
  misc_feature (851)..(851): n is a, c, g, or t
  misc_feature (904)..(905): n is a, c, g, or t
  misc_feature (928)..(928): n is a, c, g, or t
  misc_feature (978)..(978): n is a, c, g, or t
  Predicted polypeptide sequence is orthologous to G1655
nnnccgagcccangtagattttcgactggtatacgccaagcgcgcaattaaccctcactaaagggaacaaaagctggagctccaccgcggtggcggccgctctagaactagtggatcccccgggctgcaggaattcggcaccagatcaacttcttctttcgttcttcattgttcattcaatttcttctctcttcatctcaccgaacaaatcattcaattgcaatcatctatggcgtctttcgacccgagcgtagattctagtaattccgacacgttgcgagaatccaatcacaagaagcgcagaaaaatcggagaccacgccgccgccgatcaaaattcggctgccgcctccccgtggagatccgaagaggagcagcggatctactcccgccgcctcgtggaggctctccgccgcactgcgtcatcggcggccaagcctagagccgnccgccaggtccgcgagaacgccgaccgcgtcctcgccgccaccgccagaggccgaacacggtggagccgcgcgattctcagccgctggaggaagctccgcacgcagcacaagaaggcgaagaagaaggaggcatcgtccattaactgtntgaagagaacgaggattggcaacggagagagaggaaccggtacctgctggcagaagaagcgccgcactcagccgtggttccgttgnccgaggtctgtttcaaaccttctgagaagcacggactatttacgccttgagatcaaggcgagcatgacggtctcgcgactaactgccgcgcgggccggcagatcgcggncggaccnttaggccccggcctagctatatgcgccccagtgttctaattatnttatataanaatcgtttaatgttagatcagatttatcggcctgcatgaattgctatcctccnnttttgtccttatactcccccctntttttcttctttactcttataaaatggtgcagtcctattgtaaaaaaaanaaaaaaaaaaactctgggggcgcctctcctctctaggtaccgtctcttccgttaacctaa

SEQ ID NO: 1886 - DNA, 479 bp, Glycine max
  misc_feature (398)..(400): n is a, c, g, or t
  Predicted polypeptide sequence is orthologous to G1662
attaacaagaatggtcacaagcaacccctgcggtgaacagtaatgtttctttgcttataatgtagagggtagcatttgtttgacaaaattttttatgtttcactcttctaaatcctataggcatatacaatccaaacaaatcatgtactagtactaatacttaaaaattctagagaatgctctgttgcttcaacagagttaaccctacgaagcaaaaactctactccatcaacccatttttgcttgtggagtttgttctggcacttaaattctagaagaccttgtgcagttttgaggccaaaataaagctcttctgatgcttccctttcttttctatatggccatgcattatctttatcacagactccatacaccacacatttgttctttttggagannnctcctccaacgtgcttgcttttgatcttaactttaacctgacatttcttgatataaacatggacatgtctccatcgtaa

SEQ ID NO: 1887 - DNA, 481 bp, Glycine max
  Predicted polypeptide sequence is orthologous to G1798
tagtactctaacgaacagtttgaaataatgactgtggtacataaattatttaagtaggcgtacacaaccgccgttgtgattggggtacaacaagaatacatatcttaataagacatgaatataacagtctgcaaggaagctagcagcgtttgtatgggcataagtaatttttaatctttaggattacgctatgtatgcatgagcactatatgttgtaggtatcaactttaacggcatatcttctctcaggtcttcctatgaataagtccgtctccacctcttctccctcctttttggtggcgaattcgacatcctgatcactcaaacaacgttgtcgtacaatccggtactgctcacgtaagcgtttatttacttcgagtaagcacttttcctcttctttgagctgctcgattcgcttcctgaacaattgattcttagtagccctaattttgtccaggctgcgttcgagctggttctctag

SEQ ID NO: 1888 - DNA, 728 bp, Glycine max
  misc_feature (1)..(1): n is a, c, g, or t
  misc_feature (673)..(673): n is a, c, g, or t
  misc_feature (728)..(728): n is a, c, g, or t
  Predicted polypeptide sequence is orthologous to G1798
nggggttttcaatagacgctctgacatgatcacgaatttaatacgactcactatagggaatttggccctcgaggccaagaattcaagctggggataggtggatgaataaggaaagcttggtctgattagtctatactatatgccttgctattccactttttctgagtttttctctgcactcctttgctagctaccctctcttttgggcttttttgggccttcaaatcttgcttggagaaggctcaattttggtggaaacctctcacacaagaaagcatagtttcttttgggttcattctacttggtgtttagagatggtgagaggaaagactcagctgaggcgcatagagaacgccacaagcaggcaagtcaccttttcaaagcggcgtaatgggttgctgaagaaggcctttgaactttctgttctttgtgatgctgaggttgctctcatcattttctctccaagaggaaagctttatgaatttgcaagctcaagcatgcaggacacaattgaacgataccgcaggcataacaggagtgctcaaacagtgaacagatctgatgaacaaaatatgcagcatttgaagcaagaaacagcaaacttgatgaagaagattgagcttcttgaaagctcaaacggaaactcttgggagacgggttgggtcatgctctnagaagaacctgcacgatcgaaccacagtcgaaaggagtgtaagcagtgttctggn

SEQ ID NO: 1889 - DNA, 453 bp, Glycine max
  Predicted polypeptide sequence is orthologous to G1798
aagcagtgttcgtgcaagaaagaatcaggtttacaaggaacaaattgatcaactaaaagagaaggaaagagccctatatgctgaaaatgctaggctgtgtgagcagtatggtggtatccagccacagccagcaacaaaggatccgaaagaaattcaaccctatgcagaaagcagtccaagttcagaagtggagactgaattgttcattggactactcaggtctagctattgaacataatttaatccttgcctatgcaaatatcaaataagaagcccaactgcaatgtataaatatcacatgtttcctaatactgagatgaataatattatcgcttgtattatataaagaactttctagccttatgattagggtttaattattgatatgtttgcctttcctcaaaaaaaaaaaaaaaaaaaaaaaaaaaaaaaaaaaaaaaaaaaaaaaaaaaa

SEQ ID NO: 1890 - DNA, 790 bp, Glycine max
  misc_feature (1)..(3): n is a, c, g, or t
  misc_feature (761)..(761): n is a, c, g, or t
  misc_feature (770)..(771): n is a, c, g, or t
  misc_feature (774)..(777): n is a, c, g, or t
  misc_feature (782)..(782): n is a, c, g, or t
  misc_feature (785)..(785): n is a, c, g, or t
  misc_feature (787)..(788): n is a, c, g, or t
  misc_feature (790)..(790): n is a, c, g, or t
  Predicted polypeptide sequence is orthologous to G1844
nnnaagggtcgctggcattacgccaggcgcgcatttaaccttcattaaagggaacaaaagctggagctccaccgcggtggcggccgctctagaactagtggatcccccgggctgcaggctccagcaccggaaagctctacgagctctgcaacggtgacagtttggccgaggtcgtgcagcaatattgggatcatttaggagcgagcggtactgacacaaagtcgcaggaactatgctttgaaattgcagatatctggtctggttcagcgttttctcaaatgatcaaaaggcacttcggtgtttctgaacttgagcatctgagtgtgtctgaccttatggaactagagaaactgactcatgctgctctttcgcgaatcagatcagcaaagatgcgattgatgatggaatctgtagtgaatcttaagaaaaagattgaggcactagaaaaaactaatgacgtcaataacgtggtgacacggtctattgactgtgatcaaacagatggggtgactcataatctgttcccaggtctctaatgggactgatagccactactctgtgtctaactggacactcaacccttgaaatttccagtgtgtgttttattcctgcattagggaaccattccatggctaactacttgccttttatattttctattttgttgaaccattgagcatcttgaagatatgtagcctggggaacttgctttcacctctacttttgtgctaattatttattatacgtgcttttcatgcccnagacaactnnatnnnnttatntantnnan

SEQ ID NO: 1891 - DNA, 730 bp, Glycine max
  Predicted polypeptide sequence is orthologous to G1902
aaaatacacatatatagattaaataaattagaatctccaagccatggcaacacttcctctacgtgatgagactgaaaacaatctcactacaacaacattcatatccccccataccctgccctaaaatatgacttgctttccatttctcttccatcattgatataactgaagaacaccaaccacaattcacaaatataaaaatccaaaacaggagaaactttacctaatgatcctatagcagtggccttctggtttgtgatcctccataatagtacgacatatgtctaaatatacagatcagagtaatcatattcattaatttgtcattactgaaagcttgacccaggagtgaaaatagcaaggtgagaccaaccactagtaccattccaacagcttgaatcaccattttgcaaactcagaaaattctctgcgttcccattgctttgcatctccaacccgggattccgacccgaacccggatccgcaaccggacccgaactaacattctccccaaactcttccatttgcacagttttcagattagacccacttgaattcagaccctccaagaggttccccaggcccaaatggccacttgatgccaaaagggaactgaaacttccgccaccaacaaccggggtggggccaatccgggtagggtcgggttctggagcgggtgccgaggaaactgggggtgatggggaagcgcgtttggtgttgcgacagcaac

SEQ ID NO: 1892 - DNA, 857 bp, Glycine max
  misc_feature (309)..(309): n is a, c, g, or t
  misc_feature (616)..(616): n is a, c, g, or t
  misc_feature (732)..(732): n is a, c, g, or t
  misc_feature (752)..(753): n is a, c, g, or t
  misc_feature (832)..(832): n is a, c, g, or t
  Predicted polypeptide sequence is orthologous to G1944
atacattacgccagcgtcaattaaccctactaaagggaacaaaagctggagctccaccgcggtggcggccgctctagaactagtggatcccccgggctgcaggatccggtggcatgagtgtatctttggcaagccctgatggacgtgttgtaggtggtggagtagctggtctgttggtggctgcaagtcctgtgcaggtagtggtaggaagttttctggcaggaaaccagcatgagcagaagccaagaaaacagagacatgaggttataacaagtgtgataccagctgcagttgttccaatctctaccnttgatcccagtgccaattctatcagccagcgtcttccatccgaaacgataatttggtcttgctattgccagcagaggcgcaagaataagccagctgactttaaaccgtgttcgttctgtcggggtaatttatatattagatcttaatttcatctggattttactttacatggtgcaccatgtaatgtgaatgggtaccctaaatgtggcttgttttcccctggttgggggggggcggaaaatggtggactttctaaccggcccaaatgttttcaaaaggtttacccactctgctcttgttgaaaatnagggtgggggtaaaagaatcgttttatgccgggtggttgtgagcatgacaaaactcttgtggggtatgttttctttgaaaatccttctttcctttggggggttaaaaaaaaaaaanaaaaaaaaaaaaaaaaatanntctcgggggggcgccccccccctatttcccccttaaggatgtgtttcacccgcctctccttgggcgggttttaaaactntgtgaattggaaacaaccttgtttc

SEQ ID NO: 1893 - DNA, 788 bp, Glycine max
  misc_feature (3)..(3): n is a, c, g, or t
  misc_feature (45)..(45): n is a, c, g, or t
  misc_feature (547)..(547): n is a, c, g, or t
  Predicted polypeptide sequence is orthologous to G1944
canaccccccccccccccccccccccccccccccccccggtgtgnaatcagacggctgacactcatcacgccaagctctaatacgactcactatagggaaagctggtacgcctgcaggtaccggtccggaattcccgggtgggtcagtcactatggcattgtcaccaatgccaatttcgtcgtcggctccgccttctaatgacttttcctccgggaagcgggggaaaatgcgggggatggactataagccatcaaaaaaagttggtttggattatctaggtgacttgaatgcatgctctgatggtacaaattttatgccgcatatcatcactgtcaatgctggcgaggacatcacgatgaaggtgatatccttttctcaacaaggaccacgagctatatgtatcttatctgctaatggtgtgatttcaaatgttacacttcgtcagcctgattcttctgggggtactttaacttatgagggccgttttgagatactttccttgtctggatcattcatgcctactgataaccaaggaacaagaagcangactggtggaatgtcggtctcgttggctagccctgatggccgtgttgtaggtggcggagttgctggtcttcttgtagctgccagccactgtgcagtggtggtggggagcttattaccatgccgccagcaagaacatacaatagaagatgcaagatctagcgagagtgcgcaggcacatcaactacacacattgcagtgcttcatcactcgcgcctgcaaccaatgcggagactacgatgtg

SEQ ID NO: 1894 - DNA, 776 bp, Glycine max
  misc_feature (7)..(7): n is a, c, g, or t
  misc_feature (741)..(741): n is a, c, g, or t
  Predicted polypeptide sequence is orthologous to G1944
gagtggngttgattgcctgtcgaagattacgccaagctctaatacgactcactatagggaaagctggtacgcctgcaggtaccggtccggaattcccgggtcgatccacgcgtccggggaactgaaaagaaatcttaatacaagattacaccttcagaagagtcttgctgaagtgtgtgcatggacaggtcatgatctttgtattctgaacagtattcagagtttgatgttgattgtgtagacttaggagtgaatagtttgatatatgcatggaaggaagagaagggataagttctggggttacagtgataggagcagaagctccatcagcctatcacatggcaccaaggagtgaagctccaagccaagttcctccacctgttcctgaagcaacagctggagctattggtgtctcaccagcgagtgtgggattggatggaacagcagctaagaagaaaaggggtagaccaaggaaatatgggccagatgggttgaactctatggcattgtcacccattccaatctcatcttcagctccatttgctaatgaattctcatccgggaagcagcgggggaaaccgcgagcgatggagtacaagctgccgaagaaagttggagtggatcttttggtgattctgttgtacaaactttatgccccatatcattgcggtcaatactggcgaggacattacaatgaaagttatatctttttcccaaacaggaccccgtgctatatgcatnctatctgcttatggtggtatttcgaatgttacact

SEQ ID NO: 1895 - DNA, 622 bp, Glycine max
  misc_feature (9)..(9): n is a, c, g, or t
  misc_feature (52)..(52): n is a, c, g, or t
  Predicted polypeptide sequence is orthologous to G1944
cagctctgnaccatgcatacgccaagcgcgcaattaaccctcactatagggnaacaaaagctggagctccaccgcggtggcggccgctctagaactagtggatcccccgggctgcaggaattcggcacgaggaagtggtggactcactgttgttcctgacgatgctcctcctactagtgcttttgcttattcggcacgaaacaacaacaacgttgctcctccacctcctgttagggtggtgaaggttgaaggtcagagtggtatggagcttcagcttgctcctcctcctggatgggaaaaattaactgctggaggtggagctgttaaaatcaaattggagcctgtagctagctagggtcttaatctcttatcaagggtccagtagttttagtactctgtttaattgttattcatagggtcagattcaatcttcaattgtgtttatggaccacttatacggtctatagtgcttaattaattgggtcttgtcttcattgttcgccttctctcgttgaataaatactggattttatcttcgaaaaaaaaaaaaaaaaaactcgagggggggcccggtacccaattcgccctatagggagtcgtattacgcgccctcactggccgg

SEQ ID NO: 1896 - DNA, 810 bp, Glycine max
  Predicted polypeptide sequence is orthologous to G1985
aattatcaatgaattaatccaatccttaaaattacgtaattatcaaaatttttgtaacacaaacattagaggcccttagttccaacatggtaaaactcaaaattctctatcctacttcgtctttcacgcccttaaaccaaatggaaacaaataaatcaccctggtaaaagaaaatcaatgattttgaagtttatgaatgtttcgatggatagatgatggtgcttctggaacttgctcagctccaaacagttaaacacttctttttcattcctttcactttctttcctaagctgaatatatcataaatttgttgagtttgtgccaagggtttaagttgctatatggtcgctgtttcgttgcaatccttgatgttgtgggggtaaattgctgacaactgtggccacatagtcgctgcatccaaaattgcggtcccaaaaaacaaaacactgttatctgtctttgattccatttaatggaggcttcaatctcaggagacgtccttggcgttgttgaagaacgcagtggcgcagagaatggaagcaatgaaggcaatgaagcccaaaccaatgattaaagaaaccccagcgacgaggaagtccaataggcccaatcccaccatcaccataatcgccatgttcttcttattcaggtgagattgggagggagtgtatcgactaagaagagattcagaaacagatgagaacgtggatgtctctgaacggtggtgacagaatcgaaacagagggaacgcgaggagacagagacatcggagttttctcgattgtgttttctcggtccaccgacagcaac

SEQ ID NO: 1897 - DNA, 867 bp, Glycine max
  misc_feature (833)..(833): n is a, c, g, or t
  misc_feature (864)..(864): n is a, c, g, or t
  Predicted polypeptide sequence is orthologous to G2226
ggcaaaagcaaaagggtctgtatatgatgtctgtttacatatcaagaggatattatggacaaacacaattatcccaaaaaagtagatccctcgactcatatgtggcaacaccagatacagagaaacaaaggaaaacaagaccctccacacactttaacaatcataaaaaagtaaagggttaaaaaagttagagccaagaccaagggaacatcaacactgccacaactatgtacatacaatatatactgtacatgaatatatctcttttcttttatatgtacatgtttttttaccaaaagcaagatgcatcatcttcaggcatcaaggaagtcctgcaaagtgggcatgtaatgttccaatagtccaaccacttctccatgcacactttgtgaaaaatatggccacatgataaacagtttatctcagattctggttcaaactttgtgagacacacacaacaacattcatgttgaggttgtttactgccacacatgctgccaaacctaagtgttggtgtcctgcttctgaactcttcaatgaaaccctccgaggggctgaggttgaattctaatggctcaggtgggtttcgggagatgtctggtgaaggagacaacgacgaaacgcggataccgacaatttgtagaattgtcctaacaatgcctttgaatatggatatagacaaggcagtgtttacaagaagcacacataacactccttcagatggtgctgggagacttgacaggcccattttgataccaaattgtgttggttgcaagtggatgatgattttttctctttgaatctgaaaccagcagaatgaacaaattgctatngtcacttcatcaatggaaactcttcgacagncac

SEQ ID NO: 1898 - DNA, 757 bp, Glycine max
  misc_feature (1)..(1): n is a, c, g, or t
  misc_feature (704)..(704): n is a, c, g, or t
  misc_feature (756)..(757): n is a, c, g, or t
  Predicted polypeptide sequence is orthologous to G2226
naggatgctgttgattacgccaggcgcgcaattaaccctcactaaagggaacaaaagctggagctccaccgcggtggcggccgctctagaactagtggatcccccgggctgcaggaattcggcacgaggctgagagttacattgaagagttcagaagccggacgccaacacttcggttcgacagtgtgtgctgctgtaaacaacctgagcatgactgctctgtatgcctcactcagtttgaaccggaatcggagataaaccgcttatcgtgcggccatctcttccacaaagtgtgcttagagaagtggctggactactggaacattacatgccctctttgcaggactcccttgatgcctgaagatgacacaccttgctttcagtaagcaaaaacaagggagcatggcaataagagagagtttcatgtacagtgtagtgtacatattcttgagggtttttgatgttcatgcatctgagttctgccacctttataagtttttaacctttttccttttatggtctgagtttgtggaggattttgtttttacctttatctgtctgtgcgtctatagacacatgaggaggatactggttgcttgcatgtaatgtttgttcacaatgcacaccttgtttagaccaccttaaatgtctatatgtgggcagttttgatcctaagtaaggaagcatggattgtagactccatntggtttggcctttcaactctgatcggcgatgtgtatatatagtgatgtgtgnn

SEQ ID NO: 1899 - DNA, 787 bp, Glycine max
  misc_feature (340)..(340): n is a, c, g, or t
  misc_feature (787)..(787): n is a, c, g, or t
  Predicted polypeptide sequence is orthologous to G2520
gatgagcttgtacctgattacgccaagcgcgcaattaaccctcactaaagggaacaaaagctggagctccaccgcggtggcggccgctctagaactagtggatcccccgggctgcaggagagctagacgcgaaaagatcagtgagaggatgaaaattcttcaggatatagtcccgggttgtaataaggttattgggaaagcattggtccttgatgagataattaattatatccaatcgcttcagcggcaagtagagtttttgtcaatgaagcttgaagcagtaaattcaagactggcccccagaattgaagtgtttcctcctaaagattttgatcagcanacatttgatacaactggcatgccgtttgcttcccaagctacaagagagtatagccgaggttcatcgccagaatggttacatatgcaggttggaggtggttatgaaagagcaacgtagtctttgaaatcccatcacctgataataaatgcatataggatcattaatctctccatcagagctcccataaatcatatacctcaggtgttgtgtgttagtcctatagacacctcattccctgttttctacaagaagcatggagctgtggttggtttcacaggatcactaggtagtactcaagccacttcatttggtagtgtgttgggaaatgatgcattttccaatgttgtagttaggttgctgtactcttgcattcatacccttaaaaggaaggtagtttcttgggaaacaatgctggtgggctgaatacttcaggcttccattgtgtan

SEQ ID NO: 1900 - DNA, 652 bp, Glycine max
  Predicted polypeptide sequence is orthologous to G2719
ggtaggttggaccatgcatacgtcagcgcgcattaaccctcactaagggaacaaaagctggagctccaccgcggtggcggccgctctagaactagtggatcccccgggctgcaggaattcggcacgaggatcgtcctccgcgtcagggacgccttgcgaatcaccgcttttacaatcgcactccccacagtctacttcactgcctcaaatcccttcatgccctcctcatcgatgcagaggaaaatgcgattgcgaaagtttctttcccgttagtttggtgggacgcgagaaagaggattatttgaaaggactgtggtaaccacaacaatggcggctacaaggtgtcatcggcgacgattccagtcgaatagagatcgaagactgatttttttcctttttcctttttttttaagttgctaggggaatctttggcattgcgaaattgcctgtaattactgattacctttgtttctgtcttgtgaattaatgagaacggggaagcagatatgaagaaatataaccttgcttggctcggcgctccctcctattgtcccgaccgccttcctcgcggggggccccgtacccaattcccctattgtttgccgtttcccccccctccctgcccgcggttttccatcctcccgctggtacc

SEQ ID NO: 1901 - DNA, 793 bp, Glycine max
  Predicted polypeptide sequence is orthologous to G2763
ggaaagagaaaaatagatgtatactatgcaattagaaaacaataaacagaaagaaagcttctttgggggcaagggtgaaagaaaacgagccaaataatgatgatgatgatgataaaaattaaaaaaattgacagacacatgacatggcatggcatacatacataaaggcctagagccaaaagtgtcttctatgacgagctaggtggcgcggaaggggaggcggcggcgccggaagaagaagaagaaccagagagaaggttaaagagagcgctcatggctcgaacctgcatctcaagcgcgggtatgtaatcaatggcttcttccaaaataaccggtaacggttctttacggcaaccgggaaccaagcgtgcgaggaacctcacttttctctgcacgcccggtgaacccttccccttcagccggtaaacgctgacccggggtttctttgaccgggttgggggcgttgtaagtctctgccgcttgtgtttggtgaacttgagcttgagccggttggtgaggatggctcggctccagcgcgtcatccccttggctgtcacggctaggactctgtcggcggcgtcgcgcacggctttgcctcggcgcggcggcggcgccaacccgagattcactctggctaaggcttggcgcagcttggaggagtagatttgttgctgcgcttgggatttccacttgggattgctctgatcctcttgccgttgttgctgctgcctcagctgcgctttcttcttcctccgtttcgcgtcacgtgaccggtccgtgttccgacagcaac

SEQ ID NO: 1902 - DNA, 897 bp, Glycine max
  misc_feature (1)..(2): n is a, c, g, or t
  misc_feature (26)..(26): n is a, c, g, or t
  misc_feature (691)..(691): n is a, c, g, or t
  misc_feature (766)..(766): n is a, c, g, or t
  misc_feature (783)..(783): n is a, c, g, or t
  misc_feature (823)..(823): n is a, c, g, or t
  misc_feature (864)..(864): n is a, c, g, or t
  Predicted polypeptide sequence is orthologous to G2763
nnccggcgagtagtgtctcgcatganttatcgcttgcgagcaacctaccctcactaaagggaacaaaagctggagctccaccgcggtggcggccgctctagaactagtggatcccccgggctgcaggaattcggcaccaggcgacgcgccacgccgcggcagggcggtgcgcgatgccgccgacagggtgctcgccgtggccgccaaggggaggacgcggtggagccgcgccatcttaacgaaccggctgaaggtcaagttcaggaagccggttcacaagaggcagaaggttgttgttgttgggccgggccggccaaagaaaaaggcccggttcagcgttctccggctcagggggaaaaccttacccgcggttcagaggaaagttagggttctgggccggttggttcccggttgcagaaaagaaccgcttccggtgattctcgaagaggccatcgattacatacccgcgctcgagatgcaggttcgcgccatgcaagctctcgctgacttactcttaggctcttcctccgcctccacctccgccaccgccgcgccgcctagttgatctcactttccggcgattatgccacgtttcatatattttttttccttacttttgttattatttgcctcgttttcaccctcactctactcggcttatgttaattgccaagtacatacaaaaaaaaanaaaaaaaaactcgaggggggcccgtaccccattcgccctatagtgagtcgattcgcgcgctcacttggcgcgttntacaacgcgtgactggnaaacccctgcgttaccaactaatcgccttgagcacatccncctttcgcaggctgcgtaattacgagagcccggacgatcgnctttccacaagtgcgcagctgaattgcaatgga

SEQ ID NO: 1903 - DNA, 920 bp, Glycine max
  misc_feature (1)..(1): n is a, c, g, or t
  Predicted polypeptide sequence is orthologous to G2990
naatgttcctacgtataatcaacggtcacgtagagggaataagctttttttttttttttttttcttttcaagaagaagaagaagacccattagttccactcccgttagtcccactatcattctcgtactcgttcacatcatgggaagcgagattgtggttgtggttgttgtcgccgctaccgttaccattaattccgctgtgttcatgtccatgttcggggacatgaacaccggttctaacggtggcactcccaacagctccatccagagaaatcccgttggcgctgacactcagagtgctaccgttaccgttgttaaggttgtcttttttcgcgagagtgttcttgttgttgtgcatccacactttgagaacccctctttcgacgccaatttccgtgcagaactccttaaccatttcaatcgtcgcgcttgtgcatctttcacccaactttgtcggcgaactcatgcatcttctccttttgttcttgggtgaacttcgttcggaagcgtttacgcgagtggttgtgcgccggtgccggctcgccggtgttttcccgcgcgacggagatgccaccgtcgtcggagagggcgaggagcatgtggtgggcggaggagtaggatgagatcgtcgcgcggatgcggagtctgactccttgctactggtccgtgtagacgtgatgcggtggtgtgctgcactctagctgcattctggtcttacgccataattctatatgagtctattatatcgtaatcatgtatagttgttcctgtggacatgtatctgtacattccccaacatacatccgatcctaagttatgcctggtgctcagagtactactccattcatggtgtctcctgccgtttcatctgataactgctgcagcttataatgattgctactaccggtaagtgttcggta

SEQ ID NO: 1904 - DNA, 401 bp, Glycine max
  Predicted polypeptide sequence is orthologous to G3032
cctcgtgccgaatcactaataatctagcacttgacaagttctccgatgaattgaatgagaagctctgggatgatggaagctctgaagatgatgctggtgaggaagtaattgacaacccctcagcatatgaaatattagaagtatggaaggaaatgagagaggaggatgggagtttgttgcactctgaacttgcttgtggctagtgattgtgagttgctttagtgtttaacatatgctagctgaactgtgaacagggataggaagatgtagcaattttatcgtaaattagcttgttctgatcaagtatagtgatatctggtacgatgttattggaacaagagaatgcaattaaaacttgtaaatgttagcaaactttcccttggtcaaaaaaaaaaaaaaaa

SEQ ID NO: 1905 - DNA, 990 bp, Glycine max
  misc_feature (5)..(5): n is a, c, g, or t
  misc_feature (37)..(37): n is a, c, g, or t
  misc_feature (42)..(42): n is a, c, g, or t
  misc_feature (51)..(52): n is a, c, g, or t
  misc_feature (54)..(57): n is a, c, g, or t
  misc_feature (59)..(59): n is a, c, g, or t
  misc_feature (71)..(72): n is a, c, g, or t
  misc_feature (193)..(193): n is a, c, g, or t
  Predicted polypeptide sequence is orthologous to G3061
ccaanataaaaaaataaaataataaaaaacaaaaaanaaaanaaaaaagtnngnnnncncgaatttcaaanngcatgattcgtggcagagcgtgctagagaacacctcactcaaagggaacaaacagctggtagctccacctgcggctggctggttcggctctcagatacttgctgcgatcccccgcagggcntcgcaggcaagtgtcgggcacgtagtgtctatggtctcatcttgctcatgacttatatgggtgcactgcgcttcaatcagcgtatgacatcatgttctcttcacacaacctcggcctccacgctatcacaaatgttcgtctttctgagatgttgatcgctgatgcaggtcaagcgaagttgcgttccaagtctggaaattaaagcacattcctaaccttttgttctgatgaaatggacggagctccagctggataaaattgttgggtgcaacaccctgatgaattaaggaaaaggatcaattgttttattcaccagaaacattcacccaagtcagtgtgatgatgcttgaacgaacacattaacagttgccggagctgtaaatatgacccattatgtttattatcttaataaaataaagtactaaataaaattgattccttgtatgtcacaaattccaagtggttgatcttttgttatttgtataagtttcggtgtgtacatggaatagcgtcggtacgaaagggcaagttgctgtacaataaaagggtatttattgtgaaaaacacaaagaaacacacaaaaaacgacactccgggttttgttgtgtgttttttgttgttgtggagcagcgaataaatgtccacacaaagcttgaatcacgcggctaccacatacgacatgtggggagacaacgtgccccttgtatctgtccactgatgatcgcgtgtcactcggacgagtacacgaccactcagggtaacggccaaacagacacgccacaacacgccggttcgtt

SEQ ID NO: 1906 - DNA, 638 bp, Medicago truncatula
  Predicted polypeptide sequence is orthologous to G3
ggcacgaggttgagacacaatatatatggtacagcaaagcgaatcaactaggaggatcatggaagaagaaagagattgttgttcaacaataataagaaacatagaaagcaacaacaaacctcaagagaaacacaacaaacaacaactagagaaaccatacagaggaataaggaagagaaagtggggtaagtgggtagcagaaataagagaaccaaataaaagatcaagaatatggttaggttcttacatcactccggtagctgctgctcgtgcctacgacaccgccgtattctatttaagaggtcctacggctcgtcttaatttccccgaattattgctcgaagacgacgaagaaaacaaggacggttctattcagcaaggtaacatgtctgctgatttaatacgcaaaaaagctaccaaagtcggtgctagagttgatgctcttcaagcggctcttcaagcttcttctcgttctgattccgatcaattcaacgctgatgtgaaacctgatttgaacaagtttccagaacctgaagattattaatgctttttcacttagaggtttaatattattgatatgatacttagtttctctctgtaatctttaatatccatcatctattaatcaacccaatatt

SEQ ID NO: 1907 - DNA, 812 bp, Medicago truncatula
  Predicted polypeptide sequence is orthologous to G8
ttatgttcttacataatgtcttgaatttattacacttaaattatcaaagctcattaggattctaaccaatacgtttctctctttccggaaatcagggcttatgacaaagcagctctaaaatgcaatggaagagaggctgtgactaacttcgagccaagtacatatgaaaatgagatgaaaccgggagctattaatgaaggtggcagtcacaatcttgaccttaatttgggcatggcgactccaggacatgaacccaaagaaaacaaaggatattgtcaatttcagaccgtcccttcttacaacatgcatcctggaaggaatttaaagatggagactaatgttaattcagttattggtgacccgtctttgaaaaagctggttgtaactgaacagcgtcctcccatgtggaatgccacgttttctagtttctttcccaatcagcaggaaagggcagagagaattggcattgatccttcaaaaggacaccccaactgggggtggcaagggcataatcaaggcactgtttccccagtaccacaattctcttctgcagcatcatcaggattctccatttcagctacctttccaccaaatgcaatctttcaaacacaaccaatcaactcaattccccagtcactctgtttcactcctggtagcaatgcatcatctcaatactattaccaggttaagtcctcacaggcaccaccatagcctatattctgtatttgtaataataatacaagatatatgaatggcatgacgcaacaagcttttgcgttaaaactcaattgtataattcagttaggatttga

SEQ ID NO: 1908 - DNA, 740 bp, Medicago truncatula
  Predicted polypeptide sequence is orthologous to G12
acaacatgattataagagtctctctctctctctcccaaaaaacccaataacataacagtttcttttactctagattttcatgaagattcactctctctctctataacaaactcaaacaaagaacaagagagagagaaacatggacggtggaagaggaaaaggagagagaaagagaaacggtggtggtgttggtgttgatggagagagaagatacaaaggaattcgtatgagaaagtggggaaaatgggtagctgaaattcgagaaccaaacaaacgttctcgaatttggttaggttcctattctacccctatcgccgccgcaagagcttacgacaccgccgttttctacctccggggaccatcagctcgtctcaatttcccagagctactcaacggtgaaaacaacgcggttgttggtggtggtgatatgtcggcggctactattcgaaagaaagctactgaagttggtgctagagttgatgctcttcaagcagatgttaatcatcatagtcatagccatagtcataatcataatcatcatcaccttcagcataaccggaaccagcatcatcgtgttatgccggttccggagttgcttgaaggtgatggttctggtgattttgctgagagagttgatttgaataagattcctgaaccagagagttctgatgagtgggatgttaattgatattggaaggaaaaaagtttgaagaatcgattaaaaaaagtgattcttcttc

SEQ ID NO: 1909 - DNA, 653 bp, Medicago truncatula
  Predicted polypeptide sequence is orthologous to G12
gtgttttccgggtgtgaaaggaatctctcttattgttccatccggttggcaactgttttataagttttcattttcataatcataatcatagcatatatgagtatatatatctctcaaagataagataggaactagctatattatatagtttaattagttacatgataggtattaggtaggtagggtatggaagaagaagatagggaatattgttgttcgatgaattcaagaacaaccaatagccctatagctatagatcataaaaataacaataacaataaggggatgaaaaaagagaaaaaagctatgaaaccatatagaggaataaggatgagaaagtggggtaagtgggtggcagagattagagaaccaaacaaaagatcaagaatttggttaggttcttacataacacctattgctgctgcacgtgcttatgatactgctgtgttttatcttagaggtccttctgcaaaccttaattttcctgaattgttgttcaaagatcaacaagaagatgaagaaaatctacaacaacatgggaatatgtcggctgattcaataaggaaaaaagctgcacaagtttggtgctaagagtttgatgctatttgaaactaattctctaattaatcatcatcatcatcaatcatgtttcc

SEQ ID NO: 1910 - DNA, 706 bp, Medicago truncatula
  Predicted polypeptide sequence is orthologous to G214, G680
ggccttcttgattcttggaaggaggtgtctgaagagggacgacttgcctttcgggctctattctccagagaggtgttgccccaaagcttttcacctcctcatgatttgataaataaggataatcagatggacaacatgaaggataacgagcaaaaaacagaccacaaagatcaccttgagagcaagaaatgcatttgtaattgtgaccaggcacagcaaaacctaccatttgtacaaaataacaatgaggagggatttctaaccatgggtcttggacaaggtaaacttaagactcgtcgaacagggttcaaaccttacaaaagatgtttagtagaggccaaggaaaacaggggcggaacggcttgcaaccaagttgaagagacgggtcccaagaggatacgcctggaaggggggacttctatttgatgcttgatatatgcatgcaatcacgcaaagaaaatctttgagttttgtgcatcatttctaactacctcttggtgtctgtattgttaattttctaattcggcagctcatgaaacttgtcgtgtaggtgtgtgtaccatattaaattactacctacgttcttttactttcttggaccgatgctactgcagttaaaaattccgataaaatagccttagagaagaaacatgaagtactgtttgagcattgaaaatttaagtaatttatgatcatccatcattct

SEQ ID NO: 1911 - DNA, 829 bp, Medicago truncatula
  Predicted polypeptide sequence is orthologous to G261
gctactattatcttttctttctgattgcacttcctgtgcttccgatgcaccaggatcctcagtcaagaactgctcccagaatacatcattaaccccagttgctgcagtggtgattctcgcaggttgttcttttagtgcaacagcctcaagagcagcagaagctggttcaacgttcatgtcaatttcaggtgacttaggtcgaacttcaccgtctagttgctgagaagatatggacaaactatcagcacagcatgtagattcatctaaatccatgtttgaatgagtgtgaacgaaattgccgccaacttcatgtgcaagagtctcccaaaatgccacggatgcctcaagttgatccaatctctcggtgtttaacgtcaaagtagagttatcctctgcattttccctgggcaaagctacagaagtctccatagcatcttcaacactagcttcattattaaagcaaccacttctcgccggcaaccttcgttttctctccatggcttctgccagtggcaagagatttacagcaatcataggtttctgcagtgcttcagaaacagaggacaacatcttttgttgcttatgttccaatttttccaactgatctttcgaacaatgcatttgaatctcatacgtttcccaatcatgctggtatctgttcgtctccatgaggagttgttctctatcctgtttcagcttctctatttcatcaaccatactctgcctttcagactccgttagaggggcttgtgcttgaagattatgcagagaatgactatgaaccggcttccgtctatgaatattcttcataagatgtggttgccccctt

SEQ ID NO: 1912 - DNA, 682 bp, Medicago truncatula
  misc_feature (586)..(586): n is a, c, g, or t
  Predicted polypeptide sequence is orthologous to G280
cacaatctcatttctcttaaaattttctatctctcttagaatatttttctctcaatttttttagctcttttttcctcactattttcaagcttcaatggctactcaagaggttaataagcctctttcacttcctccataccctgagatgattatgaaggcactggaagcactgaatgaaccaaatggttcaaacaaatcatcaatttcaaactacatagaatcaatctatggagaattaccagaaggccattcaattgttcttgcaaatcaccttaaccagatgaaggataatggtgaccttgtttttgcaaagaacaactacatgaagcctgatccaaatgcaccaccaaagagaggacgtggaagaccaccaaagccaaaggatccattggctccaccaccagctgctgttctgtccccaccaaggccaagaggtcgtcctcctaaggaccctaatgcacctccaaagacccctaagcctgcttcaagtggaagaggaaggggtaggccaaagaaggttcaaaggactgagaatgtttcaaatccaagtggtggagatggtgatggtgctggtgctggtgctgangttgatgatgatgatgctgctccaagtgttgctgctgttgctgttccaactactagtggaaggggaaggggtaggcctcctaagttaagcctcaaa

SEQ ID NO: 1913 - DNA, 837 bp, Medicago truncatula
  Predicted polypeptide sequence is orthologous to G481
atacaaacataatattcagggttccgacgatatgtccgaaactccggcgagtcctggcggcggcagccacgaaagcggcgaacacagtcctcgttccaacatccgtgaacaagaccgtttccttcctatcgccaacatcagccgcatcatgaaaaaagctcttcctgctaatggtaaaatcgctaaagatgctaaggaaaccgttcaggaatgcgtctccgagttcatcagcttcatcaccagcgaggcctctgataagtgtcagagagagaagaggaagacgattaacggtgatgatttgctttgggcgatggctactttagggtttgaggattatattgatcctcttaagatttaccttacaagatacagagagatggagggtgatactaagggctctgccaagggtggagacacatctggcaagaaagacgttcaacaaggttctaatcctcagcttgttcatcaaggttctttctcacaaggtgtttcctacacaaattctcagggtcaacatatgatggttcctatgcaaggtccagagtaggtaataagccaattgatcttctcacagtggttgcggtgttttcagttcggtgctggtagagctttactaaatgccgtcggcataattgaatgtatttcatgtaatgttaatactggcataagacacattggttcttgtgtcctgattttttttctctctaaaattatggtttgtatataatgtgtggagtaaaattatttatttcaaagttacatttggtagtgctggacccatggtagtcttgattccttctggcggctttggcaaggcttttagaattaggtagctga

SEQ ID NO: 1914 - DNA, 577 bp, Medicago truncatula
  Predicted polypeptide sequence is orthologous to G481
gggttttagttttagggtttatgcgccatggcagatgcaccgaaccaatgcgaagaaagccacgagagtggtggtgaacagagtccacgtggctcttcttctgcttcacgtgaacaagatcgttttttgcctatagctaacattagcagaatcatgaaaaaagctttaccttcaaatgggaaaattgctaaggatgctaaagatacgatgcaagaatgtgtttctgaattcatcagctttattaccagcgaggcaagtgagaaatgccagaaagagaagagaaagaccattaatggagatgatttgttatgggctatggctactttaggatttgaagattatatagaaccacttaaggtgtacctagcaaggtacagagagttagagggtgacagtaaaggatctgttagaaacagtgatggatctggtagacgagatcaagttggcggtcctccaggtcaaaatgctcagtttgttcatcagggttctttgagctatattgattcccaggtgcatccacaacatctggttatgccttcaatgcaaaatcatgaatagattagatgcttctcctcac

SEQ ID NO: 1915 - DNA, 718 bp, Medicago truncatula
  misc_feature (652)..(654): n is a, c, g, or t
  misc_feature (674)..(676): n is a, c, g, or t
  misc_feature (680)..(687): n is a, c, g, or t
  misc_feature (705)..(707): n is a, c, g, or t
  misc_feature (709)..(714): n is a, c, g, or t
  Predicted polypeptide sequence is orthologous to G481
cccgggcctgcagggaaactcctaccattcccgttcccaattccccttcgccggcgccaccaccatcaccaccgccgacaccactctcctccctcacacaccaccacaaatccttcagtacaacgttcttcaatttcacgcagaaacttagtcaactaaattgtatcctctctgaacacgcaactgccgagactaatcctttgttctggtagacactactcaagagtaaaatcacatcaacacttcaattccaggattctggtgagttttttccgaatacagttattaaattttgcaggaacccgagtcaacgcaatccgagttgaatccgtgactcgccggcggtgaactttgattcgagttttacgtcagaaagttcacgatggcggactctgacaacgactccggcggaccacacggcggaggatcaaacgctcacggaagcgagatgtcaccacgagaacaagaccgatttcttccaatagcaaacgtaagcaggatcatgaaaaaagcactaccagcgaacgcgaagatctcaaaagacgcaaaggaaacagttcaagagtgtgtttcagagttcatcagcttcatcaccggcgaagcctccgataagtgtcaacgtgagaagcggaagacgatcaacggcgatgannngctttgggcgatgacgacgnnnggannnnnnnngtatgttgagcccgtgannngnnnnnncacg

SEQ ID NO: 1916 - DNA, 495 bp, Medicago truncatula
  Predicted polypeptide sequence is orthologous to G504
cgactggttcgcaacaaccgaatctcccgcctggattccgatttcaccctacagatgaagagcttgttgttcattacctcaagaaaaaagcagcttcagctcctttaccagtagccatcatagctgaagttgatctctacaaatttgatccatgggagctaccagctaaggcaacgtttggagagcaagagtggtatttctttagtccaagggacaggaagtatccgaatggagctaggccaaacagggctgcaacttctggttattggaaggcaactggtaccgataagcctgttttaacttctggtgggacacaaaaagttggtgtgaagaaagctttggttttctatggtgggaaaccaccaagaggtatcaaaaccaattggatcatgcatgagtataggcttgctgataataagcctaataataggcctcctggttgtgactggggtaacaagaaaaactctctcaggcttgatgattgggttttgtgcc

SEQ ID NO: 1917 - DNA, 705 bp, Medicago truncatula
  misc_feature (568)..(568): n is a, c, g, or t
  misc_feature (668)..(668): n is a, c, g, or t
  misc_feature (691)..(691): n is a, c, g, or t
  misc_feature (703)..(703): n is a, c, g, or t
  Predicted polypeptide sequence is orthologous to G668
ccaagacagggttgtcaagatgcagcaaaagttgcagacttagatggactaattacctaaggccaggaatcaaacggggtaaccttcactgaacaagaggagaagatgattatccatcttcaagatcttttaggaaatagatgggctgcaatagcatcataccttccacaaagaacagataatgacataaaaaactattggaatactcatttgaaaaagaagctaaagaaatcacaaacaggtaataatgctgaatgcattaattttgaagaagaaaaattttcagcatctcaaagaattccaagaggtcaatgggaaagaagacttcaaacagatattcaaatggccaaaaaagcacttaatgaagcactttcaccacaaaaattatctcctaacttttctacttcaaaccctacaaatagtaacctcattttcttccactaaagaaccaggtcaatcgttttgctatgcttcaagtgcagataacatagcgcgtttattaaagggttggatgaaaaatccgattaaatcatcggtaagtactaattcagttggtgacacaaaattnccttcaacaaactttgattctgcttctagtagtggaacaaaggggtgaaatattggtctgaacatttgaatctttgtttggttttgaccctttaaagtcnttggagtcatcgaattctgaatnttctcatcaggnct

SEQ ID NO: 1918 - DNA, 822 bp, Medicago truncatula
  Predicted polypeptide sequence is orthologous to G668
attttggtatttccattcaagaactggacctggaaattggagatcagttcccaccactacaggtttgatgagatgcagtaaaagttgcagacttagatggactaattatcttagacctggtatcaaaagaggtaatttcaatgaccatgaagaaaaaatgataatccaccttcaagcgcttttaggaaatagatgggctgccatagcttcctatcttccagaaagaacagacaatgacatcaaaaactattggaatacacatttgaggaaaaagcttaagaagattaatcaaacaggtgatgaaaatgaagtagaagaaaactctattcctcaagtaaaaggtcaatgggagagaagacttcaaacagatatccatatggcaaaacaagctttgtgtgaggcactttctcttgacaagccaacacctattttagctgaaaatcaaacatccccttatgcatcaaacaccgaaaacatagctagattactcgaaaagtggatgaaaaaacccgaaaattcagtcgagacaacaaattcaggaaactccattatggtagtaacaggatccggttctagggaaggaggacagaatactatagcatgcaaacaaaaagatcaagcatttgattctttggtgagttttaattcattaaattctgattgttctcaatctgtgtcggtcgaagaaaaaatttcttggcaatggattcatgcttttttcaatatcaaagtaagccaaaccaggaaactcaagaccctctcatgtttatggagaaattggccttttgatgatgaggctgctcagtggcatgaagatctaat

SEQ ID NO: 1919 - DNA, 802 bp, Medicago truncatula
  Predicted polypeptide sequence is orthologous to G913, G1753, G2514
attcattctatcgtgtatgcttagttcctacctacaacaacaacataaacatttcacttctttcgtcatggatggcaccaacaacaacacttcatcggtgccaccaccaatacaacctcctgatgcatcatcagcaccaacaactccttcatcttctccggcgactaccggagtcgcaggaagataccgtggaacccgttgtaggagtggtaaatgggtatcagagatacgtgagccacgtaaaacaaaacgcatttggttaggaacataccctactgctgaaatggcagctgctgcttatgatgttgcagctcttgctttaaaaggacctgatactactcttaactttcccaattcaatactatcttaccctattcctgcttcattgtcttcaactgatattcgtgctgctgctgaagctgctgcacaaaccagaatcatgagaccagcacaacaagatcaacaacaacaaaacccttcagcttttagttttgaggggtcttcttcaagtagtggaatattgcaacaacaacaaggtcatcatcatgaatatattgatgaagatgagttgttgaatatgccaagtttgttagatgatatggctagaggaatgcaggttagtccaccaaggatgagttcattctctaattgttcttcagatgattcacctcgcaattctgatggacgagataatctttggagttacaatttttgaagacagaatcattcattttctctctttgaatttgtttgattttggttatttacaagtgtttgtacgggtagatcttgattcaccctc

SEQ ID NO: 1920 - DNA, 596 bp, Medicago truncatula
  Predicted polypeptide sequence is orthologous to G977
aagcacgtaccaatttcccatacaacccaaatggaccacaatcttcttcatctaagcttctttcagcaactttaactgcaaagttaagtaagtgtcacatggcttctctttctcttcaaatgaccaaacaacaacaaccaccacaaaaagagccacaacaagtttcatcacaaagtttcaattcttccattaatagtaacacttttgtctatgggaatgacattggtggaacaagtggtgaaactagtttaattagatggcttgatgaaggtaataattgtgttgggtttgaaggtcaagttgaagtttctcatcaacaatttcaacctgttcttgaagatgatcacattgaacaaatgattcaagagttgcttgattatggttcaattgagctttgttctgttggttcatcttagactacctctaatataatataatatagcatttaagcctttcttggcacgaagagtcactgagacccaactcgcctaaaacaaagttcatatcaaaagaaaatgtatcatttatccatgacacctttttgagagagagtggtagtaaggggtactaattcacctgtaataaatgtataagat

SEQ ID NO: 1921 - DNA, 752 bp, Medicago truncatula
  Predicted polypeptide sequence is orthologous to G1020
cttctcactttcattttcattttctcacaatggctccaagagataacagaatcaccaacaccaccaccgggcctgggccaaacccatcagcccaggctcaagcccagaaagagattcgttacagaggtgtaagaaaacgtccatggggtcgttacgccgctgagatccgtgacccaggtaaaaaaacacgtgtctggcttggaacattcgacaccgctgaagaagcagcgcgtgcttacgacaaagcggcacgtgagtttcgcggctcaaaagcgaagacaaattttccaacgccgttggagattatcaacaacggtagccctagtcaaagcagcactcttgaatcaccgtcgccacctccgcttgatttaactctcacaccattctcctcctcccacggtggtgttaccttggcctatccggtggcgcgtcctgttttgttttttgacgcattcgcacgtgctgaaacagccctaaccgttggccgtcgtgagatgtgtggatttgaacgtcccatggctgattttcgacgcgccgccgtgcagagtgactctggttcttcttcctccgttgttgattatgaaggtgtgccacgtcagagactcttggatcttgatcttaatgttcctccaccacctgaagttgcttgatctggatctattttgaagacccataagcaaaaaaaaattaatttttttttttctttttcgttttttgaagtacccattttgatgaacggaatcactctcgtg

SEQ ID NO: 1922 - DNA, 801 bp, Medicago truncatula
  Predicted polypeptide sequence is orthologous to G1020
acttcaagttacgctattctctcatcctcaccaacatcatcatcaatggttaccaaaacaaagaacgccgcgaatctcaaaatcaagaaaccttccaacaacaacaacaatgcaaccgagattcactttcgcggcgtaagaaagcgaccatgggggccgttacgccgccgagattcgcgatcccggtaagaaaagccgcgtctggctaggtacctttgacaccgccgaagaagctgccagagcttacgacaacgccgctcgtcagttccgtggcccaaaagccaaaaccaacttccctcctcctccttccgatgtcaaagaagatagccctagccaaagcagcaccgttgaatcatctgtccctgctcctgaccgtgaggtcacgcgccgagaagttcccaccggcggtagcgtcatggatcggttcccttttctctcgattcagcaacagatcatgccgtttgctggtgctggtgccggtgctgttgatggaatggtgccagttttcttttacgatccagcgggtcgagctgagtttttgaaccagcggtttactaacaggtttgaaccggaaccggttcagtttaacatcgggtttggaggtggggtccagagtgattcggattcgtcctctgttgttgattgtcagccgaagagagctctcaatcttgatcttaacttagctccaccaatggaatattaatttatttgattaacaccttttaattttgtttaaaaaaatattatctcaccttatttagatgaaaattagaaaaacagagaaaggacaaagtttactgg

SEQ ID NO: 1923 - DNA, 815 bp, Medicago truncatula
  Predicted polypeptide sequence is orthologous to G1020
ttctatgttaatttcaattatactttggctaaacaatacaattaagctaaaaaaacaaaaaactggagaacagtttcatagtagtaataatttgggaacaacagattgaaacctcttagtttctctgtcgcaaaaaatagacacagtcgcctatgtagtattcacatatctttcattcatcttcttcttcttcttcttcatcagaaactgttctttttctttctccactcataaaaactaaagagaaattcataatccgcaaaaataaaaacaaaaattaaaatccaagtttaagattctaattcatcgttcatagcatatcttccaaaggagggtagttaagatcaaaatcgaagcttctaccatggtggttcagatcaatcaccgaggaagaatctgaatcactctgtgcaccaaccgtcgcgtggaatccactcgcctccatagaaggattatattcaaatccataaccgtaacaagaacgtgaattcaccatgccggcacgtaacacaggatcaaaacaaaacgtctggttaaccgccggcatcggagtgaaccggtgctggaaagcaggagctaagttgagatcaagcggtgaagaatcagcggcggcgtcacggtcacggcttgaggattcaacggtgctgctttggctagggctatggatcttaatattttctatagggaaagggaagtttgttttcgcctttggacctcggaattgacgtgcggcggagtcgtaagctcttgctgcttcctccgccgtgtcgaaagttcgagccaacgcggctcttctttcctggatctcttatctc

SEQ ID NO: 1924 - DNA, 259 bp, Medicago truncatula
  Predicted polypeptide sequence is orthologous to G1063
gcacgagggacatcgattgttataaaatatttttgggccctcctcttatacctatgaaatgcatcgatggtgaatgtaaaaggattacatagttaaggttatcggtcggaaatccaagctttgataggggatattgggtgggatgtgtctattgtactattattattgaaatttgaattgttttgtggtctgtaaattattggctcataagctatattataaaatatgaactttaaataaaaaaaaaaaaaaaaaaaaa

SEQ ID NO: 1925 - DNA, 759 bp, Medicago truncatula
  Predicted polypeptide sequence is orthologous to G1075
attctgaagaacaggaatcaaatcgtgccagtgttggtggtggtgcaccgttctcatcgaacgaagaagatgatcgcagccaaggtttagagcttggttcagcagccggaccaggagatgtggtaggccgccgtccacgcggcagaccgccgggatcgaaaaacaaggccaaaccaccggtgatcatcactcgagagagtgccaacactctcagagctcatattcttgaagttgccggcggttcagatgtttttgaatgcgtatctacctatgctcgccgccgtcaacgtgggatctgtgttctcagcggcagtggcactgtgacaaatgtcagtatccggcaaccagcggcggctggtggtgttgttacgctacatggaagatttgagatattatccttgtctggatcttttctgccaccaccagctcctcccggagcaactagcttaacgatttatcttgctggaggacaaggacaggtggtgggaggtagcgtggttggtgagcttatcgcggccgggccggtgattgtgattgcagcttcttttactaatgttgcttatgagaaattgccgttggaagaggagcagcttcagatgcaggctgaggctggaggaggttctcaaggctccggtggtggcggtgggcggcataatataacaatccattttctgatccatcttctggtttaccggttttcaatttgccattgaatatgcagaatggtcatcagctaccctgtgatggtttgggcgggaa

SEQ ID NO: 1926 - DNA, 796 bp, Medicago truncatula
  Predicted polypeptide sequence is orthologous to G1075
aatctaattaacaactccaacaacaaaagccaaatgttttacaaattgttcctagaaattaattaacttagtccttacaacataacctaaccatggaaattaaattaagaaaacgagacttgaatagaaaatcagtacttcttcacaaatgatttcaaaggaaaataaaaccatggaattcaactcacctttgtgctccaattaagctcaataagattgtcttccaccagagtttccagcccaaccatccactggtaattgaggcatatttagaggcaaattaaagaacgggagcccggatgatggatcgggaaaagagttattgacaccatcaccgccaccgccaccaccacctgcagatgattgcccttgttgcatctgaagagattcatcttcatccaacggtaacctctcatacgctacattcgtaaaagatgaagcgatgacaataaccggtccagaagcaaccaaaggaccaacaacatttcctcccacaacttgaccttggcctccaccaaggaacacactcaaacttgtagctcctggaggagctggtggtggtagaaacgatccggacaaagaaagtatttcaaaccttccatgtaaagtcactacagatcctgcggcagctggctgtcgcaaggtcacgttagtgactgttccactcccactaaggacacagatccctctttgacgctttcttgcattagtagccacagagtcaaacacatcacaaccactacttactttcaggatgtgagccctaagtgtgtttgcactctctcttgtgatgatc

SEQ ID NO: 1927 - DNA, 643 bp, Medicago truncatula
  misc_feature (556)..(556): n is a, c, g, or t
  Predicted polypeptide sequence is orthologous to G1137
cagaaacagtttttggtcgttgatcaaacgggtgatcaaacaactgttatttatagttcaagatttgggagccctgttgagtgtcttggttcctgggattcgaaattgaatggttgtagcaatttaaatgggaatgatgaaccctccttaaggagagatgtgaatcatgtgattgaagttggaccaacttttgattataaagttgatgaaaatgataatcaaggaactgagattgaaagtgagatgcacgaagatacagaggaaatcaatgcattgctttactcagacagtgatggttattctactgaggatgatgaagttaccagcacagggcattcacccagtacaatgaccactcatgtcaaccaacaacctttcagaattggaggaaccgcagaagaagttgctagctcctcccctggtaaaacaaagaaacgtaagctattcaatatggcttatagtgatgttgatgtgcagtttatggacactgcaagctctctaaaacgaaacagaccctttgatctcaaccgcggtgttgatgatgatgacgacgcanaatcaaggtgctcgggtagcaattacggcagagggtcacctgaaattggttccttaacaggccataagaagatgagaaaggaaaaga

SEQ ID NO: 1928 - DNA, 551 bp, Medicago truncatula
  Predicted polypeptide sequence is orthologous to G1145
gatacacaaactcaaggtaggaaaagggttgcctctggtgttgtggttgagaaaactgtggagaggaggcagaagaggatgattaaaaatagggaatctgcagctcggtcgcgggctagaaaacaggcttacacgcaagagctggagatcaaagtttcacatttagaagaagagaatgaaaggcttaaaagattacatgagatagagagagtattgccgagtatgccaccaccagaccctaagcatcagcttcggagaactagctcagctcccctttgaagactttattgcaaatgagttcctagcaaaagttccaagcgctccaacagttctttcgcatttgctgcatatatttgaacgctcaagtatccaacaattggaaagctatttttcttctggggctatggttaattatcgctggcataccttcttcgaaagtgttttcctgtatgtacattttataagctagactttcagtttacccagccactatatatatgcattagtgtaattttgaacggaacaaaaaaaaaaaaaaaaaactcgagggg

SEQ ID NO: 1929 - DNA, 892 bp, Medicago truncatula
  Predicted polypeptide sequence is orthologous to G1146
cctaaagacaaagagcttgacctgctcattgttatattgcctgataataatggctctctctatggtgaccttaaaaggatatgtgagactgacttgggggttgtttcccagtgctgtttaactaaacatgtctttaagatgagcaagcagtaccttgcaaatgttgctttgaaaatcaatgtgaaggttgggggtaggaatacagtgcttgttgatgcactttctcgacgcattccacttgttagtgacaggcctacaatcatttttggtgctgatgttactcatccacaccctggagaggattcaagcccatcaatagcagctgttgttgcttctcaagattggcccgaaattaccaagtatgctggtttggtttgtgcccaagcacatcgccaagagctcattcaagatcttttcaaacaatggcaagatccagtcagggggacattgaccggtggaatgatcaaggagcttcttatatctttccgtagagctactggacaaaagccccagcgcatcatcttttacagagatggagtgagcgagggacaattttaccaggtgctgttgtttgagcttgatgcgatccggaaggcttgtgcatcccttgaacccaactatcagcctcctgtgacttttgttgtggttcaaaaacgtcatcatactaggctctttgctagtaaccaccaagacaagagctctgttgatcggagtggcaatatattgcctggtactgttgtggattctaagatctgccatcccacagaatttgacttttatctttgcagccatgctggaattcagggcacaagccgtcccgctcactatcatgtgctgtgggatgagaataattttagtgctgatggtcttcaaagtttaactaataacctgt

SEQ ID NO: 1930 - DNA, 794 bp, Medicago truncatula
  Predicted polypeptide sequence is orthologous to G1146
gactgtgttaactactttcctagctagatataagcataaggttataggcaaaaactaaacgtgaaaaactggttattttctgaaacttcttgtcactatagtcacctttgattggtgaatatatataatctatatatctatctattcctgcaagaactcagaaaaaattcaacatgcctttgaggcaaatgaaagagagttcagaacaacaccttgtgatcaaacctcatcagcaaaactctatgagtcaagctaagaaagttactaaagctgttcagaatggtaaaggtccaccattagtgtcacaagaacaacagaaccaaacttcaccacctcaagtaaagagtggtggaagaagaaggagtagaaatggtagaaaatctgatcaagttgatgttttgatgagaccaagttgtaggccttgtactgttgtgaagagcaatgaaaatggccatgttgttgaaaatggaaacacagtctctagtgatgtagaaatgagttttcctacttcaagtaaatctttgagttttgctcaaagaccaggttatggacaagctggtacaaaatgcattgttaaagccaaccacttctttgcagaattaccagacaaggacttgaaccaatatgatgtaactattacaccggaagtgtcttcgaaagccgtaaacaggtctatcatagcagaacttgtgaggctgtataaagaatctgaccttgggatgaggcttccagcatatgatggcaggaaaagtcttttacacagcaggagttcttcccttttcttggagagagtt

SEQ ID NO: 1931 - DNA, 701 bp, Medicago truncatula
  Predicted polypeptide sequence is orthologous to G1198
atgaatcaagggtctgcttttaattttggagagctagaagaggcaattgttcttcaaggaatcaagataagaaatgatgaaggaaaagcatctgctttatttacaagcaaaccagcagctacacttgaaatgtttccttcatggccaattagattccaacaaacaccaagagttgtagcttctctcacttctccatctctgaccattccttatggaggttcaaaatcaggaggagaaagtactgattcaggatcaacagagctacaatttgaaacaaattctccaataagtgtaaaagcatcttcttcagatcatcataatcatgcttttcaacaggagacagcaactgatgatggattaagaacaggcacatcaacacagaatcaatcaaaagccaaatcacctcaacaaaagaaaaaaggagctgtttccacatcagaaaagacacttgatccaaagacactgagacgtttggcacaaaacagagaagctgcaaagaaaagccgtctgaggaaaaaggcttatgtacagcagctggagtcaagtagattaaggctatccagtctcgaacaagaccttcaaagagcacgctcccagggactattcttgggttgtggtggtggcaatataaagccctggagctgcaatgtttgacatggagtatgcaagatggctagaagaagatcaacgacacatggcgg

SEQ ID NO: 1932 - DNA, 611 bp, Medicago truncatula
  Predicted polypeptide sequence is orthologous to G1198
ggcacgaggatggcttggtggttttcggtcgtctgaacttctcaagcttctggtaaatcaactggaacctctcactgagcagcagttgatgggtattaccaacttgcaacaatcctcccaacaagcagaagatgcattgtctcagggtatggaagcattacaacagtcccttgcagagacgttgtccactggtgcaccttcctcgtctggttcctcagggaatgtggcaaattacatgggtcaaatggctatggccatgggtaaacttggaacactcgagggcttcattcgacaggctgacaatctgcgccagcagacactacaacaaatgcaccggatattgacaacacgacaatcggctcgtgcactccttgccatccatgattacttttcgcggctgcgcgctctcagctctctctggttggctcgtccaagagattaatgattgtagtgaatagtctgtcaaattaattaattatctcatatcaaccaccatcaatactttggtcatgataagttttgctcttagcaagtgttcttggtgttgtacttgtagtctttgtaaggctgatactagtgtttcctagagttcacatagtctaggaatggga

SEQ ID NO: 1933 - DNA, 655 bp, Medicago truncatula
  Predicted polypeptide sequence is orthologous to G1198
tcagataagccacttgatgcaaagacattgagaacgtttagcacaaaacagggaggctgcaaggaaaagtcgtctaaggaaaaaggcttatgtgcaacaacttgagtcaagtagattaaagcttacacaattggaacaagaccttcaaagagcacgctctcagggtatgttcatggattggagtggtggtgttggaggcaatataagctctggaggtgcaatgtttgacatggaatatggaagatggttagaagaagacaaccgtttattaacggagttaagaaacggattgcaagcggcgttaacagataatgaaatgagagtaatggtggatggatatttgtgtcattatgatcaaatatttagactcaaaggtgtcactgctaaatcagacgtgtttcatcttatcaatggcatgtggacttctcaagctgaacgttgcttcctttggattggtggttttagaccttctgaaattatcatgatgttgatccaacaattggagccactagctgagcagcagataatggggatgtatggactgaggcattcttctcagcaagcagaggaagctctctcacaaggacttgaccagttgcaacagtctcttgttgacaccattgctgggagaccccttgttgatggtgttcaacaa

SEQ ID NO: 1934 - DNA, 660 bp, Medicago truncatula
  Predicted polypeptide sequence is orthologous to G1198
gacaggacattcaactcatcatgtcccttatggaattcatcataggattaataataataatccttcatcaagcttaatgaatgaagaatctggttttgattttggggagctagaagaagcaattgttttgcaaggagttaagaatggaaatgatgaaacaaaagcatcttttttcacagccagacctgctgctacactggaaatgttcccttcttggccaatgagattccatcaaacctcaacagtaggaggtggtaacaaatcaggaggtgaaagcagtgattcagcactatcaagcaaaaatgagaacccttttgagccagaatcacccttaagtagtaaaaaagcatcttctttttcatcagatcataataataatatggatcagcagaatcttcagctacaacaacagaagatgataatatccaatgatgcttctgctgctataagaacagcctcttcatcacagaatcaaatatcagcagcagccaaagaaaagaaaaaaggagctggttcaacatcagataagccacttgatgcaaagacattgagacgtttagcacaaaacagggaggctgcaaggaaaagtcgtctaaggaaaaaggcttatgtgcaacaacttgagtcaagtagattaaagcttacacaattggaacaaga

SEQ ID NO: 1935 - DNA, 800 bp, Medicago truncatula
  Predicted polypeptide sequence is orthologous to G1198
tctgttgtttcttctttctgggcctagttgtggatttaaggtttgtggaagaaagataagataagaaaatggttattgatgggcagtagaggtagaactgctgaggacactaataaggttgttaacgggatgccaagctacgcacctccatctaattccatgggcatggagggaactaatattcatccttctcgaatttctgattttggagcccttgaacaatctctaggatttcgtgttgaggatgccatgaatcttagcagaaatccagtgtttaatcaaatgaaagcaaatagccaagctttaggtgctgatattcaatttggtgctttaagtaagtccattgcaaactcggatataaacctctctgctgcaattgctgggtctcagacattgcaattacaaaaagacgcgatgccaaatctggcttcaacatctggtggccatcgtgagaattggggagagtccaacatggctgagggaagcgctgatacttcaacagatgatacagaagacaagaatcaaatgcctgaaaggggggaatccagtgaaagatcaaaagataaatcggatcaaaagacgttaagacggctggctcaaaatcgtgaagctgccaggaaaagccgactgaggaaaaaggcatatgtgcaacaattagagagcagcaggctgaaactgaccccactagagcaagagctacagcgagcacgcccagcagggatatttattttcagtactggagagcagaccatttcatgagtggaatgggtgcatggcatttgatgcaaaatatgcacgat

SEQ ID NO: 1936 - DNA, 702 bp, Medicago truncatula
  Predicted polypeptide sequence is orthologous to G1198
tagataaattatatacaaatatttgtcaagagacatatcaactgactggtcagtgatgtcttttcaatacagcacaagaaaaaacgaatatatacatacaacagtgtgcaaccacaaaccattaagcaggaaaagaaaccaagagagaggaaaccaccctcaaataagcttgatttctgaaatacaatgaacaactgtaacctaaaatacaaatactatttctacattttcccccttcaactctatctatcatacacctatataatcaaattattgagactatttttcaaagcatataaaagcttaatgaaaaatgttgtaccacaccagcagtatgtggaggagaatagaaaaatcacagtatctaatgtttacaagcaccacaactaggcttcttcttcacaacagaaattcatttcccaaaagataccagcttcatgcagaaagaacatatatatagctttgaaacagtttactcccttggtcgtgcaagccatagagaactcagagctcgcagccgggagaaataatcgcttattgcgagaagagctcgagctgattgtctggttgttaatatacgaagcatttgttgcaacgtttgctgcctcaggttatcagcctggcgaagaatccctcaagagtaccgagctttcccatggccatagccatttgtcccatgtaattcgccacatttccagaagc

SEQ ID NO: 1937 - DNA, 515 bp, Medicago truncatula
  Predicted polypeptide sequence is orthologous to G1275
cgcgggacttgctaggtagctagtcccccgtaaataatggcacttttgcattatttgtgtgacactgtagctatgtgtgtgtgtctgaaagagagagattctgtgcactgggactgttgatcttatcaggaactactacaagtgttcaggtgaaagatgtggtgttaagaaaagggtggaaagggatagggaagattcaagctatgtgttaacaagctatgaaggtgttcacaatcacgaaagcccctgcaattcatactgcaccccagtgtctttggtgtattccaatgaatggccacagcagaacccttctgcaacctcttcttccaattaatgctaagttaatcatatagtataagtatatgtgtgtgtgtgtatatatatatatatagctagctgctcttaataaaaggctaggaaggtttgatcgagttggtaagttgtattggctatcttcctgttatctaatcatagttattttctgctaataaaaaaaaaaaaaaaaaaaaaaaagt

SEQ ID NO: 1938 - DNA, 707 bp, Medicago truncatula
  Predicted polypeptide sequence is orthologous to G1421
caacctccgtcgtcacgcgccgccacagcaatttccgcggggtaagacaacggccttggggaaaatgggctgcggagatccgtgacccgatccgaagaaaacgtctatggctgggaactttttctacggcggaggaagccgccgctgagtacgacagagtggcagtgatgttgcatggttcaaacgcggttacaaactacccaataactcaggtggaggttaaaacggagatcgaaaaggattttgaagtgacgccgccggtgagcagcggaaacagcgacagaggtggttactccgacgctttgtcgtcgccaacgtctgtattaccctacgactgtgattcgacgccgtttgacggtttccgttacgtagacgtggacgcttttgggtttcacatcgacgcgccgttaagtttaccagaagttaacgttccgctgacatgtcatcagaagttggaaaaagaagagaagtttgaagagtttgatcttgacgagtttatgacgtggccgtattgaaaaatcttgagggcttatttgtctttttgagaaaagaaaagggactgtttggtaattatgctgttttgttgctggttgtgtaattccgaagatgccctcagttgaagttttgttgtgcttattggaagagtgtagagtttcgtgccgaaaaagaaactatatttgtgtgtatttaatttggaaataaattta

SEQ ID NO: 1939 - DNA, 810 bp, Medicago truncatula
  Predicted polypeptide sequence is orthologous to G1421
taacttaggacaaaaatatcttcatagtgttggagaaagataatcttatcttacttactctagtgctctacactcttggtcacaagggtaatttaggaattccatcaagtacaaacagaacacgacaaaaacctcaatattaacgacaaagaccaatatacccttagggtttaacttggccatgtcaagaactcgtccaagtcaaactcaccaaactcttctttttctttctcgaacggaacaaagttaacatccgttaaatttaacggcgcgtcaatatcaaagccaaacgcatccacagctccgtaacgtaaaccgtcaaacggcgtttcgccgtcgcagaaaggtagaacggatgtcggagaagcaaaaccgtcgccggagaaaatctcaggcgaacctttaacgcttttcttgtcggaggcatcgtttggaaagttgacggcggcgacttttggaccatagatcttcgcagcggcggcgtcgtaaacagcggcggcttccttctctgtgttgaaagttccgagccagagacgttttctttgaaacgggtcacggatctctgatatccaccgacccgaaggtcttttgcgaacaccacggaatatgctccggcggttagaaccgccggagttttttgtgggtcgttttctgggtttatttaaatgggtcgggttaatggagcaagatgaagaagaaggtgaagttgcttgagaatcagtgagagaaaggaattgcatggtgatgttagtgatttccttcttcactcttcgtggggtttcatcgtcgccggaggatctgaaatcggtg

SEQ ID NO: 1940 - DNA, 676 bp, Medicago truncatula
  Predicted polypeptide sequence is orthologous to G1560
gatcatttgaggcgcgacaaacaagtgttaatgatggaacttgtgaagcttagacaacagcaacataatacaagatccattcttcaagcaatggaggaaaggctacgtggaactgaaattaagcagcaacaaatgatggcttttttggccagagctatgaaaaatccagcttttattcagcaattacttcaacagaaggaaaagagaaaggagattgaagatgctattactaagaagaggagaaggccaattgagtatggagaatcaagtaatggtggcgatggaaggagtagtgttcgatatggatttgaagtgtcagagttggaaatgttggctatggaaatgcagggtcttggaagaggtggtggagaacatgaggaagagattgaggtatttgagactaatgagaaattgaataaagaacttgatgaagggttttgggaagaactttttagtgagaaatttgagagtgaattagatattctaacttctcaagatgatgatgatgatgatgatgaagatatcaatgtgttgtccaatcgctttggttacttaggttctagttcgaaatgaattacgcttaatcgagattaaccttcttcttatggttgactgattgggattcggactcaaaatcgatcggacactagtagtgtgatcttggttggcaacttgg

SEQ ID NO: 1941 - DNA, 682 bp, Medicago truncatula
  Predicted polypeptide sequence is orthologous to G1635
tccctcttctgtttttcttcaaccattgaggaagttgtaaaagtttgttaacttgtctgtgaacaaaattttgttctgtttacagagaagcaaagattttcatcactggattctgattctatggagattttgggtcaaaaagaaggaatgcattctgttatacatgttcaaaaactacttgatcaattttcatgtggaaatgaccatgccttgaaggcaaggaagccatatactatcacaaaacagagagaaaagtggacagatgaagaacataagaagttccttgaagctttaaaattatacggccgagcctggcgaaaaatcgaagatcaatcgagacactgatgggaatgatacaacaatggtggagacaattgaaattccacctccaagaccaaaacggaagccgattcatccttacccacgtaaactagttgaaatcccaaagaatgaaatctccaacttggaacagccactgaggtctaattcgcttgtgtcgttagattttggtcaagaaaacaactctccaaagtcagtattatctgcagttgcttcagaaacccttggtttctctgattcagataccccctgccggaagtttgtccccggtctcatccattagtgctgttcatacccagtagatttcccactttcttgagtccaaatcatcatcatctgagga

SEQ ID NO: 1942 - DNA, 689 bp, Medicago truncatula
  misc_feature (619)..(619): n is a, c, g, or t
  misc_feature (641)..(641): n is a, c, g, or t
  misc_feature (649)..(649): n is a, c, g, or t
  misc_feature (673)..(673): n is a, c, g, or t
  misc_feature (683)..(683): n is a, c, g, or t
  Predicted polypeptide sequence is orthologous to G1635
attttcttctttctctcttattcaccctcttccctcttctgtttttcttcaaccattgaggaagttgtaaaagtttgttaacttgtctgtgaagaaaattttgttctgtttacagagaagcaaagattttcatcactggattctgattctatggagattttgggtcaaaaagaaggaatgcattctgttatacatgttcaaaaactacttgatcaattttcatgtggaaatgaccatgccttgaaggcaaggaagccatatactatcacaaaacagagagaaaagtggacagatgaagaacataagaagttccttgaagctttaaaattatacggccgagcctggcgaaaaatcgaagaacatgttggcacaaagactgctgtgcagattcgaagtcatgctcagaagtttttttctaagatcaatcgagacactgatgggaatgatacaacaatggtggagacaattgaaattccacctccaagaccaaaacggaagccgattcatccttacccacgtaaactagttgaaatcccaaagaatgaaatctccaacttggaacagccactgaggtctaattcgcttgtgtcgttagattttggtcaagaaaacaactctncaaagtcagtattatctgcagntgcttcanaaacccttgggttctctgattcanatacccctgncggaag

SEQ ID NO: 1943 - DNA, 726 bp, Medicago truncatula
  Predicted polypeptide sequence is orthologous to G1655
gatcctcttcttcaccaattcttcattcaatctcttcaataaattcattcctctattcaatcttcaaccatttcaaatggattcattcgaaccaaactcagattcaactcattcaaacacatcacaagaatccaatcacaaaaaacgccgcaaaatcgataacctcaccaccgatcaaaactcaatcaatctcatgccatggagatcccaatcagaccaaaacacctactccaaaaaactcatccaagcactcctccgtataaattccccggaaacaaccaaacctgccgccggtcaagtccgccaaaccgccgatcgagtcctcgccgcaaccgccaaaggaagaacacgctggagccgcgcgattctcggaaaatggaagaaactccgaagacatcacaaaaaagtcaagaaagcttccaccaacggattgaagagagagaggattcaacgattaccggctgtgcagaagaaaacacgcgttctcggtcagttagttcccggttgccggaaagttccgttaccgaatcttctagaagaagctactgattatatttctgctttggagatgcaagtgcgtgctatgacagctcttgctgagcttctcgccggtggaacaccagcgggaatcgccggtcaggtgttgagttgacctgtgcgcattgtttactgcctaggctatattgcgccaggtgttacttgatttttttttcttttaatattggg

SEQ ID NO: 1944 - DNA, 692 bp, Medicago truncatula
  misc_feature (74)..(74): n is a, c, g, or t
  Predicted polypeptide sequence is orthologous to G1662
ccaacgttgtaactaaaaaggttcacctcgtactttggttttcatttcttgatcgacaagaacccatacccacnttattcaggattatgtttttcttaatttcacaaccatagtactttgtttttttctttctttctattcattcaaccttatacctgtcctttctttcttttctataatcttcttccaccatattttctgctttgttcttcttaacacgacacttctgtctcctatatctcactctcaactcttaaccttctcttcatcaaaattacaagaatttgtgagtggttagtaaatgatggagcaaagaaatgaaagtgatatgtttcaacattggagaaaaggatcatggcaatggcaagggttagagttagaggatatgaaagaaaatgatgaactaaacaaattaatgttgtctttgccagaaattcctgagccaccaacacctcttgagcctatggagttcttgtctagatcctggagtctttctgcttctgagatttcaaaggcccttactgagaaacataaacaatcttttcttgataagactcatgagacattgccggaagcgattcctgcgcctcaattaacgccaggaaagctcataccatttactaattgtcgaatgggtactattggaaaatgggtacacttacatcagaagcagcatgggaatgcaaacactt

SEQ ID NO: 1945 - DNA, 741 bp, Medicago truncatula
  Predicted polypeptide sequence is orthologous to G1662
ttgtatggtagaggtataatataacgttcttatgagtttcattgtttgacaaaattttatatgtcctactctattgagacatatacaaaatccaaacaaatcaataactgctactaatatttaaaaaattcatagattttcggttgtttcagcagagttgactcgaccaagtagaaattctattccatcaacccatttttgcttgtggagtttgctctcacacttaaattctagaagaccttgtgcagttttgaggccaaaatagagatcttcagaagcttccctttcttttctgtatggccatgcagaatcttcattacacactccataaaccacacatttatgctttttggagaaagctcctccaatgtgcttgcttttgatcttaattttgacctgatatttcatgttgatgtaaacagccacgtgtttccatcgtaatgcccctttttctgtaacctgcaacaaatctccctcacatggagaatggttctcatcaaacatctgacactcagaagcaggagaacaatgtgtttctgctattcctctatcatagggacttattgatgcatttttctttgcttcttttggaaatcttgctctcaaagctgcttctcctctcaaagctgttgcagctgcagcagtaagagtcattagatcacctggcgttttgatatcgaccgcagacttaacagtagaagcgacaccgtcatgatcagcacctgctaactccgccatttc

SEQ ID NO: 1946 - DNA, 480 bp, Medicago truncatula
  Predicted polypeptide sequence is orthologous to G1756
ctcatttattttctgaacaagatcatgatgagttattatttggaagttttccagaattctcaaaaactactaatgtccttattcatgaatttgaagagctttgtaaacctaatttctatcctctttcatctcaaaccatccttacaagttctctagctacccctaaagagcctgaacaagtcaaagaaattaaagcagcttctcatcaagatctgcaaattccagcagtatctaaatttaaaaaaagcaagaaaaacaagaacaagagtaatattgtgaagaaagtaacagcagtggatggtactctttgtgatgcatgggcatggcgtaaatatggacagaaaccaataaagggttcaccttatccacgaagctactatagatgtagcagttctaaaggatgtttggcgaagaaacaagttgaaaagaatcatttggatccaaaagtttatttggttacatacactgcagaacacaatc

SEQ ID NO: 1947 - DNA, 611 bp, Medicago truncatula
  Predicted polypeptide sequence is orthologous to G1798
tttagacacaaccctttattcctcctatcccttccttggttcattttttcttttatttttccaatttggtgcaaatctgcttccttttgttgctgcaaagaaaaggaaaaaaaatggtgagaggaaagacacaaatgaagcgtatagagaacgcaacaagtagacaagtaacattctcaaagagaagaaatggtttgttgaagaaggcctttgaactgtcagtgttatgtgatgctgaggttgctcttattgttttctcaccaagagggaggctttatgaatttgctagctctagcattctagaaacaattgaacgataccgcagtcataccaggattaataatactccaacaacatctgaatcagttgaaaatactcagcaattgaaggaagaagcagaaaacatgatgaagaagattgaccttcttgagacttcaaaacggaaactcttaggagaaggtttagggtcttgttccattgatgaactacaaaagataggaacaacagtgtggagaaaaagcataaacaaaattcgagtcaaaaagactaagggtttttcagggagcaaattgatcagtctaaaagaaaaggaaaaagccctagttgctgaa

SEQ ID NO: 1948 - DNA, 744 bp, Medicago truncatula
  misc_feature (603)..(604): n is a, c, g, or t
  misc_feature (606)..(606): n is a, c, g, or t
  misc_feature (660)..(662): n is a, c, g, or t
  misc_feature (680)..(685): n is a, c, g, or t
  misc_feature (703)..(704): n is a, c, g, or t
  misc_feature (706)..(706): n is a, c, g, or t
  misc_feature (712)..(716): n is a, c, g, or t
  misc_feature (718)..(718): n is a, c, g, or t
  misc_feature (724)..(724): n is a, c, g, or t
  misc_feature (726)..(729): n is a, c, g, or t
  misc_feature (740)..(741): n is a, c, g, or t
  Predicted polypeptide sequence is orthologous to G1798
cccgggctgcgggaacctgtattggcttctttgagggttgagataacaaaagattccattcttttcttccactaaatatttgtcagttcagatcttaccctcaaagagagttcataatggtgagaggaaaaactcaaatgaaacgcatcgaaaatgagtcaaacagacaagtaactttctcaaagagaagaaatggactgcttaaaaaggcctttgaactttcagtgctttgtgatgctgaagtcgcactcatcgtcttctctaccacagggaaactctatgagttttctagttcaagtataagcaagacagtggaacgctatcaagggaaagtcaaggaactggttctcagcaccaaaggaatccaagaaaatacacagcatctaaaggaatgtgatatcgacacaacaaagaagttggaacacctagaactttccaaaaggaagctgttgggagaagaattgggttcatgtgcttttgacgaattacaacagattgaaaatcaacttgaacgtagcttaagcaaaataagggcaagaaagaatcaattgctcaaggagcaaattgaaaagctaaaagacaaggaaaggttacttcttgaannantaaacgcttatgcaagcagtgtggaattggacaaatgattgtttaataaacaannngaagtgtgcatgacgagnnnnnngagacagaattgttcatnngncgaccnnnnnangaatgntnnnngagctgaaccnngca

SEQ ID NO: 1949 - DNA, 844 bp, Medicago truncatula
  Predicted polypeptide sequence is orthologous to G1930
taatacatacactcttcttcatacttacttcattctccttcaacaacaaaaatacaaagttagttataaaaatatatatatatatttcaattcaaactttgctagttattaacagaataacagaaaaaatggaattaggaggaagttccacagatgaaactgtcacaagcaatgactctctttcggcgaacttatctacaccgccgccaacgctgaactcactaagccgcgttggcagtgctgctagctccgtcgtggatccagaaatctacggcgtctccggtgaggcggagtctcgtaaacttccatcgtcgaaatacaaaggcgtggtgccacagcctaacggacgttggggagcacagatttacgagaaacaccagcgtgtgtggcttggtacgttcaatgaagaagacgaagcagccagagcctatgacatagccgccttgagattccgtggaaaagatgctgttacaaattctaaaagtctcactggcgttggtaacgacgccgacgaaggtgaaactgagtttctgaattcacattctaagtcggagattgttgatatgcttcggaaacacacctacgatgacgagcttaagcaaagcatgcgtgacatgagcggtggaagacagcggcgtaacggagaattgaatggtgcggtttcacgtggcgcgtgtgatgctaaagcgcgtgagcagttgtttgagaaaacggttacgccgagtgacgtgggggaaagtgaatcggttggtgataccgaaacagcatgcggagaagcattttccgttgaatgcagttgctgttgccgtcgcatgcgaccgaatctcgacggctgctgcggcgg

SEQ ID NO: 1950 - DNA, 548 bp, Medicago truncatula
  Predicted polypeptide sequence is orthologous to G1930
gtcaaagttacgttctaacaaaaggatggagccggttcgttaaggagaagaatctgaaagccggtgatacggtttgttttcaacggtctactggaccggagaagcagctgtttattgattggaaagcaaggaagaatgttaatgaggttgggttgtttgttccggttggaccggttgttgagccggttcagatggttcggttatttggggttaatattttgaaacaactccctggatccgatgttaatagtaatggtaatgttattgctgggttctgcaatggaaagaggaaggagttgaatatgtttacttttgactcttgcaagaagcctaagattattggagctttgtaacattacgttaactttatattttttgttttttgagtttttgtgactgataatatgaaagaaatggatctcaaacaaagaaatgagagatccatggagatggtactgtagttgcaagttgcaaagagtaaattgtatattacttaattagaagaagaaaaaggaagacggtgaaagtaggtgtaacaaaactgtaca

SEQ ID NO: 1951 - DNA, 796 bp, Medicago truncatula
  Predicted polypeptide sequence is orthologous to G1985
gcctttgtaaaatttatgtcttatagctatttccccattgctttccaaagaaagatggaatacacccaaaaccctaataaatctgaccaaataagatggagctctgacgacccaggtcaagttaggtcttattcttgtactttttgcaagagaggattctctaatgcacaagcattaggaggccacatgaatatccatagaagagatagagccaagctcaaacaacaatcttccgaagaaaatttgctttctttggacatcgcaaacaaaaaccctaatgatcaaggagatttggaagagaatcacgaaactcaaaggggtaagttaattactacaaaagaacttcctcatagttcttcatttgttggaactcaaaggattgaagagaagaaatgtgatttagaccttgagcttaggttaggttatcagccaatggattcatcaacattgagcactcgatcatttttctgaccttgaaaaattggcaaaattataggtcacttttttttttcgtacctagctacctcttcttccacttcccatttgaaagtacaactcgattttttttatataaacataaaggtacatgtatttaatctatacctttatgcttatgtaaaatacatgatggagtaaataaatgtgaaaatttaattttggtgtgttattagtatatcaaaaaatttacattttagttcaatggcatgtttctacattatttaataaattttgatatctacaaattattgtggtagtcaaatttattcaataatgtaattatatattattgaacgaa

SEQ ID NO: 1952 - DNA, 715 bp, Medicago truncatula
  Predicted polypeptide sequence is orthologous to G2141
tccccatgttggagggtactactagtggagagccttctatgaaaggactaaactcgaagaaaaggaaaagaagtggacaggatgctgataatgataaacccaatggaactcaagaacctacaaaatgaaggtgcaaaggacaaccctgagaaccaacagaagtgtgaccaacaaccaacttcgacaattaaggcttctgggaagaatgccaaacagggctctcaaaattctgatccacctaaggaggaatacatacatgttagggctcgccggggtcaagcaacaaacagccatagccttgcagagagggtgaggagggaaaaaataagtgagaggatgaagtttcttcaagaacttgtgcctggatgcagcaaggtcactggtaaggcagtgatgctggatgaaatcatcaactatgtacagtcacttcaacgacaagttgagtttttgtctatgaaacttgcaacagttaatccacggctggatttcaatattgaaagccttcttgctaaagatgttcttcaccaacggcctggtccttcgtcccactaggatttcctctagagatgtcaatgaattttcctccattacatccatctcaaccagggatgattcagtcagtgattccaaacatggcaaacccgtccgatatccttcgaagaactattcatacacagttaacaccccgttgagtggaggattcaaggagccaaat

SEQ ID NO: 1953 - DNA, 664 bp, Medicago truncatula
  misc_feature (655)..(655): n is a, c, g, or t
  Predicted polypeptide sequence is orthologous to G2226
ggcacgaggacctcttcacaaattgttcttgttgacccacatcacaaatcctcaaatcctttatctgtaaactattaacaagatcaaaatagtttccattgataaattctgcttcaaaatacacattgcatcataaagtgtatcacaaatttgttcatcaaaatgggcctatcaagtcttccagcacaatctgaaggagtgttatgcatcattctagtaaacactgccatgtcaatatccatattcaaaggcattataaggactatcctgcacattgttggtatcattgcttcaccatcttcctctccttcccaagactacattcctcaaaacatacctgagtcatatgaaatccatctaagtccttcagatgatttcgttgaagagttcagaagcagaacaccaacacttaggtttgatagtgtgtgtaatagctgcaaagaacctgaacatgattgctcagtgtgtctcactcaatttgaacctgaatcagagataaactattgcatatcatgtggccatgtttttcataaagtgtgtttggagaagtggttggattattggaacattacatgtccactttgtaggagtcctttaattcctgaagatgatgcatcttgcttatggtaagagcaatgattgaagcatgcacaanatatctaat

SEQ ID NO: 1954 - DNA, 643 bp, Medicago truncatula
  Predicted polypeptide sequence is orthologous to G2520
aggactaagaaggccgcagtttgggaacggtttaggacagtatggtgagtttggacccggtttgaaccgggatggtaatggtttgaaccatgcttggtggtggtggtaagaagaggcgtgactctgaagatgattctgctaagtgtgtttccaccagtaatggcggtgccaatgccgtgaatgatagtgatggaaaacggactaaagcatcggggaacaagaatgagggtggtgatggtaaagttgaaggagaagccagttcaggaaagcatgcggagcaaagcagtaagccacctccttctgaccctcctaagcaagattacatccatgttcgagctagaaggggtcaagctactgatagccacagtcttgcagaacgtgccagaagggaaaagattagtgaaaggatgaaaattctacaggatttagttcctggttgtaataaggttattgggaaagcattggtgcttgatgagataattaattatattcaatcacttcagcgccaagtggagtttttatcgatgaaacttgaagcagttaattcaagactcaataccggcattgaagcctttcctccaaagattatggtcaacaaacgtttgatcttgccggcatgccatttgtttcacaagctacaaga

SEQ ID NO: 1955 - DNA, 803 bp, Medicago truncatula
  Predicted polypeptide sequence is orthologous to G2574
tttcaataaaacaagatacagaataatacactaaaattcaattctctaattacatacataaatccaatcaaaaaaagaaagtatagaatttcctaagtaactacattaaaataaataatcaccaattaattggtgttgtcactattatcaccaccaggagatgtagaagcacttttagttgcagaaaatggcaaagaaggagacaacaacatcaaacttccattctgtgtattgttcaccggtgccgttttgttcaagaaacttgaagcacaaccatttactttagaacttgatgaaggcaatgaagtagaagaaacttgaaacatctcagcccatttcattttctgactcaaattttctcctgcactttgattttgattcccttgattggtggtgtttccgataagcgaagaaagtgctgcagctaaagctgattgaaaagttggatctgctgtgatagcttttgttgctgcagatatagtactatcttgtaaacctacatgttgtgaaatgtttgaactattgttgtttttttgcatgtaggtttggtatatactttccattgtgttttgtctaccaaagtttaaagtgcttaggttattattgttcctattattactatatggttgattttgagtagtagcatagttgaggaagctattccaatgcatgggatttgattcaggagaactaaagctaagagtggaagaagggtatcttgggtagttggttattggttgttgtagcttggattgaatctaaccaagggtgatgatgttgaagaatttgatgggtttgaagtg

SEQ ID NO: 1956 - DNA, 904 bp, Medicago truncatula
  Predicted polypeptide sequence is orthologous to G2990
ctgattcgccagctcgaaattaaccctcactaaagggaacaaaagctggagctccaccgcggtggcggccgctctataactagtggatcccccgggctgcaggaattcggcacgaggggaggtggaggtggtgaccgtggttatggtggtggaggtggcaggtgatcgctactctcgtggtggtggtgctgatagcgagtggaaactggagggattagaaaattaggtcttcagtttggtggtttatgattatgaatgttgtcatgttgaattagtttgatttagttggttgaatttagtgttttggctatgatatttgttctgttatggtttagttttgctttgtcgtgtttttggtgctgaatctggttttgtataaacgattgattgaaaaggataatgaaaaattggattcaacaaaataaaaaataaagatggaaaagagtacaaggggaggaaatctggagggggggcccggtacccatttgtccctatagggagtgtcgggttgtacaatgagcactgagcccgtggtgtgttgtacaatcgttggtgaactgtggaaaacccttgagtcgcgttgacccagaatttgagtactggggccttgtgtcatcaccctttaccccatttttatccagttataagacgatcgaatatgcgcgaaaaagctcccaaacccaagatgcacagcctctcctcatatagtagtgttgcaatcatctgccctctttagtgatatatactattattatatatgatactgttattatttgtccatatatacacatatcgtatactaacagtttttattgtatgctgtagatattacttttattttttcggttcgtcattgctttagtgcgtcatattgcgattgattatatcagttattatatattaa

SEQ ID NO: 1957 - DNA, 1815 bp, Hordeum vulgare
  Predicted polypeptide sequence is orthologous to G2
ggcgcagggccctctcctcgtcctcctccagtcctcatccccatggccaccaccaccgcctccaccccccaccactacttctactcctcccgcctcgccctcgcagcccgcggccaccgcgctcccatgccatagacgccacccagctgatcggtcgacctcgctcggacgcggcacggcgagcgaggcgggcatacctgcgtttcatttgcgagttcccggcgcgcgggcctcggatcggaggacggagatggtgctggatctcaatgtcgagtctccggccgactccggcacgtccagctcgtccgtgctcaactccgcggacgccgccggcgccttccggttcggcctgctcgggagccccgatgacgacgactgctccggcgagctggcgccggccgccgcgtccgggttcgtgacgaggcagctgttccccgcgccgccgcccgcgcccggggtcatgatggggcaggcgccggcgcctccgcccacggcgccggtgtggcaacctcggcgcgccgaggagctggtcgtggcgcagcgggtggcccccaagaagaagacgcggcgggggccgaggtcgcgcagctcgcagtaccggggcgtcaccttctaccgcaggaccggccgctgggagtcgcacatctgggattgcgggaagcaggtctacttgggtggtttcgacaccgcgcacgcggccgcaagggcctacgatcgcgcggcgatcaagttccgggggctggaggccgacatcaacttcaatctgagcgactacgaggaggatttgaagcagatgaggaactggaccaaggaggagttcgtgcatatcctccgccgccagagcaccgggttcgccagggggagctcgaagtaccgcggcgtcacgctccacaagtgcggccgctgggaggcaaggatgggccaactgctcggcaagaagtacatatatcttgggctgttcgacagcgaagttgaagctgcaagagcgtacgacagggcggcgattcgcttcaatgggagagatgctgtgactaactttgatagtagctcctacaatggagatgctacacctgacgtcgaaaatgaggcaattgttgatgctgatgctcttgacttggatctaaggatgtcgcaacctaccgcgcacgatcccaagagggacaacatcatcgccggccttcagttaacttttgattcccctgagtcgtcaaccacaatggtctcctctcagccaatgagctcatcgtcccagtggcctgtgcatcaacatggcacagcagtaccacctcagcagcaccagcgtttgtacccatctgcttgtcatggcttctaccccaacgtacaggtgcaggtgcaggagaggcccttggagccaaggccccctgagccgtcctccttccccggctgggggtggcacgcgcaggccgtgccgccgggctcctcccactcgccgttgctttatgctgcagcatcatcaggattctctaccgccgccggcgcgaaccccgccccgcccgccgtcgtaccccgaccatcaccaccgcttctactcccccgcccgccggacaactagctctctgcttactcccatggacggtggtcgacgggtgtgggcgtgtgcgcgggcgcgatcgacgtgttcgcgccttgtcggtaacagttgttgtgaattaatcggagagagataacattgccgagccatgtgtcactggctggttcctctccctcgccatgatcagaatcacaggcatcatggtttcccgttcagactacgtatccatgctttcaatcatgatcatgatcatgcggttgtcc

SEQ ID NO: 1958 - DNA, 675 bp, Hordeum vulgare
  Predicted polypeptide sequence is orthologous to G15
cggcacgaggtatgaagctatttgtgggacagtacttgtagagtagatgggggagaaggaaagggaagcaagtttatttaggaagttatgatactgagcaaaaagctgccagggcatatgatgttgcagctcttaaatactggggactaaatacaaagctgaacttttcgatttcagaatatgaaaaggaactggcggacatacaagacatgtctccagaggaatgtgtgacatacttgcgaaggaggagcagctgcttctcaagaggggcttctatttacagaggagttacaaggaggcagaaagatggtcgatggcaggcccgcataggactgattgctggaactagagacatttaccttggaactttcaaaaccgaggaagaagctgcagaagcatatgatattgctgccattgagatacgtgggaaaaacgcggtgaccaactttgaccgaagcaactacatggacaggggcatgcattgtatagaaggggcagggttgaagctgcttgcaacgaagccagaatgatttgatatcgtatattgaacagatttggtaagccatattttggggcttagtggtacatacaagatagaagaactggtcgcagcctgtcagtatttgctgctgtatgattcttcagattatatatagttcttccagagagaatttc

SEQ ID NO: 1959 - DNA, 949 bp, Hordeum vulgare
  misc_feature (605)..(605): n is a, c, g, or t
  Predicted polypeptide sequence is orthologous to G214, G680
cagattgaaccgactaaaacagaaatcaaagatatggcagccatggaaaggaggtctacttccgttgatgtggcgaaggatgtaaaagatattaatgaccaggaaatggaaaggaacaacagagtccacatcagttctaaatatgaccgttctcatgaagattgtttggatagctcaatgaaacacatgcagttgaagccaaatactgtggagacaacatacacgggtcaacatgttgcaagtgctccactctaccaaatgaataagactggggcaactggcactccagaccctgaaactgaaggaagtcatcctgatcaaacgaatgatcaagtgggaggagctaatggaagtatggactgcgtccatccaacacttcccgtggatctaaaatttggcagcagctccacagcgcagccctttccccacaactatgcatgctttgcaccaacgatgcaatgccagtgcaaccaagatgcctacaggtcatgtgaagatatgtcagccaccttctgcaacatgcgtcggtccacattgttgtaaaaccccacagtacatgcaactgcagggctggcaggatcatactggccagccgcagacgggancaccgctgtcgatccaaattaaggagttgtggctcaaaatgctcgaggggaacattttgttactcctccaagcgtgggttatgggggtagcagctactgttgctgggggcttcgcacctggtggggcaacaacaagggctttctgccttcgtgttggcttgcgcacgttggctttatgcactttgggcctaggttataacacggtggctgtttcgccaactagaatgtcccagggaagcgtggatagaatcttggccaagaggtgagaggcgcgcagaggagatcccatgatatattgggcggtcgggtggagatgtaaagacttatagtaggggagagggccg

SEQ ID NO: 1960 - DNA, 383 bp, Hordeum vulgare
  Predicted polypeptide sequence is orthologous to G214
atcatatcaacaataccgacgaaatatgttgcaaccctcagataacatacgctacagaacctatcacctttggaacaagatcgtggctcaagcaactacatacaatgtgcattcaagtgtagttctgcccatttgcatattgcattaaggcgtaggactgccctaacctagacacgagtagtacaactatacaaataacacgcacactcagaaatcatgagtaatttcagatcagaaatggtactgcatgtgatgtgagttctagtctcgactactcggcgagttgaaatatgtttgactacttttgaccattcggaccctttactgaagcaagcacatgacgagctagtggaaggaccaaacacagccgccagcggccgcca

SEQ ID NO: 1961 - DNA, 698 bp, Hordeum vulgare
  Predicted polypeptide sequence is orthologous to G261
caacccccaaccaaccaaccagacccaaccgaagaagccgagccgaaccccaccccgccgatcagccgccatgcgctgaggccgaaccgccgcagcccgaggaggaggaggaggtggaggggatggagggcagtggcgggtcctcgtcgctgccgccgttcctcatcaagacgtacgagatggtggacgagccggccacggacgcggtggtggcgtggacgccgtccggcaccagcttcgtcgtcttcagccaggccgacttctgccgggatcttctccccaagtacttcaagcacaacaacttctccagcttcgtgcgccagctcaacacctacggctttaggaaggtagatccagaacaatgggaatttgcgaatgaagaattcatacgagaccagcggcatcgattgaaaaatatccataggcgcaagccaatattcagccattcatcgcacactcagggtgctgggccattagctgatagtgaaaggagagactatgaggaggaaatcgagaggctcaagtgtgagaatgcatcactaaacttacagcttgaaaggaagaaaactgatatggacagtaaaatgacggcttttgaaagacaaactacttgctatcgaggatcagcagaaaaatcttatttcttatgtcacagaaattgttaaggcgcctggatttctttttaacttcatagaaca

SEQ ID NO: 1962 - DNA, 832 bp, Hordeum vulgare
  Predicted polypeptide sequence is orthologous to G280
gaaaattcccccctccccgctgcccgcgcccgcactctagctctagagctcggctccaccgccgtgggctctagccgccgtcgctgccatggcgaccgaagggtctcccaagtccggtgacatcccgccctaccccgagatgattctcgcggctatcgaggcgctgggcgacactaacggctccaataagtcggccatttccagctacatcgaggagaagtacgagggcctcccttccgcgcacgcctccctcctcacggccaacctagccagcatgaaggaggccggcaagctcgccttcgtcaagaacaactacctcaaggccgacgcggtctccgccaccccggccaagcgcggccgcggccgcccgcccaaggaccccaacgcgccgcccaagcccaagccggatcccaacacgcccaagcgcggccgggggcgcccgcccaaagaccccatgtccgtcgccgtcaaggaggccgtcgccaaggccaccaccggcatgcccaatggccgcggtcggccgccgggccccctccgcgggccagaaggccaaggtaaccaaggaggctgagtctccggcgggcgcgtctggctcgctcctggcaagcgcggtcgtgggcccccacgcaaggtggcggcttgaagcccgcatgcctgtgccctttcggtccgtgtatttcgcccggggtaccaccggtggaaacctcctaagggtgacggtgcctggtccattccggccttcgaccaatagggggactcggatctaatggttcataagccggaaaccggatccataataactgggcccaagggatggattgttggatcgatc

SEQ ID NO: 1963 - DNA, 1114 bp, Hordeum vulgare
  Predicted polypeptide sequence is orthologous to G280
ttggaatgccagcttcgaccgcgcgtattaaccctcactaaagggaacaaaagctggagctccaccgcggtggcggccgctctagaactagtggatcccccgggctgcaggaattcggcaccagggccggtggctccgacagcgccgccgcggcgcaggcggccgcgttcaagaaggccaatgaggggaggaaggcgtagatcaaccggatcgccgtcgagagggctttaatttagctagctggctgcctatatctgtggcatgcgtgcgtttaggccggacggacgtgtgcgttgcgttttggttgtttcatttgagttcgtggtttggttgtgtacgttggtgtcttcatgggctagcttcgatctatcgtactatgtgtgttgtaatgaatctcgtttaagttttttgcagttcaaaaaaaaaaaaaaaaaaactcgagggggggcccggtacccaattcgccctatagggagtcgtattacgcgcgttcactggccgtcgttttacaagtgtcgccgccccggccctgtacctcctccattattttagtcgttgcactgatccgtggtactcttgttgcgacgtgaggtttgtgtgttcgtttactctcactgattatggttcccgccttcgtctcttgtctaggccctctagctatatatccatttacttcgctcactcccgtaatctggatctgttgtcactgcgttagcctgtagtcggagaccataccttcttgactagctactctcccgtcatctacctgcaacatcggctagatttcgacgaacgacatcatagtctgctatgattcgcgagtcgatgggtatgctgcggagtatcatgatccagctcgaatatctccccctccctcggtgacaggtatcccgctctccgccttctccgctcctcgcggcgcctcacccgtccgtgtctcttccctctcctcccctaatctgcggctagtctctctctgctccctcgtgcatcgctacctattcgcgttcgtggatagttcgatattcgtgcgtagccgtagtgtcgtcgtcgtttgtcctaggtgtctgcgtttatgtcctgctatgagtctagactgactttctgccctccc

SEQ ID NO: 1964 - DNA, 1048 bp, Hordeum vulgare
  misc_feature (981)..(981): n is a, c, g, or t
  misc_feature (983)..(983): n is a, c, g, or t
  misc_feature (985)..(986): n is a, c, g, or t
  misc_feature (995)..(995): n is a, c, g, or t
  misc_feature (998)..(998): n is a, c, g, or t
  misc_feature (1000)..(1001): n is a, c, g, or t
  Predicted polypeptide sequence is orthologous to G481
cctctcccacgcgctcctcgatctccttgctgcactgcacctgcagtcctgcacgtacataatagtgccccaaagattgattctcagtttctcgtacaagtgtccttccagttaagttcatgcctccgccgcgtcgatgcttgatcggagtggtttgacgtcaccacttgcttcttgatttgagctgagacagatcatatatatcgaggcgccagcgccatgccggactcggacaacgactccagtgggccgagcaacgcgggcggggagctgtcgtcgccgcgggagcaggaccgcttcctgcccatcgccaacgtcagccggatcatgaagaaggcgctcccggccaacgccaagatcagcaaggacgccaaggagacggtgcaggagtgcgtctccgagttcatctccttcatcaccggcgaggcctccgacaagtgccagcgcgagaagcgcaagaccatcaacggcgacgacctgctttggcaataacccccctcggtttgagaacttctcacccgttaatactacttccccaattccccaaatcaaggcaaaggcggttcttcacaacaccacaccgataacaagccgcgaccttcccaaatccaggacacattcccggggtccccgatcggagggagcccctccccccgcggaggttaataataggcttcccaggcaccccagtgggaagaaaaaagtttaaattgacaagcggtcccgaccctaggtacgtgggctaaatataaggggggggacctcctgttgttccaaaaaaaaatttgttcaggggagacacacccccggcggcgaaaataatccctgagtattgtggtgttcaaaaaaaagaaaaaagagggcggcggcgccggcctacggaatagatgtaccggcggatacggcacggcggcgaggacccgcgttttcggccggttgggtattcgaacagcggagtacaggtgcgttgcgcgcgcatgngnanngcggggggnggntnntcatactatagttcgggggcacccgggagtgtgcggctcagggcgac

SEQ ID NO: 1965 - DNA, 674 bp, Hordeum vulgare
  misc_feature (206)..(206): n is a, c, g, or t
  Predicted polypeptide sequence is orthologous to G481
aaacgaatcgcacccgcctgcgccgccttctcttctccagcgtcggatctccccccactcgccgccctcaccgcacctccattccccgcctccaccaccttccctccacgcgcacgcgctcgtctatataaggaggagggccggatgtcggacgcgccggcgagccccccgggcggcgggaacgggggaggagggggaggggtggncagcgacgacggcggcggcggcggatacggcggcgtcagggagcaggacaggttcctgcccatcgccaacatcagccgcatcatgaagaaggccatcccggccaacggcaagatcgccaaggacgccaaggagaccgtgcaggagtgcgtctccgagttcatctccttcatcaccagcgaggccagcgacaagtgccagagggagaagcgcaagaccatcaacggcgacgacctgctctgggcgatggccacgctcgggtttgaggagtacatcgagcccctcaggtttatctgcagaagtacagagagacggagggtgatagtaagctagctgggaagtctggcgacgtctctggtaaaaaggatgccactggtcctcatggaggagcaagtgcgccagggatgggccaacaagtagcatacaatccaggaatggtttatatgcaacctcaataccataatggggcg

SEQ ID NO: 1966 - DNA, 693 bp, Hordeum vulgare
  misc_feature (650)..(650): n is a, c, g, or t
  Predicted polypeptide sequence is orthologous to G481
gtgccacatggagcaccgcaagaccgtcaacgcggaagacatcgtgtgggccctgaaccgcctcggcttcgacgactacgtcctgcccctcagcgtcttcctgcaccgcatgcgcgagggcgaggcggggacaggtggtgccggtgcaggcgacaaccgcgccgccacgagggcgcctccccgcgcgccgccgcccgctctccacgccgtgccgttgcaggtactgcagcgtcccatgtacgcgcccccgtctccggtgcaggttcagaatcacatgcagaggccagtgtacgcgcccccggctccagtgcaggttcagaatctggtgcagcggccagtgtacgcgcccccggctccggtgcaggttcagaatctggtgcagcgccccatgtccatgtacgcttccccggctcctgttcaggttcagatgcagctgggcatctacgggccccgggctccggtgcgcgggtaccccgtcacgatgtcccccgtgcggtccgtcgtcgcgccgcacgtcggcgagcagtgccatgcgttcggcggagaacccgtcgtggcccagcaatactacgggtacgggtacggggaaggagcgtacgggcgctgtactagcaacaacggaggaacctgtgccgacgaggaaagtcgtncaaacgcgttcccgtgccccgggttgccaacgatgagccggaa

SEQ ID NO: 1967 - DNA, 901 bp, Hordeum vulgare
  Predicted polypeptide sequence is orthologous to G504
gaaacgagccatcatcaaaagaggaggccccaggaggcggtatcacaaccatccagccagccagccagccgcctttctcttctctttcaacgccgggcgcccgcggagggccggtggagcgagcgagcgagcgaggagggggaggatgatgacggcaatggtgaaggccgaggcgatgacggcggaggcggaggggagcagcgggcggagggacgcggaggcggagctcaacctgccgccgggcttccgcttccaccccacggacgacgagctcgtcgtgcactacctctgcaggaaggtggcgggacagccgcagcccgtgccaatcatcgccgaggtcgatctctacaagttcaacccctgggatctgcccggggcgtgccccccttcttcctccctcccttctctccttactccttccaccatctgtctgattcaatgtgtatgtgcgccgtgctgacctcggccgcgggtttccgtgcagagagggcgctgttcgggagcagggagtggtactttttaacgccgcgcgaccgcaagtgccccaaagggtggcgccccaaccgagtccgccggaaccggtttctggaatgccacggtcgccaactaaccctgtgacgccccgggagagcggggggggtaccggttggatggaagaaggggctgaagagtttctctggtaagggccccatggtcgttaagaacgactggaagattcactaagtccaagtagtcacggcctacccccccctgcgaagaagagagccatgggcgagaaaagagaggggaagcttgtggtgtatgtggtaataaggtgaaaggggggtggtaaatgatgtgatgggatgccagtcggaggttgagatagtaaaagatgcgtattgaggaatcgaggagggtg

SEQ ID NO: 1968 - DNA, 796 bp, Hordeum vulgare
  Predicted polypeptide sequence is orthologous to G559
tttttttttttttttttgtagatcttggaatatataatatacccttaaggtcctagacacgcagaaacaactcgtcggaaaccatttttaatgggaagactgactaccacagtgactcgctaaggaaggtactcatgtacaacaccaatatacgaccatacggtactacgacaaccatgttccacgctgagtattataccgccataaacaaaagaactcgggcagcatccgttgcacaaccactgctatccatcctacaacctgtctgatataatcaaaagatattattttctctccgctcgcacataccatcaccatccttcaactcatcatgcttggctagattcgagtttttccccctctgctattgagatccatgttctttgtaacttggtctatgctgattgctgcgactgctgctgctgttgctgttgctgagcctgctgtgtctgggatgactgctgctgttgatgttgctgctgctgctgctgtatttgcagctgctgcatttgaatcagctgggagttcatctgctgctgtaggcccgccttcgacatacgagcatcggtaatctcaccggttgcaagtttcagccgctggacctcacccgttaacgcttcattcagagcatctctcagctgcgcctgttgctccattgcttgcagccttattttcaactcattgttctgagtcgcaagtcctccagagtccctctgcagcatcgtcaattgtgctgaaagcgtaatcgcctctgtctgcaagacctgtaccttatgctcgagttcttgcctcgtgc

SEQ ID NO: 1969 - DNA, 677 bp, Hordeum vulgare
  Predicted polypeptide sequence is orthologous to G860, G1760
gatcaaagactgacacagcgtgtcatccatactcaaaagtcaaaagaatagcatcattaagcaagtacagacctattcaacctatcctcgaccaaaaatctatcttattgacttgttcactgaatcaaatcgagagttgtgcaaatttgagactctgaatattcaggatgcagatggagtgcagagttgaaatcctagaatagaactacaagtgtacatgaggagggacgtgaacaagagttaatctgtttgttcttcgtccacatacaacatacaaagatctgtggcttcatctcagttgagaatgtctgtgaatgtaagtttcagggaggctggactagccttcaaatgagttctttttaaggtgtggaggggtgacgcggtgaagaaatgctccatgggtccatgtttccagtatttacctgactaaatttcctatttcacattgcggtctggcagacggagtcagcaagcttgagacagcaactgcacaacttgcaagaaagtcacgattatgaagacccatagattttgtaacttccttgaaagtaatgcagttgttgcctcatgcttggtgccaccacatgcaataactcaaaccctcggcgcatgcaggcggccaggcgcgcccaagaacaagcactcccggctgcgggaggagaggcggacctaaaact

SEQ ID NO: 1970 - DNA, 856 bp, Hordeum vulgare
  Predicted polypeptide sequence is orthologous to G1108
gagctactcaggagctaatcgatgcattgccaacctacaaatttaaaccaaaacgaagcaaaaactgggttcttgatcatgcttcgagctcagagaatcttagcgagggcggcatcctgggcccaggaactaaaaaggaaaggattgtttcggctgaagatgctgtgtgctgcatctgccttactaagtacggagatgacgatgagcttcgcgagcttccttgcaaccatttgtttcatgtgcaatgtgtcgataaatggctcaagataaatgcagtatgcccactctgcaagacagagattggaggcgtggttcgatcattctttggattgccctttggccgccgccgtgttgataggatggcaggaagaggtgtagctagctcaagatttgaggtgtagaacacgtgcttgtgctccgatgtgtgctggctgtgtagggagttgaatgcctagggaagctcatgggattcaaggtgcggatgctgaggggaagacggtgagcgcttgtgtatagactatggtacgttttgttgccaagcgggttgcggctttgtggcggccgagggcgccggcaggtgtaggtcttataagcgggggtcggaggggagggggggcgagacgagatggacgcggtctggtctttgggtggagggggtcaatgtgtgaggggggacgggggagtgtttgtgtgcgtcttatttgaggggtgggtgtgtgggagaggggtgtcgtggcggcgagtgaagggagagtagtgtaggagacgagcggggggggagtgcgtggggtgtgtggggtggagggtagcgagtagagaaggtgtggcgcggggggtatcgagggggagagagcgg

SEQ ID NO: 1971 - DNA, 726 bp, Hordeum vulgare
  misc_feature (704)..(704): n is a, c, g, or t
  misc_feature (724)..(724): n is a, c, g, or t
  Predicted polypeptide sequence is orthologous to G1145
gggcgtagatagggatgtcgtgggaggagcccggcagcccgcagctgagcctgagcggcttcagctccctcccctccatctccagcaccgccgttcggccggcccgcctgccctccctctccctcagcatcggcaccggcggggaggaccagcacctggccgtcagcagcgacgacggccagaagagcgtccgggcgatgaagaacagggagtcggctctgcggtccagggccaggaagagggcctacacgcaggagctcgagaaggaggtccgccggctcgtcgaggacaacctcaaactcaagagacagtgcaagcagcttcaatctgagattgctgcactcaacgcccagcagccaagcaacaagcagggcagcccacacaggagaacttcttcaactcagttctagcaacgctgcatcagggatgctggatgcaggagggttaattttcatctactacgatctgattagcactggtagttggtttggcttcaattaattaactcagctgcccgatcgaaatgccatcgcgcgggcttgcttgcctcggctgatccatttcatctcatgtgaatttctctgcatgtattgttgtgcgcactaatcagcctggatgcccggaccagagagcacatgcaacctgcccgcgattaattgtgtggcagaatacctttataataataatgctgaatcgcgattcanaaaaaaaataaaaaaaaaanca

SEQ ID NO: 1972 - DNA, 785 bp, Hordeum vulgare
  Predicted polypeptide sequence is orthologous to G1145
ttgcactctcgaatcctcggatttatcacgcaccgaccaacatattattctctccctgccagcatagagctgcttctccaataaggatgcctgcttgaataaatcaaaatctgaacaatttttgcacaaggattaccaaaatcagaaagcttaccgtttcatgctatcaacaactgatcatcaacagtgccataggtcaaacataaaacacgcaaaatgagctgtgaaagcggtggcaccgccatcacgggcaagaagcgggacagggcccacatttagacactagaccgggaaggctctatgtataacctcaccctcagtgaggtcgatagccacctcggagcgccacttcttagtatgaaccttgatgagtttgcgaggagtgtgcttccatatgagaagaaccttccattaccaaatggcgctgggaattcatgcagtcaaagcacgtcagcttttggtttggaacgtcacggtagcagcattactgtgcccctgccattgagcaagaagacaggggatgaaatttggagagacatccagcacgaaccaggataatcagtgatgatgatgaaaagggagttcaggtcgtgaggcacagaatgtcgtttggggagataacacttgaaagagatcttgccaaagggctggaatagttaccggacaaaggtcaaaaagatgcttaagagttaatctgatgtttgaagaacctggaaaaaaggcccatttttaaaacttaagtcccggatttcccaccgggaccaaaggccatttgagcgccaatt

SEQ ID NO: 1973 - DNA, 596 bp, Hordeum vulgare
  Predicted polypeptide sequence is orthologous to G1145
cccataatgacctatgatgagataaagacagtctaacttatcatatacaaagaaggagctctgataaaattaaaacatgtacctagcagatttacacacactgacaaagcctcggaacagacagatcatctgggacatgctaggggtcgcctagggctgctactcatctacaaactctgaaccaccgggctgggataagctacaacacctcaggctaccaactgtttctatcataaccacggaaaacatacgagcagtgtaatctacaaaatttactatcgacctcaaacgggtgcagaacttgttctccggagttgatacttgggttctgggggaggcgcagaggttatcatcatctccaactccttctgcttcttcaacctctcgttctcctcttctagacgagacaccttgttttcgagctcattagtgtaagcctgcttcctcgctctggaccttgcagctgattccctgttttttatcattcttttttgccttctttctacgaccttatcaggtataccatctgaggcaccacgcttgcgcccaggtgtctgaggatcagaatgtgcatcgagcattggtgaagtaatctg

SEQ ID NO: 1974 - DNA, 914 bp, Hordeum vulgare
  Predicted polypeptide sequence is orthologous to G1146
gttacacaccctcatcctggagaagattccagtccttccattgctgctgtggttgcttcccaagactggcctgaggtcactaagtatgcaggattagttagcgcccaagcccataggcaagaattgatacaggatctttttaaagtatggcaagatccccaaagaggaactgtgactggtggcatgatcaaggagcttctcatttctttcaagagggcaaccggacagaaaccccagagaatcatattttacagggatggtgtcagcgagggccagttctatcaagttcttcggtatgaacttgatgccattagaaaggcatgtgcgtccttggagcccaattaccagcccccagttacttttgtagttgtccagaagcggcatcacaccaagctttttgctaataaccacaatgatcaacgtactggtgatagaagcggaaacatactgcctggcactggtggtggttcaaagatttggcatccgaacgagtttgatttctacttgtgtagccacgcttgcattaaggaacaaagccttctgcgtattattactactatgggatgagaacaattactgggggtggattgacactttaaaaacaacttgtgctaacgatgctaggggccccccgctttgtaaatttggcccccaccatttatgccaattgggaagcctcggcgtggttttattgggccggaacccggatgggggcctggaaatggtgcccgggcccccaaaggggaggataaacaggggtgggagagtgcgttggaggcgctcgccctcagggaacaggagaggtttgtgttcgttaagggcggcggtcgggcaattttgcaacgatatttataggtatgggtgggtttctcggtggggggggagaacacgcgacactacgcggacgaaatatt

SEQ ID NO: 1975 - DNA, 970 bp, Hordeum vulgare
  Predicted polypeptide sequence is orthologous to G1146
gttacttttgtggttgtccagaagcgtcaccacactaggctttttgctaacaatcacaatgatcagcgtactgtcgatagaagcgggaacatactgcctggcaccgttgttgattcgaagatctgccatccgacagaattcgatttctacttgtgtagccatgctggcattcagggaacaagccggcctgcccactatcatgttctctgggacgagaacaaatttactgctgatgagttgcaaactctcacaaacaacctgtgctacacgtatgctcgatgcacccgctctgtatcgattgttcctcctgcatactatgcccatctggcagccttccgggctcggttctacatggagccggacacctccgacagcgggtccgtggcgagcggtgcacgtggcggtcctccacagggcggtccacgcagcagcaccaggttttgggaacgttgctgtcaggcctctccccgccctcaaggaaaacgtcaagcgcgtcatgttttactgctaagatcctcgcagttaccgtgaggtaacttgaagcacctgtgagtcggattggggatgctgttcaacaccattgtgggaacctaaacccaagttatcttgctgtactcttgttcaacacccattctaaatacctgcaccgggatgggtgactagtgtgggcggtgcacaaaccttttaaagcttttcaacttgattggggcgtcatttagtctgttgcgttgcgcccgtgctgctgccagaaagctttgctttcatgggctgtgccgagtgagaaatctggcctagtcctatttttgtatcccctggtgtttaaaaattatttttgacccattggtgaaggaatcacttggctagcatgagccctttgtttccttgcttggacgcatccaacggaaaatttgtggggcgatgatgtatattggatggtatactcaaaaggaaacatgaactttaagtaaac

SEQ ID NO: 1976 - DNA, 673 bp, Hordeum vulgare
  Predicted polypeptide sequence is orthologous to G1146
acctggaatctcaagaaaagcattactggcttctcttgagaagttcaatgggtcccattgattgctatttgttaagtgaccatcaggaggtatccaacccagagcaggtggcacaagacaatttggatcatgcatccgcagctggaggttttgatgctccacgaccggtggatggtcatcaaagtcaagctcccgaaaagggagagggggacacaatcggcaaggacacatcgaacccatccaatacacatgaactgatgtctggcattctgagaatcataccgccagatactgatattgatgctgattactggctcgcttctgacgttgacgctactgaaacatgggccacttagacttggtccgcctcttacgtggcgaaatagcaatgattccacacaatgcacattctgatgaaggagatggagcctggatcaataggcccaccttcaacggagtcttccattgggtaatcttaaaagaatatgtgagacagatcttggattggtctctcaatgctgtttgacgaaacatatttttaagatgagcccgcagtatcttgcatatgtcgcccttataatcaatgtcaaggtgttttctcacttgcatgagcttgatcttcgttatcttctaagccggcaaactggagctctaaatcgcataattgacagag

SEQ ID NO: 1977 - DNA, 558 bp, Hordeum vulgare
  misc_feature (7)..(7): n is a, c, g, or t
  Predicted polypeptide sequence is orthologous to G1146
gagaagncaacagcaatcaactgcttatgtatcttataaaagcaagaaaaatactgatgagaatacagcaagtaacaaaaggcagagcttcagaaactgctgcagaaacaaacttacacacacgcaaaaataacgaacttgcaaacttacacttgacacctcttcaccgtgtgcattcgtcgggatagagccaggtgatcttaataaagcaacaacaaaagaagaaaaatagcgcaagccgtcgcttgaatgctcagattttcaagctccagacccttaaaagtattcgagattcaacgtttacaacataacaaagtacacaaatagatggtacttaagcaaacataggtcagcatagtacggcgcacgacatagccactggcagattattactactctcttcacataattacaaggacaagaagctgacacgccgacttaaggagcatattaagattgcccttcacgggcttcagcagtagaacatgacgttcttcacactgtccttcattgctggaaggggcttaacagctgcaccgccagggggccgagtaccac

SEQ ID NO: 1978 - DNA, 652 bp, Hordeum vulgare
  Predicted polypeptide sequence is orthologous to G1146
ccttaaaaattcttattgtttgcataatggtgtaaaacagtacagctcgcaggcactaataataccgtcaccgaaaccaccacaaccttaacagtaaaccatggcacgcttgacatcttggcaaggagaggccggacagcagcatatccaaaagccctggcgctgcatgccgcaagcaacggacccgctatccgaggtatctgtctccgtgtaaaatcgagcccaaaaggctgccagatgtgcataatacgctggaggaacgatcgatacagagcggatgcgcctagcattcgttacgtgtagcacgagttgtttttgggagtttgcaactcatcagcggtaaatttgttctcgttccacagaacaagataatgaagcaggctggcttgttccctgaatgccagcattggtacatatgtagcaatcaaattccatcagatggtaaatcttcgaatcaataacagtgcaaagaacaggcaggcagcatatttccggcttctatcaatagtatgtttcctgccaatggtggtgaaagccggcaagaacctccaagatcggcacgaggaagaggtgaagaatcgcaggcatggagaagaaagcatcatcagcgagaaacagggcaagcagcatcagcctgaattgtaagcgtaca

SEQ ID NO: 1979 - DNA, 614 bp, Hordeum vulgare
  Predicted polypeptide sequence is orthologous to G1146
gtggggaaacatatacagggtcgtagcattacatggaatcgtcaggcactgcaaatctggacagatgtttgaatgcgcaggccaataatctggtcaagacaaacagagcaatgccattcgaaaatctgtagggggcagagaggaattgaaatattcaggttgctcagaaaacatggcagcactgacagtctgatacatatagatacacttacgtgatgactgacgatattgcttttctaccacaacgaaaggattgccagatcaacaggtaattcggttggcatcatggcgaagagaggcgttgcccctaaactcagcagtaaaacatgacacgtttcacgttttccttgaggtcaggcagaggcttaacagcaacattccctgcagctctactgccgccgcgtgcgccagtagggccacggcctgtcgtggcaccactcgcgaccgagccaccgtcggaggtatccagttccatgtagaaccgagctcgaaaagccgcgaggtgagcatagtatgccggaggcacaatcgatacagaacgggtgcaccttgcgtaggtgtagcacaggttgttcgtgagagtctgcaaaccatccgcggtaaaattgttctca

SEQ ID NO: 1980 - DNA, 661 bp, Hordeum vulgare
  Predicted polypeptide sequence is orthologous to G1146
actgaattacctattggaaatgaaactgctcgctatggacactcctatccgttttcccactaggctcctacacaaatattgagaattgtagaattaacttgactcttagtaggccaaacagcctcaaagtttcggatggctatacatttgcgtgtgcataaaatatttcggaacgcaaagtctacaatacagaaatggtatttcgtctataatgacttgacacagctaattctgtaactaacaccgaaggttatggtttaatgattctcattctcatgcaatgagcttagatgtagtacatggaatccctcatactcggcggaataacaatgtcctcgatcgtttggttggtgccgccactcatcacactctgggcctcacttgggtcgaaaacttcagataagtagcagcgtacccttgtgcagagtaaatcagcatagtaagcaggaggacaaagactgacggcttttgttgctcgtccaaacagatgactcatattgtttgtcaattcctcaagggcatcagcgtgatttttgtgaccacccttaaccttattggaccggaaaatttcgtctattatcacatagtaatgacaggcacgtgctgttccctgaagacatgcatgggcttgtaggtaaaagtcccagtttcgagtctctgt

SEQ ID NO: 1981 - DNA, 700 bp, Hordeum vulgare
  Predicted polypeptide sequence is orthologous to G1146
agttgttagacataataattttattggcacatacaaaaagcggttcatacatatggaggcgcagaccatgtccaacaccacgcgacactggtgcattctccggcaggtgcacgcgcttccacttgggcagtagttacttctcgctgatgcccatcaccgttacgggttaccgctactacttgtcttgctccttggcgtctcctgctactgatcttcgaagccttgtgctaccgtcggagaagagtgaaccagccagccatgtccatgtgaccacacacaattttatgtttcctgtgagagcttaaattgcatattccacttgccaacttttggccagaatactttctccttgccttggtcaccaaatttcagcataggagggggtagcacacgacccttaattattgttagtctgttctcaaaagtcacaccgaattcctttgcatatggatcctcattgtatgggttcacaatattttcttatccgacgatcttcttcaccacctccttgcctttgatcaggaagaaggtgggcatggccttcacccccagcttggaagacgcgtccaggacatcgtcgacgtcgacgaagaggaagagcatgtcggggtgggtctgggcgagctcctcgaacttgtagcgctcctcgcgtcatgaatccgctcacggatgcatcttcttgagcccttccctccgctgc

SEQ ID NO: 1982 - DNA, 898 bp, Hordeum vulgare
  misc_feature (797)..(797): n is a, c, g, or t
  Predicted polypeptide sequence is orthologous to G1198
gccgcagtcgcgtactggtcgctgggctcatcgtgccggccaggagcggcggccgcggtagctcggggagcttgcagcagcggtggccgcaaaaggatcggcgacggcggcaccctactaccccgtagcctccgatagaggcccctcttcctgttcgagctttgtcacaacaaaggaatctctctgggagttacattgagcactaggaataatctgcaatggcagaggccagtcctagaacagaaacgtcagatgatactgatgaaaatcttatgcttgaaccagggaatgctgctcttgctgttgcttctgactctagtgacagatccagagacagaaacggagatcaaaagacaatgcgtcggcttgctcaaaatcgcgaggctgcaaggaaaagtcgtttgaggaaaaaggcatatgttcaacaattggagaatagcaggctaaagcttacccagctagagcaggagttgcaacgagctcgtcaacaagtttgcttttattgcttgtcactgtcttgagttctggttacaagacttcatttgaagtttgcttactgaaatttccttcacagggcatttttatatctagttcagcagaccagtcccattccatgagtggaaatggggcattggcttttgacacggagtacgcacggtggttggaagaacacaatcgacaagttaatgagctgagagctgcagttaatgctcatgcaggcgatactgagctgcgcagtgttgttgagaagatcatgtcacactatgatgagatttttaagcaaaaagaaatgcggncaaagcagatgtctttcatgtgttatcaggcatgtggaagacaccacctgagaggtgtttcctatggcttgaggtttccgaccttctgaccttttaaagcg

SEQ ID NO: 1983 - DNA, 851 bp, Hordeum vulgare
  misc_feature (159)..(159): n is a, c, g, or t
  misc_feature (368)..(368): n is a, c, g, or t
  misc_feature (422)..(422): n is a, c, g, or t
  Predicted polypeptide sequence is orthologous to G1198
gcgcgggcggggggggggggaccaaatcagcgacaccgccggtcggagctcgtatcctcggaggaggaggaagaggtggcctccgggtagaagccgcgcggattcggtgcgggggctctgaggcacccctcccccccatccatcccgggcgggggcccnaggggggggggggcgaccatggccgcggcccgccggcgccacgccgagccccgctccggacgaccgcgccgaccgtacgccgccatacggttgtagtaaatcctaggcagctactaatctggattcttggagagaaaaattccggcaacgacccatctcccgcagcacaggctgggctcaccactttgctgttacgaaggggggagcanagtgatttgctgtctcattgtgattgtggtccgctgagtgatggcagatgctanctcaaggactgacaactcaactgtggtagacaacgacggcgagatctataggttagaacaaggagcaagtgggggggcaatcatggcttctaattcttccgataggtctgacagggccgacaaacccttgggaccaaaggacattgggtggtcttgcgtcaaatccgtgaggctgcaaggagaagtccactaaggaagaagtcttatggtgcaccgctagaaagcccggagctggagcttgcgcaaattgaagcgggagctccaaaaagcttccccacgagggaattttcaatttttagcctccggagaccaaacgcctgcctatgggtgggaacgcgggccatgactttccgaccataaaacccttagagggtgggggagccgaaccagcgattcagtgggggggggagtggagttgaggtgatgcga

SEQ ID NO: 1984 - DNA, 700 bp, Hordeum vulgare
  Predicted polypeptide sequence is orthologous to G1198
cttatttttaacacaaattgaagtactgtttcaataatgaattctgggcttccttcatttgttcccactccaggatacattaaaccatttgactcaagaaaaatctgatgacagttctacgcgttctgacaagttctcccatttctggagcttcctttgtttcccagctctctgtttctcacatatctgctacattacatccaaaaaaatttcttcccagttgtttcgattatgctcctactttgaaggttagttccaaaatacatttgaatcagaaggcagaatattggctttcagatggatgtgctgcaatgcttagctctccgcaattgccttcatctgtcatcagtatctctcgagggcgagaagcccagagggagcttagggcacggaggcggttgtggtactcgccaatagccaggaaacatcgagctgcctgcctaactgtcagaatcctgtgcatctgatgaagagtctgctgcctcaagttatcagcctgtatgacaaaaccttccaggttggccagcttgccaagagcaactgccatgtcacccatgaagctccccatgttggtatcatcgctaagagacccgctgcctgccacagtgactgccaatgactgatggagctgctccaggccctgggtgagagcttcttctgcctgctgcaatgactgctcaaggctgcagatgccaaccat

SEQ ID NO: 1985 - DNA, 849 bp, Hordeum vulgare
  misc_feature (675)..(675): n is a, c, g, or t
  misc_feature (765)..(765): n is a, c, g, or t
  misc_feature (831)..(831): n is a, c, g, or t
  Predicted polypeptide sequence is orthologous to G1275
ggcggcaccagtgctctaccaacagcaggcgcaggcggtgggcgacgcctgcttcttctcctccatgtcctcctacttctccaacgaggcaatcagctcctcctgctccagcccagcctccagcttctccgccgcgctgggcgccacgccgcccgctgcgccggcgatcagccccgaccccgcgtcgcagttcgacatctccgagtacctctacggcgacggcccgttagccgcgccgctggcgcccgttggcgctgctgttgcaagctcggcgactgcggtgcctgcgaggagcgcggccgagtcggcggcggcggtggagaggccgcggacggagcgcatcgcgttccgcacgaggacggagatcgagatcctcgacgacggctacaagtggcgcaagtacggcaagaagtccgtcaagaacagcccaaacccaaggaactactaccggtgctcgacggaagggtgcagcgtgaagaagcgggtggagcgggaccgggacgacccggcgtacgtggtgaccacgtacgagggcacgcacagccacgccagccccagcaccgtctactacgccagccaggacgccgcctccggcccgcttcttcgtcgccggcacgcacccgccgccaggctccctcaactgagtagactagccaccaacgacggagccacgtngagatcaagcacgtacggggccttccatttttgggcaaagctaagccaagcttcgggccttcggtgcccgtaaccaacccaacaaagttngtaagttaaacttaagtggccactaactgggtttcaagggttccgggttttcccgaacttgtaagnggtttggggtaacttggc

SEQ ID NO: 1986 - DNA, 760 bp, Hordeum vulgare
  Predicted polypeptide sequence is orthologous to G1275
cggcacgaggtgtggacttgccgcaatgtcctcgtactcgtccctcatctctgtgagccccggcgagcagatcggtgggtatgcggaccaaggtgacgacgacgacatggcggccgccgctaactacctatcatcattctgctttgattttggcgacgagtattccgtagggaaggcagcaacagcctcctaccccttgcacggacagcagcagcaggcgccgaccaaagccgacagccaccacagcggccaagcagcaagtattaccagttcacagagattcgacaatatcaacacgagcttgacgagcagcgacgcgaggagcaaaggcagtaagatcgcgttcaagacgaggtcggaggtggaggtgctggatgacgggtaccgctggaggaagtacggcaagaaaatggtcaagaacagcccaaacccaaggaactactaccgttgctcaagcgagggatgccgcgttaagaagcgagtggagcgggatcgcgacgacgagcgcttcgtcatcaccacctacgacggcgtccacaaccaccttgcgccactgccgccgcagggatgcgccggatactcgctatcgctagcgcagacgcgcgtggacgaggggtcatcaccgctacccatggaagggcgccgttgctttcttgacgccatgaagatgcacgctgccgggagcctcgctggctcctcacccgtgcccgcaccgcgcacactagagcgtcataactgataattgataatatgtccagga

SEQ ID NO: 1987 - DNA, 902 bp, Hordeum vulgare
  misc_feature (45)..(45): n is a, c, g, or t
  misc_feature (54)..(54): n is a, c, g, or t
  misc_feature (658)..(658): n is a, c, g, or t
  misc_feature (662)..(663): n is a, c, g, or t
  misc_feature (665)..(667): n is a, c, g, or t
  misc_feature (670)..(671): n is a, c, g, or t
  misc_feature (673)..(674): n is a, c, g, or t
  misc_feature (676)..(676): n is a, c, g, or t
  misc_feature (688)..(688): n is a, c, g, or t
  misc_feature (691)..(691): n is a, c, g, or t
  misc_feature (693)..(694): n is a, c, g, or t
  misc_feature (696)..(700): n is a, c, g, or t
  misc_feature (753)..(753): n is a, c, g, or t
  misc_feature (884)..(884): n is a, c, g, or t
  Predicted polypeptide sequence is orthologous to G1482
cctcgggtctgcagggaattcggcacgaggagaatacttatgtgntttgtatanatccttcacttaggtttctgcagtgaggttaacacatttttgtggagtgctgatcagtagctgcgcaagtcatttccatccaagctgaccatttcatctcgtctatctgcagacgagtgatgccaagcaagcgccaagggcgcgaggcgggaacaccagcaggagacgaaacgggcagaagcagaagctgtcgtcgaagcacgatgtctcgtccgaggacgagatgctgagcccgcagcagcccagagtagtatgaccctcgatgcaaccatctggtcccttgtcgccttatgtcctgaccatgtcaatggtcactcggtatcgcactgcagccgatagagcgccagcgccggaagctgttacgaggggggatgcttcgtcgaaggctatgtaggccccccttagaaggtttgtaagagaacctagtgtgtgagactcatcgatgttaccgcattcttttttctcggtttgtgacgctatgttgttgttgttgttgttgttgtggttgttgttgggcattgtactctcgattgattcagtgtccattgctgttatgatggaagaagaaagctccttgttgtggtgaaaaaaaaaaaaaaaaaanacannannnaannannanaaaaaaaaaaanaanannannnnnaaaaatacgtggggggggggccccgccccaattcccccttaaagggggggagntaaccgccgttactactattttactgccacccccgcaactgccacctagtcggcaatcgaccccgttattttgccttcttgcgagtgcgaatgtgtttgctggtcgttgtatttcggccgcttgtagcggnttgaaaaggaaatatttg

SEQ ID NO: 1988 - DNA, 647 bp, Hordeum vulgare
  Predicted polypeptide sequence is orthologous to G1560
atataccacataatccggtgtggaaccgcaatacaatcagtctatgagactatgactataaattagcactacaatatacaatacagctatcaatacaatggtatacagattaaatggttatgaattctggtagagttttggatcgttgttacttagacgacccagctttcgcgctacgcgtcgacatatctagatctcctcctttccagctctagcatctcagcctcatccctcattccttcactcagcagctcctcccagaagtcatcagtcagctcggcctcaccgcagccctgactccgaccacctttgtcatcctccatgcccttcctgatcccttgaatgttcattgctaaattctccagctctgaaaattccctgtcctcaaaaatgaatgtggactcgagttgctcactctgactcgtcccctcagggccaaggaacggcattacgttgatggacctcctcctcttcgttgggtaagggtcctcgaggtccttcagtttatcttgttgctggacaagctggagaaagaagtcagggttctgtattgctcttgccaggaaacccatcatctggagctgcttctgctccgcccggtgtagcctctcctccatggctcgcatgtcagctctcgtgctctgctg

SEQ ID NO: 1989 - DNA, 840 bp, Hordeum vulgare
  Predicted polypeptide sequence is orthologous to G1635
cagcaacccctcgctcaaacaatcatcagctagcagcctcgaatcatcagcatggcttctgctggccgtcgtcccacggtgctcctgcagatcgctctcttcgtcgtcgtcacggcggtcatcatcaacagctccgtctgccttgccgccggtggccacgacagcaccggcactgtagtaattggtccaggcaccggtagtggtagcaatgacccaaaccatcctgttttcccgtcgccgcctggtaaaccctacaccggccgtgggtgccgcacagtttactgatgtagaccaccggtaggtggccaaccctgaaaacacccgtgcgcatacccgcctattttccaaaacaatgcaaggatgaaagatgaaaaacctacgggcggcctaaatgcttatattatatgcatgcatgcattccttactgcatctattgattctactgtatcgtgagccagataccctacaagattggcgcatccttgatacatgtcatatagcagttggttaacatgaccaaacatgatttgcacttgtagtgatcatctacacgtatcccctcatgatgttgtttgagaacgtgcaattcaagtgatagattctgcatggagggtaccacgtgacgccatgtctctctacgttgaggtcgagtgattaatacaaaaatgcactaggccgagccaagtgtttagagcgaacaataaatatatgacaagaacgattcgcgcaagatatatatcttaaaactgcccgatatgatggcccaatatccatatgtgcacgctcagtcgtgttatacgtatatataataaataatgataacgacactcgtttatctcg

SEQ ID NO: 1990 - DNA, 797 bp, Hordeum vulgare
  misc_feature (11)..(11): n is a, c, g, or t
  misc_feature (29)..(29): n is a, c, g, or t
  misc_feature (795)..(795): n is a, c, g, or t
  Predicted polypeptide sequence is orthologous to G1635
ggttctttagnaacacattggcacaaagnaccgctgtccaaatccgaagccatgcccagaagtttttctccaaggtggtgcgcgaacccggagctaaaattgagatcgagatccctccccctaggccaaagaggaagccgctgcatccatatcctcgcaagcgtgcggactcttgcaacggggcaaacccagcaaatggaccatccaagcttgctcaaatttcatcatcttctggttctgaccaagagaatggttctcccgtgtcagtgttgtctgcaatgcagtcggatgcttttggatcatcgatgtcaaacccgtcatctcgcagtacttccccagagtcgtcagatgaggagaataatgttcctccaatggtcagcagagaggaaggtcaacaaacagggataaatcaatcccacaaggaggctgatcaggaaaacaaagatacgggtacctccgaagaggattcttctggtgaggtgcaggtaacaagcgtgaagctgttcgggaagacggtcgtcatcccagacccgaggaaaaggtgctccccggatccaggctcagggcatgaaaacggagggcaaacctcacattcctctaacaaaggaacatcacaagccccactggctgtagagattccaacacatacaaagggagaacaaatctcacaatcctctaacaaggcaacatcacaagccccattggctgtagagggtccgacgtatacaaagggagagcaaatctcacaattcttttacaaggcaacttcacaagccccactggctgtagaaattnca

SEQ ID NO: 1991 - DNA, 476 bp, Hordeum vulgare
  Predicted polypeptide sequence is orthologous to G1662
ggcgaggagggcataggctgctgccaaggacgaggctgcggcgaaagctagtgctgctgccatcgaggctatcattggccatagaaggaaaacagaaggtgagacagcagaacctgcatctactccaaacgctctcggcggcgggtttctcagcaggcttggcctcagttcgcctggagaaggtgcgcctcaagacaccccaataataagcactgaaacaaaagatgggcaggagcaattttgatggtcatgagccttcatgtcctgcatttgttctgagcactagtcgtgcattttcgtatcgattctaggggcatcaatctgtatgaactctgatggctacaaaggtttctaactttcgactgtatctccagttgagaccttgtgtaactatgattgatgcataacaatagagcaataaccatgagatcttgatgaattgtcatcaatagtataaaaaaaaaaaaaaaaaaaaa

SEQ ID NO: 1992 - DNA, 628 bp, Hordeum vulgare
  misc_feature (582)..(582): n is a, c, g, or t
  misc_feature (616)..(616): n is a, c, g, or t
  Predicted polypeptide sequence is orthologous to G1662
acgtgtcttcaactcttcatactccctcctgcaaaattttgattcatgtactaaccctaactgcaccagttgagttttaatgtttctagcctgtgccctacttgatcggctacatcaacctgctggagcagattttgcacaccatgaacccagctctgtttactggtgctgctctcacacttgaactcaatcaggccttgtgctgtactcaagccaaagcagcttgtctctggtaaacctttccctggctcagtccactctgggagctcactgtataccccataaactacacttttattgttttttgacagcacacctccaatgtgtttgctcttcagcttcaatatgacctgtaattatccagacttgctgttaactgatattcaactgtgtataatgtacacctattcatcagaaccttgatattcccgttaagaaaataatgagaagggggttatcctagtcggaaaatctattcaccagaatgagacgagttatttaaacgcaaacctttttgtgtcctattttacaagtgaagctctggaggggaattggcctacctgtgacctcttgttgatgtanattgaaacccgtctcttgtgtaaatgcccttttnttggtgcgtttt

SEQ ID NO: 1993 - DNA, 697 bp, Hordeum vulgare
  Predicted polypeptide sequence is orthologous to G1662
gcggcggtacgtgccggtttctgtagttcaagatcaaaggcaagaatctgccaaatctgatgatgagaacaaggctaatgatggagaaccttcatctacggaaacagagcagtctattgggaaaactaatatcgatgatatacttatggatgaatcccaggcatcagatgaggttcgagattctggaaattttgttggtggaaccgacctaaatttgaacctgggtctgaaagaccccgatgttgaagatgaaggtgatacagttgaagatgaaggtgatacagtagcggccgctcacacgtagtaaaatctactaactctctatctcatcgttttgtatgcattacaatacagagctgaactaaactacagtaccttacaagagtatcatcaacaccattatgtcatatatatgtaacaacccccttatatcacaacatactatcacctcagaccgagcagacggctcacacatcaacccattttcactaccgactccagcttatctcccacacgatcctccgcggcaacttgtcgaagcaggttctgcacatcgtccacccagttctgcttactcgcgccgtcctggcactcgaattctacgataccttgcgccgtgctcaggccgaagcagcatttctcatccatgaaggccttccccggctcgatcacccacgtcggaagctcgctgtatacg

SEQ ID NO: 1994 - DNA, 707 bp, Hordeum vulgare
  misc_feature (250)..(250): n is a, c, g, or t
  misc_feature (280)..(280): n is a, c, g, or t
  misc_feature (340)..(340): n is a, c, g, or t
  misc_feature (356)..(356): n is a, c, g, or t
  Predicted polypeptide sequence is orthologous to G1795
gccaccaccgcaccgcaccgcaccgcaacaacaaccgccgcgcccgcgcagagcaccgtcgaacactcggcgccacccatggctcccaagaacgcggcccccgtcgccgtcgcagccgcagccgcagcgggcggcggcatggagcccaggttccgcggcgtgcggaaacggccgtggggcaggtacgcggcggagatccgcgacccggcaagggaaggcgcgcgtctggctcgggaaccttcgacaccgncgaggcccgcgcgcgcgcctacaacgccgncgcgcttcactaccgggggccccaagccaaagaccaacttttcccgtcggcacccgtcgnccgctacgcgcacgtnccgctcccgctcccgctttccgccgccaagaagctggccgtcagccccagcagcagcaccgtcgagtcctcgtcccgggacactccggctgcttcccccgcggccccgccggcgctcgacctgagcctggcgatgccggccatggtggcggcgcagccgttcctgttcctggaccccagggtcgcggtgaccgtggccgtggcagcgccggcgccggcgccctgccgatcagcggcgatcagcggcatgaagaacaaggtggcgtcccgcgaggaagagcagagcgacaccgggtcgtcgtcatccgtggtggacacctcgccggccgtgggcgtggggttggacctgaac

SEQ ID NO: 1995 - DNA, 571 bp, Hordeum vulgare
  Predicted polypeptide sequence is orthologous to G1798
aaagcttggaggtcaaaattgacaaaagcctcctaggcatcagggcaatgaagactcggcggtttgaagagcagctctctgcgttgaggctcaaggagacgaagttgcggcaggacaatgaagatctgtatatccagtgccagaaggagcagcaccttgagttggaggcgccccctgctccggtgaccatggcggagcagggccaggacgacgcggttgaagtggagacggacctatttcttggactgcccggcaccggccgcccctgagatggagtctccaggctttggaggaaaatgcccagaataagctggccatggagttgcaagcagcagcaagcaatcgatgcggacggcgtatatagatataaaccctgtggagccgaaaccttgagagtacatacatgagttagttgatgtcgtcgtttccccgggtccttcctggccgtggtgtgccgatgtcttgatgagatgagaggaacaggacgatcctctggagaagaaagtggcggagaggggcgaaaaggatatttatggtgcccaaaaaaaaaaaaaaaaaaaaaaaaaactcg

SEQ ID NO: 1996 - DNA, 615 bp, Hordeum vulgare
  Predicted polypeptide sequence is orthologous to G1798
gcggaattttttttttttttttttttttcacatacatataattcgttaaattaatttggatagaaaaacaaataaaagcatatgcatgcagatcgatcttgcgaccaattcttttttataagacctgcactgcacgcatgctgcagcctgtcaattattttttgcatcgctatctcccagtctcacaccgacctaattgaatcgattttatatatggacaaacatatttgatcgatttttgaatcgatcttcatggactgattgattgagcagatttaatcaatcaattctctactgctgctagctagacgacccgggccttccaatgaccagctcagtctccacttccatgtaatggccgtgccgctcgtccctctcattttcttcagctccagcaccatcaggcgatgtttcagcagcagcagcagtcgccagctctagcagaggcagcgccttgtactcttcacggagtaccgagttctccatcaacaacttcctctccttctccctcagctccgagattttatccagcattttctgttgcttcttttgccggatgcagcttaggctctttccagctgcagcttcagctcgtgcagctcatgggacgaacag

SEQ ID NO: 1997 - DNA, 904 bp, Hordeum vulgare
  misc_feature (498)..(498): n is a, c, g, or t
  Predicted polypeptide sequence is orthologous to G1911
gtagttcaggtcataggtcgaggtacgtacatagcagctttgccagcttaattgtcgatcgaggaaccaatcgtcgagcgacgtcaatggcttctctgtcaatgagcgtggggtggacgccgaagcagaacaagctgttcgagcaggcgctggcggtgcacgacagggacacgcccgaccgctggcacaacatcgccagggctgtcggcggcggcaagtcggcggacgacgtgaggcgctactacgagctgctcgtccatgacatcgcccgtatcgaggccggcaaggtgcccttccccgcctaccgtcccccatgtcccggccccggccacaacgccagctacgaggccgacaggttgaagcacctgaagatctaggagataatcggttaatggacaagaaatgatgcacactaagcagatggattgaacgaagcaacatgtgcatatggggctttggggtgtaccttttactataagcgtggctgcgtgggcattntggtcatgtaatatatacatgccaaacctacccggccgaaaaaagtcggcccgaccatgcagtggcatgcatgtttcataatacactagtgggctattggctaggggggcttttaagtatgtactggagaccggacttgtgcttctttaaaaaaaaaaataatttataataatataaattattatatttattatattaaaataaaataagggaaaaaatgaaaaagaaatatataatataataactctggggggggggcccggggccacatttgctccttaagggggtggttataaaatattttgtgcgcgcgttttataaacggtggggagtgggaaaaccctgtggggtccccatcttattaactttggaggaaaattccactttttacaagtgggggagaaag

SEQ ID NO: 1998 - DNA, 638 bp, Hordeum vulgare
  Predicted polypeptide sequence is orthologous to G1911
atcgtagctctgaagtgcgagaaacatactactctactcctcattcccatccaggtcgagatgtcttctgggtctacgagctcatcccgtggcggcgccaacgcggtgtggagcgtcagggagaacaagctgttcgaggaggcactcgccaactacggcgagggcacgcccgaccgctggcacaaggtgtcgcgcgccatgggcgggaccaagacggccgacgaggtgcgcaaccactatgagatcctcgaggaagacatcaagctcatcgagtctggcagggtcccgttccccaagtacaagtacaggaactgattcatcgcggagcgaagcatctgaattctgaagttcctgcaatgaggagaaccggttgataatctagcgtttacctggaataaaaagaagaaaacatgtgtgtgtgtgtatgtctgtgtgtgtacgcgcgcgcgtgcgtgcgtgtgtgtatgttgtggttttaagtttgtaagcaaatcaagtgcggttgctcttgcagacaatagcatgtagttttaagtcttccccaataagttccggagtaaacatcagtaatgtaaatctcctgtacttatttgtaatgtttatgaacatgtgcttggtaccaaaaaaaaaaaaaaagg

SEQ ID NO: 1999 - DNA, 519 bp, Hordeum vulgare
  Predicted polypeptide sequence is orthologous to G1930
gtcctggaattttttaatgaatcatacatttcagcacaggcaggaggtagcatcctagaatcttgagagttggcacgctagctactgcgaccgcacgatcttaggatagatcctttcgcggcttctggttcccaaggctactttgtcatctttacgcccggagtcgacgaacaaccgcgtgccggcgcggtagaaggagacggtatagccagccgcaaggtcgcggtcgttaacaaagtagttcaagcccttcatgagatagtattggccggaggcctcaaactgaaatggccacaccttcccgttgccgctgccgtcctcaaactgcagcacggcgtgcctccccttgatcgtcttgcggaggccggggtgcggccacaccaagttcactgggaccatcagcgagcagccatccgactccatatcactcgccgtcagcactcgctcgaacatgtacctctgctcattttgacagtcgatgaagagcctccccctcgtggcctccccgacgccgcggct

SEQ ID NO: 2000 - DNA, 585 bp, Hordeum vulgare
  misc_feature (404)..(404): n is a, c, g, or t
  Predicted polypeptide sequence is orthologous to G1944
cggcacgagggttgtgcatgtgcctgccatgagcgcaagctctgagccacccaggcagaagcgcggccgtccgcggaagaacaccccagatggtaccaagctgccagctatcttccctgcaccatatcctattggtcttgtggcttccccgacaccagctctacccccgggcttcacgttgggattgtggggcgtaggcgtcgtgaggccccaggcaccaccagcactgccgtcgccattaccgccaccaccctttgagaattcaaaacaacgggccaagaagaagagggtatggccgccgagctccacaaccagcaagaagcagcgggagttggctgtagcagagccaggtgccactggattagttcctcaggtcatcacaatccaaggtggagaggatgtancagtgaaagtcatgtcctattgtgggaatgggtgggcagtttttatcatgtctgccgagggcgccgtacgcaatgtgacattgaagcaaccagcttcttcctgtggaactgttatttatgagggttattttgacattgtctctttgtctggcgtgtacgtgccgtcaaaaagtaatggact

SEQ ID NO: 2001 - DNA, 718 bp, Hordeum vulgare
  misc_feature (547)..(547): n is a, c, g, or t
  misc_feature (575)..(575): n is a, c, g, or t
  misc_feature (614)..(614): n is a, c, g, or t
  misc_feature (664)..(664): n is a, c, g, or t
  Predicted polypeptide sequence is orthologous to G1944
gcaggaatgttttttttttttttttttttgatcgagcaccatatatttaatcacaaggacatacaaaatagatccacaaggaaaatgaattaattgcacggtgtaagtatgcatatataaattttgaactattgggggcatcgatgagttcagttcagttcatatggtgtataattttcaactatttgaatccctccgaatttctccgcacgtttgcagcgccctgagagcgagagacagacgagactagcttgctgagccagctcctgcggcttctgaagttctgaagactccacgacggagcagggctggctggccggcgagcactcgtcctcttaaccctccggagacggggacccttgattacctccgacgacggggtcctcctcgcctcggctgcgggcggtgccgacgccaccggctgcgcggtccagttctccaccctgaacgccgacgcgcccttgccggcccgcgcctggctgccgctgtacgagtccgccatgtcgccgccgctggagatggtgaaacccaccgtcggttgcgccgncaccgtcttcatctcgatcaccggtttnttgccttctgctccatctggtagctcggaaggaagtttncacaaccacctgaacagggcttgcaagcacaagaatgccagttacgccgnctccgatgacgcggccatcggcggttgctagagaagacgcttattctaccgcag

SEQ ID NO: 2002 - DNA, 840 bp, Hordeum vulgare
  Predicted polypeptide sequence is orthologous to G2146
ctcacgtagaccacagcgccacgccacgccgcgcctacccttaccgcacgtagcgtagctactagagagccggctagctagcacatttcattgattgtcctgcggatccgttcagcatggagatcgcgaggaggaggaggtcgctgtgctcgagccgtcgccgccggtcggcggcggtggggcggaaggtgcgggagctgcgccggctggtgcccggagcgtccgttatgcccaccgaccggctgctccttcgtacggccgactacatcgcgcagctccgggccagggtggagctcctcagggcgctctcggagctctgcgaaggccatggccatggcgactcccctagctagttggctgcctgtggtatgccgtatatatacgtggatatctcgccacgtataaaaggggaggtatatattgaacaattatggttgattaagtagcgtataattgagtactacctaggtgcgaatatgcatacgaatcgtatgtgtcccagaagtatataggaggtttggttttctgtccaatatcttcttggaatcttcgcgtccgaatcataattctgggaggattattgaactcctacttggggatcgcggatcaatcttgcggtgctatggggaaacaatcctggacccgattggaggtatagagtgacaccggcttacaacgggatatcgtcataacgcgtggtcggcctacgcacgagctgaccctatctccctgggggggagccccgatccccaaattccctcctatatggtgtctctttaaaaattaatggaggccgccattaaaaccctgtggaatgaggaaaacaccctgcttggcgcc

SEQ ID NO: 2003 - DNA, 601 bp, Hordeum vulgare
  Predicted polypeptide sequence is orthologous to G2150
tttttttttttattatatataatggcaatacaaatgatgtactattacacatcttcaatgcaatcccctcttatttgagggagaatggataggaagggtgccgcgctacctaccgatcgatcttgctactaggcttagcagaagaaaggagctataccgtcagtcacacggccggccgcgctccattttcttgttcaaaataaccatgggtgggtggaaattagaagctaagacactgctagggcccaacattgttaggttgaatctcagagtgcttccatggacggcaagcaagcttggctgacatgactggctctcaggctctgaattgcttctcctccctatgtacagcgggcgtcgtcaaggcgttcggtggtgggatcgagcttcttccctggtgatcatgtcaaagctccattttcatgtggaccgtctgcaacgagccgtcgtagctgttggacgaagtggcgatctcctggctctgccccatgtccatctgaaccacgctctgcagatcttgccagaaagccccaacctgagaggcggggtcgctgaagaagtgctgctgctgctggtgcaaccccatgggccggcagaaagg

SEQ ID NO: 2004 - DNA, 634 bp, Hordeum vulgare
  Predicted polypeptide sequence is orthologous to G2251
agggacgccctatgctgctgctctccctcgtcggcctctgccgctccccgcgccgctccgtggacgacgccccgctgcccgaggaggtcaaggcgcggctcccggccgtcgagttctcttggctggcgcgtccggagcagcagcagcaggggtgccacgacggcgcggcggcgtgcatcgtgtgcctggagaggctggaggcggcggacgaggtgcggcggctgggcaactgcgcgcacgccttccaccgcggctgcatcgacgggtggatcgacctcggccggaccacgtgcccgctctgccgctcccacctactgccgcgcgcgcggagggccagccccagcctcctcacgcgcgtttggtgagcaccaaccgcgcgcccgatcgttagctcggacgcccccacgtctttccttttcccagcgcggtggcggccggcagctgggtccggggaggtggcgccgcaatgctgcacggagattcgcgatctggaccggctacatgtatatttattctggggtctatacattatctcaaaattgagattatttagctttagggtttgtatatatagagcacaccaataggtgcatacgcataggtttctattctcctggagaacgattaattagtc

SEQ ID NO: 2005 - DNA, 247 bp, Hordeum vulgare
  misc_feature (228)..(228): n is a, c, g, or t
  Predicted polypeptide sequence is orthologous to G2291
ttttttttttttttttttttgtacttaagtccttctaaattctgatgccttttgcacattttctttcctgaataaaggaatatcagaaggtatcatcatttcagtccaaagaggggctctaaaactcgagtaacacaaattacacccctgaatctgggaaagctaaagaggtgacagggggagatctaaagttctttttcttatgtatggtacacaggaaaacgttangatctttcaggatgatcat

SEQ ID NO: 2006 - DNA, 562 bp, Hordeum vulgare
  misc_feature (436)..(436): n is a, c, g, or t
  Predicted polypeptide sequence is orthologous to G2346
cgttggtccagcgaccccagtcgtcgagggcatgccatcgtcgctgcttggtctctagcttcgagctggagcaggtccatctactccagccatcccgctgttggcctccctcctctccagactccttacaggacgactaaccaagcaggaagactaacggtcatctccctccgctcctgaccaggatgctgcaggtgtaggtgatggagaagaaactatgcagagcttggagaagaatagtagaagaggagccttgggacacacgagcaaagatgttagaggaaggcacaactgcattgtttggtggagggcgccacaagacagaaactcacgcggagaaccagacactgcagctccctgtctggtgaggcgtgtgacttccccttcctcctgttatggccgtcaggagaaggagagcgagcagtggcgaatgtanaaataatttccaggtgtggcggagcttataaaggagaaaagcatgcaaaatgcaaatgtccaaaaactctctagactattatatatatagcactttgtgttctgcaaatacaactaatatccaaat

SEQ ID NO: 2007 - DNA, 456 bp, Hordeum vulgare
  Predicted polypeptide sequence is orthologous to G2520
acataaatccatggaatacatgaaggttgcgaatacatgaggaacagtcctgaatcccaaggtcaaaacaaaaaggcaccgtgctcggcggttctctctaaatacatgtccgacgtctctaccagcaattacagctccaaaaactatgaataaaaccgcatttggaacgagatggttgcacaaaaaaattgatctacgatatgaaagtgggggttgattggccgaggattcatcgcacgctttgttgggtgccaccctgaatttgttctgctcatgtcactctttcataggtgccgccaatctgcatgtgaagccattctgaagccggcgagccctgggcgtactctcttggtgtttgtgggtcaaatgtaagccctggagctgtgttgtatgtcggcgcagcaaaatctttagttggaaatgtttcaactccgttgtgagcatgggcatgggcat

SEQ ID NO: 2008 - DNA, 546 bp, Hordeum vulgare
  misc_feature (68)..(68): n is a, c, g, or t
  misc_feature (123)..(123): n is a, c, g, or t
  Predicted polypeptide sequence is orthologous to G2763
ttgccttgtcagtaacaatggccggcttctgctgccaaacaaactcccatgtgtgaccgcacacaggnagccacagctcacaaaacgtagtactactggagggggtgtggggggtacacgagnatgagcaggcaagaaatgttcctcctacccaactaatgcacaattgcatccactctggggctcaaaacctctaaccatgggcgctgcggtgggccggaccgagacggaggcgcggcatcccatcacgcgccgtagatggcggagagcctccgcagggcggccaccttgagctcgaggatgcagatgtactcggcggtctgccggagcagcacgtcgacatcggcgtcccgggcgtccgggactatcttcttgagctccctcagcctcctcagcaccatgtgctggaagggcctcctgtgcatcagcgatgccaccacccccttggcctttcccaccgtgaaggtggccttccttctcatctctctctgtgtatctctccctctctccctccccaggttgctgtgtcactaacttgtgctgtgc

SEQ ID NO: 2009 - DNA, 384 bp, Hordeum vulgare
  Predicted polypeptide sequence is orthologous to G2885
ttttttttttttttatcttttggggatgtcatgtgaacttcgagcacaccaagtaaaaaatcacaattgtataggtacatgttagagataaaggacaatcgactggatgaacaacttcttcatagagaagataatgtcatagcctatttagtctattttgtagtaaaatggaatcaaacatccgatgaagatttcagaatgtctaattttcttggatgattttggaaggtacatataaagattgtccaagtgaacatggtgaagatacaaacttggagcgcagatacaaaaaccaaatcagtcttggaaaaaattaattagttccttcttggattcatgctgcttttcaccttgacaagttgaaggactgatgatgcctcgtgc

SEQ ID NO: 2010 - DNA, 336 bp, Hordeum vulgare
  Predicted polypeptide sequence is orthologous to G2990
agtaaggaaatggatgcattcacattcgggtttccataatcctcattcaccgtctagttgttataagagtattaaccgattcgattcggaacttcagcaaaaataccaatgagtagtactgtatgattgatctatcaagaagcagtcaagagcttaagatagttttgaccaagactctgaatcgtctggtcgatcagccagccgcctagctcgcaccgtccgtcacttcggcgatcttggcgcgaccgccgtggaccgccgcgtggggcctgcctcgacatcgccgtcctccctcttctccacgaccgccgcctcctcctcctcgccgttctccgt

SEQ ID NO: 2011 - DNA, 1967 bp, Zea mays
  Predicted polypeptide sequence is orthologous to G2
ggcacgagctcccactgcactgctgctccgctgccgctaccctttccctctcccttctcgtcctcggtcctccccaacccatggccacggccaccaccacccactgccccttctcccaccacgctatttatcgcggctgcacgactcctgcccatcaggcgccatagagacgcgtgggaccgaagccgccgatcaagcgctgctcggggcggagcagcggccggcggtggtgagtgctggcagacaggccggcaggtcaggcagagtgaccagctggtgagtcgaagcttgagcggggagctggactttgggggttccggcgggctccggagcggagatggtgctggatctcaatgtagcgtcgccggcggactcgggcacgtcgagctcgtccgtcctcaactccgcggacggcggcttccggttcggcctgctcgggagccccgtcgacgacgacgactgctccggtgagatggcgcctggcgcgtccacggggttcatgacgcggcagctcttcccgtccccgaccccgccggccgagccggagccggagccggtggcggcgccggtgccggtgtggcagccgcagcgcgccgaggatctcggcatggcccagaagccggtggcgccagcgaagaataccaggcgcgggcctaggtcgcggagctcgcagtacaggggcgtcaccttctacaggaggacgggccgctgggaatcgcacatctgggattgcgggaagcaagtctacctaggtggttttgacactgcgcacgcagccgcgagggcatacgatcgagctgcgatcaagttccgcggcctcgacgctgacatcaacttcagtctgagcgactacgaggatgatttgaagcagatgaggaattggaccaaggaggagttcgtgcacatactccggcgccagagcacggggttcgcgaggggaagctccaagtaccgtggcgtgacgctgcacaagtgcggccgctgggaagctaggatggggcaacttcttggcaagaagtacatctatcttgggctctttgacagcgaagttgaggcggcaagggcttatgacagggctgcccttcgcttcaatgggagggaagctgttactaactttgagcctagctcctacaatgcaggagataataacctgcgtgacaccgaaaccgaggcaattgatgatggtgatgccattgatttggatttgcggatttcacagcctaatgtgcaagaccccaaaagggacaataccttagctggcctccagccaacatgtgattcccctgaatcttcaaatacgatggcttctcagccaatgagctcatcatccccttggcccgggtatcaccaaaacccagcagtgtcatttcaccatcagcgcttgtactcgtcagcttgtcatggcttctttccgaaccaccaggtccaggaaaggccggtggagcgaaggcctgagctgggcgcccagccattcccctcatgggcatggcaagcgcagggctcccctcacgtgccgttgcaccactctgcagcatcatcaggattctctaccgccgccggggccaacggcggcatgcccctgccgtctcacccgccggcgcagttcccgactactacaaacccgttcttcttcccctagaccgcttttgacatgacagcttgctgttccggctcagctctcggcgtctgggatggcagctggtcttgcgtgtggcgtctagcagctctggtgatggaagaaagtgattgtgttttgtgtgtgtgtgtgtgagagagagagagagccataataagaagcgacatggctggtctccctctggtatgcgcctgttaggatatgggatatctccatgcatggattgtttccgagacagtagtagtattttgttgtagtcgaccatgcgtgtacatcagtataactggatctttgaagagctgagattttatgactcaacaagcattgacat

SEQ ID NO: 2012 - DNA, 2284 bp, Zea mays
  Predicted polypeptide sequence is orthologous to G2
ggatctttcgctttccttaccccgttagcgttcctgcttgatacactacgactgcagattctttggcagaccgctaccaagtgcaagtgtgcaacgcacacacatcactcacagtctcacggtgtctctgtgcgcgcgcgtgggacacaggagggagagagacacagagaagggggcgggacgatcagctctagctcagctggtatcgtctaaactgcataaaaggggagggaaaaaaagttgcaatgatgcatcccggcgcatagatagagagagagagagaagagagagccccgactcgagagccaagaacgccgtgtgttgtgtttgtgtgcatctatctccgtacacgcacgctcgtacgcaccagctagcacgaccgccatggccgccaccaggagagccttcttccacagcgccgtcgacggcattgcgcgcgccgggccgggggaggccgagcggctgccggcgccgccgcaggtcgggcgaccggtggaaggcgccagcagcatggtcttgggcttccccgtgccgcggcccacgatgccggaccgccggccggccgccgtcacccagcagttctttccgcccactactacggccgcgcagcaggcgacgatggaggagcaatgccacgtgcccgccggtagcgcggcggagcagtgggtccggtcgtcggcgtccaggaagagccggcgcggcccgcggtcacggagctcgcagtaccgcggcgtcaccttctaccgccgcaccggccgctgggagtcccacatctgggactgtgggaaacaggtgtacttgggtggattcgacacggcgcaggccgctgcgagggcctacgaccaagccgcgatcaagttccgcggcctgaacgcggacatcaacttcaccctggacgactacaaggacgagatgaagaagatgaaggacttgagcaaggaggagttcgtgttggtgctccggcggcagggcgccggcttcgtcaggggcagctccaggttccggggagtcacccagcacaagtgcggcaagtgggaggccaggatcggccagctcatgggcaagaagtatgtgtacctgggcctgtatgacacagagacggaggctgcccaggcatatgacaaggctgccatcaagtgctacggcaaggaggcggtgaccaacttcgatgcccagagctacgacaaggagctccagtcgcagccctgggacggcgagctggatctcgagctcagtctgggctgcgccagcagcgatccgtccacggtcgccgtcgaggcgttcagccccgcgacgagcagcagtagccgcaagcagaggacgatgacgctgacgctcggtctgccggaggaggaggagacgggcgccggctaccctcaccctgctgccggcatgttcgggcgcccggctgatggccacgtccacgtagcaccgccgccacaccggcaatggcagcagcagcagcagggacagcacgcagctccagatgcggcgcctgagcgacgagcggcagagccagcagatcggcagcggtggggccggggcgcgcgctggcccatcgccagcgccagcggcattaactgggcctgggcgccgccgtacgccaccgcccgcgccggcaccgacgacgacgacgccagcagcgccgccgctgcagcatcatcaggattcccactgtggcagctgggtgcggcgtcgtccaggtccagctggcccagctgctgagcctttcctgtcgtcccgcgccaccaacagtgacgctgctgggccacgtactgacggcgactggtgacctgctggaaccgccgccggcctgtttcccttttctaggtaaaagcagtggcagaggggcgagctagcgacagcgtgcctcgtcatccatcgtccctgcgccgtggctggcggggtgggaaaaagtctgagcagttttgagcgtccggaggagctcgagatttcctccctcgaatagtcacttggggtggccactagttattatttctttccttccccctcgttgattctgctacccattatagcctctgtatctagctacatgcatgatgctgctctagcgctgttggacgttgatggcacggtgtacggatatggacagggttcgtgtgaccccatgtccactgctaggcctgtttccaaatggagtatttctgcagtaccatggcttatagaaatgccgagtattttaaaccattaggtgcttggttactttcccaaaaactaggttttcaaagctatggtataatgaataccacggtatatatttttc

SEQ ID NO: 2013 - DNA, 684 bp, Zea mays
  Predicted polypeptide sequence is orthologous to G2
ccacgcgtccgaacgcttcttttctttttcttttttttatagcatgcagtgatgattcaaccttagttgtgcctttcctcctaatcctatatatgtaggatttagtactggttgactatataagtatatatgtattgttcagtaaaagtatacataggttagctgcatgtttatgtatgtagctggttgtttcaatcagaagataaaaaaaaagggaagtagtggctagggaattcctccggtgggaacgccgtgcttgggtgcaggtacatataccttgggctattcgacagcgaagtagaggctgcaagagcctacgacaaggccgccatcaaatgcaatggcagagaggccgtgacgaacttcgagccgagcacgtatcacggggagctgccgactgaagttgctgatgtcgatctgaacctgagcatatctcagccgagcccccaaagagacaagaacagctgcctaggtctgcagctccaccacggaccattcgagggctccgaactgaagaaaaccaagatcgacgatgctccctctgagctaccgggccgccctcgtcagctgtctcctctcgtggctgagcatccgccggcctggcctgcgcagccgcctcaccccttcttcgtcttcacaaaccatgagatgagtgcatcaggagatctccacaggaggcctgca

SEQ ID NO: 2014 - DNA, 646 bp, Zea mays
  Predicted polypeptide sequence is orthologous to G8
agggttgattctgtagagcgtatgatagggcagccattcgcttcaatggaccggatgctgttaggaactttgattctgtttcctatgatggagatgtcccacttccacctgcaattgagaaagatgtggttgatggagacatccttgatctgaatttgaggatttcacaacctaacgtgcatgatctcagaagtgatggtaccctgactggttttggattaagttgtaattctcctgaagcttcaagctccattgtttctcagccaatgggcccccagtggcctgtccatcctcacagcagatcgatgcggccccagcatccacatctgtatgcatctccttgtccaggcttctttgtgaacctcagggaggcgcctatgcaggaagaggagaaccggtccgagccggcgtgtccccagccgttcccctcctgggcatggcaaacgcagggctcccgtgccccagttctccctgccaccactgcagcatcatcaggattctctaccgccgctgccaccggcgtggacgcggccacagccggccacagcgtgccgccgccgtctggtagcctccggcagttctcgggctaccaccagctccgcttccccccaaccgcctgacggagacagaccacctcctgttgagt

SEQ ID NO: 2015 - DNA, 883 bp, Zea mays
  Predicted polypeptide sequence is orthologous to G8
acttgtgcagggtgacgcctctgtacctggagctgcctctcgagaagccggtgctctgacggcgcaggacgtgcacgaactcctccttggacaggctccccatctgcttcatgtcgtcctcgtagtcgctgaggttgaagttgatgtcggcgtcgacgccgcggaacttgatcgccgcccggtcgtacgcccttgcagcggcgtgagcggtgtcgaatccacctgcgtatatcggccagcagccggaccaccactaggtacacctgcttgccgcaatcccagatgtgggactcccagcggcctgtgcggcggtagaaggtgacgccgcggtactgcgagctgcgggagcgcgggccgcggcggctcttcttggccggcggcggcgcggcgtgtgggtgcggcacgatcctggggcccggcgcctgttgctgctgcaggtcggcgcggaagaagccgagctcggcccaatgccgcggcgtcggggccggcggaccggcgccggccgggaacagctcgcgggtcacgagctgctgctggtgctggtggcggtggcgaggaggaggcgatggcgtggcgtcctcgtcctcgtccgcgccggccgcgtcgctatcgctccggatgaggatgctgaactccagcacggccggcgttgagctagatccctcctccgccggcgcgggcgcgccgcccgccgacgccgcttccgacgcgttcagcaccgacgaccccgagtcgctcgcctccatctccaccggcggcggcgcctcggccacgttcagatccaactgcatctcctgctcctgctcccctcccctccaaagctacaactcgcaagcggcagcccgccaccgatccccagtcgcaactgggctgctaactacct

SEQ ID NO: 2016 - DNA, 880 bp, Zea mays
  Predicted polypeptide sequence is orthologous to G15
gtctcactcaacctgcgcccatgggattggcttaacttctgggacgtactccatccactacggcaactcccccctgcactgcagtttatctcggcgggtatgacgtggaggagaaggccgcgagggcatatgacctggcggcgctcaagtactgggggacgtccacgcacgtgaatttcccggtggaggactacagggaagagctggaggagatgaagaacatgaccagacaggagtacgtcgctcacctgagaaggaaaagcagcggcttctcgcgcggcgcttcgatctaccggggagtcaccaggcatcaccagcacgggcggtggcaggcgcgcatcggccgcgtctcgggcaacaaggacctctacctcggaacgttcagcacccaggaggaggcggcggaggcgtacgacgtggccgcgatcaagttccgcggcctcagcgcggtcaccaacttcgacatcacgcggtacgacgtggacaagatcatggagagcagcacgctgctcccgggcgagcaggtccggcgcaggaaggaaggcgccgacgccgcggtctcggaggccgccgccgcgctggtgcaggccggcaactgcatgacggacacctggaagatccaggcggcgctgccggctgccgcgcgggccgacgagcgcggcgccggccagcagcagcgtcaggacttgctgtcgagcgaggccttctcgctgctccacgacatcgtgtccgtcgacgccgctgctggtacagggacagggggcatgtcgaacgcgtcctcgtcgctggccttcagcgtgagcaactcccgggagcagagcccggaccggggcgggcgcagcctcgccatgctcttcgccaagcccgccgcggcgcccaa

SEQ ID NO: 2017 - DNA, 1466 bp, Zea mays
  misc_feature (1392)..(1392): n is a, c, g, or t
  misc_feature (1406)..(1406): n is a, c, g, or t
  misc_feature (1418)..(1418): n is a, c, g, or t
  misc_feature (1425)..(1425): n is a, c, g, or t
  misc_feature (1444)..(1444): n is a, c, g, or t
  Predicted polypeptide sequence is orthologous to G214, G680
ccacgcgtccgctgcctgctcacttccgttccgtagtccagctagatccccgggcaaccgatccaccgagaagcttgtggttgtggcggcggcggagagggaagcggggagcgggaggtcggaggcctccgtgcgtcggaggtggacgagggagcgaggcggcgccagaccgaggttgcgtcgggctcgatttctactgggctgctgtctgctgagtttacggaagtgtttggccctagaagagttgaagataaggagtggagctaggtttaaactctggtgacttggttgttgtgtgcaacgaatcaactatgctgagtttttctgtagagtaacagaaattggatcaattcaagtagaggtctaggaggagatatgaggtactacttgcgtcaggtccagcgtttggttggagatatggaaggaggagctctcttgtttatagacgacctcaactccaagtgacaaagcgaacagctgttgaacgtttcccttctatttctgtttctttttgccggatttggagatggaggtgaattcctctggcgaggaaactgtggtaaaggtaagaaagccgtacacaataacgaagcagcgggagcggtggacagaggctgaacacaaacggttccttgaagccttgaaactttatggcagagcatggcagcgcatagaagagcatgttgggacaaagacagccgtgcagatcagaagtcacgctcaaaagttcttcactaagttggaaaaggaagctatgaacaatggtacttctccggggcaagcccatgacattgacatacctccaccacggcctaaaagaaagccaaacagtccatatcctcgaaaaagttgtctcagctccgagacacaaaccaaagaacttccaaatgacaagtcaacaaaaccaaatatgcccttgagcaatgggcatgtaaaaatggtaggcgatgcatctcttcagaattttcaaaggaaggagttgtctgaaaaaggaagtcgctcggaagttcttaatctcttccgtgatgccccatctgcatcattttcttcagttaacaaaagctcttcaaatcatggggcacccaggaggaccgaggcaagtaaaacagaaagccgagatatgtccatcatggaaaataattcttttaaccccaacacccaagaggatgtaaaggtgatcagtgatcaggaaatggaaaggcttaatggtatccagatcagatctaaatgtgaacattctcatgaggggtatttggacatctcaacgcaacaaatgaagctaatgccaaagtctgtggagacaacatatgtggatgaacaaactgcaagagcttcacacaccctagcagagagcaacggggacagctagcgttccagtgactgtacctgaanggactccatcctgntcaaacaagtgntccagtngggatccatgggagcatgnacccatggatccatcccatggt

SEQ ID NO: 2018 - DNA, 804 bp, Zea mays
  Predicted polypeptide sequence is orthologous to G214, G680
gatttctcgcggcgctcgccgcgagagcgacccccacaggtcgccgcccctccgcggcccgcgcagcgcacagcatacagtcagcacacgcagcagctgccaccacagcgaacagcaaagcacctccgactcggagtcgcggcgagagccgagaaccttctcattcatcttcctcttctatccatcctgcctgcctgcttgcctccgtattccagctagatctccgggcagccgattgaccgagaagtttgtggttgtggcggcggcggagagggaaacggggagcgggagggcggcgcggatgccactgctgcgccggcgccggcggggccggtgatgcccgccgtggcggtcgcttgaggccgccgtgcgtgggaggtggacgggggagcgaggcggtgcggaccgaggttgcgttgggttggattcgattgggctgcgtctgctgagagtaaggacaattggatcaatttaagtaggtctgggcacacaaatttgaactattaacgcattgggagtgcttgtgtgttagaggtctaggaggagctatgaggtactacttccgtcaggtccagcgtttggttggagatatggaaggaggagctctcttgtttatagatgacctcaactccaagtgacaaagtgaacagctgttgaacttcccgtctatttctgtttctttttgctggatttggagatggaggtgaattcctctggtgaggaaacggtgataaaggtaaggaagccatacacaataaccaagcagcgggagcggtgaacagaggctgagcacaaacggttcct

SEQ ID NO: 2019 - DNA, 2364 bp, Zea mays
  misc_feature (69)..(106): n is a, c, g, or t
  misc_feature (140)..(163): n is a, c, g, or t
  misc_feature (386)..(390): n is a, c, g, or t
  misc_feature (509)..(515): n is a, c, g, or t
  misc_feature (534)..(539): n is a, c, g, or t
  misc_feature (708)..(712): n is a, c, g, or t
  misc_feature (999)..(1003): n is a, c, g, or t
  misc_feature (1209)..(1213): n is a, c, g, or t
  misc_feature (1895)..(1929): n is a, c, g, or t
  misc_feature (1945)..(1949): n is a, c, g, or t
  misc_feature (1953)..(1957): n is a, c, g, or t
  misc_feature (2040)..(2049): n is a, c, g, or t
  misc_feature (2085)..(2100): n is a, c, g, or t
  misc_feature (2136)..(2144): n is a, c, g, or t
  misc_feature (2208)..(2245): n is a, c, g, or t
  Predicted polypeptide sequence is orthologous to G261
gcccacgcagcaatctggtcttctggaaatctccatcaatccgattccgaacggcagaaaattttcccnnnnnnnnnnnnnnnnnnnnnnnnnnnnnnnnnnnnnncctgagccacctcccatgcgccgcgccgcagccnnnnnnnnnnnnnnnnnnnnnnnnggtctggagagggatggagggcgcgtcctcgctgccgcccttcctgagcaagacgtacgagatggtggacgacccggccacggacgccgtggtggcgtggacgccgctggggaccagcttcgtcgtcgcgaaccaggccgagttctggagggatctgctccccaagtacttcaagcacaacaacttctccagcttcgtgcggcaactgaacacctacgtaagnnnnnaccgcacagcacgatcattcattttcttcgccccatctccctctctgtccacctgtggttttgatcaatcggggtgcgtggcggcgtgctactgtcagctatgctgttgcccctttgcnnnnnnnctccacaagttggcatttnnnnnncgaatcttgttagccttgtagtagaacaattgtttagggtatcgtcttcggtcgaatgaactgtttccttgttatagcatagcgtgttgacaacttggtggcgataactttaaattacatgtgtccactatatatctagtatatatgctcaattatcttgttgagatgnnnnnccttttctaaatccaactagagttagtgtaccttttgacaaatgaagtgctgctaacggtaaacactgttgaattggcatctttgttgacacccaaattaaatccaatagaaaccataatgatttcggatggttacttttgatttatgagccttgatgggtcaaatttctgtgatgttgtgttaatcgttttcctgcttcttcttatgtagggctttaagaaaattgatcctgaacaatgggagtttgcaaatgatgatttcattaggggacaacagcaccgactgnnnnntatacacaggcgtaagcctatattcagccattcatcgcatactcagggttctggaccattaccagataccgaaaggagggattatgaggaggaaatcgaaaggcttaagtgtgacaatgcagctctgacctcagagcttgaaaagaatgcacagaagaaacttgttacagagaaacgaatgcaggatctagaagataagttgatcnnnnnggaggatcggcagaagaatctgatggcgtatgtcagggatattgtacaggcaccaggatctttctctagctttgtgcagcaacctgatcatcacggaaagaaaaggagactaccagtacctatctctctctaccaagattctaatgctaaggggaaccaggttgtgcatgggagcttcatcaccaacccaccagcttgcagggaatcatttgacaagacggaatcttcattgaactcgttggagaatttccttcgggaagcgagtgaagcgttcaatatttcatatgatgatggcctccctggccttcatctgctgtcgttatcacagagctccattcgtccggagaaagtgatccccatgtgccatcacctgtctcaagaatgcatacatcttcggctggtgcgggagattcgctctcttcccgcgatttaacagagtcaactagctgcgctgagagccctcgcctccctcagatccaaccctgtacagattcacgaactaaggtgtctgagatcgatgtcaatcgggagcctgctgtcacagaaactggtccgacaagggaccaacctgccgaggagcctccccacgtagcagctggggtgaacgatggcttctggcagcagttcctcaccgagcagcccggtcctgatgtacaccaggaggcccaatcagaaaggagannnnnnnnnnnnnnnnnnnnnnnnnnnnnnnnnnnaggggaccgagaaaannnnnggtnnnnnaagaagaatgttgagcagatgagagagaagctggggcgtctcacctcggtggagaaaacctgactgtatttcttgtagctggnnnnnnnnnngttagcacagaaacacatataggacgctggtgcctnnnnnnnnnnnnnnnnttgcagtgtatcatatatcttcgccaccagatatgnnnnnnnnnatcgacctcgtagtcgtacttcttccacctgtacttttgccgtgtttacagtgagacttagttnnnnnnnnnnnnnnnnnnnnnnnnnnnnnnnnnnnnnnactagtcgctatacttctgttaggagttctgcattcgtacttggttagtagacacttcctggtactgttgtccaacgacgtggttatatatgtagatgatgataatattcacttcgttg

SEQ ID NO: 2020 - DNA, 748 bp, Zea mays
  Predicted polypeptide sequence is orthologous to G261
gcaaataactgaatctgtgctctagctcaacagcacgaggacatacgtaatgtacatgggtcagcatatgattttactttttacagtaggaaatgctagaaaagacttagctagcctaaactataatgtacagcggcaacaccgatggtgtggtatcagtaattctcgggtgcataagaagctgaatcaagctgccccatctgctcagtgatctgatcaacattgtcctggagacgaggacagcagcggtctacggcagtcttcacatcctcttttgcttctattgcctcgcttttaccctcggcggcgtctgtgagaaaccgctcccagaatacatcgttcactttggccggcacatgggaacctccagtttcactggtggtatcatcttgcgaggtgtcgccggttgtggtgtcagagttcatatcgactccagcagctgtcctatgggcatgttcatggagctgtgccatcggcagcatcgggctctgggcgtagtagctcgggggttctgccaacggagaagacgactggtcttgccctgaggtcgaagcgaaggggttctggcaagctgatggctgcagatcgatctcggtatccattggtgccgagagcatctcgcctagagccagagcagggctgggttcagcaacaccagcggcgtacaacatgccttgagcagcagacgtatgcgctgttgccctctgcaagaaactctccagcgacaccagggccagctccatcttct

SEQ ID NO: 2021 - DNA, 1112 bp, Zea mays
  misc_feature (303)..(308): n is a, c, g, or t
  misc_feature (387)..(442): n is a, c, g, or t
  misc_feature (451)..(480): n is a, c, g, or t
  misc_feature (489)..(520): n is a, c, g, or t
  misc_feature (568)..(598): n is a, c, g, or t
  misc_feature (610)..(655): n is a, c, g, or t
  misc_feature (663)..(700): n is a, c, g, or t
  misc_feature (874)..(900): n is a, c, g, or t
  misc_feature (943)..(963): n is a, c, g, or t
  Predicted polypeptide sequence is orthologous to G280
ggagcgaggctcctcctcgtttcctatctatcctgatccaaatccgccctactcgcttcatatatcctggcacgagggaaaacaattcattccgcgccgcatctgggaaggtctcgtcttgctcgcctccgtccgtcgccgcaccctgcgtcgtcgccatggccaccgacgaagccaccaagccgtccccgatcccaccctatcccgagatgatcctggcggcgatcgagggtctagacgacaagagcgggtcgaacaagtccgccatctccaagtacatcgagggcaagtacggctcgctgnnnnnngcgcacgcatcgctgctgaccgcgcacctggcgcgcatgaaggagtccggagagctcgtcttcctcaagaacaactacnnnnnnnnnnnnnnnnnnnnnnnnnnnnnnnnnnnnnnnnnnnnnnnnnnnnnnnnggcgcgggnnnnnnnnnnnnnnnnnnnnnnnnnnnnnncgccgtcgnnnnnnnnnnnnnnnnnnnnnnnnnnnnnnnnggccaagagcccgctggaagccgccgtgaagcaggccaccgcggggannnnnnnnnnnnnnnnnnnnnnnnnnnnnnnggccaagaccgnnnnnnnnnnnnnnnnnnnnnnnnnnnnnnnnnnnnnnnnnnnnnncgacgggnnnnnnnnnnnnnnnnnnnnnnnnnnnnnnnnnnnnnnggtacgccccgccgtgcccagcgagacggccgcggcttgaccccgcttcttggggataatagttcgtcccgccgcgagatgggatggttagggcgtagcaattcgtcccgctgcagctgcggctgcagctgccgtgttaatgttggtaggcttggtctccatgcttcatctaannnnnnnnnnnnnnnnnnnnnnnnnnnctcaattaattaatggagtaattaggaggattcgatgtgctgnnnnnnnnnnnnnnnnnnnnncagttcagtttcaccgtgtgtctctggtgttatgtgctggatctgttgtaagctaagctagggagcttgagtgctgtgttggtcgattaattattataagctgctaatgtggatgtgtacaattaattagaggatggtgatgatgttcg

SEQ ID NO: 2022 - DNA, 524 bp, Zea mays
  Predicted polypeptide sequence is orthologous to G280
cacacacacactctctctcttcgcagacacaaccaaaagaccaaggtggaaaaatagtaaagaaacggagcgaggctcctccgcatttcttatctatcctgatccaaaccctccgagggggaaacaattcattccgcacggcatccgggaaggtctgcgtcgtcgccatggccaccgaggaagtcgccaagccgtccccgatcccgccctaccccgagatgatcctggcggcgatcgaggacttaggcgacaagagcgggtcgaacaagtcggccatctccaggtacatcgagggcaagtacgacggcgacctgccgcccgcgcacgcgtcgctgctggccgcgcacctggcgcgcatgaaggagtcgggtgagctggtcttcgtcaagaacaactacttccgcgccgacgcgcccgacgcgccgccgaagcgcgggcgcgggcggcccccgaaggcgcgggaccccggcgcgccggtgtcgccgccatcggggcgcgggcgcgggcgcccgcccaagcccaag

SEQ ID NO: 2023 - DNA, 887 bp, Zea mays
  misc_feature (14)..(14): n is a, c, g, or t
  misc_feature (807)..(807): n is a, c, g, or t
  Predicted polypeptide sequence is orthologous to G280
ccagttccgtccgnattcccggctcgaccccgcgtccggttgcacatatgactgagggtcggcatgaagctctgcctgcacaagctgtagaccaaactgggcctgtgcaaaatgaagttgaagctatgattttgcaatcccttgctactactcctttgatggagaagaggagtcgtgggcgacctagaaagaggccattggaaactgaaactgcagaaacccaagttgctgcatcggtggagaagcgagggcgtgggaggccaagaaagaagaatccatcggcagggtggtctgcaggaaccagggatactgcattaaaggggattaagagagggcctgggaggccaaggaaggccaggccttttgaaactgagtctgtgaaaactgcacttgaggtgtctagggatttgacagaagatgggcctcaaaaggatggggatcttgtgtcagggaagaaagcagatactcatggtgtggtttggtagtgtcaactgaggaggtagccattgctcccatggatgctgggtgcgcagacgccaagggttgatctgatggatgtgggcaccaagagtcactagtgctctgatggtgcgaacaagaacaaaaaagaaataatgatagtacctgaaaggctaaacagaacatgcagctaataagtgtgttcatggatataattaatagccatactgcaagtattgctatatgtttgcaccagtttgattactcgtatgtttttgagcagttccattggaaactgcgtttgatgggtttcacttttggggggtggatttaatatctaaccacatnctcttctttgtcaaggactatacattttgtattttgtgcttgactggaactagccatcataggtcatttgtttccagttc

SEQ ID NO: 2024 - DNA, 873 bp, Zea mays
  Predicted polypeptide sequence is orthologous to G280
cgtggccttaactttacggcttcaccgaccgaaaacccccatttcctcttctccaaaccccactcaccgcaacgagccgccggatccatggccggcaaagacggctccgtcccttccccgcctcctccccggctcccatcctaccctgagatgatcgtggaggcaatccgggcgctgggactcgagaacggctgcaacagactgcgatctcggactacatcaagggcagctacggctccaacctccctgcccagcacaacgccgtcctcacgggccacctcgcccgcatgaaggctaccggtgagctcgccttcctcaggaacaactatctcctccccaacgaggacgaagcctccccgctgagcaccggtgggcacaagggccccgccgccgccgaggagtctactggcgtgttggacgttggtgacgatgtgttgcttgcttcccctctcgtcatcgacgctgacgccgtcgacattgacgtgcctgctccagctcccgttgtcaccgctgatgtcgacgacattgacgtgcttgctccagctcccgttgtcagcgctgatgtcaaccctgttcataccaagcggggacgcggacggcccccgaagcccaaggaccccgttgctgagggctacggtggtaagcccgctacagctcccgtcgccgccgctgccgtgcctgtcaagcgcgggcgcggacgtccgccgaaacccaagaaccccgtcgccgaggactcagctcccactgcgtcttccgtcgtcaccactgatggcaatgccgtgcctgtgaagcgtgggcgcggacgccccccaaagctcaaggaccccatcaatgtggccactgaccaagccaccagcggcatgctcagcccca

SEQ ID NO: 2025 - DNA, 1002 bp, Zea mays
  Predicted polypeptide sequence is orthologous to G481
gcacgacgctaaaataaactccccgctctcccccgcccgtccagctcttgctccgcctccgctgctctgtcctcttccctcctctgcgtttctcctcagagctgtttgacttgaccggacagtgctgttcggtggctcggccgcgatgccggactccgacaacgagtccggcgggccgagcaacgcggagttctcgtcgccgcgggagcaggaccggttcctgccgatcgcgaacgtgagccggatcatgaagaaggcgctcccggccaacgccaagatctccaaggacgccaaggagacggtgcaggagtgcgtgtccgagttcatctccttcatcaccggcgaggcctccgacaagtgccagcgcgagaagcgcaagaccatcaacggcgacgacctgctctgggccatgaccacgctcggcttcgaggactacgtcgagccgctcaagctctacctgcacaagttccgcgagctcgagggcgagaaggcggccacgacgagcgcctcctccggcccgcagccgccgctgcacagggagacgacgccgtcgtcgtcaacgcacaatggcgcgggcgggcccgtcgggggatacggcatgtacggcggcgcgggcgggggaagcggtatgatcatgatgatggggcagcccatgtacggcggctccccgccggccgcgtcgtccgggtcgtacccgcaccaccagatggccatgggcggaaaaggtggcgcctatggctacggcggaggctcgtcgtcgtcgccgtcagggctcggcaggtaggacaggttgtgaccgtcgccgtccatgcttgcatggccatggcatggctcagtcccgccgccggcttcttgcttggtgtcggtaattagcgctggttaagttaaccttcggtttttccccccttttcttttcgtggtaagtaatgttgtgctgaatggagccagtgatatggttaagatagctccataacctctcggtaaaaaaaaaaaaaaaaaaaa

SEQ ID NO: 2026 - DNA, 630 bp, Zea mays
  Predicted polypeptide sequence is orthologous to G481
atgccggactccgacacgactccggcgggccgagcaacgccgggggcgagctgtcgtcgccgcgggagcaggaccggttcctgcccatcgccaacgtgagccggatcatgaagaaggcgctcccggccaacgccaagatcagcaaggacgccaaggagacggtgcaggagtgcgtgtccgagttcatctccttcatcaccggcgaggcctccgacaagtgccagcgcgagaagcgcaagaccatcaacggcgacgacctgctgtgggccatgaccacgctcggcttcgaggactacgtcgagccgctcaagcactacctgcacaagttccgcgagatcgagggcgagagggccgccgcgtccgccggcgcctcgggctcgcagcagcagggcgagctgcccagaggcgccgccaatgccgccgggtacgccgggtacggcgcgcctggctccggcggcatgatgatgatgatgatggggcagcccatgtacggcggctcgcagccgcagcaacagccgccgcagcctcagccgccacagcagcagcagcagcaacatcaacagcatcacatggcaatgggaggcagaggaggattcggccaacaaggcggcggcggtggctcctcgtcgt

SEQ ID NO: 2027 - DNA, 860 bp, Zea mays
  Predicted polypeptide sequence is orthologous to G481
gaccggttcctgcccatcgccaacatcagccggatcatgaagaaggccgtcccggccaacggcaagatcgccaaggacgctaaggagaccctgcaggagtgcgtctccgagttcatatcattcgtgaccagcgagtccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacaggtaatctatcgtactgtcatttgttagtaaaacaatactgcagctattttccgtctcactaaacatggcagaaaatttcgatcattacattattccactaataattttctctctgtacgcactcagtaccacaatggggaaacctaataaagggctaatacagcagcaatttatggtaatattattgctccctgaattttgttaactaaagattctgtatcatgctatatgtatgttcccttttttcttcttcttgttttgacattgcttctttctctacgggtttatcctcagctagggagtctctgcattgcttacatgtgttttggcagaaaacaggaggcccttcaaaaggtgttaatctctgcgaggctgcctctcaggggtaatgggttcggttagcgctcttttgccggttttcaggagattgactgtggtcctttggc

SEQ ID NO: 2028 - DNA, 929 bp, Zea mays
  Predicted polypeptide sequence is orthologous to G504
cgcctgcgcctccgtctccggccggctctcctcgatcgctacgatttcagggggggcccccggacgaaaccaccaaaaatcccagcgcagatcactcgccggcctcctgctccagcagatcctctcccaaccgacagcgtaacaaaaaccccggctatcctcttcgctgtctgctctccttcacgctactagagcgcggctctgccaaactgcagggatccatcgtcccgcggggccggccagccggggtagtactacggtgatgaggtccatggagagcacggactcgtcgtccggtgagctaccaccaccgcagaagcagccgagctcggcgccggatctcccgccgggcttccggttccaccccacggacgaggagctggtcgtccactacctcaagaagaaggccgcgtccgtgccactccccgtcgccatcatcgcggaggtcgacctctacaagttcgatccgtgggagctacctggtacgtaagataaggcgacattcggcgagcaggagtggtacttcttcagcccgagggaccgcaagtaccccaacggagcgcggccgaacagggcggcgacgtccggctactggaaggcgactggcacagacaagcccatcatggcgtccggcggcaaccgcgagaaggtcggcgtcaagaaggctctcgtgttctaccgcgggaagccgccaaagggcctcaagaccaactggatcatgcacgagtaccgcctcgcggatgcggcgagctcaaccaccagccggccgccgccgccttgcaacgccggagggcaggccacgtctctcaggctcgacgactgggtgttatgccgcatctacaagaagatcgacaaacttggagtcggcgatccgccgcggatcatggagtgcggcgaggactccgtggagaatgcggtggcagcctacc

SEQ ID NO: 2029 - DNA, 866 bp, Zea mays
  Predicted polypeptide sequence is orthologous to G504
attcggagtcttctctcgtccctgtccccctccagcaccgccgccgccgccaccgcgccgcaacctcgccatggcacgccctccgtcggcggccctcaagccgccgtatccggccttccaatcccatcccagcgatctcgagctcgtcaacttctatctccgtccctgggtcgagaccggcgtcaagaccggcgcgttcatccacgacgcagacgtgtacgccgctgaccccaactacctcacccgtcagttcgcgccggcggtggcccaggacggcgagcgggcgtggtacttctacaccccgctgcgccacaagagcgtccacgggacgcggaagacgcgcaccgtggccaccggcggcgggtgctggcacaacgaggcgaaagctaggcccgtgtacatggtctccaacgggatgcaccagattgcgcatcgccagagcttctccttcgtcgagaaggatggcggcgtgcgggtccgcacgggttggctcatgatggagctccgcctcgtcgaggacggcgccgccgggcagaaaccggaggaggacggcgccctcgggagtcgcgtcctgtgcaaggtgtaccgcagcccgcgcaaccccgagccaagcggcatcgaagccgcgacggcgcccgggcagaaggcggaggcagacgacgatgaatcttgcgacgacgaatctagcgacgcgacgttggacgacgatgacagctccaacgcgtcactagcggcggcatcgggacccaagagggaatccgacgaggtggaatccagcgacgcgacggtggcggcacttagtcgccatagcgcgccgaacgacgagatctccggcgggtccgcggtggcgcccggacgcaaggaaa

SEQ ID NO: 2030 - DNA, 878 bp, Zea mays
  Predicted polypeptide sequence is orthologous to G504
ttttttctcacctcccgtggcagcagccggccaacacccgcaccgcagtccacagcaagaaccaagccacagcgaagaaaagatccaatggtgatggcgccggcggcggcgcagcagcagcggcgccgcgacgcggaggcggagctgaacctgcccccgggcttccggttccacccgacggacgaggagctggtggcgcactacctctgcgcgcgcgccgcgggtcgccgccccccggtgtccatcatcgccgaggtcgacctctaccgcttcgacccctgggacctgcccgagcgcgccctcttcggccgccgcgagtggtacttcttcacgccgcgggaccgcaagtaccccaatggctcccgccccaaccgcgccgccgggtcggggtactggaaggccacgggagcggacaagcccgtggagcacggtggcaggacggtcggcgtcaagaaggcgctcgtgttctaccacggcaagccgccgcgcggggtcaagacggagtggatcatgcacgagtaccgcctcgccgacgccggcgcccgcgcccgcgccaggaagcccggcaccggcacgctcagggtaagcggcgagcacctcgcagtctcgcgccgaattttcttccttggtttcatctcctcgttataaggaatcaccaccggccaccgggatgctgacgcgctgttcgatcgactctcctgcagttggatgactgggtgctctgccggctgtacaacaagaagaacgagtgggagaagacgcagcagcagcaggagaagaagcagaaatcagaagcaatggagtcggaggcctcgctctcgcactcccactcagacacgcggacgccggagtcggagatcgacgacgacccgttcccg

SEQ ID NO: 2031 - DNA, 841 bp, Zea mays
  Predicted polypeptide sequence is orthologous to G504
gatctttcaagctatccttgcttcctagctccctttggcgtgctgtaccggacgacaggggtaggtaggtaggtaggtgtagctagctcggcgagcgagggagcaatccggccaacagcacacgcgtcgatcgccatgccgagaagcggcggcggcggcaatggcggtggcattagtagtagtagtagggtgatgcccaacctcccggccgggttccgcttccaccccacggacgaggagctcatggtgcactacctcatgaggcaggccgcctccatgccgtgccccgtccccatcatcgccgaggtcaacatctaccagtgcaacccctgggatctccctgccaaggcattgttcggcgacaaggagtggtttttcttcagcccccgggaccgcaagtaccccaacggcgcccgccccaaccgcgccgccgggtccgggtactggaaggccaccggcaccgacaaggccatcctgtcgtcgtccacgcccacgagccacggcggcgccaacatcgtcgtcggcgtcaagaaggcgctcgtcttctacggcggcaggccgcccaagggcaccaagacggactggatcatgcacgagtaccgcctctcgggcgcggcggacgacgactgcaagggcagcaccaggcgcagagtgtcttcctcctcgtcgtcctccatgaggctggacgactgggtgctgtgcaggatccacaagaagagcaacgatttccagttgtcgtcgtcgtcggagcatgagcacgagcaggagggagcggcggcgggcggctcagcgacgactgtggaggaactagacgctctcgtcgtcgtcgacaacagcagca

SEQ ID NO: 2032 - DNA, 270 bp, Zea mays
  Predicted polypeptide sequence is orthologous to G559
ggtaccgagctcgaattccgttgctgtcgcgcccttccggcttgattctcccaaattgccactgtgtgggattaatgttgcagtgtcatcttgtgacctccttgaactgcccgtgaccgtgtctgccatattcttctttaccgctgaggttcaagttcttcttactctctgcaacgacacgccaggagcaaggaggtggcaagtcgtgcagaaatatcctgtcgcccttcgtcgagcagagggcggttcatgatgctgccgacagcaacg

SEQ ID NO: 2033 - DNA, 884 bp, Zea mays
  misc_feature (665)..(665): n is a, c, g, or t
  misc_feature (780)..(780): n is a, c, g, or t
  Predicted polypeptide sequence is orthologous to G559
gcacgacgtactccaaatactcttctcatttcctctcggttctgctcggtggcaacccagcgcgtagatcttattcttggacgagaattctcctcaagttctcggatttctgtttttgtgccgcttagcaattcaaccccgaaattcttttgcggcgcagtcttcacccgaatcttgggtcgtagccaagaagatgaacaaggataaggctccgatgccgggagacggcgaccccagcgatggcttgccgccgcagaccacgcgccgtgccggggcgccgccctcgtcgtcgaccccgccgcgggagtacgacatcagccgcatgccggacttccctacccggagcaccggccaccggcgtgcgcactccgagatcctgggcctccccgacgacctcgacctcagcgcccctggaggcggcgacggaccgtcgctgtcggacgagaacgacgaggagctcttctctatgttccttgatgtggacaagctgaactcatcgtgcggggcgtcgtcggaggccgaggctgagtcctcgtccgttgcggatggcgtcggtgagggggctgagctgggccacgcgcccaggccaaggcatcagcacagccagtccatggatgagtccatgtcgatcaaggcggaacagctggtgggggagcaggggatgnaggggatgtcgtctgcagaggccaagaaagcagtctctgcggcgaaactggctgagcttgctcttgttgacccaaagagggctaaaaggatttgggctaatagacaatctgctgncagatcaaaggaaaggaagatgcgatatattgctgaactcgagcgcaaggtgcaaaccctccaaacagaaagcacaacattgtcagctcagctaacattgctgc

SEQ ID NO: 2034 - DNA, 915 bp, Zea mays
  Predicted polypeptide sequence is orthologous to G559
gcaaccctccaacagaagccacaacattgtcagctcagctaacattgctgcagagagacaccactgggctaacaaccgagaacagtgagctgaagattcgcctgcagaccatggaacagcaagtccacttacaagatgctttgaacgacacactgaaagctgaggtccagcggctgaaggtggcaacagggcaggggccggccaatggtggtggaggcatgatgatgaactttggcgccgtgccacgcgcgtttggaggaggcaaccagcagatgttccacagcagccagagccaagcgatgcaatccatgctggcgacgcaccagctgcagcagctccagctccactcccagcctcagcagcagctgcaggcgcagcatctccagcagggggcgagagacctcaagatgaaagggcatctgggcgcccaagcccagtggggcggtgggaagtctgggagcagcggcagctgaggctactggcacgggagttttggtgtatgtggttactggttagctaggaggggagatccccttgttctcgggcgggtgctcccgtgcatgggtagttaccgttagctcgggctatctatctacaggctcagttcagcttcagttttactgttaactcgggggctcagctctcctgcagcgtactgtgtccggaaactcggatggtaacaggtgttttatccgttggaatctgtctgtatctctttgctagtttaagggtaaaaatggtcgggatttcagggcttcaaatgaaatctcccgtcttgagtaaggtccgggatccattgctattccattgggatatgtacccctccctgggggctccagggggggtgtaccaaaaaaaaaaaaaaaaaaaaaaaaaaaaaaaaaaaaaaaactcgaggggggcccccgccccccc

SEQ ID NO: 2035 - DNA, 831 bp, Zea mays
  Predicted polypeptide sequence is orthologous to G559
acgatacagcccttccctcttcaatcctctcgtcatttcctctcgcttctgctcagctgcaacccagcgcttagatcttattcttggacgagaactctcctcaagctctccgatttctgttctcgcgccgcttagcaattcaaccccgaaattcttttgcggcgcagtcttcacctgaatcttgggtcgtagccaagaagatgaacaaagacaaagctccgatgccgggagacggcggccccagcgacggcttgccgccgcagtccacgcgccgtgccggggcgccgccctcgtcgtctaccccgccgctggagtgcgacatcagccgcatgccggacttccctacccggagcaccggccaccggcgtgcgcactccgagatcctgggcctacccgacgacctcgacctcagtgctcccggaggcggcgaaggaccgtcgctgtcggacgagaacgatgaggagctcttctccatgttccttgacgtcgacaagctgaactcatcgtgcggggcgtcgtcggaggccgaggctgagtcctcctcggccgcgggtggcggcggtgagggggctgagctggccgacgcgcccaggccaaggcatcagcacagccagtccatggatgggtccatgtcgatcaaggcggaacagctggtgggtgcgccggggatggaggggatgtcatctgcagaggccaagaaagcagtgtctgcggcgaaactggctgagcttgctcttgttgacccaaagagggctaaaaggattttggctaatagacaatctgctgcaagatcaaggaaaagaagatgcaatatattggcgaactcgagct

SEQ ID NO: 2036 - DNA, 931 bp, Zea mays
  misc_feature (802)..(802): n is a, c, g, or t
  Predicted polypeptide sequence is orthologous to G559
tccctcctggcttctgcccctttgtctgcgctcctcacgccgccccccgccccagcctcacacccgcattccccagatctccatggactcgacccctcccacggacccggcggcctcctgcttggcctccgcctctgcggcggtggcatcgggggacgtcgccgcgatgctgccggactcgccgccgcggcgtggggcgggccaccgccgcgcacagtcggagatcctcctcggcggcgccgcgctccccgacgacctcaccttcgacgcggacctcggcgttgtcggggaggcctgcgtggccggcgacgaggatgaggaggatgacgacgacgacgaggaaggggtcggcggcgctggcggcagccggatgttcgagatgttcctcgagaacggtggcaagctcccaggaccgccggagccgtcggcgcatccgcattcgacgccgccgcggccacggcaccatcacagcatgtctatggatgggtccacgtctttgtttggttccgccgccgccgggacgcctgggaggtcgggcgctgatgccaagaaggctatttccgacgctaagctcgccgagctcgcgcttgttgaccccaaacgtgccaagaggattttggcaaaccgccagtcagctgctaggtcgaaagaaagaaagatgcgctacattgcggagcttgaaaggaaagtacagactctccaattagaagcaactacactatcagctcagctggccatgttgcagcgagatacgactggtatgacaagtgagaatagtgatctgaagatacgtgtgcagacnatggagcagcaggttcagctgcaggacgctctgaacgacaggctaagagacgagattcagcagctgaagggtgcaacaggacaggtaaacgccagcattggaaaaacaggaaactctggtatgtcatca

SEQ ID NO: 2037 - DNA, 647 bp, Zea mays
  Predicted polypeptide sequence is orthologous to G559
aaatcttgccgagcttgccctaatcgatccaaagaaagcaaagaggattataaataatagacagtcggcggcaagatcaaaagaaaggaagatgaggtacattgctgagcttgagcggaaggtgcagttcatgcagagagaagccacagcactggcaacccagctggcattgctacagagagacacggctgggctgactgttgagaacggcgacctgaagatacgtctggagagcacagagcagcagatccacctacaagacgcactgaacggggccctgaaatcggagatgcagcggctgaagatggcgacagggcaggcgggcaaccagatgatgaacttcgccgaaccgccgcacacgttcggcggtgcgaaccagcaggtcttccaccacccgggccaagcagtgccgccattcctggtggcgatgcaacagcagcagcagttgctgctgccgcacatgaaccagccgttgcaccctctgcagagccagcagctgcatcaggcggcgacgctcagcatcgacatggaagggctgccggcggctccacctggccagtggcaatggggtggtgacacgtggtcggagagcagcagtagctgattcggcggcgacgacgacgtgggttgtggatgtatgccatgtt

SEQ ID NO: 2038 - DNA, 1369 bp, Zea mays; identical to SEQ ID NO: 615
  Predicted polypeptide sequence is orthologous to G668

SEQ ID NO: 2039 - DNA, 129 bp, Zea mays
  Predicted polypeptide sequence is orthologous to G668
accaactacctccgcccgggcatccggcgcggcaacttcacgccgcgcgaggagcgcgtcatcgtccacctccactccctgctgggcaaccggtgggcggccatcgcgtcgcatctcccgcagcgcacc

SEQ ID NO: 2040 - DNA, 129 bp, Zea mays
  Predicted polypeptide sequence is orthologous to G668
accaactacctccgcccgggcatccgccgcggcggcttctccgaccaggaggacaggctcatcgtccacctccaggcgctcctcggcaaccgctgggccgccatcgcctcctacctccccgaccgcacc

SEQ ID NO: 2041 - DNA, 879 bp, Zea mays
  misc_feature (853)..(853): n is a, c, g, or t
  Predicted polypeptide sequence is orthologous to G668
cccgattcacctcctgggaaagtggaagggagggagaagcaaggcaaagcggagccgagggtcaaaggccctcgtcctgcttggccaagcaagcgtcgcgcacgtacgtagaggccgaccggccggccaggttgaagaaggcatggggaggccgccgtgctgtgagaaggccgggttgaagaaggggccctggtcgccggaggaggacctcttgctcgtctcctacgtgcaggagcacggtcctgggaattggcgcgccgtgccatgcagcaccggtctgatgcgctgcagcaagagctgccggctccggtggaccaactacctccgcccgggcatcaagcgcggcagcttcagcgaccaggaggagaagctcatcatccacctccaggagctgctcgggaacaagtggtccgcgattgcgtcgtacctgccggagcggacggacaatgacatcaagaactactggaacacgcacctcaagaagaagctcgccaagacgggcgccagggaaagcggtgccagcgccaagacgacgaagaagagcgatagggccgcggcgcccaaggggcagtgggagcggcggctgcagacgaacatccacaccgcacgccaggcgctccgggaggcgctgtccatggacgacactgcgccgccggcaatcaagccggagccgctgccgctgccgctggggcagctgccggcgccagccagccaggcgatgtacgcttccagcatcgataacatagcgcgtctgctggagggctggatgcgtcccagcgtcagtgggaatgcgtcggctgagtccatgtcctctttctcggcgttctccggtggtggcgacggcgcgtcggcnagccacatcggcacggcgcacacgcc

SEQ ID NO: 2042 - DNA, 821 bp, Zea mays
  Predicted polypeptide sequence is orthologous to G668
ctgtcctcaacctcaagccgccacgctccaccaacacgcgcgcgctggcttcttcaacctcggttgcttgctcgcaacaagacacggatcgtcagagcaagagctctggtgacctgacgattctgctcttgttctcgtacggcgccggtgcctagcgtctgtagcctttttgtgtgtgttttttcgcccatatctccccaccaccaccaccaccaacctcagccgcagttcacccgcgtcaccgcacgagtacacgagcaatccgcaagcgataacctgcaagctgaggggaaaggaaggtgaaggccagctgttttgctcacggagaaagaggttcgtcgttgatcaacacggacacaccatggtgaggccgccgtgctgcgacaaggagggcgtcaagaaggggccatggacgccggaggaggacctcgtcctcgtctcctacatccaggagcacggccccggcaactggcgcgccgtcccggccagaaccgggctgatgcggtgcagcaagagctgccgtctgcggtggaccaactacctccggccgggcatcaagcgcggcaacttcaccgagcaggaggagaagctcatcgtgcacctccaggccctcctcggcaacaggtgggcggccatcgcgtcgtacctgccggagcggacggacaacgacatcaagaactactggaacacgcacctcaagcgcaagctgcagagcggcggcgacggggcggccaagccgccggcgcacaggccgccgtcgtcgtcccaggccagtgggagaggagggtgcagacggacatcaacttggcgcgccgcgcgct

SEQ ID NO: 2043 - DNA, 658 bp, Zea mays
  Predicted polypeptide sequence is orthologous to G729
atgacctaataactctaccccagcccactactacctcttcctgctgcaggttctcctttccatcctttcctctaactttggaaccaccaagaagctcagctcaccgtctgcaaacccgttgggagctaccatgagccgaggctgctgctggggcgtttccaccggcggcggcgtgggtgtgcagacgacggcggcggcggttcctgatctctcactccacataagccctccgtcgccaccggccggcggcgtcgaggtgctgccggagccgaggctgctgctggggctggggctggggccggggccggggctggagctcgacgacgacgacgccgccgtggcgacgaagaaggtggacgacgacgacgacgcggccgcggcggcgcgggagcacaaccttcacgcgcagcggctccggctgcagttgcaccagccgagccagacggcccacgggttcaagaagagctcgtcgggcaccgctgccggcggcgggaggagaagctccagggcgccgcggatgaggtggaccaccgcgctgcacgcgcacttcgtgcacgccgtcgagctcctgggcggccacgagagagcaacaccgaagtcagtactggaactgatgaacgtgaaggatcttacactagcgcacgtcaagagccacctg

SEQ ID NO: 2044 - DNA, 751 bp, Zea mays
  Predicted polypeptide sequence is orthologous to G729
gcaccatcagatcataattaaatatggctggtcgttacaatgcaagcaaatcaatctatatatgcagctagctagctcgatctagcctgtcgatctcttatccgcatgcatggtccagcttcatcgatcaactcatccatatgtagatggcgcgcgcgcggcggattattatatccgtcctagggtgaagtcgaggttcggtttgttgcctccgccaaacatcgtcgcagcagctacttggaacggcgccgacaagttcaggtcagaaacatcgtcatcaaggctctcgaaggatttgatgtcgcccggagtggcatctcttgatttgtcacggacgaaccagcaggcggcccctcttatcgaggcgttgcaccagaaagcacacgtgctggcgccattatgctcgctgccgtcaggcggattggagtgctgggcggacgactcggacccgctggtggtggtggtggtattggtgaggtcgaacaggctgctgtcgtcgtcggggatgtcgatgatcgtcttcgcaccacccgcttgcccgtaggatgaagcagaggctggcctgtggtcagtagtcttgatggtccgatacatctgcaagtgcgacttgacatgggccaacgtcagatccttcacgtccattagctcaagaaccgacttgggtgtagctctctcgtggcccccgagcagctcgacggcgtggacgaagcgcgcgtgcagcgacgtggtccaccgcatccggggggcgcgc

SEQ ID NO: 2045 - DNA, 478 bp, Zea mays
  Predicted polypeptide sequence is orthologous to G729
tttttttttttttttttttttttttaaagagagtataatactttattacatcatctgacacattgtatctttaacaagtatcacatcaaagtaaagcggaaataaacaactgggcaatctcccacaggaagatgaccggcgcatcgttagacttaaaaatcatcgtcgtcgataaaatctccatcaaagtctccagcatcaccctcttgctcaaaagcgtcttgcgggtcgtcctcgaacatattcgaatcgcctaccgcacaatcggcttcttaggttcgcgcgtgtgatggggatggatcgacgggtttcaaccggacggagagcagggctcgactacggacagcgagtgcgtggctccgatgaactccggcgacaaacggcacactccggcgaacaccacgggctccggcgacgaacggcaacgaactacggcaacgtcactagcgatgagcgaggagtgctagagctcgtgccg

SEQ ID NO: 2046 - DNA, 895 bp, Zea mays
  Predicted polypeptide sequence is orthologous to G779
gcacgaggtctggtggcgcaccttgagcgtggagtcggtggccagcgctggcgctggcgctggcgctgcgccgccgccggcagccaagaagagaaggctcagctcctgcaccgaccaattcgtccgttgacacggccagttcagcagcaaggcctcctgagcgttccatggagcaggagcagagggttgaacttgcgaacgaccgcgacgcgcagtcgtgctgcgttggggaggtggaaagcgggcgcaggtttgctctgggggaggcggaagcggaagcggcagagggcgacagcccgacgagcagaggcggaggagggagaggatccaggagactgttgccgcgctcaggaacatggtccccgggggcatcgcgaaagacgccgcggctgttctggacgaagcgatctgctacttgcagtacctgaagctgaaagtgaagacgctgggagctgtctccctctagctaagcctatctagccctctctcctcgtcgtggtggctttgttgtcgaaggccgaagccactggcttctggtgagaggagagctagcctatatcacccatctgttcagttcagtcccagaggagctcggatcttctcctacccgactcactgtcggtggctgcatcacccatcttcctcatcgtgggttggtatgcaaaagctagaaacatctttccgctgagcgtgatccaaagcgaagcccccattccatgcaaagcgctgggtcgtgccgtgcgtggggtggctcctgctttatatacgcgttgtgctcctgctttggctgatgtttgctttggtagttatatatagttctgtgtactacaaagtaaagtaagtcttgtaaaacgtgcacatcctccaggcgggtttgtttctctgctgcccgtct

SEQ ID NO: 2047 - DNA, 636 bp, Zea mays
  Predicted polypeptide sequence is orthologous to G860, G1760
ttttttttttttttttgactgactaattgttaataataaggatctgtccctatttttttggcaaaaaatgtggcccctagattttgttaatctgctatacatctagctactagagatagcaagttaattaattatacgcaaagcaaattacagatctgttaaagttgaaccaagtctgatcatcggtaagaaattacatacagatatatgtctagctagctagggagagtcacgacgtagatgaatcgtacttggtgttggagaaatcgtagagcctgccggtgctggagaagatgatgaggccaacctccgcgtcgcagaggatagagagctccttcgccttcttcagcagcccgctccgcctcttggagaaggtcacctgcctgctcgtggagttgtctatcctccttatcactatcttccccctccccatccctccttctatctctcagatctagtctaggccggaccggatgggaaggaaggatcacacgggaagacgaagagctcgccggcggccggggggacgagcgatgactggtctgatgggggaattaaaggcggaagctatagcctagctactagaggccggttccattcctagccaccttccaaagagcggaacgggaagtgccg

SEQ ID NO: 2048 - DNA, 571 bp, Zea mays
  Predicted polypeptide sequence is orthologous to G860, G1760
ttttttttttttttttcttgatagtaaacgaagatgagaatacagtaacaaactcataacttatttgtcttagaaaatctccagcatggcaaaaaaaaaaaagacacaagctagcaggactgtactcaggttcccaaaagttacatatatgggcggtttaacaaactcaaagtaactttaccagcttcctttgaagcgaaaggttttgttcttttcgttgtagttgtagtccctactctaaagtagagatcatatggttgtccagtcactctcatttatgttaattaattgaaagcttttccaatcttactagctctggcaaagggaggcagaaagcttgaggcagcaactgcataacttaaaagagcaccatcggtatgaccctcaactaaccggaaagtgaactcttcgcgttcgcttagttccctgggtcggggcgctctcgaagggtggcctagtcggttttcgctcccttcgattttctcttgacccttcttcgaagttctcatgacacgaaggttctatttctaggaggtcgagctcctacccttcttccggagctagggtttct

SEQ ID NO: 2049 - DNA, 1539 bp, Zea mays
  misc_feature (74)..(125): n is a, c, g, or t
  misc_feature (169)..(194): n is a, c, g, or t
  misc_feature (230)..(246): n is a, c, g, or t
  misc_feature (896)..(900): n is a, c, g, or t
  misc_feature (1374)..(1403): n is a, c, g, or t
  Predicted polypeptide sequence is orthologous to G860, G1760
ccgccctgcgccaagaaaagccatcgttcttcccacaaacgcacacatagaagcatcattcccctctcggctannnnnnnnnnnnnnnnnnnnnnnnnnnnnnnnnnnnnnnnnnnnnnnnnnnnaaacctgctgcctttgagctttcttcttcgagtgctcccaccannnnnnnnnnnnnnnnnnnnnnnnnncacgttcggcggcgcgcgcggagaaagatagatccnnnnnnnnnnnnnnnnngtccttgcttccgatcggagggccacaaccacaacctctcgctccttagcgtgcgcgcgcgagccagggtcaagaagagagctagctagctataggccggagatcgatggggaggggaaagatcgtgatccgcaggatcgataactccacgagccggcaggtgaccttctccaagcgccggaacgggatcttcaagaaggccaaggagctcgccatcctctgcgatgcggaggtcggcctcgtcatcttctccagcaccggccgcctctacgagtactctagcaccagcatgaaatcagttatagatcggtacggcaaggccaaggaagagcagcaagtcgtcgcaaatcccaactcggagcttaagttttggcaaagggaggcagcaagcttgagacaacaactgcacaacttgcaagaaaattatcggcagttgacgggagatgatctttctgggctgaatgtcaaagaactgcagtccctggagaatcaattggaaacaagcctgcgtggtgtccgcgcaaagaaggaccatctcttgatagatgagattcacgatttgaatcgaaaggcaagtttatttcaccaagaaaatacagacttgtacaataagatcaacctgattcgccaagaaaatgatgagttacatnnnnngatctatgagactgaaggaccaagtggagttaatcgggagtcaccgactccattcaactttgcagtagtagaaaccagagatgttccagtgcaacttgaactcagcacactgccacaacaaaataacattgagccatctactgctcctaagctaggattgcaattaattccatgaagaagagtaaaactgccgtcttatgatgctgaaggaaactatttattgtgaagagatgatactcagagaaagacatatttgtggcagggagatttgagatatgaacttataaatgtaatgcaaataattttcagactggaatggggtcgtggaattcagaggatgattgctttctagttgcatttgatgtttgatgagacttttctcatgtgaaacgtttattaaaacttcaaaatggtgcagatgttgctactacccttgttaggcttgtataaatatttgactttgtgtactagcannnnnnnnnnnnnnnnnnnnnnnnnnnnnngtgataggggacaatgatgcgatctaggagtacaaacagagtctagtttccactcagttgagttttatattgctctcaagcgttatcaagggtttagtaggatacagatataattaagatacagtggttaaatcgc

SEQ ID NO: 2050 - DNA, 695 bp, Zea mays
  misc_feature (671)..(672): n is a, c, g, or t
  misc_feature (677)..(677): n is a, c, g, or t
  misc_feature (680)..(681): n is a, c, g, or t
  misc_feature (685)..(685): n is a, c, g, or t
  misc_feature (690)..(690): n is a, c, g, or t
  Predicted polypeptide sequence is orthologous to G860, G1760
tacgcgggggcgtgcataataaaacctaatcatcggcacttcccgttccgctctttggaaggtggctaggaatggaaccggcctctagtagctaggctatagcttccgcctttaattcccccatcagaccagtcatcgctcgtccccccggccgccggcgagctcttcgtcttcccgtgtgatccttccttcccatccggtccggcctagactagatctgagagacagaaggagggatggggagggggaagatagtgataaggaggatagacaactccacgagcaggcaggtgaccttctccaagaggcggagcgggctgctgaagaaggcgaaggagctctctatcctctgcgacgcggaggttggcctcatcatcttctccagcaccggcaggctctacgatttctccaacaccaacatgaaagctgtgatagaccgatatgggaaggcaaaagacgagcagcttggcaagaacgatgcaacttcagaactcatggtacggtgaggaaaatgtacctatttctagctaactagcagttattggtcgtagtacacacgtgccatatgatgtatgttggtcggaccaagatcagaagtttagtccttcattactcacaaataaatgacattcgttgtgtttagctaatcagcttttcaaaatttttgcgannaaaanaannaaanaaaanaaggt

SEQ ID NO: 2051 - DNA, 854 bp, Zea mays
  Predicted polypeptide sequence is orthologous to G860, G1760
gcatcacatcgagccgggagattggaatccagttgagatttcgctcctctcctcccctcccccgccctggtgagcccctccgggcgacgtgtgtcccgttgcctttccttcgctcgacggccacctgttgccctcgcatggctctgcctgctcctgccaagcgtccaagctcccgctcgcccggcggctgcacgccgcagcgtctatccacccagatccgcacgatccccgctaatcgccgcaccccctacctcccatgcaacttctctagctcacccgcatcccggctcggcactgccttctccttgcacttcacttctgtatctagaccacctcatcacaattcgtcgtcagcgtcgcgccgtcgtctcagattgatgcaaggcgtgatgagaagctagaggcagcaactgcatatattgcaagaaaattgggtttcaaaccataccgataattttcttgcaagttgtgcagttgttgtctcaagcttgctgcctccctttgccaaaactacgaggaaaagcacatgttatattatcagtgaacacatcaggataaatcttaactgatatgtgttggtaatacacacatttaattggaattttgcagcatgatatatacagcagctattaggtaggcgttttgggtttttaggtcccgtttggttccattagtcctaagactaaagtttagtccagaaactaaacttaagttctatcctgtttggttttagagactaaatagattctaaacacattaaatgaagtacacaaagcctaaaatgcccctctccttattgcttgcgtgcggtgcagattctctatgcaagggtaattagtgtaaatgatgtcatt

SEQ ID NO: 2052 - DNA, 725 bp, Zea mays
  Predicted polypeptide sequence is orthologous to G860, G1760
tttttttttttttacctagaaaaccaagaggacttataattcagagtacaatttacaatagcatacatggcaagcttatatgaaaagcaaaattaaaatcaacattcttcttaatacataaacaatcgcatctagcagcttaaagtttagctgttaggtcttgcaattcaaccaacgatatccatttcttatcactcggtttagttatcctcactgtatttaaagtcttatggcactttcagtgttctttattaaatcatctggtttactgactctgagttatcctgaagtttggacaaaaatctcaccctacacttggtgtttctgatttgtccctttgcacacttagctcaagattgatcggaagattctctgtattccgagtactgtgtctaacagtagtacttgtttgctcattatttactccttgtccatacacctttctccgtaattcagtgttatgttgatgaagaaggttaactttgttgtatagttccatgctttcctggtgcatgaggcttcccttcctgtttaattcttgaatctgataaaaaataagttggtcctttttcagacgaatatttcttaggctcgtctccagcttattctctaaattctgcaaatctcccacgttcaggccagaaagctgctgacccaacaactgccgatggtgctcttttaagttatgcagttgctgcctcaagctttctgcctcgctttgcctg

SEQ ID NO: 2053 - DNA, 669 bp, Zea mays
  Predicted polypeptide sequence is orthologous to G977
cagctccctgtcgcacacaccttacgccgggtaggcaggagcaggactcccactgtcccaccgagccagaggccctccgatccgagcgagcaggggcgccaccgtctccaatggctcggccacagcaacggtaccgcggcgtgcggcaacgccactggggctcctgggtctccgagatccgccaccctctcctgaagacgaggatctggctgggcaccttcgagacggccgaggacgcggcgcgcgcctacgacgaggcggcgcgcatcatgtgcggccctcgcgtgcgcaccaacttccccgaggacgccgccgccgacggacaggggcagccggccgcgacggcgcttctctcccccgcgctcgtcgccaagctccaccgcttcaaccttgcgtccgtgcaggcggcgcgcggcagggccgatgactccgcggcagccgccgcctcggcgcccgccgtgctcgcacgcatcgcgccgatgcctgccagcaatgccagcatgcgaatcgcccccttgacgtcggcggctgtggctgccgggcactggagcggcgactttctcgaggagcagtacgtggaccagatgatcgaggagcttctagactccaacttctctgtggagatcttactagttttcccccgacccctctgctccgtctcatctctct

SEQ ID NO: 2054 - DNA, 979 bp, Zea mays
  misc_feature (568)..(572): n is a, c, g, or t
  misc_feature (751)..(755): n is a, c, g, or t
  misc_feature (783)..(787): n is a, c, g, or t
  misc_feature (803)..(827): n is a, c, g, or t
  misc_feature (841)..(861): n is a, c, g, or t
  misc_feature (912)..(919): n is a, c, g, or t
  misc_feature (963)..(977): n is a, c, g, or t
  Predicted polypeptide sequence is orthologous to G1020
gcacgagaaccgcctcgctgaaccggaagacccgcacacacacgccacttgtagaccatggcgccccgggtggcggacaagtcgcctctaccgccggccaccggcctggggctgggcgttggcggaggagtcggaggcgtgggcatgggcccgcactacagaggcgtgaggaagcgtccatggggacgttacgccgccgagatccgcgaccctgccaagaaaagccgcgtgtggctcggcacgtacgacacggccgaggaggccgccaaggcgtacgattccgccgcccgcgagttccgaggcgccaaggccaagacgaacttcccgttcccgtcccagtgctccgtcgcctccggtgctgccggtagcgccagtagcaacagcaccgtggattcgagcggtggcggtagcggctgtggcatccaggcgcctatgcaggccatgccgcttcctccggctctcgacctcgacctcttccatcgggcggccgccgtgaacgcagtctccaccggcatgcggtttccgttcaagggctatcctgtcgcctgcccgacgccacagcagtacnnnnnctacgagcaggcggctgccgcggcatccggataccggatgctcaaggtcgctccaccggccgtgactgtggccgcggttgcgcagagcgactccgactcgtcgtctgtggttgatcactccccttcgcctcccgcggtgacggcaaacaaggtgggcttcgaactggatctgaactggnnnnngccggcagagaactaggcaggccggagnnnnnggctgacgacttagtnnnnnnnnnnnnnnnnnnnnnnnnntcaggaatgttacnnnnnnnnnnnnnnnnnnnnnatggctgtattcttgttctgtagactaagagatggggagtcttgtaaatannnnnnnnccgtcgagacggaaatgaactgagatctgttcgtctgtctgatnnnnnnnnnnnnnnntc

SEQ ID NO: 2055 - DNA, 493 bp, Zea mays
  Predicted polypeptide sequence is orthologous to G1020
acgcttccctttcggcagcatccccgttacgcacccgtattacttcttcgggcaggccgcagcagggtgccatatgctgaagctgccaccgacgacggtgactgtggctcagagcgactcagactcctcgtcggtcgaggatctgtcgccgtcgccgtcgccgtcgccgccggccgccgtgtcagcgacgagatccgccttttgatctcgacctcaactgcccaccgccggccgaggcggaggcatagtcgcggagttttgctgaatgactgcctgtagtttcttcctttctttcgtcttttatccgtagagagaatcggtaggcttaggacccctttgtattcacacggtgtcacggccacacctccgaactctggtactctgatatttagagtgaaactacgaacacgtggttcaaagttaactctatatggtttatagtcatgagaaacggctaaaaaattctgcagctaacagaaactatttatttcct

SEQ ID NO: 2056 - DNA, 455 bp, Zea mays
  Predicted polypeptide sequence is orthologous to G1020
tcggccgccggcgccgtgggagctgcggcggaggcggagggagccctgtgccgcggcgcacggaccgcagcgctggggaagttggtgcgggcggtgggcccgcggagagatcgggcagcggcgtcgtaggcgtgcgcggcggcctcggcgcagtcgtaggtgccgagccagatcggggtcttcttggccgggtcccggatctcggcggcgtagcgccccgacggccgcctccgcacgccgcggtaccgaatctccggcgacggcgagggctgctgcggcggcggcttcgcccggcgcatcgcggacggagagggggtggggcgctcggcggagagcgcaagcggggcgggtctcggctagggtttggccataaatttatttattttcttctctccagttctggtttctccccgattttttgatcttcttttccgcttcggttcccccaacacaat

SEQ ID NO: 2057 - DNA, 428 bp, Zea mays
  Predicted polypeptide sequence is orthologous to G1020
caaacatatcctgataatgagtcattacaatatttgctaagataaaatgaacgcactgtctcccagagttgatattacaaatagaaatcaaaaaaacctgaaatggattaacaagtccatgaacggagatgcatattcttcaatattctgcccgtgggagtaggatctcgtggcgtccagaatggattaataagcaaacaagggagtatttgacttcacttataacctcagcttgccgccgccgccgccaagggagtgagggcctgagggagagccggagagggtcggccgcctgcacggctgcactgccgacctggcctctggcggtctgccgccggccgtgagcccgtgagccgtgacggcctgcactgccgcctgccagtctggcgcctggcggtctgccgcccgccgtgagcacgagacaggga

SEQ ID NO: 2058 - DNA, 1002 bp, Zea mays
  Predicted polypeptide sequence is orthologous to G1020
gcacgccgtataagcacaaccaccaccaccaccgcctggccgtacctttacacgctcgcctccttccatggcgcccaggaacgctctccccgccgccagcgccgtggccaacggcatgttgatggagccgaggttccgcggcgtccggaagcgcccgtggggcaggttcgcggcggagatccgggacccggccaggaaggcgcgcgtgtggctcggcaccttcgacaccgccgaggccgcggcgcgcgcctacgacgccgccgcgctccacttccgcgggcccaaggccaagaccaacttccccgtcgcgttcgccgcgcttccgccgccgccgccgcccaagaagccggccgccgtgaccgtgagccccagcagcagcagcaccgtggagtcctcctcctcctcctcccgggactcgcccgccacgccgcccaggcccgcgtctccgtcccagcaggccccgtcgctcgacctcagcctaggcggcacaccggccatggtggccgcccagccgttcctcttcctggacccgaggctcgcggtgaccgtggccgtgccggcgcccgtgccctaccggccgaccgcggtcgccgccggtgccaacaagcatgctgcggcatcctgccgtgaagaggagcagagcgacaccgggtcgtcgtcatccgtggtggacgcctccccagcggtcggcgtggggttcgacctcaacatgccgccgccggccgaggtggcgtaggtggaccgaccgccgcagcgcccggtgacacgagacgagacggctccgagaggtcgcgtagatgattagaaacaagctgtattagtacgaggttgggttcaatttgccgcgatgggttactgctagccaggtgtacatagacctttttgcatcggcagctaatacctatttgccgatgttacaaaaaaaaaagagcgaaacgttttgtagttcgttgtaatataaaaaaaaaaaaaaaaaaactacgagggggggcccggtaccca

SEQ ID NO: 2059 - DNA, 1086 bp, Zea mays
  Predicted polypeptide sequence is orthologous to G1020
gcacgaggctccacgccacccaacacatacaaacacacgcacgcgcgcgcgcgcgcctcccgctgttccgcaaaacaaaggaaacgaaggagaggaggccatggcgccgagaacgtcagagaaaaccatggcaccggcggcggccgctgccacggggctcgcgctcagcgtcggcggcggcggcggggccggcggcccgcactacagaggcgtgaggaagcggccgtggggccggtacgcggcggagatccgcgacccggcgaagaagagccgggtgtggctcggcacctacgacacggccgaggacgccgcgcgggcctacgacgccgccgcgcgcgagtaccgcggcgccaaggccaagaccaacttcccttacccctcgtgcgtgcccctctccgcagccggttgccggagcagcaacagcagcaccgtcgagtccttcagcagcgacgcgcaggcgcccatgcaggccatgccgctcccgccgtcgctcgagctggacctgttccaccgcgcggcggccgcggccacgggcacgggcgctgccgccgtacgcttccctttcggcagcatccccgttacgcacccgtactacttcttcgggcaggccgcagccgcagccgcggaagcagggtgccgtgtgctcaagctggcgccggcggtcaccgtggcgcagagcgactccgactgttcgtcggtagtggatctgtcgccgtcgccaccggccgctgtgtcggcgaggaagcccgccgcgttcgatctcgacctgaactgctcaccgccgacggaggcggaagcctagtcgtcgaagcttttaatgactgtctgtcttcttagttctttcttctcctttttctcgaggaaaattcggtactactaagctgagagacgctctcctccgacagacgacgtcgacgacgggcatttttgtaaatagtttttgcgccgggacctttttagtttatgatgaaagctgtattgtcaccgaagacaggtcctgccggcgttgttatggcccggattactatattatattatgcactactagtaaaaaaaaaaaaaaaaaaaaaaactcgagggggggcc

SEQ ID NO: 2060 - DNA, 480 bp, Zea mays
  misc_feature (452)..(452): n is a, c, g, or t
  misc_feature (456)..(456): n is a, c, g, or t
  Predicted polypeptide sequence is orthologous to G1038
tgcagcgtgcccctgtattgagagagagagagaaggtcactctagtgcagggggacgaatagagggtaccgatgcagtggatagcagtctacagttacctctaaatggagggagggggaagcaaaccgcaaccgttgcagacagtcttatacggaaacaagggccccgtgacacaccgaagctgccaaaaccatgcgtgcgatgcacatgcaccacacacgagtgtcgtcacgtactgtgcacacgcactattctgtacccatatcacacagacacgcgcgcatcagcatcaccaccaccaacaggcagcacggtagtatcagctcttccctggtccatgatgcttttgctcttcgttttttttctccttccccgcatttccttttcctttttagaccatgtaaatgatgtttaatacagagactctagaattgtttaaaaatgtatttgcnaaanaaaaaaaaaaaaaaaaaaaaaaaa

SEQ ID NO: 2061 - DNA, 566 bp, Zea mays
  misc_feature (510)..(510): n is a, c, g, or t
  Predicted polypeptide sequence is orthologous to G1063
tttttttttttttttttttttagctagctacccagaatgattaaattacgatcagatcaaaattacctctgatctctctatagttcatcatctccatccaccaatccatcgatccaccaccacaccacgccaccattgatcgatagagacagactatattgattcctagctagttaatccgatccggtacaaattaaggaaaggaaaggaagctcctaccactatcgaatttcctctcctcgctcgatcgctcagtgcattccatggctgctctggccgccggcgctgctgaacccgaaccctagcgcggcgtgggcgccggcgccgcccatggacgacgaggacgatggcgacgtcggcccgtggatgtcgacgggcctcacgagcccggcccagacaatgagcggcaggccgcccacggccgagacgctgggcccggctcctgctccggcggccgcgggcgccgggggctggagctcctgcacctggcgcttgaggaacttgatgtancggatggcctggtcgagcatggaggcggtgcccatcttggtgccgtcgggcacgaa

SEQ ID NO: 2062 - DNA, 615 bp, Zea mays
  Predicted polypeptide sequence is orthologous to G1063
tttttttttttttttttgaagaaacactgatggatatatagagagagagagagataaaaaaggggtagtacaatgtaaatgtacagcctacgtagggtagaccagcacgtacacgtactcatcgatcacgcgcatgcacgggctgcgactccaacaaaaaattggagcagccacgtcgtatgccgtatgcggctacagcaggcaataaatgtatcaaggatcctacgtctttacacaggcatgcgatcatgcgctagctagttcacgatgcagtgcacacacacacagacaacgctacaagagcatcggcagagaggccggccgtacgtcgtcgtcgtcccgtcgagacgccaacaacggagagcgctggccggccggccggccgaagcgctagcatagctcgatggtaacgatcgaccggcacgcgcgcgcgttcgtctgtcgcgcgcgtcgcgttacatgtcgccgtggggcagcgcgtactgccacggcgcgtggaatgccgggtaggcggcggcgccgagcgcggcggctctgtgggctgcgcgctccatggactgcacctgggacttgaggaacttgacgtagtggatggcctcgttcagcatggacgcc

SEQ ID NO: 2063 - DNA, 680 bp, Zea mays
  Predicted polypeptide sequence is orthologous to G1063
gaccaagtgctggctagctagctgtatatagctagtagctagaatgattatattatgattgataaaatccaaattacctctgatatgatctctagttcgtcatctccatccctccctccatcgatccaccaccatctatcatggatagattaatggttcctagttaatcccatccgctacaaattaagcaaaggaagcaccttcaattaatcccccctccttggtcgctcgctcatcagtgcattccatggctgctctggccaccgccggcgctgctgaagccgaagcctagggcggcatgggcgccgcccatggacgacgaggacgaaaacgacgtccgcccgtggatgtcgacgggcctgacgagcccggcccagtcaataagcggccctggacccagcggcaaaaacggcggcacgccgccgggtcgccctggcgccgccgagcccacgaccgaggtgctgggcccggctccggctgccgccgggtactgctggtgctgcggctgcggcggttggtgctgcacctcctgcacctggcgcttgaggaacttgatgtagcggatggcctcgtcgagcatggaggcggtgtccatcttggtgccgcccgggacgaggcgctgcaggatgcggatgcgctcgctgatccgctcgcgccggtgccgcgccgccccgctctga

SEQ ID NO: 2064 - DNA, 1326 bp, Zea mays
  Predicted polypeptide sequence is orthologous to G1108
ccacgcgtccggcacaacccttgctgccgtcctggtcgccacacggccacaccaacccaacacctcttcttcctccgctctcagcttaccccaccacaggcgagggaggcgactccttcctcgcggctgcccgctccggccccgatcgcatctcctttgcacgccacggcccgcggcccgcgcgcagtgtccatcggcacggccgtcctccgtgtgtgggggcgcatctggtgctagcttgccgggctagggtttggcttggcctcgtctaccgccccgtctcgtctgataggcacaggttccgtgcacgcgatcgtcgtctctccatccgttgtgactgcttgccgtcccccgcttgcttcgtcctgctacgggagggccactgctgccatcgcgtccaccgacgaatttccccacagagcattagagcaattatcttggagttgcagatctgtacctgaagattcatattgaaatctggaagcttctgctgttgagtacagagaaatatttcttgccttttgaggaagactgcagagcccctaaatgtgaaacttgtttcttttcttgtctactcctgaatgctgacgaactcagcctctcacgttacttagctgaaggtcgtactggtacagacaccgaggatggagcaagcaacaggtgtaagtggtcctgaacacataattgatattccaagggaaattggtcctcctgcttcggtttctcgtagtgctggtagagagaaccatgaagaatcgaatcctgtggacaggccttcaacaagagctctagtacctgccttgcaggcaccatcagcaataggtgctgtacctattacagggcatacttcaggcactaggagaaatgacaactatgttcgtcggcacagaagcccattgaattctggactgtggatttcaattgaagttattgttaactttagccagattgttgctgccattgttgttctttgtgtgtcaagaaaggaacacccacaagctccattacttgagtgggtcataggttacactgttggttgttttgcaacgttaccccatctctattggcgctatatacaccgtaatattgtaaatggtgagcatgagtcatcacatacacctcaagggtccgctcataacaactcaaatgaagcgactcatgctgcaagtgcatcagaacgccgcagaaatgctgcccgaaatgctgtgcttgctaatcctaggatcaatgcgctgtttgaccacttcaagatggccctggattgtttctttgctgtctggtttgttgttggaaacgtgtggatatttggtggccgtcttctgctgc

SEQ ID NO: 2065 - DNA, 1181 bp, Zea mays
  Predicted polypeptide sequence is orthologous to G1108
gcacgaggcaactgtggggaaaacactgatgctgtaactgctttggagctccttgggtaaaacctccatcttctcacattttgttccatttgagtttgctccagcagtccagctccatgtaccaacttgcgttttggtggaatccagtttatcacaaactgtgaatcagttcatgaattctggtgacagtgagtaataccttgtactagtctgtccttgactccttgtattcttttgaaactgtgattagtaccctgttatttcacattattggtgcttctaatcatgagtacatttaacgatagatgttcatcaatatttctgcacattaccactagctaaaatgtgaaagatattaagaggttcttggatgtcatctagtagtggctactgccatttctcactattcttttctgacctagtagtaatttggtattttgtctgtgcacatgataattagggactaatattgcaaaatgggacagcttgtttgcatgtttcaactccatttcaaagcattgatatttattcagcaactgatcactcttttagagtagtcaatgttgtattctggattttctacttgatcatttgttagtgagctcactcatagcagatcttacctttagttaatactccattccaaattataagttgttctggctttttagatacatagcttttgctacgcacctaaatacatattatgcctagatatatagtaaaagttgtgtatctagaaaagccagaatgacatattttggaacagggggagtagtatagattcaatcacatagtttttccctcttccatagcatgttaaatgtaacatctaataatattgatgcaggtgtgctgcatctgtcttacgaagtatggagatgatgatgagcttcgtgagcttccttgcacacacttctttcatgttcaatgtgtagataaatggcttaagataaatgcggtgtgcccactctgcaaaacagagattgggggtgtggttcgatctttctttggcttgccatttggccgccgccgtgtcgataggatagcggcaagaggtgtagctagctcaagattcagtgtatagaacaatgctgtttttccgcataaagagctctgctctgttgcaatggtttaaaaaaaaaaaaaaaaaaaaaaactcgagggggggcccggtaccc

SEQ ID NO: 2066 - DNA, 828 bp, Zea mays
  misc_feature (728)..(728): n is a, c, g, or t
  Predicted polypeptide sequence is orthologous to G1108
tccacttcttcctcttggtctggttcgggcagagcatccgcacctgctcggccgattaccccggcgttttctgttccctttcaccccgcgtgcgggcgctatccttcccgtggcgacgtctgggtgaccgctgccgcagccctacactaggttcctaggtattcgccgggcccttccccggcgacgagcacccaccatcttaggctacctctgtggggatcttctgtgaagcaagagaagttacctagcacacaactcaaagttcagtagattattgaggatcaacatttcagccatctgtatgttagttaatatgatggccgatggtaacatctggttagaaagatagaaactcattattgcgctacatatggtagtgcccattcgacataagaactaagctggacattggtagatccaagttattaatggcgcacacttcctgtgatggtgtacatcatgttataagtgtagcacatggggaaactgcatcaacatcaaccagtcatcaagatatgtgcagtgactcggatgaaccacatcaggaagataggctatcaacaagcacacaaaccctgtcatcagagtcttcgccatcaatatcaccaactgcttatagcaccagaaatttatcttttcctagaagagatagtatatatggtcatggaagaagtccatggaattctggtttatggatctcgtttgaaattgtcatgtacattgctcangttgtagctgctattgtcatcctcatcttttcaagacatgaacatccccatgctcctttgttcgcatggataattggatatacacttggctgcattgcta

SEQ ID NO: 2067 - DNA, 911 bp, Zea mays
  Predicted polypeptide sequence is orthologous to G1108
ggaaagaggaggaagaattcgagtccaagtcttggagctctcgctttaggcggccagggtggaactgccccttgcccgtggttggtgaggcgattcgtggtcgggagcttccgtttctcttcggaggtgaagtggatctgacctactgtaggggaaagagcaaagtacattatcttgtacaaatgtgcattacgctacctttatcataaaccaaatcatctctgtttctgggaacagcaaccagtaatttcccatgcaacctcttggttgatggatgttcttcctgttgggtcagaaagagaaagtcaaacagatagtcaccctttactcatggagcatgcgattggcatcccaaggcatgatgttgcttctacttcgacacctcatcgagacaataatgatggcatggatcaactgccccgtgattcagaaagttcttctggaacaactgatgcatcttactctccgaatgctcctctagcaaggagagatgataatcgccttcggcgtcagcaaagtctaaattctggcttctggatatcaattgaactagctgtaaatcttagccagattatagctgctatctgtgttctgtctgtgtcaaagaatgaacatcctcatgctccattgtttgagtgggtcattggttatacaataggctgcattgcaactcttcctcatctatactggcgctatctccagcgcaaccagctggccactgtgctagggtcaaatcagaactacgttccagacaacagctttgagagtagttcttttactgggatttcgccccctcctgtgtctgaagctggtgttgtaactgtatcaaatggagtcttgagaaacaatgtggttatcacaaatccaagggccctagcttttgctgatcacttcaagatggcgctggactg

SEQ ID NO: 2068 - DNA, 864 bp, Zea mays
  misc_feature (823)..(823): n is a, c, g, or t
  Predicted polypeptide sequence is orthologous to G1108
cgccgaggacgaggaccccccgacaacttacccggggggcagctacatttatacaaagtcgacgacggcaagaggataaacgagtcgaggagaaaggaacaaccttaaccggagcccccgttcccgctaggtagattaaaagttatctcaggtgcttcactaggaaaaaatgaagtaccttagttaagttttgtaacaaggatatttgatcagtgcatgtcaaaggagggtatcaaaccaacgtgtcatatgactgtctagcttatgaatgttgctcctgttttatcacccctgaaggccaagcacacaatcatcctttattgatggctcacactggaaacttgagccagcgtgatcacacaatcgatataccaatgagtgatggtatgaccgcatcaacatctcaccaggatgatcatagtggctcggatgagctgcatcgcagcagaggtccttcgaatgaagtttcaccaagcccagatacatcttccggtacaaacgatgtatctaactctcacaatgcatcctcagcaagaatagatcgaggccaccgtcaacagaaccctttgaattctggcttctggatctcaatcgaacttattgtaaatcttagtcagattgtagcagctgttgttgttctgtcagtatcaaggaacgagcacccacaggctccattgtttacatggcttcttggctatacaataggttgtattgctattcttccgcatctttactggcgttatcttcaccgcaatcgcctagacatggagcaggagatgccaccccaaaggtcgccaggaatgaacatatccgagattaattnctatgctgtcgtttcatctcctcatgcatcagaagctgtgg

SEQ ID NO: 2069 - DNA, 791 bp, Zea mays
  Predicted polypeptide sequence is orthologous to G1108
cacggattgatgtgctcttttctatatatcatggatagatatatttgtatgtgcacttacagtcacccggtcattattgcatcgatgttacagacacccgtgtgcataagtacatctctcgaacagaatggaactgtaccttgcaggcatgtaccaaggacctagcatatatatacatgaacctatgcaatgtacaaggtaaaccattacaggagctgcagcggtgccaccagctgatcaggtaacattttctatacaaggagacaatcaccaggcaaatcctgacagcaaggaggttagcaacatagcatcaaccaccaacacagtggggtcatcttaggtggccaccactaccagcatccatggttcctaagcgaaaatgtttcggccaagaacaatgttgaacacactgctctgcactgaggcaggaaatactatattggtaagatgaaacaaaaccatcaggaaaaaagaggacttgttggaccatatagtgtgtaactttcctacttgtagtttgttatatgattgtcagtttaattagaccgcatcaaagagcccctccgtcatcttcatgctcattggaaaggccaagagagcagacaacaactaccgttgtgactccacgtcgttgtctactctattgttgttgttgtcgggatccacagagccactctctggattacttgttgcttttgatccccctatctcagccttgcatagagggcacaacgcgtttatctggagccatttatctatgcattccatgtggaaaacatgtgcacagggga

SEQ ID NO: 2070 - DNA, 828 bp, Zea mays
  Predicted polypeptide sequence is orthologous to G1108
ctaaatgcgtgatgtgtctgctcggatccaatccgcgattggtttttgtcatggctcactcgcgtgttgctcgcgtcctggccttgccaaaccctctccgccgcggatctgcgcgacccggtaatgtccgtcgtgatctgctgccgccatcaacgccctactcccctcctagatcccgtgatctgctacgaagctgccatcaatgccctcctcccccttcgctcagctccccctcgcgccttcgatccgctaccgtgacccgctgcgaggcggccatcaacgcccatgtcctccttcgcgcagctaccttcccaggatctcgggcgctccttcgtcgccatactttttggttcagcgggacgcccagcccgtagatcgttgccctcaagaagtaatagtccatacaatacctggactcggcgcatgaggcctaagcttttgctgatcacttcaagatggctctggactgtttcttcgctgtatggtttgttgtgggaaatgtgtgggtgttcgatggacattcttccgcccatgacgcacccaacctgtacaggtgtcggtgagaggtattcaagttggaattggaattgtaggttatagtccactagaagaggttttttttgtgcagtggagcaaaactagctgactcgctgtcagagcaagacttccgcaaggggaactcaaactattacctatatgtgcataatacatggttcaactatccttgcttttaaacatctccttgatctttgatacattttttggattttgctcaagtatttgacatatacaagggtcccatccccgatgcttggagcaaactgcttg

SEQ ID NO: 2071 - DNA, 800 bp, Zea mays
  Predicted polypeptide sequence is orthologous to G1108
gacaacaacgacacatttttcagtcaggcgattacttgctggatcatgtaaggactcgttggtccatgacataatctctttctctctctcactatataatttacaaggtgctcttctggaagccacacacacgcccaaggcaagttgctgtctcactatacatcatggaagccgttgtgattcaatgtcgtttcctaccctcctgtggctgtcgcggcgcccaaagccaatggctggaggagcggtcctcgggacgacgtcgatctcagctttgcagagtgggcacagcgcatttatcttgagccatttgtcgacacagtccttgtggaagaagtgcccgcaagggagcaaccggagatcatcgttatccacgtacctcgccaagcagatacagcaaacggcgtcttcagcagaaacagcgcgttccttgtccgttccaggagcaaagactccaccgccaccttcgtttgcctccccgttacgaggcttctttgacctgaacctgtatgtgcccagggcgttgatcgcatccgaagtagcacctctgttttcgtccagatcttcccggaagcccatcagggagattatgcagggtaagcagcagcatatcagcgcgcagaggatgaagggcatcgcatagccaatgcagctgaaagtgaggaaggctatgcacaacctgtacaggttgggtgcgtcatgggcggaagaatgtccaccaaacacccacacatttcccacaacaaaccatacagcgaagaagcagtccagcgccatcttgaaatgatcagcaaaagcttggg

SEQ ID NO: 2072 - DNA, 840 bp, Zea mays
  Predicted polypeptide sequence is orthologous to G1145
aactccggttaccaaagaaagggctcccatacttctcatagttatatgtatccatctgttaagtcacaccatgtaaacaagctccgaccacctacatgtgtcctgaagattttacatactatactggtagcaaggcctcggacagcacatgctcggctcctgctagtctagagaaagggagggagggagagagcaaaccatcgagctaggataaacaaaaactcccaagctagcaaatgattctaaaccaaagagacaaaaaaacttacaagctacaggacttacaacctacagcaaaacaagatattctgcatacaatcagaaagtcgctgagccggttctcctcagttggtacttgggttccggaagaggctcaaagaaaagtatattttccaactcctttaacgtggttagcttcttattctcctcttctaatcgagaaaccttgttttccagttcattagtgtatgcctgcttcctagcccttgaacgagcagctgactccctattcttgatcatcctcttctgccttctctccaccaacttatcagccacatctcctggggaaccacgctttctaccaggcatcggagaatcagaaagtgcacccatcatcggtgaagaaatgtggccatcagagtatgactccaaaatagcacttggtccaacattcagggactgaaggcttaactgacccggtatgtaagcacctggcaaactatgttgcctgtgctgatggggctcgatagctgtaatccgctgctgatagtggtctaaccattgtgcccctgctgtcaaacccgcagccccagtgctaccaacctgttccacactgcctat

SEQ ID NO: 2073 - DNA, 885 bp, Zea mays
  Predicted polypeptide sequence is orthologous to G1145
cgatggtttcctcgcacacccatcacatggccgcctcctccccttccacctcctcccctaatggcagatgctaggcggcggcgcccctcttgagaagtgaaagggaaagatttgttttgccgcccgcgccctgctcaggcgctccgcctcggtcgggccacacaaggtagcgccttccgcctcgttgcctgacccattcctgtttcgttcgaagcactgaagcagccccagaccgacgccaggcgcccaggccagtggtcgacgcctgtggtgagctgataggcgatgtcgtcaccgtctccggtgctggcaagggctgcgcgtctcacgtgtaggttgtgatctttctgcccagagatgtgcgatttgtcttcgcttgatctgagtgacagtaaaacggagaccggctagtgttgttcctgaaacctgttgatttatggggagccagacaatcgcatcacaggctgggggaggtggaagaggcatgggtagtagtggtggtgccggtgcagcgcaacgcgggcagatgcagagtctggcaagacaagggtctctgtataaccttacccttgatgaggtgcagagccatttgggagaacccctacacagcatgaaccttgaggagctgctgaagagtgtctttcctgatgacctggaccctgatggtggcactaccagccaatatgagcagagttcgggcctcttgcgacagggaagtatcacaatgccgcctgagctcagcaggagaactgtggacgaggtgtggaaggacatccaggatgcaccaaacagaaatgttggggagagtggtcggcggaagcgggagcggcagccaacgcttggagagatgacgcttgaggatttcttggtgaaagctggggttgt

SEQ ID NO: 2074 - DNA, 815 bp, Zea mays
  Predicted polypeptide sequence is orthologous to G1145
gtgagtctctctcctcctcctctgcttccttcccttcaccgcccttcttccctttttggaccctcctcctctcttcaacctcttgcggctgtgccaatccccccctgttctctgattgatccatcgatctggtccctcctcgtccccccttcccctccccttgcttgcttgcttgctcaggtaaaaaaaaaggagcaggaggagctgctgcactgcacaagcagaacccctcccctctctttgttcgcaagattctccctttcttgtcatatgccccgcaaaggttttgtttccactgtcgccgctccggccgagcaaagcacctgctgttcttgccacttccgatctctgcgtgcgcccgcccgccctctttcacgcccccccaacccccacccccacgggcgcatttgatttctttgcaggtgcagccgtgcaggtgaggtgatcgcgcgtggatgggagttcagacaatgtcgtcccactcccacggcgacgacggccgccgcggcctcccgcggcagggctcggtctacggcctcacgctgaccgaggtggagacgcagctgggcgagccgctgcggaccatgaacctggacgacctcctgcgcaccgtgctcccggcggcggcggccgtcagccctccatgggcgagatgacgctggaggacttcctctcccgcgccggcgtcgccgtcgatgccgccccgcattggatgcaccagtacccgcagcagcagcagtacgcgctgccgcggcccctaccgcttccgggcccggctctggacgccgcgtaccacggcgaccggccaggtgttt

SEQ ID NO: 2075 - DNA, 707 bp, Zea mays
  Predicted polypeptide sequence is orthologous to G1145
acctgaataccttctcgtataaggaagctctcaaacttaaacatgtgtctagaaaatgtacacactgacagacaccaaggaaatgatccgccaggacatgctacagcttgctagcgacctacatacactgacctaccgggccgggaaaaagctataccctcaatctatcaaatgtttctaatacaaaaggaaggaaaccatataaagtaaaatccttgtataatgtacaaaaatcactatgagcattgtcagcgccgaaactcaaaaggcagccgaacccgttctcctgagttgatatttgggttctgggggaggagcaaaactcagtatctcatccaactcctgctgtttctttagcctcttattctcctcttctaaacggaataccttgttttcaagttcattaatataagcctgctttctcgctcttgatcgcgcagctgattccctattctttatcatcctcttctgccttctttcaaccaccttatccactacctcccctaaggcaccacgcttgcgcccaggtgtctgagggtccgaaagtgcaccaaatgatggcgaagtaatctggtcatcaaagtaaattgaatccaaagtaacacctgtagcaatagacaatggctgagggcgcaactgactagccatgtatgaacctgccaaactcaattgctgggaccccaaaacttgctgctggtactgttgca

SEQ ID NO: 2076 - DNA, 860 bp, Zea mays
  misc_feature (727)..(727): n is a, c, g, or t
  Predicted polypeptide sequence is orthologous to G1145
cacccagcgtgctctctctccctctttctctctctctcgtggcggcgcctgggcagccgtcgctgccgcctgcgctaggtgccaggtcttcttcgggcccttcgccggcgacgagtaccaccaggttgtacatgtatacacccatgtgctttactgggtcggaccctactcatcctccacactaaggccatctccatagactgcactgtttagactccactgtttagagagtggagatagggagtgagatagagagtggaatagggaggatgctggagatagcctaaggttgccactgagtgtgtgcatgattcagaggcaatgtcatcacaaactggaggtggcaaagagagtgacgccggccctgggcaacacaggcagatgcaaagtttggcaagacaagggtctttatacaaccttaccctcgatgaggtgcagaaccatttgggggagccattgcttagcatgaattttgatgagctcctgaagagcgtgtttcctgatggtgtagattcagatggtgctgtcacaggcaagcctgatcggacctcgagcctgcagcgacaggggagcatcctgatgcctccgcagttgagcaagaagactgttgacgaggtgtggaagggcatccagggtggaccagagaccagtactgtggtggatggtctgcagaggcgagagaggcatccaacacttggggagatgacacttgaggacttcttggtcnaagctggggttgttactgaaggacttgtgaaggattcagctgattttccaagcaatatggatacagctggcagcagtgttgttgtggctgctgcttctagtttgaaccctggagcacagtggttgcaacagta

SEQ ID NO: 2077 - DNA, 657 bp, Zea mays
  Predicted polypeptide sequence is orthologous to G1146
tttttttttttttttttttcggaaagacttggatcgttatatgaaataaatgcaactcaaacgtgagcgtgttaatgcagccttgttcaggcttgttataataaataatgcagcagccttgttcagtcttcaaaagagcaaagccttgttcaggaaaggggttcccgtgggcaaggactagcagtagaacatgagccttctcagttcacccttgatctccggaagcggcttcggaccagcagcagcagcagcagcagagggagctgatgaaccataagagccgacacttgtcgccgcatcagagtcttggttgacgtaaaagcgggcgcggaacgctaacttgtgggcgtagtatgctgggggagcgattgacacagagcgagtgcagcttgaatacaagaagcataggttatatgtgagagactgcagcgcgtctgcagtgaagttgttgtcgtctctcaggacatgggaatgcgcaggacggctagttcccttgatcccagcatgggtgcgcaggaagaaatcaaattctgttgggtggcagatatccttgtcaacaacagtgccaggtagaatatttccactcttgtccgcccattggcgatcatttgggttgtttgggaagagccttgtgtggtgcctcttctgcaccactag

SEQ ID NO: 2078 - DNA, 2419 bp, Zea mays
  misc_feature (284)..(289): n is a, c, g, or t
  misc_feature (380)..(385): n is a, c, g, or t
  misc_feature (839)..(843): n is a, c, g, or t
  misc_feature (995)..(999): n is a, c, g, or t
  misc_feature (1337)..(1341): n is a, c, g, or t
  misc_feature (1381)..(1385): n is a, c, g, or t
  misc_feature (1587)..(1591): n is a, c, g, or t
  misc_feature (2183)..(2188): n is a, c, g, or t
  misc_feature (2344)..(2349): n is a, c, g, or t
  Predicted polypeptide sequence is orthologous to G1146
gcacgagatcaaatttgctgctcgcgctgatctccaccatttggctatgtttcttgctgggaggcagccagatgcccctcaagaggctcttcaagtacttgacatcgtgctacgtgaaatgcctactgccaagtattgtcctgttggtagatcattttattctcccaagttagggagacctcagcaacttggtgaaggtttggaaacttggcgtggtttctaccaaagcataaggcccacacagatgggtctttctctgaatattgatatgtcctctactgcannnnnngaggccctccctgtaattgattttgtttctcagcttcttaatagagatatctcagttagaccattgtctgattctgatcgcgtgaagattnnnnnngccctacgaggtgtgaaagtggaggtcacacaccgtggaaacatgcgtaggaaatatcggatatctggccttactccacaagcaacaagggagttatcattccctattgatgatcgtggtactgttaagactgtggtgcaatacttcctggagacttatggtttcagtattcagcacaccactttaccttgtttgcaagtgggcaatcagcaaagaccaaattatctgcctatggaggtctgtaagatagttgaggggcagcgctactcaaaacgacttaatgataaacagatcactgctctactgaaggtgacttgccaacgtccccaagcgcgtgagaaggacatcttggagactgtgtatcacaatgcctactccaaggatccttatgcccaggaatttggtataacgattgatgagcgtcttgcatcggttgaagctcgtgttctgcctnnnnnaaggctgaaataccatgatagtggcagagaaagggatgtattgccaaaagttggccagtggaacatgatgaataagaaaatggtcaatggtggtagagttagcagctgggcatgcattaacttctcacggaatgtgcaagatggtgctgccnnnnntttctgtcatgaattggctttgatgtgccaagtatcaggaatggattttgtacttgaacctgtgctgtcaccttgctatgcaaggcctgaacttgttgaaagagcactaaagggacgctatcaagatgcgatgaacatactcgggcctcagggccgagaactcgacttgctgattgttatactgcctgacaataatggttctctttacggggatgtcaaaaggatctgtgagactaatcttggattggtctcccaatgctgtctgactaaacatgttttcaaggtgaacaagcagcagtatcttgcaaatgttgccctgaaaataaatgtgaaggttnnnnnaaggaatactgtgcttgttgatgctttggcaaggagaatnnnnnttgtcagtgacatagcgactattatctttggtgctgatgtgacccatccccatcctggggaagattctagtccttccattgcagctgtggttgcttctcaagactggcctgaggttacaaagtatgcaggattggtgagtgctcaagcccatcgtcaagaattgatacaggatcttttcaaggtatggcaagatcccgaaannnnnactgtctctggtggcatgatcagggagcttctcatatctttctggagggcaactggacagaaaccaaagaggatcatattctacagggatggcgtcagtgagggacaattctaccaagttctgttgtatgaacttgatgccattagaaaggcctgtgcgtcattggagtctgactaccagcctccagttacttttgtcgtggtccagaagcgtcatcacaccaggttgtttgctaataatcacaatgataatcgtgctgtcgataaaagcgggaacatactgcctggcaccgtggtggactcgaagatctgccatccaactgagtttgatttctacctgtgcagccatgctggcattcagggaacaagccgccctgcccattaccatgttctgtgggatgagaacaactttacggctgatgggttgcaaactctcaccaacaacttgtgttacacgtatgctaggtgcacacgctcagtatcgattgttcctcctgcatactatgctcacctggcagccttccgagctcggttctacatggagccagatacgagtgacagtggatctatggcaagccgtggccctccaccannnnnncgcaacaccaaggctgctggtgttgggaatgttgctgtgaggccattacctgccctcaaggaaaacgtgaagcgggtcatgttctactgctaagactgatgctgttaaggcagagctaccttttattattacagtatatcgtgaagactagagtannnnnnccatgtacttgatgatgctgagctaccttttattatgtcgtacgatatatatgcgtggtactggttacag

SEQ ID NO: 2079 - DNA, 1054 bp, Zea mays
  misc_feature (80)..(109): n is a, c, g, or t
  misc_feature (140)..(144): n is a, c, g, or t
  misc_feature (495)..(499): n is a, c, g, or t
  Predicted polypeptide sequence is orthologous to G1146
ccaacgaactgagaggctcactttatatataatgcatcaagtcaaagcagaaaatttcaaaagcaatgaccacaaggttnnnnnnnnnnnnnnnnnnnnnnnnnnnnnncacttgccttggacttctacgaagtccaccnnnnntaataggcattttctgacgagttttggatagaatactcgccaggcccaaaatatgatttggaggtcgtgcggcccgcccttcagggttacttcaccatagttacaccaacccagaattactcgattcatttcatggcaacaaaagtgtcgatgacggtccttcctgcaaaggccaccttcagcagtagaacatgaactgcttgacactctccatcactttcggcagctgcttcaccggaacagcgccatctttcatgcgagagctcgccactgaagacgacccctggtcggagaggtcatcgtccatgtagtggcgcgcacggaaggccgccaggtgtgcatagtacgccnnnnnaactatagagactgatcgagtgcatcgcgcatacgtgtagcacagtttgtaggtcaacgtttgcagtgcatcggcagtgaatttgttttcgtcaaacagaacatggtagtgtgctggccggctcgttccctgtatgccagagtggctacaaaggtagaagtcgaattcacttggatggcatatcttcgtgtcaacaacagttcctggcaaaatgtttccacttcgatccatctgtccatgtgcatgatgatcttcagggaaaagccgtgtgtgatggcgcttttgcaccacaatgaatgtaatgggaggaaggtagccctcttccaagctggcacacgcctgagtacaaacataaacgtaactcaattaggagattgcaacaaaagagaataatattgtgaagaaaaccacctttcgaattgcatccacttcataaagcaagacctggctaaactgcccctcactgacaccatctcgatagaaaattatcctgcttggtttgcggctcccgtttgccttatagaatgacacgagtagttccctgatcattgtcgt

SEQ ID NO: 2080 - DNA, 2635 bp, Zea mays
  misc_feature (158)..(162): n is a, c, g, or t
  misc_feature (363)..(367): n is a, c, g, or t
  misc_feature (628)..(648): n is a, c, g, or t
  misc_feature (1126)..(1148): n is a, c, g, or t
  misc_feature (1176)..(1199): n is a, c, g, or t
  misc_feature (1398)..(1403): n is a, c, g, or t
  misc_feature (1715)..(1775): n is a, c, g, or t
  misc_feature (2457)..(2466): n is a, c, g, or t
  misc_feature (2510)..(2514): n is a, c, g, or t
  misc_feature (2537)..(2542): n is a, c, g, or t
  Predicted polypeptide sequence is orthologous to G1146
ccgagccgacgcccaaggccgcgtacagagagatcatgacgaagctgttgtccgagaaccagcacacggatttcgacggccgcttctccgtgtacgatgatggtgactcgctcttcacagccggtgcgctgccgttcgacaccaaggagttcgaggtnnnnntctctgcaggcggcgacgaaaagatggacaggaagtacaaggtgatgatcaaccatgccgcaacgattagtctgctacagctgaggatgctgttagcgggctatcccacggacatccccgcgcaggcgctcgtggtcctcgacaccgtgctgcgtgacgtcttcaacgaacgcaatgacatggaatgcgtcgtgattgacnnnnnggatcgcacactgggtgttgacgcatggaaggggctctatctgagcatcaggccaacacaaaactgcttgtctctgattgcagacgtgtcctcatctgtattcgttcaacccctgctattgattgaattcgttcagaagatcctaaagatagatgccgtggataggaacttgactaaacctgagtatgacaagctcttgaaggccctcaggggtgtgaggattcaagtcacacacagagataatagacgccgagtatggtnnnnnnnnnnnnnnnnnnnnngccaactctctacgtacagagttgctggcttgtcagtgaatcctactaatgatttgagttttgaatcaaaggttggagtcacaacgactgtgattgattacttcagagaaatatacggcctggaactgaaatacaaatatctcccatgcgtcaatgctggcagcgagcaggatccaatctattttcctatagaggtttgcaagatagctcccaagcagtgttaccagaagaagctggaaggtagtcagttttctactccaaggaagtcagcctggatccatcctgaagccgagcaatcctgtcctcagattgttgagcagaggcagtacaaacaaaccaaacgtgcaaatgaatttgacttagaatttgatggcaatcttacaacagttgctgctagagttctgctgcctccaaatcttaagtatgatgattctgtatcacagaaaacatggtttccactggatgggtactggaatannnnnnnnnnnnnnnnnnnnnnnggtgccaagatcagaaactgggcatgtnnnnnnnnnnnnnnnnnnnnnnnnaaggaagatattaagaagttttgctttaagctggctgaaatgtctcgtattactggactggactttgccgatttgaagctcccaatattcactgcacgtccagatcgagttgaagatggtattcgtaggtgctatcaggaagcgaagaacaagctaagggatcagaagattgatttactgcttgctatactaccagatnnnnnngacagtttatatggaaatattaaaaggatctgtgagacagatattggtcttgtgtcacagtgttgtcgaaggtcaagagtcttagtgaataataatcagatattggcaaatattgctattaagatcaatgccaaggttggaggaagaatctcagtattcgatgacgtacagaagagtttaccggttgtttcaaataagccaacaattatatttggtgctcatgtttctcacccttctgttgtagatggttctactggcccttctattgcttctgtcgttgcatcccaagactggcatgaggtgtctaagtannnnnnnnnnnnnnnnnnnnnnnnnnnnnnnnnnnnnnnnnnnnnnnnnnnnnnnnnnnnnaaggagctccttcatgcatttgcaaacgagtccaaggagaagctccagcagctgatattctacagggatggcataagtgagggtcaattcaatcgaattttggagaaagaaatcccagcgatagaaaaggcttggaacgcactgtatgacaatgagaagccacaaatcaccttcgttgttgtgcagaagaggcataaactgaggctgttccccgtggacgacaactataagatccgttctgctaagaagaaaattgttgagcctggcacagtggttgatagtgagatctgtcacccagcagaatttgatttcttcctttgcagccaatctggtggtatcaaaggcccaaggcgtcctgtgaggtaccttgtactgcgagatgataacaacttcacggcagatgaactgcaggctctcacaaataacctgtgctacacttattcaggcggcaatcgttcgttgtcggtcgctcctcccgcatactacgcccaaaagctcgcacatcgggcccgcgtctacctcgccaaaggctcggacaataatgcagcagctgctaatggtggtcggaagcaaattccagagataaagaatgagctgaaggggtccatgttctactgctagtcctttgcctgctgaacggacgatgaattgttctatagtgaaagacttgagtgtgctctgnnnnnnnnnnctgaatctggagaaggatggcatctgcaatagtcgccgtgttcnnnnnagtacactagaataaatggatgnnnnnngtggacgcccatgttgaactagttttcttttccagtaagtacttcagaatgagtgagataaatatatcattcagcgtctggtggtctggcatt

SEQ ID NO: 2081 - DNA, 3777 bp, Zea mays
  misc_feature (54)..(173): n is a, c, g, or t
  misc_feature (201)..(231): n is a, c, g, or t
  misc_feature (258)..(353): n is a, c, g, or t
  misc_feature (375)..(379): n is a, c, g, or t
  misc_feature (956)..(962): n is a, c, g, or t
  misc_feature (1420)..(1424): n is a, c, g, or t
  misc_feature (1454)..(1458): n is a, c, g, or t
  misc_feature (1617)..(1622): n is a, c, g, or t
  misc_feature (2512)..(2516): n is a, c, g, or t
  misc_feature (2571)..(2575): n is a, c, g, or t
  misc_feature (2615)..(2619): n is a, c, g, or t
  misc_feature (3315)..(3319): n is a, c, g, or t
  misc_feature (3413)..(3418): n is a, c, g, or t
  Predicted polypeptide sequence is orthologous to G1146
ctgctttctccagtgagccgcacccgcactaccgctgacgctaattaaccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagtgccattggtggagctggtaactnnnnnnnnnnnnnnnnnnnnnnnnnnnnnnncagccgtctgccgagcctgctcagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgagcgaactcaacaacctnnnnnaggacgtggctgggtgcctcaacagggtggccatggtggtgggcaacaccagggtcgtgatcgacattatcagggacgtggaggaccagggccacatcaccttggtagtggggcacctgagtatcacccgcgtgaataccagggacgtggtggtgaatatcagggacatggtggtgagtaccagggacggggtggtgactaccagggacgtggtggtggccgctccagaggtggaatgccacagccatactatggtgggcataggggaggtaatgttggacgcaatgttcctccaggtccgtccaggacagttcccgagctgcaccaagccccatatgtccagtatccagccccggtggtttcgccctccccatcgggacctggctcatcctcacagcctatggcagaggtgagctctggacaagtccagcaacagtttcagcaacttgccgatcgtggtcagagttccacgagccaagaaattcaagtggcaccagcatcaagcaaatcggttcgattcccgttacggcccggcaagggcacttatggggacaggtgcattgtgaaggcaaatcannnnnnngctgagcttcctgacaaagaccttcaccaatatgatgtatctataacacctgaggttacttcacgtggcgtcaatcgtgctgtcatgggtgagcttgtaacaatatatagacaatcccatttgggtgggcgtctacctgcatacgatggaagaaagagcctgtatactgctggaccattgccatttacttctatggcatttgaaattaccttgcaagatgaggaagatagtcttggcggtcgccaaggtggacataggcgtgagagagtatttagggtggtgatcaaatttgcagcccgtgctgatctccaccatctggctatgtttctagctggaaggcaagcagatgcccctcaggaagctcttcaagtgcttgacattgtactacgtgaattgcctaccgcgaggtattctcctgtcggtaggtcattttactctcccaacttagggagacgtcnnnnncttggtgagggattggaaagttggcgtggnnnnnaccaaagcataaggccgacacagatgggcctttcactgaatattgatatgtcctctactgcatttatcgagcctctccctgtgatcgattttgttgctcagcttcttaacagagatatctcagttaggccattgtctgattctgatcgcgtgaagattnnnnnngccctaagaggtgtgaaggttgaggtgactcacaggggaaacatgcgcagaaaatatcgcatttctggcctcacctcacaagcaacaagagagctatcattccctgttgatgatcgtggtactgtgaagactgtggtgcaatacttcatggagacttatggttttagtatccagcacaccactttaccatgcttgcaagtgggtaatcaacaaagaccaaattatctgcctatggaggtttgcaagatagttgaaggacagcgttactcaaagcgactcaatgagaaacaaatcactgctctactgaaagtgacctgccagcgccctcaagagcgcgagctggacatcttacagactgtgcatcacaatgcatactatgaagacccctatgcactggaatttggtataagaattgatgaacgtcttgctgcagttgaagctcgtgttctgccaccaccaagacttaaataccatgatagtggccgagagaaggatgttttgcccagagttggccaatggaacatgatgaataagaaaatggttaatggtggcagagtgagcaactgggcatgtattaacttctctcggaatgtgcaagatagtgccgctaggggtttctctcatgagttggcagtcatgtgccaaatatcaggaatggattttgctcttgagcctgtgctgcctccagtgactgcaaggccagaacatgttgagagagcgttaaaggcacgttatcaagatgcaatgaacatactgaggccacagggaagggaacttgatctgctgatcgtaatactgcctgacaacaatggttctctttatggggatctcaaaaggatctgtgagactgaactcggattggtctcccagtgttgtctgactaaacatgnnnnnaagatgagcaagcagtaccttgcaaatgttgcactcaaaataaatgttaaggttnnnnnaaggaatactgtacttttagatgctttgtcaaggagaatnnnnnttgtcagtgacagaccgaccataatatttggtgctgatgttacccatccacatcctggagaagattccagtccttccattgcagccgttgttgcttcgcaagactggcccgaggtcacgaaatacgctggactagtgagtgcgcaagcccatcgccaggagctgatacaggatcttttcaaagtatggcaggacccgcagagaaggacggtaactggcggcatgataaaggaacttctcatttctttcaagagggcaactggacagaagccccagaggatcatattctacagggatggtgtcagtgagggacagttctatcaagtattgctgtacgaacttgatgccattagaaaggcctgtgcgtccctggagcccaactaccagcctccagttacttttgtcgtggtacagaagcgccatcacactaggctgtttgcgaacaaccacagtgatcagcgcacagtcgatagaagcggaaacatactgcctggcaccgtggtcgattcgaagatttgccatcctactgagtttgacttctacctgtgtagccatgctggcattcagggaacgagccgccctgctcactaccatgtcctgtgggacgagaacaagttcacagctgacgagctgcagaccctgacgaacaacctgtgctacacgtacgctaggtgcacccgctccgtgtccatcgtgnnnnnggcgtactacgctcatctggcagccttccgagctcgcttctacatggagccagacacctctgacagcgggtcactggccagcggtgcccgtggnnnnnnacccggtgcggcacgcagcagcacgagaggggccgggagtgtcgaggtcaggcccctacctgctctcaaggagaacgtgaagcgtgtcatgttttactgctgagacgctggtgggctgccttcgccaaggaaaatgccctggagcattcccatgtacccgcactgtttcggtgatacagtactatctaacgccgattttgcgcgttaagacttccagtgatctgggaaatttcttgtacgactgttgtagtgttgtgtattcgtaatgtgatgacgcggcagttcttctaggagcttagtgccgtgtaaaatatctgttgtaagttgtaacctgtcaccctctagtgttatgtcatgat

SEQ ID NO: 2082 - DNA, 649 bp, Zea mays
  Predicted polypeptide sequence is orthologous to G1146
gagattgtactccagcgtgccgttaatgaattgattgaattcaacctagaaaacaccagaaggtttcttctacacccccttttcatagtacactggaacattggatgcatgcatctgaaccaacaagaactattatacaggcatttccgagtattttacagcgatcgctaacagattgattgttcatgatccaaatacgcatcccgtttcctcttcgttcctggagaaagctaatctaatccccctactgaaccctaccaagttagctacagcatgtgaatggttgttaaagtggtcacctcgtcaggagtagaacatcacccttttcaccttctccttcacagcaggcaggggcttcaccaagcctccgttcgtgccattggagctcttcgacgtctggttctccgacatctctggttccatgtagaaccgcgcccggaatgctgccaggtgtgcgtagtatgcaggagggacaacagaaaccgagcgtgtgcaccgggcataactgcatcaataacatgtatatcaagctaataaaattctcaaaaaaaaaaattaaaagtgcaaaggacaaatataaaatatacaaagaagtgcattacgtgtagcaaaggttgtttgtcagtgtttgcatttcgcccaacacaat

SEQ ID NO: 2083 - DNA, 1084 bp, Zea mays
  Predicted polypeptide sequence is orthologous to G1146
gcgggcacgcggttaaagtgaaggatccacaaaagggatttgttccctacctaatgatcaggcatgctaaacatcttagttgtctaacttagttcttcagataaatgatttgtcctttttttaaatgtcatatttttgcttcagggaactactcgtgccattctataaggcaaatgggagccgcaaaccaaataggaaaattttctatgggttcgtaattgtctgtttgaatgaattttgttgttgtctaaacttaaatctcttttccttgcatgtaaagaaaaagacctgccagttttctttatgttagtacatatttcaacagctaaacagctacaccttgtatacttggagaagaatcctggagttactttacttgtttccttgatttgcagagacatgccagtgaggagcagtttagccggttcttgcattatgaagtggatgcaattagaaaggcgtgtgccagcttggaagagggctaccttcctctagttacattcatagtggtgcaaaagcgccatcacacactgttttgtcctgaagatcatcgttcacacagacaaccagatcgacgtggaaatattttgcaaggatgaactagatgcaaaacctgaagagctggaaggagaagagttggaatctaagcttctagagcctgttgcagctctttcggtgcatccagtgcatgtcccaggaaacaagcaactagcttgccctacttcacagaaagttatagctaaatacgatgagctggctgcactacaagctgaaatggcattgtgatcaggattaacgcatggaccgaggaagcgcaatgacaagcctaatagcctgcaactgatgaaaggaatggtctctactacacgtattattgtccatcccatctttgtttaatggtcgtagctgctttatacaattattcctacctatgctagactgtgagccattgtatatcaatgtattttatcatattgatttcgtagcaacgtacgagcatatacctagtatatttataaacaatgtgtagcacttgccacatttaaacagctaatcttaaaaagacaaaaaaaaaaaaaaaaaa

SEQ ID NO: 2084 - DNA, 766 bp, Zea mays
  Predicted polypeptide sequence is orthologous to G1146
tttttttttttttttttttgatatgcaaagctccattgaaatagatataaatgtcgaaacaacaatggcgcaccaccatagagccattcagtcagagccctcaatattgagacaaccgaaatcgaacaattctttgatggaattttgtacatgttggtttttttggataagatcatttaccaatgttcaatgagaggcccatttgagttggacggaagcttgggtaatatcctctccagcactctagcccaccgcaatgtcctcatcaccaaaacttcttggagaaggaccaaaaaagagttacataattgagagaaggtgactcaagacaatatccagtgcttggattgcgtcatatggcgtgtcccttcgttgacaattgatcaattgatttttcggccctccttccccaacttgacaacgaactccaatgatttgaacgacatctcgcttgcagtgtacatgctcttgcttcaaatcatatgcacatgtgtcttgtgggcgcgagatgtcgcattgtgtggcttgacaagctctgagagcagcaccctgttggtccttcttccttttgtttcaggatttattaaaacctggtaaatgtgtatgggtcgagtcaaatatgtatggagcacaaaagaaaaacttccaaccagacattaagagataaacatctagtatttcttgcatacacaataaacataaatcactgatttcaacaaataaaacttaggacataatcgagcaagataacaaacaaatggatatc

SEQ ID NO: 2085 - DNA, 774 bp, Zea mays
  Predicted polypeptide sequence is orthologous to G1146
ttcgcgttctgcgcaagtgcttgctcaacaaggtctaacagcgaaacaactagagttactcatcataattctgcctgatatgagtggtttttatggaagaataaaacgagtttgtgaaactgagcttggtttaatcactcagtgctgcgcacctaagaatgtaaggaaaggagggaatcagtaccttgagaatctttccttgaaaatcaacgtaaaggttggtggccggaacacaatgcttgaagatgctttcaaccggagaataccgcttctgacagattgtccgacaatagtctttggagctgatgttacgcacccatctgctggggaaagttcatctccatctattgcagcagtggttgcatcaatggattggccacaagttacaaagtacaaatgcttggtgtcttcacaaggtcaaagggttgaaattataaatgacctttatacagaagtggaagatccacagaagggcattgttaaaggtggaatgattagagatttgcttatgtcattcttcaagtcaactggccaaaagccttcgaggattatattctatcgtgatggtgttagtgaggggcagttcagccaagtcttgctttatgaaatagatgccattcggaaggcatgtgcaagtttacaggataattatctcccaagggtcacatttgttgttgtgcaaaagcggcatcatacccgcctgtttcctgaaaatcatcgttcacgagatcaaacagacaggagtggaaacatcctgcctggaaactgtgttga

SEQ ID NO: 2086 - DNA, 704 bp, Zea mays
  Predicted polypeptide sequence is orthologous to G1146
cacactcctgtcgtaccacaaatcagaactaatgcgtcaataggcaccgtagttgataataatatctgccacccaacagaatttgatttcttcgtgtgcatccatgctagggccaagggaacaagccgtcctacgcattaccatgtgctacgagatgacaacaagttcaccgcagatgctctgcagtctctaacatataacttgtgctacattgcgcagatcatccagggcggacctataagatgtcaagtgtgtacgccccaacaacccacagatgcggctcgacgctctccatcgtctggtataccaggataggcttcaagagaggctaagaaaatctaagtgtttaggacttgaagaggctgcaaagaacaaaggttttgaccttggtaacgatgcactcattgcaaactgttgaggaggaataactatttggcagatgcagacatgcagtagcttcacacttggttcatcggacaacagttctttgaactaagtagagtggaaggaaactgaacctaacacccatccatgacccagcttacatataggtggttttactgggttctgcatcagatcctcgcatacaaggtgacttcacaaatttagccaataagttgtatagccgagtgaagctatgtttgacttatgctacgacgagccaccatcacatttgcaacatgctaaagagcaaaatgacacca

SEQ ID NO: 2087 - DNA, 1714 bp, Zea mays
  Predicted polypeptide sequence is orthologous to G1198
gcagaaactctttgcttccgcctggctcgcgatgcttgtttgggtgcgcgggctgcggcgaggtgaggcgacggcggcgccgggcggttgcatggtggccgatggagagtagacggggagggtcgtcggcggcggcggcggaagatgcgggcggggcgatgccgagctttgggccaacgcagcacgccattcgcgcagatgtgaacagcatgcaaccttctcgagttactgactttggggcactggcacagtctgctggattccgaatagaagatcttgctaaccttaatgcaaatgctttgttcaatctgaagccaaattctcatacgattgacaacagtcctctccagtttggaaattacggaaagtctatttcttctcatataaatactacagaagcaacaacagctgcaacaagaattgaccctcagctgtcagcacagcaaacaggagcacaaccaattctggtggcgttaccaactggtaacatggagaattggggagagtcagctatggctgatagccctatgactgacacatctacagatccagacactgatgagaggaaccagatgtttgaacaaggacttgttgctgtccccacagcatctgattctagtgacaaatcaagggacaaactagatcagaagacacttcggcgtcttgcccaaaatcgtgaagctgccaggaaaagccgtttacgaaaaaaggcatacatccaaaaccttgagagtagcagactgaaacttactcagttagagcaagagcttcagcgggctcgtcaacagggtatttttatttcgacatcaggagatcaacctcaatcaacaagtggaaatggagctttggcatttgacatggagtatgcacgctggttggaggagcacaataaacatgtaaatgagttgagggctgcagtcaatgcacatgctggtgataatgatcttcgttgtattgttgatagcattatggtacattacgacgaaattttcaagctcaagggtgtggcagctaaagcagatgtttttcatgtgctgtctgggatgtggaagacccctgctgagagatgtttcatgtggttaggtggcttccggtcatctgagcttcttaagttactggcaggtcacctagagcctcttactgatcagcagcttgttggtatatccaacctgcagcagtcctcccaacaagctgaagatgctctttctcaagggatggaagcattgcaacagtcgcttgcagaaactctagcatctggatccttgggccctgctggaccttctggcaatgttgcaaattacatgggacaaatggcgatggctatgggaaaacttggcactcttgagaactttctacgacaggctgataatctacggctgcaaacacttcaacaaatgcaacgcatcttaactacccgacaatcagcacgagccctactcgcaataagtgactacttctctcggctgcgtgctttgagttctctttggcttgcccgtccaagggaataaattcaattaattcataactaggataatttttttgtactgtttctagtatggccattagtttcttcagaacgctcatgtgtcagtgagatatttggatcatattgtaggccatcatggtttactggacaactttgtaacaattttggagagaaaaaactgagttgtaaatacatctggaataatctaagatcttatgaaggggaaaa

SEQ ID NO: 2088 - DNA, 1163 bp, Zea mays
  Predicted polypeptide sequence is orthologous to G1198
gagaactggggagagtcagctatggctggtagccctatgactgacacatctacagatccagacactgatgagaggaaccagatgtttgaacaaggacttgttgctgtccccacagcttctgattctagtgacaaatcaagggacaaactagatcagaagacacttcggcgtcttgcccaaaatcgtgaagctgcccggaaaagccgtttacgaaagaaggcatacatccaaaaccttgagagtagcagattgaaacttactcagttagagcaagagcttcaccagactcgtcaacagggtatttttatttctacatcaggagatcaacctcaatcaacaagcggaaatggagctttggcatttgacatggagtatgcacgctggttggaagagcacaacaaacatgtaaatgagttgaggcttgcagtcaatgcacatgccggtgataatgatctccgtggtattgttggtagtgttatggcacactacgatgaatttttcaggctcaagggtgtggcagctagatcagatgtttttcatgtgctgtctgggatgtggaagacccctgctgagagatgtttcatgtggttaggtggcttccgatcatctgaggttcttaagttactggcaggtcacctagagcctcttactgatcagcagcttgttggtatatccaacctgcagcagtcctcccaacaagctgaagatgctctttctcaagggatggaagcattacaacagtcgcttgcagaaactctagcatctggatccctgggccctgctggaccttctggcaatgttgcaaattacatgggacaaatggcgatggctatgggaaaacttggcaccctagagaactttctacgacaggctgataatctacggctgcaaacacttcaacaaatgcaacgcatcttaaccacccgacaatccgcacgagccctacttgcaataagcgactacttctctcggctgcgtgctttgagttctctttggcttgcccgtccaagggaataaattcaattaactcataaataggattttttttgtactgtctctagtatgtcaattagtttcttcacattgctcatgtgttgatgggatatttggatctaagatcttatgaatggatgacatgtatgtgttcaagtgaaaaaaaaaaa

SEQ ID NO: 2089 - DNA, 1864 bp, Zea mays
  Predicted polypeptide sequence is orthologous to G1198
tggccatggtgcaaggcgaggagagttcttggaggatggagagggcagcgctgcctctcaaccaggcgctcgcgtacggagtccaagcccacgccgccgccgccgctgcaccgccgacctgcttcctggacttccagcctgcggccgcatccgctgcctacttcgggttcggtgagctggaggaggccctcatccacggtggtggcgccgccagcgccggcggcggcgtcgatccgggcgtgatcatcaagaacgacgtcgcgcaggcaaagtcagcggcaggatatctcgcgggcgctggcaccggcaggccccccacgctggagatcttcccttcgtggccaatgaggcaccaacagcagctgcacagtgggaattcgcagtcagtagggagcaccggcactgactcgagctcagctcagaacacaatgtctcagatggagttggtgtccccagcctcctctgcgccgcggcaggaggtcatgatggtgaccactgatgattacagctacaagccaggcctcgccgctgcgcccgctgctgccgccccgccgagctttcagcagcaccacccgctcccgctgcagctgcacggaggagagggagggggagaccatgacaagaggaagcatggatccacaagaaaagatggcaagttggtagatgccaagacggaacggcggctggcgcagaacagagaggctgcgaggaagagcaggctgaggaagaaggcttacgtgcagcagctcgagactagcaggatcaggcttcagcaggtcgagcatgagctccagagagcacggtcacagggcctgttcgttggagggtgcagcgccgccggggacatgagctctggcgccgccatgttcgacatggagtacgcgcggtggcttgacgacgacaccaagcggctggcggagctccgaggcgggctgcaggcgcacctgctggacggcaacctgggactcatcgtggaggagtgcatgcagcactacgacgagctgttccagctcaaggcggcgctcgcgcgctccgacgtcttccacctcctcaccggctcctgggccacccccgccgagcgctgcttcttctggatgggcggcttccgcccgtccgagctgctcaagatcctgataccgcagctggacccgctgacggagcagcagctgctggggatctgcaatctgcagcagtcgtcggagcaagcggaggaagctctcgcccagggcctgcaccagctgcaccagtccctggccgacacagtcgccgcgggcacgctcaacgacggcgccgccgcccccaactacatgaacatcatggccgtcgcacttgagaagctcgccagcctcgaaaatttctatcaacaggccgacaatctaaggcaccagacgttgcatcagatgcgccggatcctgaccactcggcaggctgcgcggtgcttcctctccattggggagtactacagccgcctcagagctctcagcaacctctgggcttcccgtccccgcgacaacttcatcgggacagagagcctcagccccacagcaacggaactgcaagccctgcaccaccagcagcagaaccagttcgccggattttgaggcctcacctggtgagggagggtgtaaaactttggccgcgagggtggtgttacaaagattagaggttttgagagggagatgcattgtaatgttctatcattaaagtactgagaaagcaacatcactaggcgaaaagggcggggagaaggaattgctgtagtgcgatgttgggtggctcacctgttcatatggctcttgaactgattgaagggttagcaccgcagaatttttgtgcgtgtcaggagagaacaaatcagttacac

SEQ ID NO: 2090 - DNA, 497 bp, Zea mays
  Predicted polypeptide sequence is orthologous to G1198
tacagccgccttagagctctcagcaacctctgggcttcccgtcccggcgacaccttcatcaggtcagagagcctcagccccacagcaacggaactgcaagccctgcaccaccagcggcagaatcagttcagcggattttgaggccttacctggtggtgcggtggtgtcggagggtgtaaactttggcggcgaaggtgatgttacaaagattagaggttttgagagagagatgcattgtaatgttctatcattaaagtactaagaaagcaatatcactaggcgaaaagggcggggggaaaggaattgctgtggtgcgatgttgggtggctgacctgttcatatggctcttgaactgattgaagggttagccccgcagaattttttgcgggtagcagcagaaaacaaagcagtggcagaagattctggctgctcacttgccagagagcactaattgcagttagagtgacagagtaaccattaaaaaaaaaaaaaaaaaa

SEQ ID NO: 2091 - DNA, 952 bp, Zea mays
  misc_feature (778)..(778): n is a, c, g, or t
  misc_feature (872)..(872): n is a, c, g, or t
  Predicted polypeptide sequence is orthologous to G1198
ggggctaccccctacattaatcaaaaagtacacaaatggacagaataatcattctcctaacagcaaaatgagaaaatgggatgcaacaataccaacatatactacagtaaccaaaggaagattcttgttactctcttcccattccgccccccatgtcccaggaagttacattaggactaaatctctaaccagtacaaacaacagaaaccctgatcctgccctctctaattattattgcattgctaacacacccataaatcaccataacttacaggattatattgacctacttgtacacccacctgagtacaatttggaccaagcagcggccaaaagtaattgtacaacaaaaacagtaccaccaaagatctgtgatgcatcgctgcgaacgacgcagcagcaccgtaaggcagagggaactcaaaatactgacggcccttcgttattcacgtggcctagcaagccacagagaacttaaagcgcgcaatcgtgaaaaatagtcgtggattgcaagaagagcacgagaagcctgtcggatcgttaggatacgttgcatttgatgcaacgtctgctgtcgcaggttgtcggcttggcgaagaaaattctctagcgtcccgagtttgcccatggccatggccatctgacccatgtagtttgccacatttcctgaagaacctgctggaccgagagatccagccaaagtctctgccaaagattgctgcagtgcttccatgccctgtgacaacgcatcctctgcttgttgggaagattgctggangttggtcaaacccagcatttgctgctcagttagaggctcgaggtgattcgctaggagctttaaagctcagatggacgaaaaccccaagccatangaagcacctttcagcaggtgtcttccacatgcctgaaagttatgaaaaacatcagcctttgcagcacacctttgacttga

SEQ ID NO: 2092 - DNA, 764 bp, Zea mays
  Predicted polypeptide sequence is orthologous to G1198
gagtggttttggatccttttgctggagatgtgcatagtgtgagcagagagagagagacgggtggaggatggtcagagccttcataagggcttcaggtggggctctgctggagacgacgaccgccgccgccgccgccaccaccatcgccaggcatctgagctcccccaaattctctgctggagcgcccctagcttcccaccgccgacgatgatggcggcctcttccaccatgagcaaggaggaatcagcagcaagctacgacatggcggaatttgaccagtcagcaatcttcctctacctcgaggatggccacgatcaagaacaacaacgacagactctgaacatctttccatcgcagccaatgcatgtggctgagccaattcctaccaagggtgttagcatgggcatggtggcagccagcatcatgctgcccaacggaaactcttcttcacccaagagacaagagcaaggtggtggccagcagaggaatgtcgctgctcctgcaggcgccgctgtgccgttgcctaataacttagccaaggataacaggaatagccttactaagaaggaagaatctagtggtggaaagggtgcagcatctgccgcaggtggtgttcaggagagagtgaaagaccctaagacactgaggaggcttgcacagaatagagaggcagctaggaagagcaggcttatgaagaaggcttatatccagcagttagagacaagtaggatcaggctcagccagcttgaacaacaagttcaagt

SEQ ID NO: 2093 - DNA, 904 bp, Zea mays
  misc_feature (25)..(25): n is a, c, g, or t
  misc_feature (49)..(49): n is a, c, g, or t
  misc_feature (868)..(868): n is a, c, g, or t
  misc_feature (877)..(877): n is a, c, g, or t
  misc_feature (893)..(893): n is a, c, g, or t
  Predicted polypeptide sequence is orthologous to G1198
actggtcaaaccagttccggtccgnattcccggctcgaccccgcgtccngatattcttgatggcaagaggaacaaaataagcagataaatgagctgaggactgcagtaaatgctcatgcaagtgatagtgacctccgtcttatagtcgatgggataatggcacattatgacgagatattcaggctgaagggcattgctgcaaaggctgatgtgttccatatactttcaggcatgtggaaaacacctgctgaaaggtgcttcttgtggcttgggggtttccgttcgtctgagcttctaaagctccttgtgaatcagcttgagcctctaactgagcagcaattgatggggctatccaatctgcagcaatcttctcagcaggctgaggatgcattgtcacaaggaatggaagcattgcagcagtccttggcagaaacgctggctgggtcccttggtccatcaggatcttctggaaacgtggcaaactatatgggtcaaatggctatggccatgggaaaacttggcacactcgagaatttccttcgccaggctgacaatctacgacagcagaccttacatcagatgcaacgtatcctgacaatccgacaagctgctcgtgcgcttcttgcaatccatgactacttttcacgtttgcgcgcactgagttctctttggcttgctaggccacgagagtaacatcacccccgttggggtcactcgatgaactgatctgtgaatgtgggactgctggctgcaaactcgcaaagcatttgcagatgactggaggatcagtcctctctgtacaaagtgtattaacatcttctggtctcatattgtgctccagtgttgtacaatttagggaaaagctggnattacttgntagtatcatgaaattngtattggcata

SEQ ID NO: 2094 - DNA, 791 bp, Zea mays
  Predicted polypeptide sequence is orthologous to G1198
cttttgttccatccccaggcgtacatacggaacctcgagacgagccgcgtgaagctggcgcagctggagcaggagctcataatggccaggcgccagcagcacggcgcgtacggcgtgggaggaggagtcgcaccgccggcggcgcccgtggacccgcgcgtcgctgcgttcgagctggagtacgcgcactgggtggaggagcagagcaggcaggcgacggagctgcgggcggcgctgcagtcgcacgcgccggacgtccagctgcgggtcctcgtcgacgccgcgctggcgcactacggcgcgctgttccaggccaaggcgagggcagcccggtccgacgccttcttcgtgctgtccggcgtgtggcggtcccccgcggagcgcttcttcctctggatcgccggcttccgcccctccgacctgctcaaggtgctggagccgcagctgagcccgctcatggaccaccaggcgtccgaggtgcgcaagctgcagaacacggcgcggcagctggaggacgcgctgtcgcagggcatgagcaagctgcagcagacgctggtcgacaccctcatgaccgtcgacgtctccccggacggcgccgggggcggatacgcggggcagcagatggcctgcgccgtgggcaagctcgccgacctcgtcgacttcgtggacaaggcggaccacctccggcagcagacgttgcggaacatgcacaagatcctgacgccgcggcaggcagcgcgcggcctgctcgcgctcgcggactacggtcagcgcctgcgcgcgctcagctc

SEQ ID NO: 2095 - DNA, 906 bp, Zea mays
  Predicted polypeptide sequence is orthologous to G1198
ctagcggctagcgcagcgcattatttgccttcccgtcctcgcgccgattccatcccgcgaggctagctgctccgtcgacccgtctgtcgtttactcacgccgccggctcttgactctgccgccttgcctcggccagcatcgccggcagcgccgtctcgccgccggagtacatggcgtcggcgtcgccggcgcagttcgcggcggcgcccctcaggatggggtacgggaggccggcgccggcgccgcccccgcccgtgatgggcatgtggagcagcgagccgttcagggtcgacagcggcagcgcccacgccaccagcgcgtccaccgtcaacaccaagctggaggagacaaggttagaagacgacgcacaggtagcacttgagccggcaagaagtacggagcaggaaaccagtaggccgccagagagggcccagagaaggctcgcgcagaacagagaggctgctcggaagagtcgcctgcggaagaaggcctacatccagcagctagagacaagccgcatgaagctgtcgcagctagagctagagcttcaacgggcgcggcagcagggtgcatatgcgaatagtgggagcatgggagactcggctctcggctacagatgcccgatagatccaggtgtttctgtgttcgagatcgactacagccactgggtggacgagcagaagagacacacggcggagctgacgtcggcgctccaggggcagcagacatcggagctggagctccgcctgctggtggagacgggactcagcaactacgagcacctgttcaagatcaaggcggcggcggccaacgcggacgtgttctacgtcatgtcgggcttgtggaagacccccgccgagaggttctttctctggatcggcgggttccggccgtcggaagtcctca

SEQ ID NO: 2096 - DNA, 828 bp, Zea mays
  Predicted polypeptide sequence is orthologous to G1198
gacaggtgaacatcaatgtgcattctaatggttcgctgcaaatcaggggcatacagagtgagaattttacagcagttggtaatgatacatcaacaacacttaactacaaagctaagcagcctaagctacatgaacatccccttctatttgggtcatagtatgtgcagatatgtccgaatcaagtctgtcgcagccttgtcaaatctcctgaccattgaaaaccaaattgtgaaaagtattgcagtcaaatagcatgttcttgctattccttgggccgagcaagccagagagagcttagggcacggagacgtgaagagtaatcacttatcacaagtagcgcccgagctgactgtctagtggtcaggatcctttgcatctgttgtagagtctgacgaaggaaattctcaagcgttccaagttttcccatagccatggccatttgacccatgtagtttgccacatttcctgttgatccagaagacgaaagagacccagccaaggtttcggccaatgattgctgaagggcctccattccttgtgaaagagcatcctcagcctgctgtgaagattgctgaaggttgcttatccctgacagctgctgttcggtgagaggttcaagttgtgtcgaaagaagctttaaaacctcagatggtcggaaacctcctagccacaaaaaacacctctccgccggtgtcttccacatgccagataagacgtgaaaaacatctgccttggctgcattgcctttgagcctaaaaatctcatcatagtgtgacatgatcttatcaacaacacttcgaagaacagtatcacttgcatgagcactga

SEQ ID NO: 2097 - DNA, 797 bp, Zea mays
  Predicted polypeptide sequence is orthologous to G1198
gtcctttgaagctgggctagacgctagagcacatcctgtgctgtgagaaacgtaacctaataaaccttgtgttcagcgatttgacggcctccgttatccgaagaaacaacttcaaccagacatgtggcgagcgaggtgattagctagtgacaagtgttgatctaagggagatcgttttgagcatgctatgatggagctctactccggatatcttgaagatcatttcaacctccacaagctaaggtcatgagaaggctcgcgcagaacagggaggctgctcggaagagtcgcctgcggaaaaaggcctacatccagcagctagagacaagccggatgaagctggcccagctagagctggagcttcaacgggctcgacggcagcagggcgcgtacgcaaatgggagcatgggagacccagctctcggatacacagggtcgatcgatccaggcgtcgccgcgttcgagatcgaatacaggcactgggtggacgagcagaagcggcacacggcggagctgatgtcggcgctccaggggcagcagacgtcggagctggagctccgcttgctggtggagacggggctcagcaactacgagcacctcttcaggatcaaggcgctggccgccaacgcggacgtgttccacgtcatgtcgggcgtgtggaagacccccgccgagaggttcttcctctggatcggcgggttcaggccgtcggaggtcctaaagattctgagcccgcagctggagccgctggcggaggcgcagcgcatgctcgtgggcggcctccagcacacgtcaac

SEQ ID NO: 2098 - DNA, 886 bp, Zea mays
  Predicted polypeptide sequence is orthologous to G1198
ggaagacatcgctactaccccagccacagtacccattgggtatttatctgctcccttgctgaagctggaatgtgcagctcgatcggttagcgctacgagtcctcgctgaatccagccaaatgatccccttgagcttgccagttagagcacgcacctaatataatgctggccttccgtcagaagtaacagctagctaagagaagcacaagaaaaatctggtagcttgagttctgactcgaactcagagatggcttatgcaagccccgggactgatgatacgtcgacagatctagatactgacgagaagaatcacatgttggagctagggcagcttgtgtcccttacagcttctgatcccggcaacaaagcaaaggacaagctactaggtcaaaaggcactgcgccgtctggcccagaaccgtgaagctgctaggaaaagccgtctaagaaagaaggcatacgttgagcaacttgagaatagcaggctgaaacttagccagctggagcaggaactccagcgtgctcgccaacagggcatcttcattcctactccgggagacgaccagcagccaaactctactagtgaaaaaggtgctttggcgtttgacaaggactacgctggatgggaagacgagcacaggaagcagataagcgagctgagggccgcgctcagcgcacacgccggtgacgacgagctccggcgcatcgtggacggcgtcatggcgcatcaccacgaagcgttcaggctcaagtgcgtggcagccagggccgacgccttccacgtgctgtcggggatgtggaagacccccgtggagaggtgctttatgtggctgggcggatttcgaccgtcagagattctaaagtttctcgcaagccatctggacccc

SEQ ID NO: 2099 - DNA, 906 bp, Zea mays
  Predicted polypeptide sequence is orthologous to G1198
aacgacgccctcgcttggaggagttggagggcgggacgatgcccagacggagctgagggcgcggaggcggcggtggtactcgctgatggagacgaagcaccgagccgtctggcgggtcgtcaggatccgccgcatctggtgcaaggtctgctgcctcaggctgtccgcctggcggtaaaagctctcgagggtgtcgagcctgtcaagtgccagggccatgagagcggtgtagttggcgacattcgcgccgtcgctgagaggactagcgcccacggcgtccgccagcgactggtgcagctgctgaagcccctgcacgagcgcctcctcggtctgctccgacgaccgttgcagattgtacatccctatcagctgcggctccgcgagagggtcgagctgcggtatcagcatctgcttgaggatttcagaaggacggaaccctcccatccagaggaagcatcgctcggccgtggtcgcccacaggccggtcatcaggtggaacacgtcggatcttgcgagcatggccctcaggtggaacagctcgtcgtagtgccgcatgcagtcctcgacgatggcccccaggttcgcgtcgatgatctggggctgcagcacggcctggagctccgtcatgtgcttggtgtcgtcttctagccaccgggcgtactccatgtcgaaaatcacagcgcctgaactcaagtctccagccgcaccacctcctctcgggaacagaccctgaaacatgcatggtgatggtggtaataacgctattcaaacactagatcagatgttctatatatgtcccctgtctcctgatgcgtctagagaactttgaacctgtgagcgtgctccatgcagctcctgctcgatttgctgaagcctgatccgactcgtctctagctgctgtacgta

SEQ ID NO: 2100 - DNA, 884 bp, Zea mays
  Predicted polypeptide sequence is orthologous to G1198
ctcgtgtctcgtcttgggtagcgtacgcaccttagctcgcaaccatccatccatccacggggctcgggcgcagcagcctcccccgtcgtcgtcttcgtcgtcgccttgccgccgctctgatccgtgcccgatgcatcgtcagccatctcctcacgccttcagcagcagcggcagctgggcggagcagggcgcgggcgggtaccgccacggcagggacggcgccaccttcctcctccccgagctcctccagcgcagtaataacgccgccctgccccttgtttatccgcctgcctgcgtattttgtttcctttctttttcttcttgttggatttctcatggctgttggttgcacgcgcgcgcatcgcgggggctaatgtgaaggccccaaccccagctccaagtcctccagcgccgccaccttcgtgccgccgctcgccgccgcgcatggaggaggagtagcggccccgtttggcatggcgccgctgggagtggcggcggcggacgaagcccggttctgcatgacgccgtggtcagcggcggcgcacttcgagaactggggcgactccggcatcgtcgtcaccagcccgctcgccgagacggcctccaccgacgtcgacatgggtggaggtggagccatggcgcagagcgtcgacggacatgacaactcattgccggcgtgcaaggtggagcccagggatcacaaggcgcagaggaggcttgcgcaaaaccgcgaggcggcccggaaaagccggatgaggaagaaggcgtacattgtggagctggaaaacagccggtccaagctgtcccatcttgagcaggagcttcaaagggcaaggcagcaggggatgttcatttgcagtggacgctccggagatcatggatgc

SEQ ID NO: 2101 - DNA, 736 bp, Zea mays
  Predicted polypeptide sequence is orthologous to G1275
tttttttttttttttttgagtgctctctgcttcccttaaaattattacttgcactgtgtaagtgtaaaactatacaagtaggtcagaatttaatccggctacagcgatagcttctagagtattttatctctataaattgcatctccaacactaatttgaatagctgcagcagttgagactgtttagccagccgctgaacattcttcttatccgacgactggagtgtaaaggtaactatgggtcaaggcccggaaaagtcagaaggctagggagcccgagtaggaggtggccgacggggagccgctgtgcggcgggctgtagaagccgctattgccgccgccgctgccgtacgggacgatgatagcagcggctccggggctggcgtggttgtggacgccgtcgtaggtggtgatgacgtagcgggggtcgtcgcggtccctctccacccgcttcttcacgccgcagccctccgacgagcagcggtagtagttccttggatttgggctgttcttgacggccttcttcccgtacttcctccacttgaatccgtcgtccaagatctccacctctgacctcgttctgaacccgatccttccgttgcttctgagtcttctctcgtcaccaccaccctcacaccacatcatcttctcgttgcgatcgccgcccccagccccggctccggcagcagtgacgatcggcgccggtgagtagtcgaagtggtgaatgtcgtcgagct

SEQ ID NO: 2102 - DNA, 467 bp, Zea mays
  misc_feature (332)..(332): n is a, c, g, or t
  Predicted polypeptide sequence is orthologous to G1275
taattccgctacaacgacagcttctagagtattttgtctctatattgcagctgcagtaattcgaatagctgcagcagttgagactgtttagccggccgctgaagattcttctcatccgacgactggggtgtaaaggtaactatgggtcaaggcccggaaaagtcagaagactagggagcccgagtaggaggtggccgacggggagccgctgtgcggcgggctgtagaagccgctattgccgccgccgctgccgcacgggacgatgatagcagcggctgcggggctggcgtggttgtggacgccgtcgtaggtggtgatgacgtagcgggggntcgtcgcggtccttctccacccgcttcttcacgccgcagccctccgacgagcagcggtagtagttccttggatttgggctgttcttgacggccttcttcccgtacttcctccacttgaatccgtcgtccaagatc

SEQ ID NO: 2103 - DNA, 866 bp, Zea mays
  Predicted polypeptide sequence is orthologous to G1275
gtcactggtcacaccgcgcagcgcaacggcagcagcagctcatcgctagctccacggtcgtcggtgttccctgtgcctgtgcgtgcctactactctactctacatggcggcctcgctaggactcgcccacgaggcggccccgttctacgccgccgcctacccgccggccggcgctgcttacgcttacctcgcaccaccacccggcgacctcgtcgtcgagttcccgccgcgcgccgccaccatggctgacgactgctgctaccagttcggccaggagatgggcggcgcctactgctcgccgccggtgttcgacaatggcatgacgagcctgctgtaagttcgcgtacatacgtgctgttactagcagctagcttgcgtgctaataatgtgcgctgtcgccgtcgttgcgtcgcgtcacacgtaacgtacgccgtggcagcggctatactcaatgctcatcccatcagttgcgtacctgtggtttggctggggcttcaggaactatggcgtcgaaggcgacgggaggaggccggtgggcggaccagctggcggtactgggaacggcggcggccggccccggccggcgtcacggatcgggttccggaccaggtcggaggtggacgtgcttgacgacggcttcaagtggcgcaagtacggcaagaaggcggtcaagagcagccccaacccgaggtacagtagcagaatacaacactagctagcttggcgcacatggcgccaccgactccgacgaccacttcaattcccgttcattgtcacgctcatgcatgcaagcttgacgacgacgtgctgatccgcgcgccgcgccgtgcgtgcgtgcaggaactactaccggtgctcggcggagg

SEQ ID NO: 2104 - DNA, 724 bp, Zea mays
  Predicted polypeptide sequence is orthologous to G1275
ggcgcattgactgatacacatatatacaacaagcaaggcggctagctacagcggctagtgcgcgcgtggtgcaggcgcatctagctactacctggtgcttgttgtgcatacaatggcgacttcgctgggactgaaccctgaagatctcttcacttcgtactcgtcttcctactactcctcgccgccgttcatgtccgactacgcggcgagcttcacgccggcggccggggactccacggccttctcctcggagctcgacgaccttcaccacttcgactactcaccggcgccgatcgtcactgctgccggagccggggctgggggcggcgatcgcaacgagaagatgatgtatgtatatatgcaacgcacgcagcaaaatattattactgtgtctgtgtgtgtgctagttattgttggttggtgtcggcgcccctgctagctgcttactacagtttgcttcggtgatttcgctcatcatcaggtggtgtgagggtggtggtgacgagagaagactcagaagcaacggaaggatcgggttcagaacgaggtcagaggtggagatcttggacgacggattcaagtggaggaagtacgggaagaaggccgtcaagaacagcccaaatccaaggtactactatactacacaaatacacatgcaaattaatagagcagctagctaaattcccccaacatgaaagtcaagacaagagcaaagagatgaatt

SEQ ID NO: 2105 - DNA, 857 bp, Zea mays
  Predicted polypeptide sequence is orthologous to G1290
gtggacaacctcccattggtcttatctgttgccaacttatgtagcaaatcttgtgtgaaactgcttgagaggtgccttgatgtagtagttcgttcaaatcttgatatgattgctcttgaaaaaaagttgcctccagatgttgtcaaagaaattgttgatgcaagggtaagccttggattagtttcaccggaagacaagggcttccctaacatacatgtaagaagaatacacagagcactggattctgatgacgtggagctagtccggatgctactcaaggaaggaaaaactaatcttgatgatgcatatgcattacactatgccgtcgaacattgcgactcaaagatcacaacagaacttctggatctcgcgcttgcagatgtcaatcataggaacccaagaggttatacggtccttcacattgctgctatgagaagggaacctaaaatcattgtctctcttttgaccaagggagctcggccatcagacctcacatttgatgacagaaaagcagtgcagatctctaaacgacttacaaagcatggggattactttgggcctactgaggacggaaagccttctcctaaagatagattatgtattgaggtactagagcaagctgaaagaagggacccgcaacttggagaagcatcagtttctcttgcgatagaaggagactctgcgcgtgggaggctactctaccttgaaaaccgagttgctctagcaagaatactgtttcctatggaggcaagggtagcaatggacattgctcaagtcgatggaacactggaattcacccttgtttctagtgtggatctgcctgccgagatacaacggacagttgacctgaacgatac

SEQ ID NO: 2106 - DNA, 723 bp, Zea mays
  Predicted polypeptide sequence is orthologous to G1361
ttttttttttttttttcggagctattcttttctcttttttttttccttttgatagatgatgtaattcagcagcactcaaaaaaaactttgttggcgtggctagctactgaccaggaagtctctccggatgcgtgtagcagatgccgttctcgccctcgatggtggggatgaactcgtcgacgagcgggtgcagcttgcgggtgtccggcctcgccttcccctccaggtgctccagcagctcctggtccgtcggatcgaacttcacgcccgccggcagccccggcaggtcctggatcgccgccgcctgctgcacctgttcgtcatactgcgcgcggtgtccgcaggaggggcaggtcctgatgaggttgacgtgggaggaggcctgcagctgctgtttcttggcggcggcggcggtggccaggttgtcctccacggcacgcacgtcgttgaagctgttgcaccatgtcatggccgtcgacgacgacgatcgatctccgccggccccaagctagcctagccttgtcaccacgtcccggccctcctctttctactaaaagctaggggggagggaagcaggggaagggatagcagagagagagagatagggagggagatcgatcgaaagcctcttgttgtccgctttgctcctcagctcgcccccatatgatgcaacgccaaggctgatccccaggggaatgacaggccgcgcaaaagctcgtgccg

SEQ ID NO: 2107 - DNA, 1455 bp, Zea mays
  Predicted polypeptide sequence is orthologous to G1361
gcacgacgctctctccggccgatccctgtcgagccgggcgctagcgctacctcttgtcagcccttgcccttctttaatcgcgcctgctgtcttctcctcgctcatggagacgtcgtcgttctagctactagatcagttactgccttagccttactgctagctagctagtcgtcgtcgtcgtcgcccgcccgcgcgcgcgcttcgcttgtttttcgttatctatcgatcgagaaggaagcagctaataattagggggtccgatcaattcgttgttatgacgtggtgcaatggcttcaacgacgtgcgcgccgccgtggagagcagcctgtccccggccgcagccgccgtgggcaagacggcggcggcgtcgcttgccgtcctggtcaagatgtgcccgtcgtgcggccaccgcgcgcaatatgagcagaagagcacgacgatccaggacttgccggggctgccggccggcgtgaagttcgacccgacggaccaggagctgctggagcacttggaggggaaggcgaggccggacacgcggaagctccaccccctcgtcgacgagttcatccccaccatcgacggcgagaacggcatctgctacacgcacccggagaggctccccggtacgtacgcaccgtgtgagcaaggacgggcttgtccggcacttcttccaccggccgtccagggcgtacacgacggggacgaggaagcggcggaaggtgcacagcggcgacgacggcggcgagacgcggtggcacaagacgggcaagaccaggccggtgctgtccaacggcaggccccgcgggtacaagaagatcctggtgctctacacaaactacggcaagcagcgcaagcccgagaagaccaactgggtgatgcaccagtaccacctcggctccgacgaggaggaacgcgacggcgagctcgttgtctccaaggtctttttccagacgcatcctaggcagtgcggctacaccatggccagggaatccgccgtcgttgtccctgccgccgccgcagtcaccggcagcagcaacgcgtttattgccggccatgatggtagcgtcctcagagaagcaaacggcggagctgatcagttctacagcccaagagcaatgatggggtatgaccagggggggcctggaaacagggcacctcctgcccctgctgtgcctccccacttcatgcctaactttgctgtccatgcagcaagggctagctttgccccttgaaccgagaattcaggacaatatacaaacctatcaaatttgccagatataaataggcatttaggagcatgtgcaaactcccaggacctgaacacaattcactacttgtgctgggattgtataaaaaatgtcatgttcttaccctctaacttcacgttcatttacaagctcctcccttattgccatgcaacaatgtgataagattaaagaaaaaaaaaaaaaaaaa

SEQ ID NO: 2108 - DNA, 677 bp, Zea mays
  Predicted polypeptide sequence is orthologous to G1361
caacacgtactcatcctcttattgtccaccattacggttcagtaaactcgtcgaccatttgtagtaagttattgcattcatgaagttgccattatctgcctgcatttccctcccctctaacctatatcagtcgaatagttcctcttgcgcgtcttggtcagggaccaaagccagcagcccccgatgtagtgtgcacctcaaagttaggcaccaggtgagcaaaagcggcaaccctgctgttaaaagctgcctggttgtagctaattagtgctgctgggctgtaaaaatctacaatgcctgcctccttcaacatgttgttgccgccgccattgccaccgtcatgggggtgggggtggtggtggtcagtcgctgcgttggcagcgagcgggatggcgtccttagccgtcgccgaaccgctgccgcactgcctcggctgcgtctggtaaaacaccttggagacgacgagctcgccgtccttctcctcctcatcggaccctaggtggtactgatgcatcacccagtttgtcttctccggcttccgctgcttcccgaagttggtgtagagtaccaggatcttcttgtagcccttgagttttccaccggtgaacaccgggcgggtcttgcccgtcttgtgccatcgcgtctcgccgccctgctcgtcggtatggacctttcgt

SEQ ID NO: 2109 - DNA, 1808 bp, Zea mays
  Predicted polypeptide sequence is orthologous to G1421
gggtaccgggccccccctctagtttttttttcttttttttttttttttttcccacgaaacttattttttcccctttcattgcttaacagtaacagctcaatgaacttgtccactacaatgtctttgacaagcattaccaaataacaaagcaaacacttaggcactataccttaaacataatataacctaccaaaattacctctctgcggccgctaatgggggtgtgttcggcaaagaggaaatctcctgggcacgagcagatccaacttgcccggggaaaaaacccaagatatctctcccctttccaagcacactctcaggggcacgtttatgaaaccaaacaaccctaacatatcaagggcacactccctttcaattcacacgcaaaaatcaacggtttgcaggaagtcgtccatgccgcggccgaggtcgcagccgggcatctccgggaagacgtcgttgatgtcgtcgaggtcgaggtcgatctccatctcctcgtccccgaagtccccgagcaggaggtcatgttcgtcgtccaggccgaagtccgcatcggagagatccagggcgtccagcccggcgcggaagtccagcgggtcgatgtcgggcagctgcaggccgcgcagaaggtcctggtagaactctgggtcctccggcagctgcgctgattcggtcgacggcggggcgggcgtcggctctggggactgcgtgttccgcgcttccttgctcggttcaagcacggacgacggcgacgggtgcgcgaatggagcggtcgaggcggacgacgaggaggaagccgtcggggtgctgccgcttgccggagtgtctgctgaggacgcggccacgggcagcccgcggcggcgccgcttctcgtcggcgaagctccgggaggcggacaggtaggccgcggaggccgcaccagcggtgtcgaaggtgccaagccactgcctcttgccggtgaacgggttgcggatctccgccgcccacttgccccacttgcggagcctcactccgcggtagcgctccggcgccccgccgttggtgcacgcggccacagcggccgccgggagaaccggcttggctggggccttgccgatgaaggcctcaaaagagaagcgcttggtccttgatggggtgccgccggcctcctcgtcgtccgagtcggagtccgagtccgtggcgtcggggtcctcaaataggacacggacgcggcgcctcggctggaccggcgccggcagctgctgcgtccgggacttcaagagggcagcagagggtttaaggccaaactcagacatcttcttagcgttgggcttcttcgccagggccttcttgaggagaacctgttgctggttcaacggagacatctctcttctatctcttccgacggggagaactccaaaacttgtcgccaaaattgccaaaactatggggggaaaacttctaaagaaaaacaagaaactctgggtgcaaaaaaaatgacggagacgagcgcaaatcggccgaatccgtcaatctcctctacagaagccgcacggccttatgtggaggaatccggaatacttcaccccgaacccgtccctgagcatcgacgaggatttgttccagccgttgagccccttgcgcatagatcggccagagcaagcgagggcgcggaggatgacggcgacgacggcgatgatgagcgctacgaccaccagatcggaaaaggggcaagaagacatatacgagagttgtctgcttcttcttctccgacgccggcgacgtcgtcgtcgcctccggcctcccttacacgcgcttaaacggggtgc

SEQ ID NO: 2110 - DNA, 864 bp, Zea mays
  Predicted polypeptide sequence is orthologous to G1421
ccccaatctcccctttcgtcttctcttcccgctcccgtcccgaaattagcccaccgattagcttgcttgccctggcagatcgaagccgtagccctagccgaggagcgcccatggccgctgcgatcgtggcctgaggcggcggggctcttcccatggggtgaggggatggaccctagcctgaaggaggaggtgatgaaggcggtggaggaggcgaggtccgcggcggcgccgcggtgccgggtggtgcggatcatcgtgcacgacgaggacgccaccgactcgtcttccagcgacgacgagggagaggaggcgggggagcgcgccgcggcgcacccggccgcggcgccggcggggagcgtgaagcgcagccgcgtgctgctccagtccgctgggtgcggggcggaggaggacggcgagggggccaggttcacgggcgtgcggcggcggccgtggggccggtgggcggcggagattcgcgacccgctgctccgccgccgcgtctggctcggcactttcgacaccgccgaggaggccgcggcggcctacgtcgcagcgcgcctccgcatccgcgggcccagcaactcgctccctccgcccgagcaccgcccggccttgcccccacgtcccccgccgccacctcagcagcgggagaagaagctgccgctgccgccgccgccgccgcctctccttccgcttccgccgaagaagcagcagtatccgccaccgcctctgcttccgccgaagaagcagctgtatccgccaccgcttcccctcctcccaccaaagaaacagcagcagcatcaccatcacccgtcaccgcctctgcccacgcttccgccgaaaaagcggctgccgtcgccgcct

SEQ ID NO: 2111 - DNA, 819 bp, Zea mays
  Predicted polypeptide sequence is orthologous to G1421
ccgtcccctgcctggaccctcccgatccgcctctcctcggattccgggtggttcccattccatcgacgtaccccctagtattcactgcttcggtgttgtgggctccgtagatcgacgtggcaccagaactatccgcgctagctgttgatttatgtcgcctgctctgctgccgctccatggttctgagctcacgtcgtcagcatcctcttcttgctcctttctccagcctgggcaggggggcgccagagactgcgggtttcgcttcaggatctcaggatttggatttggggtgaagtactctgggtttctacatttaggccctcgcttcctactttgccgcacctgagatagtaaaagagttcaagaatcccccccaaatcacagtcagtcttgggtctggtttgggtggatttcattacgtttcctccaagttcaaacagccagcaggatttccgagttgagtctgaagatcttcgcttttccggtttccatcagaagttagagagaacccctattctgatttgccagattccatctgtgctgcagttcttgcgcagttcaagagactgccccaactttatccaaaaagtttcctccgtctcatttgtggtcaatctggaagcggtgtgtcaagatgcggccctcggtgcagaaggtccgcattttctgttctgatcctgatgctactgactcatctgatgatgaagatggccagatcatcgcagtgaagaaaatggttatggagatactagtcccagtgacaaactcgaagacatctaatagtctgaagaccctttgtgcgtgtggagcaaagggact

SEQ ID NO: 2112 - DNA, 925 bp, Zea mays
  misc_feature (624)..(624): n is a, c, g, or t
  Predicted polypeptide sequence is orthologous to G1421
gagtctcgccgccgcaagcttgtgtaaggtgtaaccctaaccctaaaacacttaccttcgcctccagcaccacgcttccatggaggggcgcggaggctaagtatagccaacctctacaccatatccccatggattgagcggattcccaaggcatgggtacaaaccctcacctgcaagagctggccgcttcggcggtggcggcttctgaaccaccaccgcgggcgcgcgtggtgcggatcctagtgcacgatgctgacgccaccgattcgtcctccagcgaggatgaggcaccgccacttcttcctcggcggaggtcgaggggtggtagcagcagcctgagcgtgaggcgccgtgttatggaaccggctggggcaagctcggccgttcggttccgtggcgtccgtcgtaggccgtgggggcgctgggctgcggagatccgcgacccgcacaaccgccgcagactgtggctcggcaccttcgacaccgctgaggaggctgccaacgcctacgacgctgcgaacatccgcttccgcggtgtcagcgccactaccaacttccctgcggcccgctactcgccccctccaaagccagcgaagcctatcatctcgctgactcctgaacccnggaaggtgatcaccttgccaccggtacctgtgaagccaaccttccctgttcaggtgaaggaagtgggtgggagctggggcggcctgatcaagggagctaggtcggaggtcaaggcgtttgcacccaagccagtatggaagatgatccccagggtgcaccagaagttccgggttgtgccgatggctctgggctgcgtgccgtccatgctgcctccatctacgtggaggaggttggcggtggctgatggtcccagtatctgcaattactatcgctagaggtttttattgtctatctccatggc

SEQ ID NO: 2113 - DNA, 809 bp, Zea mays
  Predicted polypeptide sequence is orthologous to G1482
cgaagattgtatagtagatagggggtagatgaccggcgaaacggccggcggcgacacgtatggcgcgtttggcctctgcggctctgtacaaatggcggcccaagacaggaccagacttcttcgcaaaatgttcgtggcgctctcaggaacgccttagtcaaagctttgcacgctatagaagacttgtattttagcttttgaatattttcagctaattttaggagctgtgcattcaaacacgcgttagtcaaaggttcgcctcagttaaaggtttcttcatgcacgccgcagaagactagaatcttgcagcagtatttgcatggcaccgaaccgacggctgggatgatagaactgaaccgacctgatagaggccatccgagcaggcgccgacgtcgccagcggacgcgtcgtcaatgaggaagtcctcgacgtgccacccgggcagcgtcttggtcaggtactcggagatgctgctcccgtcgctggcggtcgccgtggtcgcgccgccggcgccgctgccgctgctgcaggattcgtcgttgcaggggccgcggctgttctcctgctcctcctcttcggatgggcccgcagagtccaccggcgctgacgagaggcgcacgccggtgagcaggaaccggctgtgccgcctcgtcatgtcgctggcgctgtgcaccggcgcgtcgcactcccggcacaggatcgccctgtcctccttgcagaacaagaagcccctccgctcctgcacgcagccgatgccagacaggcagcgccgctactcggttagcaagcaccaaagcaccgtccgagcc

SEQ ID NO: 2114 - DNA, 614 bp, Zea mays
  Predicted polypeptide sequence is orthologous to G1482
ctcgtccaccaggaagtcctcgacgtgccacccgggcagcgtcttggtgaggtactcggagatgctgctgctgtcgctcccgtggctggtggcgggcgccgacgacggaagaggaggaggatgtgcggctgcgtcgccggcgctgcagcagaagctgccgctgctgttctcgtcgtcctcctcctcctcatcctccggcgccgggcacgcggcggcgggctcggcggagaggcggacgcccgtgagcaggaaccgggcgtggcgcatggtcaggtcgctggccgtgtgcaccgacacgtcgcagtcgcggcacaggatggcgcggtcctccttgcagaacaggagcccccgcttgtcctggcagatgtcgcagagcggcggcggcggcggtggcgccgggctgagcagcgagaagcggcggtgcttgccggcgagcttgttggcgcggtgcacgcggcggtcgcacgcgtcgcacagcgccgcctcgtcggcgcagcagaacacctcggccgcctcggccgcgcacacgtcgcactgcaccttcatctcggccactccactctgcttttccctcaagcgatgatcgcgcgcgctctggcggctcagctcagggc

SEQ ID NO: 2115 - DNA, 856 bp, Zea mays
  Predicted polypeptide sequence is orthologous to G1482
gtcctcttctctgttcctctccagcccccttttcaacctttgacgctgtagcttgagagcgagcttagtgcctaccatattctcctcctgagcgactgagcgctggtctccgataggctcgccatgcaggtgctctgcgacgtctgcggcggcgcgccggccgccgtgctcttctgcactgacgaggccgcgctctgctccgcctgcgaccgccgcgtccaccgcgccgacaagcgccgccgcatcccgctcgtccagccctgcggcgacgactccgccgccgccgccgccgcgccgctctgcgacgtctgcaaggagcggaggggcctcgtgttctgcgtggaggaccgcgccatcctgtgccccgactgcgacgaccccatccacagcgccaacgacctcaccgccaagcacacccgcttcctcctcgtcggggccaagctctccgccgcgctcgtcgaccaggcgcccccctcccctgacgacgacgacgacgacgtcgccgagcccgacgctgtccccgccgcctgcgcggccaaggcctcgtctcttgagtccggcggcggcagcagcatctccgactacctcaccaacatctgcccgggctggcgcgtcgacgatcttctcttggacgactcgtcgttctcagcgccatctaagaccggctacagcgacggccacgatcaggtgccgtccgtggatgccgacctcttcgacgtggtggccagcggccggccaggcaagcgcgtcggcggcgcagcgctgggcttcgacaaggccccggcctccgttgtggtcgtcccgacgcaggggtgcgtgacggagaagacttgggacagcgacagcgacgtgttcg

SEQ ID NO: 2116 - DNA, 867 bp, Zea mays
  Predicted polypeptide sequence is orthologous to G1537
cccaagagccggcacagaggcaaaggccagccctccagtgacaggcagatcgaggccacatggagacgccacagcagcaatccgccgccgccgccgccgccgccgcccacgggcaggacgacggcgggtcgccgccgatgtcgccggcctccgccgcggcggcggcgctggcgaacgcgcggtggaacccgaccaaggagcaggtggccgtgctggaggggctgtacgagcacggcctgcgcacccccagcgcggagcagatacagcagatcacgggcaggctgcgggagcacggcgccatcgagggcaagaacgtcttctactggttccagaaccacaaggcccgccagcgccagaggcagaagcaggacagcttcgcctacttcagcaggctcctccgccggcccccgccgctgcccgtgctctccatgccccccgcgccaccgtaccatcacgcccgcgtcccggcgccgcccgcgataccgatgccgatggcgccgccgccgcccgctgcatgcaacgacaacggcggcgcgcgtgtgatctacaggaacccattctacgtggctgcgccgcaggcgccccctgcaaatgccgcctactactacccacagccacagcagcagcagcagcagcaggtgacagtcatgtaccagtacccgagaatggaggtagccggccaggacaagatgatgaccagggccgcggcgcaccagcagcagcagcacaacggcgccgggcaacaaccgggacgcgccggccaccccagccgcgagacgctccagctgttcccgctccagcccaccttcgtgctgcggcacgacaaggggcgcgccgccaacggcagtaataacgactccctgacgt

SEQ ID NO: 2117 - DNA, 433 bp, Zea mays
  Predicted polypeptide sequence is orthologous to G1539
ctcgaattccgttgctgtcgggcgccaaaatctaatctttgggtatggattagtattccagaagataatccagcattgttaaacctactgtgaccagtcatcgaggtcattctattgaagaatagtaaatggggaagagcacattaactgttgcacacatgagaagcagataccaaaatatttttttttgggtatggattagtattccagaagaggattaggcatagataaacctactgtgaccagtcattgagctcgatctattgaagaatagtagatggggaaggacacactaactattgcacacacataagaagcgaataccaaagtttaattactagaaaacactttaccaaatctaaactttgggtatggattagtattccataagagcgacagcaacggcgacagcaacggaattcactggccgcgt

SEQ ID NO: 2118 - DNA, 586 bp, Zea mays
  Predicted polypeptide sequence is orthologous to G1543
caacaacgggagcgggaacgggtaacaacatgagggacctggacatgaaccagccggcgagcggcggcgaggaggaggagttcccaatggggagcgtggaggaggaggaggacgagcgcggcggcgccggcgggccgcaccgcgccaagaagctccggctgtccaaggagcagtcccgcctcctggaggagagcttccgcctcaaccacaccctcacaccgaagcaaaaggaggccttggctgtcaagctcaagctgcggcccaggcaggtggaggtctggttccagaaccgcagggctaggacgaagcttaagcagacggagctggagtgcgagtacctgaagcgctgcttcggctcgctgaccgaggagaaccggcggctgcagcgggaggtggaggagctgcgcgcgatgcgggtggccccgcccaccgtgctctccccgcacacccggcagccgctcccggcgtccgcgctcaccatgtgcccgcgctgcgagcgcatcaccgccgcaacggccgcgcgcaccccacgcccggcgcccgccgcgagccccttccacccgcgccgcccggtccgcggcgtttt

SEQ ID NO: 2119 - DNA, 838 bp, Zea mays
  misc_feature (17)..(17): n is a, c, g, or t
  misc_feature (44)..(44): n is a, c, g, or t
  Predicted polypeptide sequence is orthologous to G1560
ctccagttccggtccgnattcccggctcgaccccgcgtccgggnaaggatatctagatgatgggaacttgactcaagttagtgaccagtcagagctgaacgacgacttctgggcagagcttttggtcgaagattttggagacaaggcaggacagccagagttggagggaagaactgaagacgtgaatgaccttgctcaacaactggggtatctgagttcttctagcccaaaatagagccagttcctaatggttgcccccacaatcactggtgctttccctaccctactgttgcagaccatcctgatcaaaccggtacttttcaaattcaattcaatgacacaaacctgttaaaatctggtggagaggtgttcatactgaaggcgtgctgtggagaggtcactgccttgacgttgaaggcttagcgctgtactctgctgtgggagttacgtgtggggtgttggctaaatgtctcttccggcgtcttctggcaaaatgatctcgtggacggtgactggcaaagatgcctaggggccaacgtatacgtacacagctgttatcagatcttgttcaaagtcattgcgcggttttgacggtgctatgtatcgatcagggttctggccttctggggttgggttgtagaattgactggctgatctagtgttctccatgtatgactggtgtaaccttaaaacaccctcagcttgttgttgaactgtgacaagcatctcgtttttttgttgtactccattttcatcatcattgtacatcaaattgctgaattatgaacagatcccctataatttggtggactgcgtcttggcatttggctaccggccc

SEQ ID NO: 2120 - DNA, 705 bp, Zea mays
  Predicted polypeptide sequence is orthologous to G1560
gaaccgcaacactacaaagcttccaccgcatgaaattagacaaacagtttgcacacaaccactgacagaaacatgtataaccatcagtactacttgctgagtcgctgtcactgtacataactacagactgaattcctgacgggcagggtcgtaaaacaaccaacagatcgctggcgtcgcctaaaacagccactccagtggcaagcagcaatcactagtcagatcacatcagatgcacctagcagttctcccttgacaccatggcgaatgccagccaattctcatggaagcaagccctaccattggcgaggaattcagaagggcatggaaaccgagcaacggaagcagaattgcctagtcttgctgacacagtgaacacaattcaggagctgcgggttctggtaagatggaaataacaaaacagcaacgaagccaagactaattgctagatgttgggccatctgagttgagataacccatcttctcagacagcacattcatatcatcctcgattacagggctatcgttctcctcgccaagtccttcgttcagcaactgctcccagaagttgtcattcagatcctcctggggcatgtcttgctgctgctcagaggtactgccaatatcaatatcaatatcaatatcatgtggcccaatcaggccgtggccatcgaaagctgggctctcgaggtcagctgggattcc

SEQ ID NO: 2121 - DNA, 1547 bp, Zea mays
  Predicted polypeptide sequence is orthologous to G1594
catccccaacctctctctctcccccctaggagtgggagctcctggctccatctatccgcctgcagatatcacaagcttttcctgctgctgctgctgcagcagcacctgcagcttctccgtctgcagtgcgagcagctgctaaaaattcccccataagcctctggcttcctgcccccctcactttcttggaagcccagcacaacacgaggatcatattcactccctacagtggcgtactagaataccagttgtgcgcaaacagcggcagcagccgtgatgtacaggtgagctggctctgccgctccactccatggaggatctgtacagcatccacccggggatctcgcgggtcgtcggaggcgcggcgagcgaggcgtccgtcgccggcgccggcgccggcgggccctcgccgtcggatctgacggagctcatgaaggcgcagatcgccagccaccctcgctacccgtccctcctctccgcctacatcgagtgccgcaaggtgggagcgcatccgcatgtgacgtcgctgctggaggaggtcagccgggagaggcgccccgacgccggcgccggggagatcggcgtcgatcctgagctcgacgaattcatggacgcttactgccgggtgctggtgcgctacaaggaggagctgacccggccgttcgacgaggccgcgtcgttcctgagcagcattcaggcgcagctcagcgacctctgcagcggtggaagctcgccggcggctaccgccacgcactccgatgacatgatgggctcctctgaggatgagcaatgctcaggggacactgatgtgccagacatggggcaagaacatagctctcacttaggtgaccacgagctcaaggagatgcttcttaagaagtacagtggatgcctcagccgtcttcgttcagagttcctgaagaagcggaagaaagggaagctaccgaaggatgctcggacggtgttactagagtggtggaacacgcactaccgctggccttatcctacggaggaagacaaggtgaggctcgcagcaatgaccggtctcgacccgaagcagatcaacaactggttcatcaaccagaggaagaggcattggaagccatctgaggacatgcggttcgcgctcatggagggtgttgccggtgggtcttctgggacgacactctacttcgatacaggcacaattggaccctgaatcatacaccacttgggatgacaactggccagctcatattagtaataagatctggcatgtggagtgacgatctgctcggtgaaaattgaaaataaatctgctgagctgaggttgatcagactagtcagttgccctattattttacaagatcatgtgtatatggtgccgtcgtatcagaacaaactgtatgcatgtatgggcgaattgagacctgcaaaaggagtttaattagtagtttcaagtattggctcatggatttgtaatactcgctacccaatttaattgttagataggctgaagggcttataaaggtaaatttacttctgctaaaaaaaaaaaaaaaaaaaaa

SEQ ID NO: 2122 - DNA, 1447 bp, Zea mays
  Predicted polypeptide sequence is orthologous to G1594
ggcacgagagagagcagccgagccggttcaaccccatgaataccgctgctgcagagatcacggcctgcttctgcgtctgcagctccagcagtagcaacagcaggggctgcagtgcaaacgactgctagttcccctttccccgcatgatctctgccccttcccctaccttctcttgttcttgcttgcacgacccttttccttgtgcgctagtgccgcttcttcttcgtcttcctggagctccccgcatccacacatgccccaagaaccagacaataaaacaacacggaaccatcggagtctttttctactactatttccagcgatttgattatatggatgtgtgcacaggtgcacgtagataggtagaatagaagggagattatagctagctagaggcagcgagcagctcggttgctgggacacgcgatcgagctacagcaaagaagactgcagggtggcgcggcgggcatggaggatctgtacagcatccacccggggatctcgcgccacggggcggcggcgactagcgaggcgtccggggtcgccggtggaccgggctcacccccgcccccgcccccgccggcggcggatctgacggagctggtcaaggcgcagatcgccgggcacccacgctacccgtccctcctctccgcctacatcgactgccgcaaggtgggcgcgccgtcggaggtggccacgctgctggaggagatcggccgggagaggtgcgccgccgcctccgccggcggggaggtcgtcggcatggaccccgagctcgacgagttcatggagacgtactgccggttgctggagcggtacaaggaggagctgtcgcggccgttcgacgaggcggcgtccttcctcagcagcgtcaggacgcagctcagctccctctgcggcggcgccgcctcgctctccgatgaaatggtggagtcctctgaggacgagccatgctcaggcgacacagacgcgacgacagacccagggcaggagcacagctcgcgcctggccgaccgcgagctcaaggagatgctgctgaagaagtacagcggctgcctgagccggctgcggtccgagttcctgaagaagaggaagaaagggaagctgcccaaggacgctcggtcggcgctgatggactggtggaacacgcactaccgctggccgtaccctacggaggaggataaggtgaggctggcggccatgactgggctggacccgaagcagatcaacaactggttcatcaaccagcggaagcggcattggaagccgtcggaggacatgcggttcgcgctcatggagggcggcgtctccggatcctcctccgggacgacgctctacttcgacacgggcaccatcgggccgtgatcgatgcgatagatacctctgacgaattgggggcaaattgttggttgatactgagattagttacatgaagcaatatccgctg

SEQ ID NO: 2123 - DNA, 1094 bp, Zea mays
  Predicted polypeptide sequence is orthologous to G1594
cacgagagcagcttggttgctggggcacgcgatcgagctccaggcaagaagattattgcaggaaggcgcggcaggcatggaggatctgtacagcatccacccggggatctcacgcgccgggggcgccgccacggcggccagcgaggtgtccggggtcgccggcggaccaggctcgccccctcccccgccgtcgcagccccctccgccgccgccggcggatctgacggagctggtcaaggcgcagatcgccgggcacccgcgctacccttccctcctctccgcctacatcgagtgccgcaaggtgggcgcgccgccggaggtggccacgctgctggaggagatcggccgggagaggtgcgccgccgcctctgccggcggggaggtcggcctagaccccgagctcgacgagttcatggaggcgtactgccgggtgctggagcggtataaggaggagctgtcgcggccattcgacgaggcagcgtccttcctcagcagcgtccggacgcagctcagctccctctgcggcgccgccgcctcgctctcagatgaaatggtagggtcgtcggaggaggacgaagcatgctcgggaggagacacggaggcgacggagccggggcagcaggagcacagctcccgcctggcggaccgtgagctgaaggagatgctgctgaagaagtacagcgggtgcctgagccggctgcggtccgagttcctgaagaagaggaagaaagggaagctgcccaaggacgcgcggtcggcgctcatggactggtggaacacgcactaccgctggccgtaccctacggaggaggacaaggtgaggctggcggcggcgactgggctggacccgaagcagatcaacaactggttcatcaaccagcggaagcggcactggaagccgtccgaggacatgcggttcgcgctcatggagggcgtcaccggcggcgggccctcgtccgggacaacgctctacttcgacacgggcaccatcgggccgtgaccaccacactaccagcttgggcaacgcaaagtgcatacgtttttctttgtgtatatgggcgacaacgtgtcggtaggtacactcagcatactgg

SEQ ID NO: 2124 - DNA, 574 bp, Zea mays
  Predicted polypeptide sequence is orthologous to G1655
ttttttttttttttttccccaaactggtttctgatccttcattccccggtaccaaaatcatggcacgcaacacacaattatccacaagttcttttatgtactaacacgagagtaagtaccaaagcacagcagagcagaaagaagagaggagcagcatttgcagctgcggtaggagtaaggatcaaggaatttacagcaaatcacgagctcatcactctgctagtcccaccaccaatcgctcccgacaatagcaacgcacgcaccgcaaaatgattaacatccggcagatgcagatggggggagcgagcaggagccggtgatcaatcatgtcatggggccaagcggctaggccaaccaaccaatcaatccgtcaatccagccacacccgcgcagccacgtctcacctctccgccggcgacgacagctgcgcggccgccagcgcgtcggcgagcgcgcgcatggcgctgacctgcatctgcagcgcggccacgtagtcggcggcctcctccagcagcgcgggcgcggggagcctccggcagcccgggacgaggcagcccagcgcgcggagccgctc

SEQ ID NO: 2125 - DNA, 649 bp, Zea mays
  Predicted polypeptide sequence is orthologous to G1655
gatctgaaccaacatttcaagctgcattcatcggagagcgaatcgaagcaggtgagaacaaaccaagctacaaaagaatcctgagccggagggaggagaggatagagacagcaaaaccactgtgggctacggcttcttctatcacatattacagcacgggttaatcgctgggacgccatcgtcgtcgtcgtcgtcttcatcataacactaaccgctcaccgaactgggagaaacaagacgacaaaggaaactagaaagagggaaagctagcggttaactaatcccgaggaaaaattcggggcgagggaaaaaatagacggaaaaaaaatttacaacgaatccacgaatgttggtcacgccggcgaggaggaaggggaagagccggcgccggaagatgatgaggagacggcggacagcgcctcggcgagggccgtcatggcgcggacctgcatctggagcgccgcgatgtagtccgtggtctcggcgaggagcgtcggaaacgacagcttccggcagccgggcacccagccggcccagcaccatggccttcctcgccaccggaggcagcgcggcggtgcccttcgccccggaggcgccgtggcgcggaggcggggacgcgggggcccgaaggcgcgcgcggggcgcggcc

SEQ ID NO: 2126 - DNA, 753 bp, Zea mays
  Predicted polypeptide sequence is orthologous to G1655
caggtttctctgaagtacagatcagtaattatggttatgagatgatacaagcaagccatgaacaacggttaatctgcttgcagcagcagcagcagcagccagaggtacactacaggacgttcagcaagaagcacatgaaagatacatcatacatgagggtgtgatctgaatgaacatttcaagatgcattcatcgaagagcgatcgaagcaaatgaaaataaacccaagctacaaaagaatcctgagctagggaggaagggaggagcggagacagcctacgacttcttctatcacattaccgcacgggttaatcactgggacgccatcatcatcttcttcttcatcgtcacactaaccactcaccgaactgggagaaacaagacgacaaggaaaactagaggggagagagagagaaagctagaggttaactaatcccgaggaaaaattcgtggggggagaaaagagagggaaaaatttacaacgaatgcacgaatgttgaggcttcggcttcgatcacggcggcgaggaggacccggcgccggaggaggaggtggcggagacggcggacagcgcctcggcgagggccgtcatggcgcggacctgcatctggagcgccgcgatgtagtccgtggtctcggcgagcagtgtcgggaacgacagcttccggcagccgggcaccagccggcccagcaccttggccttcctctccagagggggcgtggcggcgcccccttcccgccgaggccgagggg

SEQ ID NO: 2127 - DNA, 548 bp, Zea mays
  Predicted polypeptide sequence is orthologous to G1798
cccagcagcgtgaagtgaggccagctagccttatcagcctatggcggctcggattggagcggacgggaaggcgatggcacgccgcggccgcgtggagctgcggcggatcgaggaccgggtgagccggcaggtgcgcttctccaagcgccgctcggggctcttcaagaaggccttcgagctctccctgctctgcgacgccgaggtcgccctcatcgtcttctcccccgccggcaagctctacgagtacgcctccaccaggcaaaaggcgtggtgcgtcacttatccattcaaacacaggaatttgttgcaatcacgggattgtagaagaaaactacaagatgtgatgatgctgatgctacataagtcatgctaaaatgtctcgtttattgaagtattgtatctcaaatatattattttttaatttctttatcttgtagtttatatttgagattttattattatatttagtcactgcacactctcgttaaaagagtaacgacctttttggtgaccaaaaaaaaaaaaaaaaaaaaaaagtcgacgcggcc

SEQ ID NO: 2128 - DNA, 585 bp, Zea mays
  Predicted polypeptide sequence is orthologous to G1798
gcacgagctgggcactggtgaatgaacgagagtgacctgacccccgtgcggccgtccgccgtcaccgaccgagcgccgggtcccaccactccccgtccccaacccctcgcgctcgctccagcctccagcaaccgcgctccctgttcctttccttcccaggcggccaggcccagcagcgtgaagtgaggccagctagcctattatcagcctatggcggctcggattggagcggacgggaaggcgatggcacgccgcggccgcgtggagctgcggcggatcgaggaccgggtgagccggcaggtgcgcttctccaagcgccgctcggggctcttcaagaaggccttcgagctctccctgctctgcgacgccgaggtcgccctcatcgtcttctcccccgccggcaagctctacgagtacgcctccaccagcatagaggatacatataaccgctatcagcaattttctggagaaggaaggaatataaatgacgatcgaaatagaaacgataacaaggataaagcttcttcagatttgcagttgatgctgagcaagattgccacctggtctccccagagcaatgctgac

SEQ ID NO: 2129 - DNA, 1341 bp, Zea mays
  Predicted polypeptide sequence is orthologous to G1798
ccacgcgtccggccaaaacccttacgcgcgacgcggccccctcctcttcttctctctcccaccaccgccctccccttgccatttttggtgagtgccccctttcccttccctagaccagatcctcgccccgttttccacttttgcctccaccgcgccggcccaattcggataacaagctccctccgcctcgccgcgtctcctcccagccgcaggagccgccgccatccgatccggaagagggaggaggggggagggaggaggatctgtgtcccgattcgattgcagctctcgtccccggcggtccaggatggtgcggggcaagacgcagatgaagcggatagagaacccggccagtcgccaggtcaccttctccaagcgccgcaacggcctgctcaagaaggcgttcgagctctccgtcctctgcgacgccgaggtcgcgctcgtcgtcttctccccgcgcggcaagctctacgaattcgccagcggaagtgcccagaaaacgattgaacgttatagaacatacacaaaggataatgtcagcaacaagacagcacatcaggacattgagcaagtaaaagctgatgctgagggcctggcaaagaaactggaagcacttgaagcttacaaaagaaaacttttgggtgagaggttggaagaatgctcctttgaagagctgcacagtttggaagtgaaactcgaaaagagcctgcattgcatcaggggaagaaagactgagctgctggaggagcaactccataagctgaaggagaaggagatgaatctgcgcaagagcaacgaagatttacgtgaaaagtgcaagaagcagccgccgccgccgccgcctatgctgatggctcctccgccgcctccagcgccggcagccatcgatcacacggggccgaaggatgtcgggatggacgtggagacggagctgtacataggattgcccggcagagattaccgctcaaacaacaaagacatgactgcacagtagctgtcaggtcaggtcaggtcaggctagccagcagtgcagagaataatcttagatctgtggtgcggagaactggagatgcaagccaagcccaagccaatcaacatgataaggatcatgagtgtcgcgtcgtgttttacaaacctgtccaccgtccgtcaaaggcacatgcgccagaacgtccgtcagagaacacttaccccctcatctccctctattagctagctgctccggcctgctcatgtcgaaaccttctgttcaagtatgttctcctcctgatgaattccctgcccggcatgcattggtgagcttcttctcgagaagaagtgggtggggtggggacactgtcg

SEQ ID NO: 2130 - DNA, 1154 bp, Zea mays
  Predicted polypeptide sequence is orthologous to G1798
gcgccctttcccttcctccccagatccccgtccccgttttccacttttgcctccgccccaattcggataacaaacccctccgcctcgtcgcgtctcctcccagccgagccgatccggtagagagagggagagggagggactgagggaggaggagctgggttccggtcccggccgcccggccggctgcgcgattcgattgcagctctcgtccccgggcggcgtccaggatggtgcggggcaagacgcagatgaagcggatagagaacccgaccagccgccaggtcaccttctccaagcgccgcaacggcctgctcaagaaggcgttcgagctctccgtcctctgcgacgccgaggtcgccctcgtcgtcttctccccgcgcggcaagctctacgaattcgccagcggaagtgcgcagaaaacgattgaacgttatagaacatacacaaaggataatgtcagcaacaagacagtgcagcaggatattgagcgagtaaaagctgatgcggatggcctgtcaaagagactcgaagcacttgaagcttacaaaaggaaacttttgggtgagaggttggaagactgctccattgaagagctgcacagtttggaagtcaagcttgagaagagcctgcattgcatcaggggaagaaagactgagctgctggaggagcaagtccgtaagctgaagcagaaggagatgagtctgcgcaagagcaacgaagatttgcgtgaaaagtgcaagaagcagccgcctgtgccgatggcttcggcgccgcctcgtgcgccggcagtcgacaacgtggaggacggtcaccgggagccgaaggacgacgggatggacgtggagacggagctgtacataggattgcccggcagagactaccgctcaagcaaagacaaggctgcagtggcggtcaggtcaggctagcagctacctcagccacgcacaggcccaatcaacgcaagctagctagctgagaataatcttttagatctctggtagtgtggagatcgagatgcaagccaagcaatgtgatatcgcgttgtgtgttaccaacctgtcagtctgtgtatcatcccgtcccgtccgtcagagtctcagagaacgaacacttcttctccttctccctgtagctagctgctcctgcttgtgtcc

SEQ ID NO: 2131 - DNA, 895 bp, Zea mays
  Predicted polypeptide sequence is orthologous to G1798
cgacgagcgacgagctaaaccccgaccgagtcgctgcttgggtgcccaagatagccctaccgcctcgcctctctcgttccccctcatcgccacgccagtcgcctccactcccagtcatctcccatcaccgacgacgtgtcgaggcgagagaagagggcgagtccaagtctagggttcccgccgcatcgacacgggcatcgcaccgcaccgcgaggggcgggcacggaggaagatggcaccgcgcgggcgcgtggagctgcggcggatcgaggacaaggcgagccggcaggtgcgcttctccaagcgccgcgcggggctgttcaagaaggccttcgagctggccctgctctgcgacgccgaggtcgcgctcctcgtcttttcccccggcggcaagctctatgagtactcctcctccagcatagaagatacatatgaccgctatcatcaatttgcgggagcaggaagaaaagtgaacggacataacaacgataaccgggatgtagctgcttcagatttacagtcgagacttaaggagatcgcaacatggtctaaacaaaacaacgctgaggagtcggatgccaatgaacttgagaaacttgaggaactcctgacaaatgctttgaggaatacgaaagccaaaaagatgttggcaaaagaaaacaatggtggtgccggtgcaagtacaagcagccagatgttgctttactcggcagagcgtgcaaccgacaaatgaaacggggcgtgcatctgttgctaacggggcggtgccggtgccgcatactattgttgtgtagctgaagtttgtcaaggtggctgctggcaaggtagccgaggaagtggagttcataacaggatgcggaaactgtgccgctccttgccgaacttagccccgtta

SEQ ID NO: 2132 - DNA, 904 bp, Zea mays
  Predicted polypeptide sequence is orthologous to G1798
gacgaaacggcaagcgtcgccctctccaccgccaccagtccacctcctcgtcctcctccggtcacgcacgcagctagcttacccgccccgccactataaaaatccacctccaccccaccgcgcgtctacagttccacacacgcgtgcacgggcgggcaagcaccagaaaggaaaggcggaggccgcgcggcgggcgccagctgcagccaagagcccactagtagtagtagtagctagttcaccaccgcctgcttgcctcctttactttgccatatttgctagcgtttcctggattggggacgcttccgtttcgggaagccgtgaagggatcggccacgacgatggtgcgggggaagacggagctgaagcggatagagaacgcgacgagccggcaggtgaccttctcgaagcgccgcaacgggctgctcaagaaggccttcgagctctccgtgctctgcgatgctgaggtcgggctcgtcgtcttctccccgcgcggcaagctctacgagttcgccagcgccgccagcctccagaaaacaattgaccgctacaggacatacacaagggaaaatgtcaataacaagactgttcaacaagatatacagcaagtcaaagcagatgccgtaagcttggcaagtagactcgaagccctagaaaagaccaaacgaatgtttctgggtgaaaatttagaagaatgctccattgaagaactgcataatctggaggttaaactggcgaagagccttcacgtcatcagagggaagaagacacaactgctggagcagcagatatccaagctgaaggagaaggagaggaccctgctccagacaacaaagagttgcgggataagcagcgcaacctccagtctccaccggaggcgccacgggacctgaccgctgtgtcc

SEQ ID NO: 2133 - DNA, 651 bp, Zea mays
  Predicted polypeptide sequence is orthologous to G1895
ttttttttttttttttttttttcagaaaaactgtgatatctttaaatttatatcttggggaactgcaatacatcattcactataccaactcaatcatcaagcatgtgggccaaaacaatcaatcaaacactgaagaataaaacaactcacacatggagccatacatcagttcgtagcagtggtacaacacatgcaactggtaaaaagagaggatcttgccttctgcttttctttgcttcttggtgaactaaccatggtattactcttcgagttcgattctggttccttcaatggagaccatataccagcttcgctctgcatcagcaagctctcaaatggtttcttaaatcttgcaaaatgatttgctattctgaagtctcctcctgttggttccctggggcttaacagtgggctcctctcagattcttcatcagcctcaattttaaattgcattacagcaatgtcggctgtggggatttccatgtgtacatggctatgctgctcaatacaattggaaaaacctatattttgcgctccctgaagtaatggagtcacttcactggcttctctccctggagttgatgtctgatgagtatgttgttcctcagtagccgtaccaaaacatgttgtgactttcacctgattgcattg

SEQ ID NO: 2134 - DNA, 1037 bp, Zea mays
  Predicted polypeptide sequence is orthologous to G1902
ccaagggctaccccgtgccggttgccaaggaggagaggccggcgccgggcggcgacccgtgcccgcggtgcgggtcgcgggacaccaagttctgctactacaacaactacaacacgtcgcagccgcgccacttgtgcaagtcgtgccgccgctactggaccaagggcgggtccctccgcaacgtccccgtcgggggcggcacccgcaagagcagcagcagctcctcatcatcctcggcggcgacgacgacgacgacgacgacgtcaacctcgcccggcgccgcgcccaaggccacgaaacggtcgaagaactctaagcgccgccgcgtcgcgcctgccccggaccccgccgcgcccggcacggacgcctccaccgccgacgtcgcgagcacggcaccgtccgcagcgacggtggctgcctcggagaagccgagcgcgacggagcacgcagcggcggctgtcgccactgagaagccgccggccgcgcctccggtgtccgtcggcgctttcgcggacacgtccccggcgccagatgctgggagcggcggcgttagggagctgctgccgcacccgagccgcttcgagtggccgtcgggctgcgacctggggccgccctactggggctggggcaccagcgtgctcgccgacaccgacccggcgctgttcctcaatctgccgtgagtgacccgtgacaacgccatggcgcccatggttaactagtcaaccatcatcacacggtcgacgagatgagaggaacagagcacgcagtgcgtcgggctcttgaagctaggtgctgtagtagtctcctaagcttactgttgtctagaccgacagtctcgcgtacttgtgtagttgtgttgatggtttttaatcgccgctttgtactgcaattctagtaaaaaggctagcatgggatagccgggctctgcacggatctgtgcttgctttgacagtttgatctgattggggtgctttcttattttaaggccatgagaatcgcaagaacagggagcggcgaacttcgaagaaaaaaaaaaa

SEQ ID NO: 2135 - DNA, 865 bp, Zea mays
  Predicted polypeptide sequence is orthologous to G1902
cgagctgggaaggaagagcccgcgttgctcgctcgctcgctcgcatgcagctttcccacacggcgccacgcatgcaggagcccgggcgccggcccgtaccgccgttcgcgggcgtcgacctccgccgccccaggggctaccccgctccggcggcgaaggaggcggaggaggagccggccccagctccggcgccgggcggcgacccgtgcccgcggtgcgggtcgcgggacaccaagttctgctactacaacaactacaacacgtcgcagccgcgccacttctgcaagtcgtgccgccgctactggaccaagggcgggtccctccgtaacgtccccgtcgggggcggcacccgcaagagcggctcctcgtcctcggcctcggcctcggcaacgccaacctcgaccggcgccgcacccaagagcccgaggtcgtccaagaactccaagcgtcgccgcgtcggcccggccccggcgccggaccccgcccctgccaccgccaccgccaccgctgacgtcgcgaacacggcaccgtcgacggaagccgcagcagcaacgcgtgccgcctcggagaagccagccgcgacggaacccgcagcggcaacgggtgccgcctcggagaagccggccgcgacggagctcgcagcagcggttgtctccacggagaaacctccggcggccgtcggcggtttcacggacacgtctactacggtgcccgagatcgggctcgcggatgtctgcagcggcggcgtgaaggagcttgtgccggacccgggccacttcgagtggccgtcggggtgcgatctggggtcctactggggcaccagcgtgttcgccgacaccgaccccggcgctgtttcctgaacctg

SEQ ID NO: 2136 - DNA, 662 bp, Zea mays
  Predicted polypeptide sequence is orthologous to G1911
caaacctaatcagcaggatctactagctagctagctgttgagagcttgacacaaagaagcgaccgagcggtcgagctagcttccaccatgtcttggagccagagcgagaacgcgcggttcgagcgcgcgctggccacctacgaccgggacacgcccaggcggtgggagctcgtggccgccgcggtgggcggcgggaagaccgccgaggacgccaggcggcactacgccgacctcgtcgacgacgtcggcgacatcgagtccggcggctacggcgccaacgaccaaaacgccaacggcggcgccaacggcagcaacgggaacaacaggggcggcagagccaaccggccccagacatgaggggcgcctgccgcgggagaccgcaccagcacgccggccggacgacgttgcgcgcgtgcatgcaatgattgttcgtcgtgtacgtacgtgagtcctgagatatgtatgtatgttcgtgtgcctgtgtgtaactatatatatatatatgtgtatacatatatatcggcatgcatgcatatgcgcaaagtgcgcacaagtatatatgcgctgttgtggcagaagccgtgtctgatcagtgtgaccgagtgcgaggagctagcacgggcgcatagctgcagcctgctagctagctcctgatggatgtg

SEQ ID NO: 2137 - DNA, 478 bp, Zea mays
  Predicted polypeptide sequence is orthologous to G1911
atatatatgctacagatgctgagattttacatcgcaacacggggggaacggagatcgattgatcaacatcctatagctattgctagtagtaattctaattcacatgcgtgcttgaacagataatccgtccgacccactcgcttggcttgcttcttttgtagccacacgtgcttcttttttttggcgcgaagtgtacgtatgtaggacgtacttgttcagtggttctcatgatgcttgcctgccgcctagatcttcaggtcaggtgcttcagcctgtcgctgtcggcgtcgtcgtagccgccggggcaccctgtacgcggggaaggccaccttgccggcctcgatgtgctccaagtccttcaccagcagctcgtagtagcgcctgacctcgtccgccgacttgccacccacggcgcgcgcgatgttgtgccagcggtccggcgtgtccctgtcgtacaccgccaacgcctgctcgaaca

SEQ ID NO: 2138 - DNA, 544 bp, Zea mays
  Predicted polypeptide sequence is orthologous to G1911
aaatacataatatttatatatacacacaagtggacaagtaggagggagagggaacagaagcattggagatcgatgggtcggtcggtcgatcgcgcgtgactggctagcataggactcatcccatactacaattattactactaaattaacacatgcatatgcatgcatctaatctgattcttgctttcacacaccacttgcatgcacttgcagcatggaccattgcatgcatactgatactgtcccattaatcctatatacacacatgtttgcatcttctggatcatcgatcgttcgtcctatatgttcaattgacctcctagatcttcagctgtttcagcctgtcggcggccccgtagccggcggggtagcggtaggcggggaagggcaccttgccggactcgatgtggccgacgtcctcctccagcagctcgtagtagcgcctgacgtcgtccgcggacttcccgccgccgacggcgcaggcgatgttgtgccagcggtcgggcgtgtccttgtcgtacaccgccagcgcctgctcgaacag

SEQ ID NO: 2139 - DNA, 650 bp, Zea mays
  Predicted polypeptide sequence is orthologous to G1911
gcataaatacatgacttttaggctttacaccctccataactttagttcaaggggaccaatgaatacatgtggttatcaatcttatgtacactaggatcctacaaccacaggtagacagacataaacttgatcataaactatactatacacatattgacatatacacactggttcatcattttattctccaaccagagctggatttcctttggttccttcttggatccgtagagctttgttttctgcctctttgagcctccaacatttttttaacctcgggtccagaatccctgtgtcttgtgcttggggtacggcacattgcctgactcaatcatcttgacgtcgtaatcaagattttcatagtggcagcgcacttcctcggcagacttgatgcctcccatggcgctggacaccttgtcccaccggttgggtgtgccctcgccatagtaggcgagtgcctcttcaaacatcttgttctctttctggctccactgtgacatggagttgggagaggagctccacgaggcagacatatttgaagtatcctctgttggtgcgctaaggcttactgtatctagtgtctagactgaagtatttcgctcttcagaagctcttatggttttccccgcgtacctcggccgcgaccacgc

SEQ ID NO: 2140 - DNA, 472 bp, Zea mays
  misc_feature (33)..(33): n is a, c, g, or t
  Predicted polypeptide sequence is orthologous to G1911
tcggggggggcaccacgtctgtggaggaggtgngccgccgctaccagcagctcgccgtggacgtcgcgcagatcgagtccggcgaagtgcccttccactactggtacgccgccgccccgccgctgcatccaggcaccaacaacaacaacagtacctacgtgcccaacttggcccagaaaatggaatagattctgcaatcgctcgctccaaggatcagggcctttggactcgaccggccggcagcaagttgtaacaagcatttggccccgggattttgtttatttgtagtggttttctcgtagttaaaatatcgctactttatgcacgatatatatattctgctgtccatcttctttcgttgttctcaagtgacctgaaacatttctactgcaacatatttatgagaacaaacgctgcatgctcagaacgtagacattccaagaaaaaaaaaaaaaaaaaaaaaaaaaaaaaa

SEQ ID NO: 2141 - DNA, 779 bp, Zea mays
  Predicted polypeptide sequence is orthologous to G1911
ctttgagcctacagcaaaggaggacggcaacgtgaacagcaagcagttcacgtttgccaagtgcctataaatagtagccaccctatagcagcaacgagatcaaaacagcagagcttgcaagagctaaaaacgacttcagtccagccatccaacaagaagatcagtctacacataaaaccagagatgtctgggtccaggagctcttcgtctcacaacgttaccattgattccgagtggagcaaaaaggagaacaagctgttcgaggaggccctagcctgctacggcgcgggcacacccgaccgctggcacaaggtggcccgtgccatgggtggcatcaagacagccgacgaggttcgccgccatcacgagatccttaatgaggatgtcacgctcatcgaatccggcagagttccattccccaactacaacacgcagggagcttggaactaaggagtgaaggatgatgtgaagaaccaccagacaggaactactgctacgcatgaaatagatatcttagccattgaagtaaatgtgctgatatattgtgttaagaagtttatgattgctcaggtaataaataagaggagctagagaatacacataagtgtgttatgtgtaaatagctatatataggctgtgagcaaatcatcagttatgctatagaaaccagggaaccctatctgcccatagtgtgtactgtgaaattatagtcccctccctatggatgaatacttgtatagtaaagtgtggtgtaaaactcttgtaccagttttgtaaat

SEQ ID NO: 2142 - DNA, 574 bp, Zea mays
  Predicted polypeptide sequence is orthologous to G1911
atttcactttcaccgtagcatatatagcacgcaaacgctaccaggtagcagaatacagcaaaccggcctgacgacgacgtacacttggatggaatggaagccacgaaatagcataggtagggggtgtttcttatgtggacctattgctgctctaggctctagagataaggctctctccaagatcacatccacttcactgcggctggttggggtgcctcgtcatcctcttgtcaccgttgtccctgccccaagaactgctgctgctgcttccactgccaccagcaccagcaccagcagggctgctggactgggatcctcggccgccttcttcggtttcgatgtgcttcacgtccgtcttcaggtacttgtagtgcctcttcacgtcctcggctgtcttgccgcagccgactgcccgcgcaacgttgtgccagcggtctggtgtgtccttgtcatatactgccagcgcacgctcgaagagattgttttgactctcggtccaggacgaacccattgttttatcttcactcagcaagagaagacacctagctaggagagatgcagggcaagcaatggc

SEQ ID NO: 2143 - DNA, 1115 bp, Zea mays
  Predicted polypeptide sequence is orthologous to G1930
gcacgagggcccaacgggcggtggggcgcgcagatctacgagcgccaccagcgcgtgtggctcggcaccttcgcgggcgaggccgacgcggcgcgcgcctacgacgtcgcggcgcagcggttccgcggccgcgacgcggtcaccaacttccgcccgctcgcggacgccgacccggacgcggccgccgagctccggttcctggcgtcccgctccaaggccgaggtcgtcgacatgctccgcaagcacacctacttcgacgagctcgcgcagaacaagcgcgccttcgccgccgcgtccgcggccaccgcctcgtcgctggccaacaacccttcttcctacgcgtcgctctcccccgcgaccgcgacggccgccgccgccgccgccgcgcgggagcacctcttcgacaagacggtcacccccagcgacgtgggcaagctgaaccggctggtgatcccgaagcagcacgccgagaagcacttcccgctgcagctcccgtccgccggcggcgagagcaagggcgtgctcctcaacctggaggacgccgcgggcaaggtgtggcggttccgctactcgtactggaacagcagccagagctacgtgctcaccaagggctggagccgcttcgtcaaggagaagggcctccaagccggcgacgtcgtcggcttctaccgctccgctgcaggcgccgacaccaagctcttcatcgactgcaagctgcggcccaacagcgtcgtcgccgcctcgaccgcaggcccgtcgcctccggcgccggtggcgaaggccgtgcgtctcttcggcgtcgacctgctgacggcaccggccgccgccgcggcgccggcggaggccgtggccgggtgcaagagagccagggacttgggttcgcccccgcaggcggcgttcaagaaccagctcgtggagctggcactagtgtagatttaatgctacggagcgatcgatctttccctagctagctagtcttttttatttttttgctcgatcgctcaactcagatggtagcatcaccgagctgaatttagttccctctcggcatctcacttagttggttcgtttgttaatttccagtttcaaaaaaaaaaaaaaaaaaactcgagact

SEQ ID NO: 2144 - DNA, 802 bp, Zea mays
  Predicted polypeptide sequence is orthologous to G1935
acagatcaagaggatagagaacaacaccaatcggcaggtgaccttctccaagcgtcggaatggcctcatcaagaaggcctatgagctctccgttctatgcgacatcgacatcgcgctcatcatgttctcgccctccaatcgcctcagccacttctccggcaggcgcaggatcgaggacgtgatcacgaggtacatcaatctcccggagcacgacagaggaggagttgttcggaatagagagtatctgatgaagatgcttgctaaactcaaatgtgagggtaacatagccgaacaactcacacctaataaagagccaataaattccaacgtagaggagcttcagcaggagattaagacgtaccaacaccagatggaagtcttaaaggagcaacttaggatgttcgaaccagatctgacaacattgatgtcgatgaacgatttcgagacgtgtgagaaattcctcatggacaccctcacttgcgtggaggagcgaaagaaatatttgctgtgcaaccacgtggccccgttcgatccgtcggcctccgacatgcaacaacacgtagacatgttcgccctgccgccggcgccgcctcaccaacaggagcaacaaggggacgacctaggaggcgccgccagcgcgttcggtggcgatgtctcgtggttcgccgatgggatgccgacgtcgtcgatctttgccgcgtcggacccaatcttgtactttagggatcaggtgatgttcgactcgacgtcgacgatgcggcgtgactcgatggtggcaggggtggacccaggaatgacctcg

SEQ ID NO: 2145 - DNA, 848 bp, Zea mays
  Predicted polypeptide sequence is orthologous to G1944
acgaaaagaaaatgaagaaggaagtagaagaggtggagggccacggttatggcgccgccactcccatgacgccgccgccgtcgtcgctcggtcttccttccccctcggtctcgacattgacctccgccgctgccgctagggttttggcgcggccaatgcccgcctcggtcccaagcttgcgggcgccttcccccttcgtgcgggccatgcgcacccgcgttgatccgccgccgccacagccgctcacggcccctcctcttcttcgtcctcgtccggtgctaccgccgccgccgataccagagaagcagcggcgggggcgcccgcgcaactgcgaccgactcctcccgccgccgccgggcttccaccttgctccgtccgcacgggcaccgctgcctgcccgcggccaaccttcatctagggggcatccctttcgcggtcaattcggtgggctccagttgcacgtgctcaaaatacatgtgggagaggatatcgtatcaaagattgtgcaggtctcgaaaataactgggaaggctgtctgtgttctctcagtgtttggggccgttcaggattgctatctgctccactctgctgtcatcttaaatcacaagggtcctttagaaatcattcatgtgtttggatccattttgacatctgatagtcctggatttgggtgcttatctgcgactcttgcttgtggtgattgttctcttgtcggtggcattgcagttggacctctcatagctgcaacaccggtgcaggcaattgttgggagcttccacaatgatgctttccaggcaaacaagaaacctaagctcgttgcatgttaccccagttctcatgttaccgct

SEQ ID NO: 2146 - DNA, 1091 bp, Zea mays
  Predicted polypeptide sequence is orthologous to G2141
ccacgcgtccgcaaggcagtgatgctggacgaaatcataaactacgtgcagtccctgcaacggcaagtcgagttcctgtccatgaaactggccaccgtgaacccgcagctggacttcaacagcctgcccaacctcctcctccctaaagacgtgagggggacacgcacgcataacatgatcgctcgcttcgcattactacgtttggttcctagctcacacgagtcatattccattcctgtctgtctgtctgtgatcagatacaccagccctgtgggccgccgcatttcccgctggagacctcaggcgctccgctgccgtacctgagccagcctcaccatgggagccctctaggctgctgcatggacacccaggggggctctatgcacccgctcgacgcggcgttctgccggccgatgaaccctcagcatcctttcctcaacggtgctagcgacgcggcgtctcaggtcgggactttctggcaagacgaccttcaaagcgtggttcacatggacatcggccaaagccaggagatcgctcccacctcttccaacagctacaacggttcattgcagacagtccacatgaaaatggagctttgaggcatggccggggaaaaagaaagaaagaaaaccccagtccgaagctcgacgccgtcgtcccccctgtacatacggagaagagaggacacagctcgcaccggaagcagcgggctcttggggggtccaatccaacctaacgacgttggcccctagcagtgtttcagcctctaattttccccacccccgcccaatggtgtgacgattctttctttgaacaagatgcggaagaccgccgcgccggcagctgctcgcaccatccccgtcgcctgtttcgtttcagctttagcaagatcccgccggcgcggtgcgtcccagactctcccccagtatattccttcccgatcagagaccccccgcacgtaatgtcatttgtattgccgtcatatttgtagctgatatatatatagtgtatatttaagatcgccatttctcgtcaaaaaaaaaaaaaaaaagaaagaaaaaaactcgagggggggcccggtacccaattcg

SEQ ID NO: 2147 - DNA, 780 bp, Zea mays
  Predicted polypeptide sequence is orthologous to G2141
cttagcagcaggctcttgcgtccgtcttgcccttttgcttccgcctcctgcccttaaaatctttcaccaccccctcccgtcgcggtcaaattggcgatcctcgtttggggagggccaagaaaccagagctctctctccgatgcccaccaacgtcaggtgattgaggaacgttggtgtttctggataattggagatgtactcaggccagcaatctgatcaaggtcctagtgcaaatagtggcagagaattctccgaggcaaattggaattcttacacaatgcatcaaaagatagcttatagtggacaacatgggtttggaccttacggcatgggcttagaagataggctggggttgtatcaatcttcatctggtacattaagtcatgacatccaaatgagtgatgagcatagcggaggtgtgaagaagaggaaaggagtggaggactgtgtcacattgttgcctaatgcaggtgatcaacaaacagaaggttcatctcagccagaaaggaattcaatggaggaggggaacagaaagatttcgcccaaaatacaaagcaaggaagattcttctgatggtgatggtactaaagaggactatgttcatatccgggcaaagcgaggtcaagccactaacagccacagcctcgcagaaagactgaggagaaaaaagataagtgagagaatgaagcttcttcaagatcttgttcctggatgcagtaagatcactggcaaggcagtcatgctcgatgagattatcaactatgtacagtcattgcaacg

SEQ ID NO: 2148 - DNA, 881 bp, Zea mays
  Predicted polypeptide sequence is orthologous to G2141
aaaaaaaagcattggaaactactaacaaaacaaggctcctcgcgttgcatcacatcctgcagcagctcatttggtcgctgtgccaagtgccaacacgcagcccactgttactgcactgcgcgccatgccatgaatgcacgcgaccgccgaaacagacagaatttccagccatctatccaggcaacgccacaggccagcgccacgagcttttcctcagttccttctgaacacgataaaaaaacctgaccgatgcagcagcacaggcacagccgtgggtcgacgcggttcaaggcgtcgcgctgagcaggcgctgctgctcccggcaccagcaggcagctatacgcggccccctgcgcgcccgcacgttcgccgatcagatactcctcagatggaagaagccctttttttgcatcttttactagtatgtgcagctgggcatgttcagtcacatttgaaacccgtcctgcgacggcccgatgctcaggtcctgggacgacgggtacgccatctgctgctgcgcgacgtcactgaatgccccattcaatgcgtggggcggcatctgagacccgtcctttgcgcttaactgtgcctgcatgattctcctgaacacgtccggattggccatgccggcagcgccgccctggatcaggcctggctgcgagagctgcagctgtgggtgcatcatttccggggagaatccaagggaagacgaaggaacgccagggaagcggagaagatctttcgatagaagcccttctatgttgaggtcgagccttgggtttaccgttgcgagcttcattgataaaaactcgacttgtctttgcagggactggacatagttgaagatctcgtcaagcatcaccgccttcccagtgactttg

SEQ ID NO: 2149 - DNA, 635 bp, Zea mays
  Predicted polypeptide sequence is orthologous to G2146
gcggccgcccgcacgtctgttagtgcgcgcttggcgctgacctgcatctgcagcgcggccacgtagtcggcggcctcctccagcagcgcgggcgtgggtagcttccggcagcccgggacgaggcggcccagcacgcggagccgctcctgcaccttaccctccttaccctttagcgccgccgccttgtctctggcctgcaccggcggaggcgggcggcgccgccgccggaccttgccgcccgccttgacgagcacgcggcggcggctgcaggccgcgccggcgagcaggatggcgcggctccaccgcgtctggccgcgcgcggtcagcgccagcgccgagtcggccgccgccttcacggcgcgcggctggccgccgcccgtggcgcggagcgcgtccagcaggcgccgcccgtacaccccgcgcaccgcgccgctgcgccacttgctggcccgactcggcggcgtcgcggagccgccctggacgtccgggacgacgacggcgacggacagggcgaggagatcatcgccgcgcgacttgccagcctggccgccccccgccgcccgatcaagatggggcaagggatttggggagggagggaaagggtcgagcacggggcgatctacccgtaccgattg

SEQ ID NO: 2150 - DNA, 603 bp, Zea mays
  Predicted polypeptide sequence is orthologous to G2146
acactgtgacataaagtatcaattaaattggtagaaaattttgtagagaatatgaaaggaaacaaaactgctgggagcgcaaagaatgatacacacatgacgtgactacggacgactcgctatacatataaacagaggtcgatcgatctatacatgacatgcatgcttatatactcagcaaataccacgtatcatcggctgtagacgactcgtacggccacacaaatcacatagctggagctgaggcccagcactagctagggatggctagtggtgtcaccgtcgtgatggccgtcgccgccaccaatcccgccatggttagtcgcggcgatgagctccgacagcgccctaagaagctcgaccctcgcccggagacgcacgatgtagtcggcggtacggaggagcaggcgctcggcaggcatcgccgcggcgccgggcaccagccgccggagctcgcgaactttccgccccaaagccatctccccaagccgccgccggcggcttccgtggcacggcgaccgacgcctccttccctccatgtatctggcaacggcgagtgccagaagaagatcgatcgtgcgtacgcgacgaccccaacacaat

SEQ ID NO: 2151 - DNA, 727 bp, Zea mays
  Predicted polypeptide sequence is orthologous to G2150
aggtaccggtccggaattcccgggtcgacccacgcgtccgcgtgaaggttaccgggaaggccgtgatgctggacgagatcataaactacgtacagtcgctgcagtgccaggtggagttcctgtcgatgaagctgtcgacggtcgacccgcgccgggagctcgacgtgggctgcttcgtcgtccccaaagacgacgtaacgatgcaggccaacaggctgtgcgcgcccgcgacgtcgtcgtcgagctcagccttctgctacgccgcgcggagtgttgttacgaacgccaaaggattcgagacgccgctgcccttggcgaaccatggcgtcgcggcggacgacaggccacttgagcggcggactcgagacgcaggtccccaggcggggagcttgtgggaagaggacgatctgcagagcctggtcctgatgggattccggggccgttgatcgttgacgctctgattaggctaggccgctagggacgacagttcgtttccaccgaccgccaaccaaagcgagagttgcagggccacgtaacagcagggttgggctccaatcattgggaactctccatgattgtacacagacaggacgcttacacgctaatttccagctcggcggaggccaagaaacgaaacaaaaaaaaaaggcgaaaagaagatgtttttttctcgcattccccctcacgaatttgcagtttaatcgatgtaagataactcaatgtaatt

SEQ ID NO: 2152 - DNA, 808 bp, Zea mays
  Predicted polypeptide sequence is orthologous to G2150
gccctcttcccacaagctcctcccccccatctgaaattcacggcaggtttctcacctcttcgcccttgacgcgtcacgcgtccacagttttggagtggatcgatcgcacagctagcgatacgatcgagatggacgaacttggcaaataagcttgctgtacgtacgtacgtacctggggactcgcgttctcatcagcaggtccttcgagtggccgccgctccgcggtgccggcgtggttcacggtggccgccgacgaaggaggagccatttcgaaggctttggcgtccgacgcagcaacgcccagccgcgcggcggtgccgggagctgggggcgtggtggtgtagcagaacgccgggctcgagccctcgagcgcgtggtaggctgctggcagtggcagtggctgctgtgccatggagatggaggacgtcgcggcggcgcacatcttgttggcctgcaatccgttacgcatatagttctcaagaaatgggcaacgcgatcaaaaaggaagatcatccactacttcatttcatttcgagtggtggtggtgaggaggagtaggaggaggaggaaattacgtacgtcgtctctggggacgaagctgtcgtccgcgccgagttcgaggcgcgggttgacggtcgacagcttcatcgacaagaactgtcgcgaaatcaagaaccgtcttgctcagattcagaagctacagctcgtactttgttttacaagagagttctttaatgtctgatacagaggagacagactctacgcacctctactttgcgttgcagcgactgcacgtagtttatgatct

SEQ ID NO: 2153 - DNA, 1037 bp, Zea mays
  misc_feature (618)..(618): n is a, c, g, or t
  misc_feature (810)..(810): n is a, c, g, or t
  Predicted polypeptide sequence is orthologous to G2226
cccgggctgcaggtcgagacggagtcggtggtgcagcggctcccctgcggccacctcttccaccgcgcatgcctcgagacctggatcgactacgaccacgccacctgcccgctgtgccgccaccgcctcctgccccccgccgctgccgccgacgaggtgccccggattgcctgattagcgccctaggaattgagagtaggcgtagcactctgcacctcgcagcagcagtgtctctgtacaggttttttttttcttttcctttttgttcgggggagagagaggacagaacggagattgaaggaagaaaatggtggcaacaaagctgttcccctttcgtttcaaaaaaaaaaaattatatattgtacaccgacttgagcaaaactcaaaattgtctttgggcttgtgctggggtggacgcaaaaaccactatcttgctgtgaataagggattctataatagtggcacgactagattaccctttcgtatgtggttgctttatttgtgattgtacacgcattgatgtttttaaaagaatttttgggggggaaagtaagaaaagataatcaaaggggtcactttaataagctcttttgtttggctttgattaaaaaacatcanaaaagtctggtggacagcggcgttgggtcttttttagtgccggaaattttctttatccactccaaaccgaaggagagtggatttttggaaaccaagtttattaaaatttttattgttatgaccatttttttttataggtccccacgggatttgtttaatatggggcggtgcgtggtttttaattatacaaanaagggggtgcacgcccaaaaactggtagttctccacaaatttctcgaaacctcaagtatgtgtccgaacctccttctttttattggaatccattctgggtcacaattttgggggtggcgtgggttttatggaaacgtctttctgactggaaatattttgaccgtgttaaaggacagacctttctggtttgtaaaacccaatctccttaataaaaaaacttggtattt

SEQ ID NO: 2154 - DNA, 771 bp, Zea mays
  Predicted polypeptide sequence is orthologous to G2251
ccatacatatcactctccgctccgccattgttgctccttattagtagttcgtcccgcgtcccttgacagttctatctatccccaccacaaataagagaccacctctctgccttcttctcggaggtcggagaagagctctctgcttcattcggccggtccaactccaccgaccgatccaatccaacccactgaccatggggttcccgccggtgtgctgctgcgcccccatccccaagccggtcgtcgccttctgcaacctgctcggcgccatcaaggacgccgtcctgctgacgctcgccgccgtgggcttcccgcacgacgccgcgcgcggctcggcggacgcccaccagcccgaggaggtgaagacccggctccccgccgtggagtacgcccagctcctggccgagcagcagccgtcgcccgccacccacgcggcctgcatcgtttgcctggacacgctggaggcggcggacgaggtgcggcggctgggcaactgcgcgcacgccttccaccgggcctgcatcgaccgttggatcgacctaggccggacgacgtgcccgctgtgccgctccgacctcctgcccagcccccggggccgggccgggctgctcgggctgggccggctcgccagccgtctcacgcgcgttcgcgtttggtgaggaccgtctcggaggccacttttaccttttcggtggccaggccgcggtcgcagcccatcccggtggggccggaacggcgcggacacgttagcgaccgcgaccgggccgcccg

SEQ ID NO: 2155 - DNA, 710 bp, Zea mays
  Predicted polypeptide sequence is orthologous to G2251
tttttttttttttttggaaaaaaaactgattacgtagtatgggtaaacatctctagactacactacagcaatgtgatctgaactctgaaaccctccaatacaagcgcgtcgccgtcttcagagacagcagcaggatgagatggccaccaaggtcactcaagggatacatcagccgaccaagaaggatccagaattaggttctgctgatcatcatccgcgggccgcggcgagcaaaagcagggtccatgattgaatgccaagtccactcagaatccttggcgtccttttttttgttacgttctcggcatcaccaacaacaaattatggacctggaccaccgtggaaccgaagatcccctttccgttacgctccccctccccaaaaggctaatcacttcgatacaggcgctgaagctacagcaaagaacacacgcatcgtacacacacacactagacaacacctgatggatggatccatgaccatggcgcgcctcaaagtgggaattattgcgcctaaaacagaacgctgtggtggctggcgaccagttgatgacgcagagggccacactgcaggccgtggtcctgcgaatcgtccatcctgtaaacagccggcaccacggaggtccggttcggtggcaggttcccagcgccgtgctggtgctgcttggcctcggccgccgccgccgacgagaagggcccgcctatcaccgc

SEQ ID NO: 2156 - DNA, 377 bp, Zea mays
  Predicted polypeptide sequence is orthologous to G2291
tgactgtgtttttttttttttgtattccctgcgtttagtcagctgagttcaaccatggtcacgcgctctgcaaagaccggcttcgccggcgacggaagcacgtccagccatgaccagcgctctgcaaagagaagtatgggtggctgatcgcaactcgcaagagaactgagaagcgatggccatcaagattgacagaagaagtcgtcaaccggcttcattggtcatcctccacaacgaaagaaagaaagcagaggatggtcagattgaaagaaaaaaaaacatgtgtgatggctgttgcacacccatatgtggccgtacctgtgctcgccgatccgaagcaacacgacgaaaaaaaaaaaaaaaaaaaaaaaaaaaaa

SEQ ID NO: 2157 - DNA, 364 bp, Zea mays
  Predicted polypeptide sequence is orthologous to G2291
cggccattatggcctcggcttggttttaaacgttagtaattgctacgaagtagcataatttatttggagcgcattctgtttttattgatgcctgactttagcaagcactccatatcttcatctatcttttttataagtttgacttcatgtgacttattttagaagcgtgagctcacaaactttctcttatttggtctctgtatgggggaattatattattttataatctctgttcgttcagtcagtcattgcgaactctcttctaatcgctcactttattgaccgtgttgtaccaacacatattgcacgaagtaaacaataacatcggttaccccaaaaaaaaaaaaaaaaaaaaaaaaaaaaa

SEQ ID NO: 2158 - DNA, 720 bp, Zea mays
  Predicted polypeptide sequence is orthologous to G2520
agcatcaactgatttattcatccttctgacagacgaacgcgatctacagaaattccatggaatacatgaacagcagaaacagtcttgagattcagatggggaaacaaatgagcgcctcatcaaaaatacatgttccggctggaattacagctccaagcatgaataaaaaatgcgtctggaacatgatggtttcaaaaaaaatgaaaaagaatgatctacaagcacggccatgattgatcatggttcactttatttagcggctgcctggattcatctcgttcatgaaaccctttcatagccactgccaatctgcatgtgaagccattccgaggtcgacgtgccctgggcgtattctctactggtttgcgtatcaaatgtcagcccaggagctgtgttgtatgtctgagaaccgtaatctttggctggaaatacttcaactccctggtttgcctgggcattcactgcctctagtttcatggacaggaactcaacttgacattgcaacgactggatgtaattaattatctcatcaagtactgatgctttgccaataaccttgttgcatccaggcacaagatcttggagaactttcattcgttcacttattttctcacgacgtgccctctctgcaagactatgactatcagttgcttgacccctccttgccctgacatggatataatcttgttttggtggctctgctgctggaatgtttttact

SEQ ID NO: 2159 - DNA, 540 bp, Zea mays
  Predicted polypeptide sequence is orthologous to G2741
ttttttttttttttttatttaagttaattttatttctcttcaattttctgtatgggactaaaaactcattactttccccttcaccaaaagcttcgaaatttattctctaataaacttgaacaaaagctttggctttaaaaataccgaataccttggaacgggacggacggagtacagtagaagctttggataatttggagggagtagagtatagagtgaggcaggcaatcgcttgttccgttttggatttgtcttccggtcttccccaagaggaaactagattctggagtcgtcgccgaagcgggtgtcatctgtctcctccccctcctccgttgtacaggtagtggtacgcctggccgctgaccatgggcaccatgccgacggcgacgccgtgcaccggtgtgggtgcgaagatgtggtcggacggggacggaccctgcccccgcatccgcttcacgtacaaccggtacttctgcaggtggctggccacgttctcccgcgtcagaccttccacgttcatcagctccatgatggtcttgg

SEQ ID NO: 2160 - DNA, 863 bp, Zea mays
  Predicted polypeptide sequence is orthologous to G2741
ggtgaaaagggaaaagaaacttctctttctttctttatttcttaaaagagatccatttaccgctcacacgaagaactgaattagcaagagatccaaaaccaaaaggatcgatgggattattgagggatccaatccaacagaagggtcatttgtgggcgtggtggtagtgatggtactggtactggaaccctcctcctcccattccgttgtggttgtggtacgcctgtccgccgctggccatggtgccgtacatgggcacctcatgcaccaggctttgcggcaccggcgtggatgcgaagatgtggtcggacggcgacgggccctcgtcggagaggccctgcatccgcttgacgtagaggcggtacttctgcaggtggctggccacgttctcccgcgtcagcccttccacgttcatcagctgcatgatggtcttgggcaccgcgttcttcatccccaggtgcgccaccacgtccacgaaccgcttgtgcagctgcggcgtccacaccagccggggccgcttgctgctgctgctcatgttattgttgccgttcgtcgtcgccgccgccccgccgcccgccgccgacgagtccgccccttcgtcccccctcgctgccggatggaagggcgcgaaggaggagctccctccgctgcccgacgacgacggcggcggcgcgcgacgcagccgggacaccgtggcagccgacgcgcggtgcacgtccagcagcgtccgcccggcctccggcgggatgcggaacgccgctgccagacccgccggcaccagcggctgcgacagcggggtcagctcgtcggcgcccgggagacctgacttccactccatcacggggtcgttctcgccgccgccg

SEQ ID NO: 2161 - DNA, 436 bp, Zea mays
  Predicted polypeptide sequence is orthologous to G2763
caaagcaatgttccccagtagagttgctatatatataaaaaaagtatgggcacattctaacttgtttactggttaatatgtcataaggcacagaacttgtggactaagcttgctgtggagatcgacagtccacaagctacgtctctggatcagttagccgatccacccaatagtaccttacacctttggaaagtgtctgaactcgtacatcttggaataaaacaacaattttttgttgacagcatgtgtgtttctttggattgtgcataaatttcctgggtctttttgttttgccatcttcagaagctcgagtcgtccactggtggcttatcttctctgcctggtgagagctggcactaccgtttggtgtcgtgaccttgctgatgcttgttcgccttcctgaagatctggactgcttgttgatgcccaacacaat

SEQ ID NO: 2162 - DNA, 887 bp, Zea mays
  Predicted polypeptide sequence is orthologous to G2990
gtcgtcccatgctaaaagcccagggttaggagctagaggtaatctctctcccgtctctccccagtgggcgtgggggcgccgcatggaagccatggacgtcaagtacaagcccgtcatgttccccaacggcgccggcctcaagaagccgaagccggcggcggccgtggcgctggccggggagccgctgtaccgggagtgcctcaagaaccacgccgcgagcctgggcgggcacgccgtcgacggttgcggcgagttcatgccctcgccgggggccaaccccgccgacccgacgtcgctcaagtgcgcggcgtgcgggtgccaccgcaacttccaccgccggacgctggagggttcccctccgccgcccgcgcccgcgccgctggcgctcccgcctccgccgagcgtgatgcacggccagccgcaccgcgcccgggaggagacgcccgaggaccgccacccgggggtcgtcgacgccgacgactccgattccgactcggaaggctcggagtacgacgaggagcggtcggtgtccccgccgccgccgccgcaccacctgctgccggcgccggtggcgcagcagcccccgccaccgtcctacttcccgacggcgccgcacatggtgctctcgctaggttccggcgtgcccgggcccgcggtggcggtatccccggcgcagaggctggccccgacccagctgacgccgtccagcgcgccgccccacgccgggggcgcgatgcccatgcccaggaagcggttccgcaccaagttcaccgccgagcagaagcagcggatgcaggagctgtcggagcggctcgggtggcggctgcagaagcgcgacgaggccatcgtcgacgagtggtgccgcgacatcggcgtcggcaagggcg

SEQ ID NO: 2163 - DNA, 824 bp, Zea mays
  Predicted polypeptide sequence is orthologous to G2990
gtagttttctccactcgtcctcgtcctttgtccctgtccttcggggacaaaaacaaccaaggcggcgcaagcggtaatcttccgtggtgggggcgtgctctgctgcaagcagtggtgacgccgcttggagggagggcgggcgggcgggaaaggatggaggcggtggtggacctcaagtacctgccggttttcccgaacggcggcgtggccgcggccaagaagaagacgaggctcggggccgctgcggttgccggcggccagacgggggtgtactacagggaatgcctcaagaaccacgcggcgagcctgggtggccacgcgctggacgggtgcggcgagttcatgccgtcgccggaggccgacccggcggacccgagttcgctcaggtgcgccgcgtgcggatgccaccgcaacttccaccgccggctacccgagctgtccccgccgccgcctctcctcgctttgccgccgcctccaccgccactggcgccggcgccggcgccggctgtcgcgtcgcatgccatgcgtgacagccgcacgatgcgcggcgaggaggcgccagacgaccgcctgccagccgccttcgacgacgacaccgaggagtcggacgagggctcagatttcgaagaggaccgtcccctaacgccgctgccggcgccgggcatggtgccgctgccgcccggctaccgccaggtcgcgccacacatgctcctcgcgctgagcaccagcgcgccgggcgcccaaactcccgcggcggggcccaggccgcccgcctccctggtcccgatgccggcgcccggtgctgctgctgctgctgcggcggc

SEQ ID NO: 2164 - DNA, 801 bp, Zea mays
  Predicted polypeptide sequence is orthologous to G2990
ctgcccagcgccccagttcctggctggccggctggctgtggcctgtggctgtgcctggtctcctcttcctcggtggtggcggtggcggtggacggtggtgctgctggtggtgttgcgctgcttgttcggttgttcctcactttcacttcctttttcctccacggctcccgtcacctaagcagcagctgcagcagcatatcccccgcacaccactcgcttcttcgccatcacccggtggctagctcttgcagcagctcatctcatctctacctctggctggcagtttatttctctcctccctatcagcataagctcagctcagctcagctcagcccagctccctgctgatctgcggcatttgacctgcctcccgtgcttgaagcttgatttgttcgtttctgtgcgcggtggtgcccgggcaataactccccttggtgcctggttggctcgttgccaccctccccgcggcagagcggcctataggatgagagggacgggggaggaacccaacaaaccggccgcgacactgtcctgaccgtggaagacacgcacacagagctccagctctgcactgcactggccgacggggaaacggtggagctcgcgcggtgttccattcatggattgggatctcaagatgccggtctcctgggacctgcccgacctggagcacgacgccatgccgccgccgccgcccgtctccgcgccttccaccgcggcggcgtcgggcattgccgccgcagctgccgcgcctttctccgcgacggcgccgagccgggcggagtgctccgtcgacctcaa

SEQ ID NO: 2165 - DNA, 577 bp, Zea mays
  Predicted polypeptide sequence is orthologous to G2990
ttttttttttttttttttttgaatgatcacagtgacactgacacagcattaattagcatagccgtgataacaatgaatatctcatcataaacaatcaatcatcaacacatcgaagcaaaaggacccaaaggaattagcagcaaaaggagatgttaatcctcgatcgcagccaagggcgaggcaatgccgtgccgtgccattgccgccgcgcatgccacgtacgtaacgcggggcgcggctacagcctacatgcacatctcgctgcccctcacctcctcgtcgtcctcgacgtcggcgcccatcatcgccgtggacatgctcccgcctcctccaacaacgccgccgccgccgccgccacgcgtcgtggacgacgacgtcgtctgagcggctccggcagcgccagcgctggcgccctcgccctggctgccgccaccaccggacttgtggttgtgcatccataccttgaagacctgcctggtgaccccgatctcccggcagaagcggcccacctcgtcgtcccccagcgcgcggccgggctcccgcttgggcatccgccagccgagccgctccgccaacc

SEQ ID NO: 2166 - DNA, 856 bp, Zea mays
  Predicted polypeptide sequence is orthologous to G2990
gcaaagtcaggagggaaagaaagaaatccttttcctacacctaaagagaccaccaaaccctgcgagccaaaaaaaaaaaagccatggagtacaagagatcatcgcatgcgcaagaggaagaagaggacgaggaggaggaggaagaagaagacgacgagaacgaggaagaagaggaggatgaggaggaggccagaggccttcgctacaccacggcggcggtggcacccgtaggcgctccacagcagcagcaggtgcacgcccaagctcttggcctcggctgctcacacccctcccagctgatggattctgccgccttctcgaggccgctcttgcctcccaactcatctctggtgatgcagccaccgctgcctccaccaggcttcccgccggctcaccgccaacaaccgccgcatgcgcagctccatccgaggaaagcggagagggagagggacagagccgcgggagcgcagccccatgtccggcgccaccaccaagaaccagccaagaatggcgttctcggcggtggcgccgcgccaacgtcggcaccctctacgctcggcctcgtgcccgtggtggaagcggcccagctgtggaggtaccgggagtgcctgcggaaccacgcggcgcggcttggcgcgcacgtgctcgacggctgctgcgagttcatgccgtccgggggcgacggggccgccgcgctggcctgcgccgcctgcggctgccaccgcagcttccacagacgcgaggcggtccccggcggcggcgtggcggtatcgccctcggcggcggtaactcccacccccaccgccggcgccaactcctcccgcgccattccgctgctgctggcccccgcgcacat

SEQ ID NO: 2167 - DNA, 586 bp, Zea mays
  Predicted polypeptide sequence is orthologous to G3032
ttttttttttttttttgatggaatcaaacgtgcttagcgcaaacggtgatacccgtagagaatgaacctacacgcaaacacacacacaaaggaaacaaacatagcgctaagtaacgtagattaccattaaaattaattatcacgaagctacgtaaacctgtgaagatctcccgctatacacagatcatcagcagcgcgtcatgatgaactccaaaaacaacgacggcgacgacgcagagcgcggaaacacgctacacggaccggggacaaaggtgatgtgcgtacggagggagtgaaccagagggcggcgttgggcgctcacggatttgaagctgctggccatggcgaagttaaagccagacaaggagcagatggcgcagacccagttgtgagccggaggagctggagactggcagctcggcggaggtggactcacggccatggatggagcagcggcacggtccgtcgtcgaggtgagcggaggttggtggctggggctggggcgcgatggccagaacgacggtgaagagctcggctattgaggaagcgatcgcgaaggagataagctctgggaggtgctgggtcg

SEQ ID NO: 2168 - DNA, 805 bp, Zea mays
  Predicted polypeptide sequence is orthologous to G3032
cagctcttctctgtttcctggacgtgcgcagggagctgagctccttctcccatggcgcctccacacttccagccgccctcctctgcccagcagccgagcgcccagctcctcccctcggcagccatggcgtcctccccttcctcccgccctctgctgtccacggcgagctacagcagggagccgagctccaagctcccacggcgctcgagctccactcctccctgttcgtcttcaacccaagtcggcgccctctcgctggctgtcctctccgtcgcgcccctactggccgtgcccctcacgctggcacacaggcgcccaggcaagcttccccatggcgctcgactccctgttccatggtgccctgtggtcgcccccttcttccccttgtggctgcgctcctctgctccctccatggcgccccctgctccttcctcgacgcgctgtaggtgctcgacaaatgcgcagctccatttctcccatggccgtggcctgcttttcccggcgccctgcgcagcatctccctcccccaagtccctgcgcgcgcacagcagcagctcgccccaccttccctcgctgcgcagcccctcggcgaaacgccgctgttcctgcagccccgacaccttccctggcttcctcactgctagcgctgcgcgcgtgccacgtgttcggcgatctgtccaagtggggtgttgagcagtgagcagcaagccgtcaacgcccgccgtgtgctcgctgttttgcgcagcccatccgcgacgccgtcgaaaaaaccgtgctagccgtcaatcgccattcgtcgcgcacg

SEQ ID NO: 2169 - DNA, 749 bp, Zea mays
  misc_feature (4)..(8): n is a, c, g, or t
  misc_feature (36)..(60): n is a, c, g, or t
  misc_feature (85)..(89): n is a, c, g, or t
  misc_feature (99)..(129): n is a, c, g, or t
  misc_feature (607)..(613): n is a, c, g, or t
  Predicted polypeptide sequence is orthologous to G3044
aggnnnnnatgtatttcatggaacggctatcctgcnnnnnnnnnnnnnnnnnnnnnnnnnatagctaaatgcctcttttcgtacnnnnntgagttgttnnnnnnnnnnnnnnnnnnnnnnnnnnnnnnnttggtttctatctccaagaatagaagtagctggaaacccattcatacacaaccaggtttccaatggatcagcgccacctcttggtttccataaacacaagcatcaaattagctgcaactgagacgatgcatcgctaacaccgttgaggaaatgatactgcggatttatcgccaggcaaaacgtcgtgtcaagtggatgcatacaactctggttgtccatgcagccaagagggcttccatggtgaggctggctgaggtacgacaacgaagcgtctgaggtctccagcgagaaatgtggcggaccacaagactgatgtacatctttagggaggacgttaggcaggctatttaagtccacctggggattcacggtggccagtttcatggacataaactcaacttgtcattgtagggactgcacgtagtttatgatttcaccgagcatcactgcattgccaaccactgatttgatagattgnnnnnnntggagtgtatgactccagtctcactaaattggcacataagcatcagtaggcgaacagctgatagaatccatacagattctagcattggtaatcctccaaactcccaaccaatcggtcaatctaacctcgtgccaat

SEQ ID NO: 2170 - DNA, 532 bp, Zea mays
  Predicted polypeptide sequence is orthologous to G3061
tactttcctcattctttgtatatactttgtatttgcatttcttgatgattcatctaactgtctggatatgaacttcgtgttaaatttccaaactttaaactattgtctctactccatgagctgagatcacatatttttaccatttcttgtgtctttcagtacctgaatgtaacttcacagcaatgtttatagccagcaaaaaaagtgttatgcttaatgcatggccagatatcacatttgatccgtcccagcttgcagagtgcggtgatggtgttgtgcttcgacttaagctgttggaataggttcagttgtatattgtgaatttgtgaccatgagtggtggtgtgttttgatgatgtgtaaatttgatctacatgctgctactgctttgtaatgtcctcagattttcactgtggtcttatgtatcctaaactgagcgagcgagccctgccgaaatcggcgggttcaacattaacccaagaaatgaaaggatgctaccctgttgtgctgcggacaaaaaaaaaaaaaaaaaa

SEQ ID NO: 2171 - DNA, 494 bp, Triticum aestivum
  misc_feature (158)..(158): n is a, c, g, or t
  misc_feature (290)..(290): n is a, c, g, or t
  misc_feature (308)..(308): n is a, c, g, or t
  misc_feature (338)..(338): n is a, c, g, or t
  misc_feature (345)..(345): n is a, c, g, or t
  misc_feature (347)..(347): n is a, c, g, or t
  misc_feature (357)..(357): n is a, c, g, or t
  misc_feature (361)..(361): n is a, c, g, or t
  misc_feature (364)..(364): n is a, c, g, or t
  misc_feature (379)..(379): n is a, c, g, or t
  misc_feature (401)..(401): n is a, c, g, or t
  misc_feature (420)..(421): n is a, c, g, or t
  misc_feature (436)..(436): n is a, c, g, or t
  misc_feature (442)..(442): n is a, c, g, or t
  misc_feature (444)..(444): n is a, c, g, or t
  misc_feature (451)..(451): n is a, c, g, or t
  Predicted polypeptide sequence is orthologous to G3
ctccttccccctcgagcacggcgcgtcgtcgacagcctccatccctcttcttccctcttcatcagccgagcacaactccgtttcacaggtccttcagaaaatgggaaaagtgggttttcttcatgtttatctacaaaatgttcaatgcctcctgtttnataggaggcacggagatgtttccctgggacggatgtgcaaatcctgggttaaaatggggcgaagggcacaaaattaaggcccttaagaatccgggaatgggcgctccttaagatgccaatttgattcaaatnggagtgggtgcttgtgtngtcaagaataaagacatgaattgtgttaangggattnanaaaagaaatngtgnaanagataatgccatagncttggtaaatcctgattttagnagatgcatacacatgtgtnnacatcccaattcaanacccananttccccnacttttttttggaaaaaaatgtgccccggctaaaaaaaaaaaa

SEQ ID NO: 2172 - DNA, 740 bp, Triticum aestivum
  Predicted polypeptide sequence is orthologous to G3
gattcggccgagggagaccgggagcccaacaagcggtcgcggatctggctcggctcctacgccaccgccgtcgccgccgcgcgcgcctacgacaccgccgtcttctacctccgcggccgctccgcgcgcctcaacttccccgaccagctcctcgacggcgcccccgccgccgcgcccggggacctcaccgccgccgccatccgcaagaaggccgccgaggtcggcgcgcgcgtcgacgcgctccactccggcgggatcggcgtcgtcgcccctccggccccgccgtcgccgtcccagcgccgccggcccaagaaccccgacctcaaccgggagcccacccccgacaccgacgacgacgagtaaacccccgccgattcttcagttctcctcctccgaccaccaccaccgcctacatacctagtactagtgcgtcttaattagtccttagcagcaatcagcagcgagctagctagcagtagcagagcatcaaccatctcagtgagcaagaaggcatggggaagcaagcgtggatccgacacgcaaggtgttcggtgaaatgccgggcgagctcgggggccgacccgaccaataatggagccgcgacgttgccgtcagctcggccagggggttactaagtagggcctggactgtcagcgacggcgagcttggtagcagtagactcggggcgtgtgagtgcgtgcgcgtgcttgggcatgggcatgggcatgcaactaagcaag

SEQ ID NO: 2173 - DNA, 779 bp, Triticum aestivum
  Predicted polypeptide sequence is orthologous to G8
gaggggcgcgcatgcgccagttcctcggcaagaaggcttacgacaaggcggcgatcaaatgcaacggtagggaggccgtgacgaacttcgagccgagcacctatgatgcggagctgctcagtgaggttgctgctgaaggcgcagatgtcgacctcaacttgagcatatctcaaccaacttcacaaagtcccaaaagggataagagcagccttggcctgcaactccaccatggatcatatgaaggctctgaactaaagagaccaaaggtcgatgcgccccctgagatggtcgcaatccctcatcgatacccccttctgaccgagcatccaccaatctggcatggccaatcatatcccatctttttaaataatgaggatgcagccagagatcatagcaggaggccagaggtggccacagggggtgttccaacctgggcatggagtgtgagccaccctcctccaacacaacccatgccactcttctcgtcgtcatcgtccgctgcagcatcatcaggattctccaaaaccgccgcggcagctgcccccggcgccccatcggcctcattccggttcgacccgatggcgccatcatcatcgtcaagcaaccaacaccaccaccacccccgctgaaaaagaagccatactgtaaattttctgggaagccagtatctttttgcccctccggcgtttcagcgttttcggtcttgcgccggggcggtttcaggtagtggattggattcatgactgtatttcccatgctgcccaaagtgaaatgtcact

SEQ ID NO: 2174 - DNA, 632 bp, Triticum aestivum
  Predicted polypeptide sequence is orthologous to G8
gttgatctgaacttgagcatatctcaaccggcatctcagagccccaaaagagataagagctgcctaggcctgcagctccaccatggatcatttgagggctccgaatcgaaaaaaaacaaagattgatactccctctgagctgtcgggccaccctcatcggttccctcttatgactgagcatccaccggcctggcctgctcaatctcaccccttcttcacaaatcatgagagtacatcatcgagagaccttaacaggaggcctgaggggggtgctcctagctgggcatggaaggtgacagcagctcctcctcacaccctgccattgccgctgttctcttcgtcatcgtcatccgctgcagcatcatcaggattctccaataccgccacgacagctgccccatcggcctccctccggttcgatgcaccgccatcgtcgtcatcgagccatcatcatcgccgctgagaatcaagaagccacactgtaaatctgctgggaagctggcatttttcccccctctgggcgttgcaactttttcggttttgcgccggctggggtggtttcttgtagtggatcgattggattcttcataactgtatttgcacactgtcatactgccccaaaaaaaaaaaaa

SEQ ID NO: 2175 - DNA, 492 bp, Triticum aestivum
  Predicted polypeptide sequence is orthologous to G8
tttttttttttatggtgaattgtacttatccgcgcttatcttttggtctgaacagagcttggcgatccagagggtgctggtctctgtcggtggacattcgatgacaaatgaaaaaaacagaggcaaccaattcagcgaggccgcccacccagcaaaacgcaccaaagaaccaattctttctttaccagagaagaagaaggcgaggcccaatctcagccgccgtccgtccttacctgcctacgtccggcgggccgatggggggcccgacctgaggcgacatggccctcccaagagagaagcaggcgtcggggctgtgcaggccgtccatggcgatggagacgcccgggcaggaagggctcaatccggatgaaccagcccgcaccgagcccggccgcctcaagaggagctcgtctctctgcctgcctgcggcttaaccggagctgccaatcgccggcgaccgcctccctcaccttgtgccccttcttcttcgct

SEQ ID NO: 2176 - DNA, 1730 bp, Triticum aestivum
  Predicted polypeptide sequence is orthologous to G8
gcggccaccgcgctcccatgccatagacgcgaccccactcatcggtccaggtcggtcgctcggagccgagcggcggcgggcgggcgaggagtgcgttttattcggtcccggcgggcctcggatcggagatggtgctggatctcaatgtggagtcgccggcggactcgggcacgtccagctcctccgtgctcaactccgcggacgccggtggcggcggcttccggttcggcctgctcgggagccctgatgatgacgactgctccggcgagccggcgccggtcgggcccgggttcgtcacgaggcagctcttccccgcgtcgccgcccgggcacgcgggcgcgcccggggtgacgatggggcagcaggccccggcgcctgcgccgatggcgcccgtgtggcagccgcggcgcgccgaggagctcctcgtggcgcagcggatggcgcccgcgaagaagacgcggcggggcccgaggtcgcgcagctcgcagtacaggggcgtcaccttctaccgcaggaccggccggtgggagtcgcacatctgggattgcgggaagcaggtctacttgggtggtttcgacactgcgcacgcggccgcaagggcctacgatcgcgcggcgatcaagttccgggggctggaggccgacatcaacttcaatctgagcgactacgaggaggatttgaagcagatgaggaactggaccaaggaggagttcgtgcacatcctccgccgccagagcacggggttcgccagggggagctccaagtaccgcggcgtcacgctccacaagtgcggccgctgggaggcaaggatgggccagctgctcggcaagaagtacatatatctgggcctctttgacagcgaagttgaagctgcaagggcgtacgacagggcggcgattcgcttcaatgggagggaagctgtgactaactttgagagcagctcctacaatggggatgctccacccgacgccgaaaatgaggcaattgttgatgctgatgctcttgacttggatctgcggatgtcgcaacccaccgcgcacgatcccaagagggacaacatcatcgccggccttcagttaacttttgattcccctgaatcgtcaaccacaatgatctcttctcagccaatgagctcatcttcgtcccagtggcctgtgcatcaacatggcacggcagtagcacctcagcagcaccagcgtttgtacccatctgcttgtcatggcttctacccgaacgtacaggtgcaggtgcaggagaggcccatggaggcaaggccccctgagcagccgtcgtccttccccggctgggggtggcaagcgcaagccatgccgccgggctcctcccactcgccgttgctttacgctgcagcatcatcaggattttctaccgccgccgccggcgcgaacctcgccccgccgccgccgtacccggaccaccaccggttctacttcccccgcccgccggacaactgaagctggccgttgtgaccagacggcggtgggtgcgcgcggtcgaggtgttcgctcctcgtcgtcggtaacgcttgttgtgaaactataatcggagagagatgacattgccaggccatgtgtggtgacactactggctggtctctcgccgcctcgccatgatcgggatcacgcggatcatggctgttcattagattctcatgtatccaatgttcaagtttcccaaacggttgaaaaaactttgaaatttgtgatggcaaa

SEQ ID NO: 2177 - DNA, 1049 bp, Triticum aestivum
  misc_feature (23)..(23): n is a, c, g, or t
  misc_feature (727)..(727): n is a, c, g, or t
  misc_feature (734)..(734): n is a, c, g, or t
  misc_feature (790)..(790): n is a, c, g, or t
  Predicted polypeptide sequence is orthologous to G12
ccgacccacgcttccgaccagtnccgccccgctgcacaccaaaagctacccctccttcgggcacgcgggcggccggcaggggagagagagggcagccgaggcggctagccagcgcaggagcttaggtaggttgtaggcaggcagcctcgcttcgctcatgcagcagggcgagtaccgctcgtcgtcttccagcgagggctccgcggggtcggctgctgcggctgcggcggccgcggccatggcgcccctggcggctgcggccgcggcggtggcggccaaggaggagcacaacgtgacggtggccgtggcgccgcccatgcccatggcgatggcgatgccgctgcagcagcagcagccgcggaagcagtaccgcggcgtgcgcatgcgcaagtggggcaagtgggtggcggagatccgcgagccgcacaagcgcacgcgcatctggctgggctcctacgccacccccgtcgccgccgcgcgcgcctacgacacggccgtcttctacctgcgcggccggtcggcgcgcctcaacttccccgacgagatctccgcgctggcgctgtcgtcgcccgaggccgccgaggccggcggaggggaggagccgggcggcggcggcggcgcgctgtcggccgcgtcgatccggaagaaggccatcgaggtcgggtcccgcgtggacgcgctgcagaccggcatgaccaccatggtcgccgcgcccgcgcaccaccgngagcggnagcggctccaccaccaccaccaccacgcggagccgcacggcgaggagctgcaccgncacgtgaagcagcagcggacggcgtggaacgggcgcgccaagaaccggatctcaccaggcgccgagcccggacacctcgacgccgaggccgagtgaagcagctaggcattaaagagagcagggggttcagtccagccatccaaacccgccggccaagcagttagctattctcggcaaacccccaaccggcgtttatcaatcaggttcacacaagcagttcatccagtccacccccccccctattgtccgccgggttcca

SEQ ID NO: 2178 - DNA, 605 bp, Triticum aestivum
  Predicted polypeptide sequence is orthologous to G12
gaggcgcctttggctgccgcggccgcggcggtggcggccaaggaggagcacaacgtgaccgtggccgtggcgccgcccatccccatggcgatggcgatgccgctgcagcagcagcagccgcggaagcagtaccgcggcgtgcgcatgcgcaagtggggcaagtgggtggcggagatccgcgagccgcacaagcggacgcgcatctggctggggtcgtacgccacgcccgtcgccgccgcgcgcgcctacgacacggccgtcttctacctgcgcggcaggtcggcgcgcctcaacttccccgacgagatctccgcgctcgcgctgtcgtcgcccgaggccgccgaggccggcgctgccggaggggagatggcgggcgagctgggcgacggcggcgcgctgtcggccgcgtcgatccggaagaaggccatcgaagtcgggtcccgcgtggacgcgctccagaccggcatgaccacgatggtcgccgcgcccacgcaccaacgggagcggcagaggctccaccaccaccaccacgcggagccgcacggcgaggagctgcaccgccacgtgaagcagcagcggacggcgtggaacgggcgcgccaagaa

SEQ ID NO: 2179 - DNA, 853 bp, Triticum aestivum
  Predicted polypeptide sequence is orthologous to G214, G680
gcacgaggtttcgagttttttttttttttttttttttttttttttagcttaaatgtaaatactgcaatttcttgaaaatacactattctgggaaggctggtaatcatgtcgtggcaagtaaatcacgtggagggttcgctgtcaaggcgaatcctcttggtaccaacctcgtcagcagccggcaccctattctcctttgcttccaccgagcacctcttgtaaggtttgaagcctgtccggcgggatttcatattcaggtgtgacaattcaatgggaaaggtagctcttggcccaaccaatgtatcaagttcatggtccataactgcagcactcttgttgaggtcgaccgtcaccgtagtagcttcgtcttgttcccccctgggtaccaccttcaatccttctgcttgtggaggagaaaagctttggggaagctttcctctactgaacagtttatcgaaagccatacgaccctcttcggaaacttccttccatgaatcatttgtgcttgaaatgttcctaaacctgcggtggttcatgtcaccagctgaagaattactgcaacatgcttgctgtgtcttgtcgttggcttgatcttggttctcaggaacatgttctgcctctacatcactacttgatggcgtgttggaaccactgaagacgatcctgcttttcttgttgcgaaagcatattgtttcactctggggaagggtgtctcactataacttgaaatattaatcggggggagacccttcctttcactttgcgatccgaaacctcccttctaactcagtgactgctctacacttgttcttgggctgccatggcgtctcttatctaatcctcggaagacaaa

SEQ ID NO: 2180 - DNA, 512 bp, Triticum aestivum
  misc_feature (259)..(259): n is a, c, g, or t
  misc_feature (302)..(302): n is a, c, g, or t
  misc_feature (436)..(436): n is a, c, g, or t
  misc_feature (438)..(438): n is a, c, g, or t
  misc_feature (480)..(480): n is a, c, g, or t
  misc_feature (483)..(483): n is a, c, g, or t
  Predicted polypeptide sequence is orthologous to G214
cgtggtctcgttcctgtgcgtgatcgtggggtcgctcgcgttcgccgtgcaggccgtgctcgccgccagaggcctcgccccagccaccggtgctttaagcagcaagaattacacggttgaaccgcctaatcccccttgtgtaataggtgttacttactgttcgagcggcccacccgcacattaagtatccgtgaagatataggcggcctggggaaccacacttgggaggcagattgggagttgggagatccgatacaantactgtccaaagcatggaataaattaagctactggaacactanccttggttgttaagcatagtgatgttgagactatctatcgttggtgtttcccttttcccgaataaacaccaagacagcgcaacgtggattatctaataataccaaggagaagaaaaccacccgtttttaacgcngnaatttctctttctccgtgtgttggtgttgtactcccaacaantanaagtgtttaaatgtctcaaaaaaaaaaaa

SEQ ID NO: 2181 - DNA, 798 bp, Triticum aestivum
  misc_feature (703)..(703): n is a, c, g, or t
  misc_feature (709)..(709): n is a, c, g, or t
  misc_feature (773)..(773): n is a, c, g, or t
  misc_feature (779)..(779): n is a, c, g, or t
  Predicted polypeptide sequence is orthologous to G214, G680
gtcccttccttcgtcactcgcgcgcgcgcgcacgcacgcacgcacgcttgttcctcccactgctggcctagctagatccccaaagcggaggagttggccgggaagcttcgtccggaagcatcggccggtggcggcagagagaggagccgctgcgcccggtgcggcggtcgcttgaggccgccgcgcggagggcgggcgacgtggcgaccggggttagcttgctgctcgcccgaggtgtaggaagtgttaaggggatacataatcagttttgagctgtgaggccctgcatttgtgctgcctgctgtttgattcacgggccactcttttcctcctactcattcaagcaaagtactggaatttgtaagctcagtttattcaggttatgggagttgtttgtccttagcagagttgaagataaagagaggaaggctaaactccgctgactcagttcatgtgtgcaatgagccaactgcaatagaggttttcagtagattaacaccaattgggtcaaagaaaatagagaggtttagggggaggtatgagatactactcgcgtcaagtccagcgtttggctggagacacagaaggaggagcactgttgtttgtagacgccctcaactccaagtaacaaagcgaccagttgtcaacacttccttttatttttgtattttccctggaattggagatggagataaattcttcnggtgangaaacggtcataaaggtgcgaaagccgtacacaataacaaagcagcgggagcggtgggaccgangcagancacaaacggttccttgaag

SEQ ID NO: 2182 - DNA, 924 bp, Triticum aestivum
  Predicted polypeptide sequence is orthologous to G214
gcggtggcggccgctctagaactagtggatcccccgggctgcaggaattcggcacgagggacaggagtaccccatgcatcaggagccgagctgcctgtgcttccaaggagaggagcgctcctgaaggtatcaacatggaggaacatggatttaggtttcagttcactttccctgaacccgattatggggagtacggctctgatttcggtgaggaagaggagtgtttaccgaggcagaggaaacctcccgaagtaaggaatgcactccgtgagaagagagtcgcgtttaggcaaaagactgggcggcaccatgcaaaggtagccctgcgtaagtacaacagagcaaacaacaccaagtttgagctggtggaggtgccagtgatccgtgagttttgggagtttggagggggctgcatccattacaacttcacggctaagcaagcagaggatcatcgtcattctgctgatgcagacaacaccaagctcttcttctctgaggtcaactctgctttccatggcgacaaggatgtggtcctgtgctgtatcgttggagaacatgacaatgggcattgctatggctgtgaaggcttcaagccaaccgttgttcaccctagcagccaagcgtatggcagtggcagtagtacttgcattgattttgctggttcagatggaagctcggagagtgattaaaacgcaaaaacttccggtggttgagctcggtggttggatttggcttgcatgcatggctaatcttccagggtgtcttgtctcttagttcttaataatgccaagataaatgtacttttggtggttaatgcccttcttaaatactccgattacaaaatggcgaacatcttgcaattttgaacattttttgaactcgtcaacatttaatattttttgaaaaaaaaaaaaaaaaaaaaaa

SEQ ID NO: 2183 - DNA, 759 bp, Triticum aestivum
  misc_feature (486)..(486): n is a, c, g, or t
  misc_feature (506)..(506): n is a, c, g, or t
  misc_feature (615)..(616): n is a, c, g, or t
  Predicted polypeptide sequence is orthologous to G280
gagagagagagagagagagagagagagagagagagagagagagagagagagagagagagagagagagagagagagagagagagagagagagagagagagagagagagagagagagagcgcagtcgccgcagacctcctctcgggaagaaaaattccccacctctcctccctttcccctcctcgtccccgccgcttcgccatggccgacgagcaggtcgccaagccggcgagcctcccgccatatcccgagatgatactggctgccatcgcggcgctcaacgacaagaacgggtcgaacaagtccgccatctccaagcacatcgagggcaagtacggcgacctccccaaggagcacgctgctctgctgacggcgcatctggtgcgcatgaaggagtccggccagctcctctttctcaagaacaactactttcgcaccgacgcgccggacgccccgcccaagcggtgccgcggccgcccgcgcaagcncattgaccccaacgcgccgnccaagcccgtctcgccgcgcccccggggacgcccggtcaagcccaaagaccccgaggccgaagccgtcaacccgtctaggaaggccaagaccgttcccggccttgcgtnnacggttcgccaagcgcgggcggggctgttcgcccaggcgccccccgccaaccggggggggcttactcgttctccgtccacttggggccggtttgggtttttttggtatacccgggggtgggtgggttaattttgtttgtgggg

SEQ ID NO: 2184 - DNA, 1117 bp, Triticum aestivum
  misc_feature (816)..(816): n is a, c, g, or t
  misc_feature (834)..(834): n is a, c, g, or t
  Predicted polypeptide sequence is orthologous to G280
cctgcgacccacgcttccgcgactggagcacgaggacactgacatggactgaagggagtagaaatttttcccctccccgcagcccgctccctcctccgcgcccgcactgtagcccgagcgctcggctccaccgccgtgggctgtagccgccgtcgctgccatggcgaacgacgggtcccccaagtccggtgacatcccgccctaccccgagatgattctcgcggcgatcgaggcgctgggcgacaagaacggctcgagcaagtccgccatctccagctacatcgaggagaagtacgatggcctcccctcggcgcacgcctccctcctcacggccaacctcgccagcatgaaggaggccggcaagctcgccttcgtcaagaacaactacctcaaggctgacgctccctccgccaccccggcaaagcgcggccgcggccgcccgcctaaggaccctaacgcgccgcccaagccgaaggctgcgcccaaggaccccaacacgcccaagcgcggccggggccgcccgcccaaggctaaggatcccatggccgacgccgtcaaggatgccgtcgccaaggcgaccaccggcatgccccggggccgcggccgcccgccgggtccctcctcggccaagaaggccaaggtcgccaaggaggctgcctctccggctcccgcggacggctccgctcctgccaagcgtggccgtgggcgcccacgcaaggtggcggtgtgaggcctgcgtgctgatgcctttcggtctgtgtatctcgctgtggttgcgacggtggtaagctcctaggtgtgaccgtgcttcttcgnattgtgctccgtactaanttgtccgtcggcttagttgctcagtatgtgttgtaactaatcgagatgagtgtgcacaatggatggatggatgttttagcttcggttgtagttgactgtgctgctgtgagtgacatggtcatttttttaaaaaaaaaaaaaaaaaaaaaaaaagggcgccgttctaagtatcctcgaggggcccagcttaccgtcccagcttctggtcaaggggtccctataggaatcgtatttaagtaggcctgcccgggtttaaaaattggtatgggaaaatgttacttga

SEQ ID NO: 2185 - DNA, 1097 bp, Triticum aestivum
  Predicted polypeptide sequence is orthologous to G481
gcacgaggcgccgccttctcttctccagcgtcggatcttcccccactcgccgccctcaccgcacctccattcccctccaccaccttccctccctccacgcgctcctctatataagggggagggccggatgtcggacgaggcggcgagccccccgggcggcggcggcggcggaggaggcggcggcagcgacgacggcggcggcggcggcggcttcggcggcgtcagggagcaggacaggttcctgcccatcgccaacatcagccgcatcatgaagaaggccatcccggccaacggcaagatcgccaaggacgccaaggagaccgtgcaggagtgcgtctccgagttcatctccttcatcaccagcgaggcgagcgacaagtgccagagggagaagcgcaagaccatcaacggcgacgacctgctctgggcgatggccacgctgggcttcgaggagtacatcgagcccctcaaggtttatctgcagaagtacagagagacggagggtgatagtaagctagctgggaagtctggtgatgtctctgttaaaaaggatgcactgggtcctcatggaggagcaagtggcacaagtgcgcaagggatgggccaacaagtagcatacaatccaggaatggtttatatgcaacctcagtaccataatggggacatctcaaactgaagatatggaccatctccgagactgctgctactctgctaggcgggttttcgtcatgtggagagcactaagcagttaaagaaaactcttagtacccccattagtctcgtgttgttgggtctgccagaactgatgctcaaaggctgcttcccagatgtaaattgctttttcctgagaatagattcagttgtggtttagcatggttgttgttgttgtctgtatatttatgatgattagcctcgtcgtggctgtcattcggttccatataatctgggtatttgggggagacataactcctccaggtgtagtttgtcctgaactagctgtatcagactcttgagaagagttgctattagccctccaaaaaaaaaaaaaaaaaaaaaaaaaaaaaaaaaaaaaaaaaaaaaaaaaaaaaaaaaaaaaa

SEQ ID NO: 2186 - DNA, 779 bp, Triticum aestivum
  Predicted polypeptide sequence is orthologous to G481
ggtcaaaagcatacatcagcagctgcattatcttcttcagtcaataccttacacgagcgaaagactgcggtttttcaaacctgttcatcatcttattacagtcactaacccctaaaagttgacgtggaaaaggcgtatctctgaatttaccataaggttagacagacccatacaacacacggactgaactagagagagggaaagaacagctaacatctacagaagacatagcatggtatttcaagtatcccgcatgcacagaactaagcagagtgctggggactttccccggccacaaaggcgcagtactgctaggatcacactgccaacgaattgtatgtgtatgtttgtcatacgccgatcagtatcatcctccaccctacatgccgttgaacgatgatccaggctgcccattcagtgcacccactttctttgcagcctgctcagatttcgaaccctttgacgtgtcaccctccatctcccggtagagcttgagatagagcttgaggggctcgacgtagtcctcgaagccgagcgtgcccatggaccagatcaggtcgtcgccgttgatggtcttgcgcttctccttcatgcacttgtcgctcgcctcgctggtgatgaagctgatgaactcggagacgcactcctggatggactccttagcgtccttggggatcttgccgttctccggcacgccgcgccgcatgatgcgcccgatgttggcgatcgggaggaaccggtcctggtccttcggcccggtgctcctccgggtgcccacc

SEQ ID NO: 2187 - DNA, 639 bp, Triticum aestivum
  Predicted polypeptide sequence is orthologous to G481
ccacgcgtccgcactgagtaagtgtgtaagtaagtgacagattgaacaatgggagggcgcggcaagaagcgtggtggtgcgaagggggccggccgtgagggcaacggggagaagccggcgtcggacgggagcagcgcggtgccgacggccaacgtcgtgcccgtgacaaggcgggtgcagccgtcgaacgtcaagatcgccgagtccgcgaagcagctcacccacgactgcgcggccgagttcgttttcagccgcagggcgcgccctcctgcgcggccggcgatgacggcggccgtgtcgcctggcgcaccagtgttcaccgacgaggagctggagttcctccagtcggtaattcctccgccgccgggcggatattagcggtgcggcgggcaagctggtcggccacaggcgcaggcgctaccacctgcggggcatggctataaatgttgtgttgttttgcttgaagaaaaatcccgatgtatccaataagacaataatacatacatcggtcccaaattacttgtcttaaatttttctagatacggatgtatcgaacattaaaacatgtctatatatatccgtatctagataaatgtaagacaactaatttaggacgaagtgagggagtactaatgacat

SEQ ID NO: 2188 - DNA, 1055 bp, Triticum aestivum
  misc_feature (747)..(747): n is a, c, g, or t
  misc_feature (966)..(966): n is a, c, g, or t
  Predicted polypeptide sequence is orthologous to G481
caacccagacgtgccgggactggagcacgaggacactgacatggactgaaggagtagaaatcttgtagctccaaacattttccaccttttcgtacaagtgtccttccttctagtgaagtagttcatgcttgatcaggctagagtggtttgatgtcaccacttgcttgtggatttgaggcagacagatcgaggaggagagccatgccggactcggacaacgaggactcgggcaacgcgggcggggagctgtcgtcgccgcgggagcaggaccgcttcctgcccatcgccaacgtcagccgcatcatgaagaaggcgctcccggccaacgccaagatcagcaaggacgccaaggagacggtgcaggagtgcgtctccgagttcatctccttcatcaccggtgaggcctccgacaagtgccagcgcgagaagcgcaagaccatcaacggggacgacctgctctgggccatgaccaccctcgggttcgaggactacgtcgacccgctcaagcactacctccacaagttccgtgagatcgagggcgagagggccgccgccacatcgacatcaaccacgcccgacatgccaagaaacaacaacaatgccaccggttacgccgacgccccgggaggcatgatgatgatggggcagcccgtgtacggctcgccgacgtcgccacaggagcagcagcagcaccaacatcagattgcaatgggagggagagcgggcttaccctatcacggacgcggnggtagcaggggcgggtcctcgtcatcgtcgaggttcggacggaaagaggggtgacatctcttctcttcttattgagctgaccaaagtgagtgattacaagatatgttcctctcttggatgaagcgtacatgacttgtagcttagggaaatccatcagtacaaggagaaatgattgtcttttcctccaaacaaaatatctatcccttaacccaagttcangaaaagggggcccgtcctaaatatccttgggggggcaaatccttggctttcccggttttttgaaaaagggggtccttaaagaagcgtat

SEQ ID NO: 2189 - DNA, 1100 bp, Triticum aestivum
  Predicted polypeptide sequence is orthologous to G481
gaacccacgtcggtccggcccattccccacccctcctcgcagcgccaaccaccgctcctcctaattcccccttccttctgggccctccgctcctccccgcgcgcgcgcgcgcgtttatataagggtttcggggccccggatggtttttaaagacagggggagcccccggggcggcggcggggtcagggagcaggaccgtttcccccccatcgccaacatcagccgcatcatgacccaggccgtgttggccaacggcaagatcgccaaggacgccaaggagaggggcggggagtgtttctccgagggcgtctcccccgccatcagcgaggcggggggggaagggccataacgataagcgcaagaccatcaacggggacgatctgcactgggccatggccacgctcggatacgaggagtacgtaaaccccctcaagatctacctgcaaaagtacagagatatggagggtgatagtaaattgacctcaaaatctggtgaaggatccgtgaagaaagatataataggcgctcatagtggtgcgactagctcaaacgcccaagcgacgggtcagcgatggaggtaacgcccaagggatgggtaataatgcaccccaggaccataatggggacacctgaaactgaacatcaggcaagctacgggaatgggtatagcgccaggaatggcgaactaccagtaagggaagccgccccaccattagggtccagaggaccatggactggaaacaggggggcgtgcatggctgcctccaagaggaaggtggtgccgagagaagagagtccgccatcatggccaggggagggcgggcaccggccacgcggagagatccacgcggcgggcaacaggggacccagggggggcagatagggggtataggaaaccaaagcacaatggctccgggggggggaccgtatcagggggggcgcggccccggggcccgccacgagggggcaagggccccgggcggcgcggaacagaaaaacacgaaaagaggggcggcggtgtcaaaggccgccccccgggcgcaaggctgaggcgggtacccggagctcccgcggagaggggcgcccagaatcaaacaccg

SEQ ID NO: 2190 - DNA, 1070 bp, Triticum aestivum
  misc_feature (21)..(21): n is a, c, g, or t
  Predicted polypeptide sequence is orthologous to G486
gcgttccgcaacgcacacatnaagtgtgtagtaagtaagtgacagatcgaacaatgggagggcgcggcaagaagcgtggcggtgcgaagggggctggccgtgagggcaacggggagaagccggcgtcggacgggagcagcgcgttgccgacggccaacgtcgtgcccccgacgaggcaggtgctcccgtcgaacgtcaagatcgccgagtccgcgaagcagctcacccacgactgcgcggccgagttcgttttcagccgcagggcgcgccctgctgcgcggccggcgatgacggcggccgtgtcacctggcgtgccagtattcaccgaagaggagctggagttcctccagtcggtaattcctccgccgccgggcggatattagcggtgcggcgtgcaagctcgtcagccacaggcgcaggcgctgccacctgcggggcatggctataaatgtagtgctgctttgcttgaagaaaaatcccgatgtatccaataagacaataatacattcaacctcagccctgaaaaaaaaaaaaaaagggcggccgctctagagtatccctcgaggggcccaagcttacgcgtacccagctttcttgtacaaagtggtccctatagtgagtcgtattataagctaggcactggccgtcgttttacaacgtcgtgactgggaaaactgctagcttgggatctttgtgaaggaaccttacttctgtggtgtgacataattggacaaactacctacagagatttaaagctctaaggtaaatataaaatttttaggtgtataatgtgttaaactagctgcatatgcttgctgcttgagagttttgcttactgagtatgatttatgaaaatattatacacaggagctagtgattctaattggttgtgtattttagaatcacagtcccaagcctcatttcaggcccctcagtcctcacagtctggtcaggatccatatcagccataccacattggtaagaggtttacttgctttaaaaacctcccaacctccccctgaacctgaaacataaaaggatgcattggttgtgttaacctgttaattgca

SEQ ID NO: 2191 - DNA, 1167 bp, Triticum aestivum
  misc_feature (11)..(11): n is a, c, g, or t
  Predicted polypeptide sequence is orthologous to G504
gcgtccgggtnagatttggtctggtccagtgtgtgtgtgtgtgaccgtctcccatcttcttttgatcgtgtgtgcagcgtgcgtgtcgatggcgcagcaggggcagggcgcggcgacgtcgctgccgccggggttccggttccacccgacggacgaggagctcatcctgcactacctccgcaaccgcgccgccgccgcgccgtgcccggtccccatcatcgccgacgttgacatctacaagttcgatccatgggacctcccttcccaggcggtgtacggcgactgcgagtggtacttcttcagcccgcgggaccgcaagtaccccaacggcatccgccccaaccgcgccgccggctccggctactggaaggccaccggcaccgacaagcccatccatgacgccgccaccggccagggcgtcggcgtcaagaaggcgctcgtcttctacaagggccgcccgcccaagggcaccaagacggcctggatcatgcacgagtaccgcctcgccgccgaccccctcgccgccgccgtcaacacctacaagcccatcaagttccgcaacgtctccatgaggctcgatgactgggtgctctgccggatctacaagaagacaggcctggcgtcgccgatggtgccgccactcgccgactacgaccacatggccgaccacgacgacctctccagcggcggcgccttcacctatgccacctgcagacccctgtatcagcagcagaatcaccagcagccgcacgccgggaggctcccgacgttcccgtccatctccgagctgttcgacgactacccgttcgcgcagaaatgggacaccttacgttgagcagggcgccaccaccacctcggcgttcacccctccctgaaccagttcctcccgtcgggaacaataggcacgagtggagcgccgtatacgcgccgtcgagttgtttcaagacctagcgggggagcccaggaacgcaagggggtacccggaaaaacggggagccccaccggcgccaaaaactcaacgggttggccttcagcgcccccaatctgtaatgctgaagcccgtgtccggcgtgtgggcccaccaaaagggtcccagttaaactggcttacaaacctttaggattactccggagggcccctgggcaaaaaatttattcccgctgcagt

SEQ ID NO: 2192 - DNA, 1423 bp, Triticum aestivum
  Predicted polypeptide sequence is orthologous to G504
gcagcatttttatgcagtagccatcttctcctcctcctccccccgccttccagctagccacctagctcactatcacatcatccagcagcccacaccaactcatattgattccgttcccacctgctcgccatcgccagccatgccaatgggcagcagcgccgccatgcccgccctccctcccggcttccggttccaccccaccgacgaggagctcatcgtccactacctccgcaggcaggccgcgtccatgcccagccccgtgcccatcatcgccgaggtcaacatctacaagtgcaacccatgggacctccccggcaaagctttgttcggggagaatgagtggtacttcttcagcccccgggatcgcaagtaccccaacggcgcgcgcccgaaccgcgccgccgggtccggctactggaaggccaccggcaccgacaaggccatcctgtccacgccggccaacgagagcatcggggtcaagaaggcgctcgtgttctacaggggcaagccgcccaagggcgtcaagaccgactggatcatgcacgagtaccgcctcaccgcagccgacaaccggaccaccaagcgcagaggatcctccatgaggctggatgactgggtgctgtgtaggatccacaagaagtgcggcaacttgcccaacttctcctcctctgaccaggaacaggagcatgagcaggagagctccaccgtggaggactcgcagaacaaccacaccgtgtcgtcgcccaagtccgaggccttcgacggcgacggcgacgaccacctccagttgcagcagttccgccccatggcgatcgccaagtcgtgctccctcaccgacctgctcaacaccgtcgactacgccgcgctctcgcacctcctcctcgacggcgccggcgcctcgtcgtcggacgccggagcagactaccagctgcctcccgaaaacccactcatctactcgcagcctccatggcaacaaacgctacactataataacaacaacggctacgtgaacaacgagaccatcgacgtgcctcagctacccgaggcgcgcgtagatgactacggcatgaatggcgataagtataacggcatgaagaggaagagatccagcggcagcttgtactgcagccagctgcagctcccagcggatcagtacagcggcatgctgatccatccgttcctcagccagcagctgcacatgtgaagaaccagagagcttgggtcgaagagatcatcattgttccatttgaacttgctgtagatcgagaggatcccccgctgtggcagataggcagggatctagctagcttgctgtgtcgtgaacgaccgaccgataagaacggacaaatttcagaattcttggtgtagcacaaagctgtaaattacgggggtttattgtgaaataaattaatccagtattatc

SEQ ID NO: 2193 - DNA, 1335 bp, Triticum aestivum
  Predicted polypeptide sequence is orthologous to G504
attgattccgttcccacctgctcaccgtcgccatgccaatgggcagcagcagcgccgccatgcccgccctccctcccggcttccggttccaccccaccgacgaggagctcatcgtccactacctcggcaggcaggccgcgtccatgcccagccccgtgcccatcatcgccgaggtcaacatctacaagtgcaacccatgggacctccccggcaaggccttgttcggggagaatgagtggtacttcttcagcccccgggatcgcaagtaccccaacggcgcgcgccccaaccgcgccgccgggtccggctactggaaggccaccggcaccgacaaggccatcctgtccacgccggccaacgagagcatcggcgtcaagaaggcgctcgtcttctaccggggcaagccgcccaagggcgtcaagaccgactggatcatgcacgagtaccgcctcaccgccgccgacaaccggaccaccaagcgcagaggatcctccatgaggctggatgactgggtgctgtgtaggatccacaagaagtgcaacaacttgcacaacttctcctcctctgaccaggaacaggagcacgagcaggagagctccaccaccgtggaggactcgcacaacaaccacaccgtgtcgtcgcccaagtcggaggccttcgacggcgacggcgacgaccagctgcagctgcagcagttccgccccatggcgatcgccaagtcgtgctccctcaccgacctgctcaacaccgtcgactacgccgcgctctcgcacctcctcctcgacggcgccggcgccggcgcctcgtcgtcggacgccggagcagactaccagctgccgccggaaaacccgctcatctactcgcagcctccatggcaacaaacgctacactataataacaataacaatggctacgtgaacatcgacaccatcgacgtgcctcagatacccgaggcccgtgtagatgactacggcatgaatggcgataggtacaacggcatgaagaggaagaggtccagcggcagtttgtactgcagccagctgcagctcccggcggatcagtacagcggcatgctgatccatccgttcctcagccagcagctgcacatgtgaagaaccagagagcttggatcgaagagatcatcattgttccatttgaacttgctgtagatcgaggggatcccccgctgtggcagataggcagggatctagcttgcttgctgtgtcgtgaccgaccgaccgataagaacggacaaatttcagaattcttggtgtagcacaaaagctgtaaattacgggggtttattgtgaaataaataaatccagtattattaag

SEQ ID NO: 2194 - DNA, 1319 bp, Triticum aestivum
  Predicted polypeptide sequence is orthologous to G504
attgattccgttcccacctgctcaccgtcgccatgccaatgggcagcagcagcgccgccatgcccgccctccctcccggcttccggttccaccccaccgacgaggagctcatcgtccactacctcggcaggcaggccgcgtccatgcccagccccgtgcccatcatcgccgaggtcaacatctacaagtgcaacccatgggacctccccggcaaggccttgttcggggagaatgagtggtacttcttcagcccccgggatcgcaagtaccccaacggcgcgcgccccaaccgcgccgccgggtccggctactggaaggccaccggcaccgacaaggccatcctgtccacgccggccaacgagagcatcggcgtcaagaaggcgctcgtgttctacaggggcaagccgcccaagggcgtcaagaccgactggatcatgcacgagtaccgcctcaccgcagccgacaaccggaccaccaagcgcagaggatcctccatgaggctggatgactgggtgctgtgtaggatccacaagaagtgcggcaacttgcccaacttctcctcctctgaccaggaacaggagcatgagcaggagagctccaccgtggaggactcgcagaacaaccacaccgtgtcgtcgcccaagtccgaggccttcgacggcgacggcaacgaccacctccagttgcagcagttccgccccatggcgatcgccaagtcgtgctccctcaccgacctgctcaacaccgtcgactacgccgcgctctcgcacctcctcctcgacggcgccggcgcctcgtcgtcggacgccggagcagactaccagctgccgccggaaaacccactcatctactcgcagcctccatggcaacaaacgctacactataataacaacaacggctacgtgaacaacgagaccatcgacgtgcctcagctacccgaggcgggggtagatgactacggcatgaatggcgataagtataacggcatgaaaaggaaaagatccagcggcagcttgtactgcagccagctgcagctcccagcggatcagtacagcggcatgctgacccatccgttcctcagccagcagctgcacatgtgaagaaccaaagagcttggatcgaaaagatcatcattgttccatttgaacttgctgtagatcgaaaggatcccccgctgtggcagataggcagggatctagctagcttgctgtgtcgtgaacgaccgaccgataagaacggacaaatttcagaatttttggtgtagcacaaagctgtaaattacgggggtttattgtgaaataaattaatccagtattatt

SEQ ID NO: 2195 - DNA, 547 bp, Triticum aestivum
  misc_feature (8)..(8): n is a, c, g, or t
  misc_feature (522)..(522): n is a, c, g, or t
  Predicted polypeptide sequence is orthologous to G559
gcctgttnttttccctaaatgccaacgggcaaaccatcagtgtctgagtttagttaacaacaacaacaacaacaacaacaacaacatggagtatgcccataactggacgcaacaatgcatcttctaccggaccaaaaccaaaaggttcaacctagaattcccaaagtgacttccttcaacaactacagacaaacgcttcccacgacactgtcaacacctgtgatcgatcgtcccaactgttcaattgaaactaaaaaagccaacaccaaagccactacacctgcgcattatcatcatcatcatcatctccagacctagttgtttcagatgccgccgcttcccgacgacttcccgtcaccccacatcggctgctgctgctgctggggctgtggatggagctggagctgttgcagctggtgtgtcgctagcagagactgcatggactggttgttgtggaacatctgctggttgcttccgaattggtgtggcgcctgtgacatgccgccatagttcatcagcatncccccaccgttgcccgtctggcctg

SEQ ID NO: 2196 - DNA, 837 bp, Triticum aestivum
  Predicted polypeptide sequence is orthologous to G559
tagggcctatttaggtgactccatagaacaagtttgtacaaaaaagcaggccggtaccggtccggaattcccgggatatcgtcgacccacgcgtccgagcccaaaccaccctcgcctctcgctcccattccccttgcccagctccgtgttcttgcgacccagctcctagatcttcctccccctttccctcgcaagaatttccacccgatttccgcgctctggtcgctcttcttttagccaagaatttcctccgattcttttccagcgtaatcttagttctgagccgtatgtgttgttttcttggctgaagcttgattagctccgtggacttgcaaaaaggcggcgcgtttgaggagattcggcggggccctggtgccgggaagatgaacaaggacaggtcccggatctcggcggacggcggcggcggcgacggcctgccgccgcagccgtcgcgccgctcggcgactcccccgccggagtacgacatcagccgcatgccggacttccccaccaggaaccctggccaccggcgcgcgcactccgagatcctcagcctcccggacgacctcgacctctgcgcgcccgggggcggcgacgggccctcgctgtcggacgagaacgacgaggagctattctccatgttcctcgacgtggacaagctcaactcgtcgtgcgggccgtcgtccgaccaggcggagtcgtcgtcagccgctgctgccggcgggggcgaagcggcccaggcgggccacgtgatgaggccgaagcaccagcacagccagtccatggacgagtcgatgtcgatcaaggccgaagacctggtggggcgcccgggattga

SEQ ID NO: 2197 - DNA, 176 bp, Triticum aestivum
  Predicted polypeptide sequence is orthologous to G594
ttttttttttttttttttttttttttttctttgcatgtaccggctattgcgagtattgacgcgtgatgagtgagcgttgacacgtaacatattgacatgtaaccggtgccttctcgatagctcaatgtatcgtccttttctgaagttgctatcagtctataaatagggatcccttc

SEQ ID NO: 2198 - DNA, 1336 bp, Triticum aestivum
  Predicted polypeptide sequence is orthologous to G668
gcacgagagcgggcgagacgtgagcatggggaggccgccgtgctgcgacaaggagggcgtcaagaagggcccctggacgccggaggaggacctcgtgctcgtctcctacgtccaggagcacggccccggcaactggcgcgccgtccccaccaggaccggcctgatgcggtgtagcaagagctgccggctccggtggaccaactacctgcgcccagggatcaagcgcggcaacttcaccgaccaggaggagaagctcatcgtccacctccaggcgctgctcggcaacaggtgggccgcgatcgcctcctacctccccgagcgcaccgacaacgacatcaagaactactggaacacgcacctcaagcgcaagctgcaggcggggggcgacgccgcggccaagccggcggcgcagaggcctgcctcctcctccaagggccagtgggagaggcggctgcagacggacatcaacatggcgcgccgcgcgctgcgcgaggcgctcaccacgctcgacgacatcaagccgcagcagcccgacgcggccgacggcgtcaatgggcctgccgcagccggcgccgacagcggcagcccggcggcctccagctcgtcggccgcgtcgctgtcccagtgctcgccctccgcggctgggccgtacgtgctcaccaccgcgaacatctcgcggatgctcgacgggtgggccagcaagggtcgcagcgccggggccgcggcggacagcccctctggctcgtcggcgtccgaggtttcctacggcagcggcgcggccgcccgtgcgctggggtccgcgttcgagtacgacaggaagccggccgttctggcgccggatcagacgcagctgaacgcgatcgagacgtggctcttcgccgacgacaacagcaacaacgaccaccatggccacggaggcggcggcagcggcctgctcggcgtcgccgccatgggttaccctttctagctagctccaccgtgccaagttatgaaggtcgatgttcccctagctcttgcgttactgatgcgaggagtgtgttcactgcatgcccacctaacgaaaactacatagatcctctagtagtagtacctcggtggctatggcaatcagcttccttggtctcgtgtttacttaggatctgcatagttttcatttagggaaaagaagggaggttgtggtagcttagtgctcctgttatttactgctgtaactgtgacttggtactatgttatgttcatgggttttgggttttgtactttgaagtagatccgctgtttgcaagctgcaaaatgtggacgaataaagtcagtatgtcaattagtaaaaaaaaaaaaa

SEQ ID NO: 2199 - DNA, 670 bp, Triticum aestivum
  misc_feature (244)..(244): n is a, c, g, or t
  misc_feature (266)..(266): n is a, c, g, or t
  misc_feature (280)..(280): n is a, c, g, or t
  misc_feature (294)..(294): n is a, c, g, or t
  misc_feature (297)..(297): n is a, c, g, or t
  misc_feature (309)..(309): n is a, c, g, or t
  misc_feature (354)..(355): n is a, c, g, or t
  misc_feature (359)..(359): n is a, c, g, or t
  misc_feature (393)..(393): n is a, c, g, or t
  misc_feature (415)..(415): n is a, c, g, or t
  misc_feature (426)..(426): n is a, c, g, or t
  misc_feature (438)..(438): n is a, c, g, or t
  misc_feature (443)..(443): n is a, c, g, or t
  misc_feature (476)..(476): n is a, c, g, or t
  misc_feature (485)..(485): n is a, c, g, or t
  misc_feature (511)..(511): n is a, c, g, or t
  misc_feature (517)..(517): n is a, c, g, or t
  misc_feature (519)..(519): n is a, c, g, or t
  misc_feature (560)..(560): n is a, c, g, or t
  misc_feature (572)..(572): n is a, c, g, or t
  misc_feature (580)..(580): n is a, c, g, or t
  misc_feature (586)..(586): n is a, c, g, or t
  misc_feature (590)..(590): n is a, c, g, or t
  misc_feature (605)..(605): n is a, c, g, or t
  misc_feature (612)..(612): n is a, c, g, or t
  misc_feature (633)..(633): n is a, c, g, or t
  misc_feature (643)..(644): n is a, c, g, or t
  misc_feature (649)..(649): n is a, c, g, or t
  misc_feature (669)..(669): n is a, c, g, or t
  Predicted polypeptide sequence is orthologous to G812
cgttcctgacgaagacgtacgacatggtcgatgaccccaacaccgacatcatcatgtcgtggagcgccggcaacaatagcttcgtggtgtgggatccgcacgccttcgccacggtgctgctgcccaaggcacttcaagcacagcaacttctccagcttccgtcaaggcagctcaaacacctatgggcttcaagaaaggtgggttcctgacaagatgggattccccaaatgagggttccctaacngggacaagagcacctttcttgnaaaacatccaagcnccgttaactccccntcnatactgcctccnaacaacatcccttgggtttttacctttaaggtggggcactttccnntatnatgccaaaattttacccgcttaaaaaggacaacnactgtttttatggaaaatttgngaaacctaagnaaggacagcaanacacnaagccgttttaaccatgggaggatagtacttgnaccaacaanacacaacaaatgatcatcatggaacntctgcngnacctgaatctgaacaatgatgcaagaatggatgagaaggantcatgaccttcncaaaaagnggcccncatnacgtgcctaacttancgtggtntagacacacctgacaaaattnccgttttttnncaggncaggattttcgggccggcgng

SEQ ID NO: 2200 - DNA, 803 bp, Triticum aestivum
  Predicted polypeptide sequence is orthologous to G860, G1760
acctgctattgcgattaaggcctatctaggtgacttgattgaacaagtttgtacaaaaaagcaggctggtaccggtccggaattcccgggatatcgtcgacccacgcgtccgcccccgttctggctggatggtggccggagctcgcggaggactcgagatatgcatgtggcggcaccgagcatgaggcaacaactgcattacttgcggggaaggcgcaagtaggacacctgcattacttgcaaacaaggcgcaaaattaatagaagatcaccatacttgtggctttcttgcaagtcgtgcagttgctgcctcaagcttgctgcctccctttgccaaagctatcagaaaaaacataaagttctgttagtttccctaaactttaaaaacataaagttctgttagtttccctaaactttaaaacatgttctacaaaattgatctagaaatgattggcttactgtgctaatttaaagcaatataattactcgacaactgcatatgcacatgttagaagcaaggcagtagaatacttatgttttcatctactggcaggtagcaacatgtatagatatatcactctgaattgagttatggaccaaacattaagaattgctcactttgttggcacatcgcatctgtgaaattgcatataaatttatgtatagccagtgctctcagggtatgaattcaaatattttggtgaaaacagaattgctgctgtaataattttaaaaatattatgcacacggaggatttttagtgtaatggtgtggctgcacacctataagcctccacttgcccta

SEQ ID NO: 2201 - DNA, 1129 bp, Triticum aestivum
  misc_feature (31)..(31): n is a, c, g, or t
  misc_feature (1039)..(1039): n is a, c, g, or t
  Predicted polypeptide sequence is orthologous to G975, G2583
caatgctccaacgcgtccggagcgtacccanatggtcgacctgcaggcggccgcactagtgattagcgtggtcgcggccgaggtttctaacacaaaaccacattctatttatttcctttatatatactacataacggacattgatgtgtaataaagtatcttgacggtgactgtgtatgtaataacaaatataagtacatatagctgcacacagttgcaaacttatgctttttgtaacttggattgagtaatagacatatatctatcttcctgaaacaacctgaactgcttgcgtaccaaccagtgtacgggatcctgatctcggatggcgacgttgccatgctgtttcgtccatgctttttcagacgacgaagctaccttcttctccatgcgatggcgaagctggaccgctactgctcagcagctcctcaatcatctgcagcgtgagcctctcctcgtcatccattgtactcgccggtgaagaagccgtggttgctgacactgtggactgcgctgccaccgcatcgccggatggcccggcccctttgttgagctccacggtcatgacccagttggagtcggcgcgggcccctgcgcgcttctgccagacgccaatgtgggacttctcggtgtcgaggcgaaggcaggtcagggacggagacggcgctttgcagcacttgcgaagcttggcactgagaacctgggacaggttgctcgtcgaggaggaggagctgccgccacggacgtcccgggttgcagctggggcaggatcgccggtgctgctcctctgcacggggaaagtggtcttggcattgcggccgctcatcagaacggcggcctcgtcgtaggcccgtgcagcttcttcggcgggttcaaaggtaccaagccacaccctccttttaagggaggggtgtctgatctcagagacccaggagccccagtggcgctgcctgactccagggaacttcttctggggttgcaccatttgggtctgtctgtctggccttcacagacgagggaacgagccctctgagtccgnacctcggccgggaacacgcttatcccggggccatggcgggccgggaacatgcaacgtcgggcccaatccgcccaataagtggtccaatta

SEQ ID NO: 2202 - DNA, 817 bp, Triticum aestivum
  Predicted polypeptide sequence is orthologous to G1020
cccaccccacccccccaccccgcatcaccaaaacgcccgcataaccaaaaagatacgcgcacgccacttatacacctgctgcacccatggcgcctagagcggcggagaaggcgcctgtctccccgcccaccgggctcggcctcggcctcggcggcggggtcggggtcgtcgccgggggcgcgcactacaggggcgtccgcaagcgcccgtggggacgttacgccgcggagatccgtgacccggccaagaagagcagggtgtggctcggcacgtacgacacggcggaggaggccgcgcgcgcctacgacaccgccgcgcgtgagttccgcggcgccaaggcgaaaaccaacttcccgttcccttcgtcgtcgtcgtcgtcccctgtcgccggcgccggcggcggcggcagcccgagcagcgacagcaccttggactcgagcggcggagggagcggcggctgcgcccaggcgcccatgcaggccatcccgctgccgcccgccctcgacctggacctcttccaccgcgcggcggccgtcacggcggtcgccggcggcggcatgcgcttcccattcaacggttacccggtggcgccgcgccagcccatgcacccgtacttcttctacgaacaggccgcagcggcggcggcggcggcgtcggggtaccgcgcgctgaaggtggcgcagccggtcaccgtggcggccgttgctcggagcgactccgactcctcgtcggtcgttgatctgtccccgtcgccccccgcggtgacagcgcataaggcggtcgcgtttgatctggatctgaaccggccgccgccttc

SEQ ID NO: 2203 - DNA, 1150 bp, Triticum aestivum
  Predicted polypeptide sequence is orthologous to G1020
ctgccgcaccaaccaaccaacgccgcaccccgcccagccaccgccaccacaaccgccgtgtcgaacacttgccatggctcccaagaacgcggcccccgccgccgccgccgcggacgccggcatggagccgaggttccgcggcgtgcggaagcggccgtggggcaggtacgcggcggagatccgcgacccggccaggaaggcgcgcgtctggctcggcaccttcgacaccgccgaggccgccgcgcgcgcctacgacgccgccgcgctccactaccgcgggcccaagggcaagaccaacttccccgtcggcaccgtcgccgccttcgcgcacgtcccgctcccgccgcccaaggcgctggccgtcagccccagcagcagcaccgtcgagtcctcgtcccgggacacgccggccgcgccgcccgccgcccccgcgcccccgccggcgctcgacctgagcctggcgatgccggccatggtggcggcgcagccgttcctgttcctggacccgagggtcgcggtgaccgtggccgtggccgcgccggcgccggcgccgtgccggtcggcggcgatcagcggcatgaacaaggcggcgtcccgcgaggaggagcagagcgacacggggtcgtcgtcatccgtggtggacgcctcgccggccgtgggcgtggggtttgacctgaacctgccgccgccggtggagatggcgtaggagatggaccgatctcggtcgcccgatgacgacgcggcccggaagccaaacgaacctctctcttgggtagaacttaaagtttagaagaatggggtgtacttactagtaagaggttaaccggccgtttaattgccaggatcgacccatcgatgggtaagggtaagtaggggtacttagatccggtgcgtgcgttgcgtttttggctgggggagggaggttacctggataagaacatccatctatctgcccccgaggttcttacaatttccttaaaaccaggggaaaacaaagccaaaatgggaagaaccaggagtaagccttgggtctcaagggcaaaatttggacccgcccctctgttaggggaaattcagattccactcctctcccaaaaacaaaaaaacgccggccgccaaaaaccctcgggggcccaatctcgcgcacatt

SEQ ID NO: 2204 - DNA, 1163 bp, Triticum aestivum
  misc_feature (26)..(26): n is a, c, g, or t
  misc_feature (37)..(37): n is a, c, g, or t
  Predicted polypeptide sequence is orthologous to G1020
acgcccgccctttttttttttttttntagaagtaatncaatataatccggtccatgttgacgccggcaggaggtggcttgggcgacaatacatccatccatctctgcctctccggcgaaaaaagaaaccgtatttacagatctgcccctgccgttgttgtgcaaggcggccggcctcttctaaaaacatcatggaggtacatgcaaatttttcttcgttctactaggggcaaaaaaagaaggcgacgaaagaaactagcagtcatatcagctacgtggactggggggcccgatcagagctccgccggcggcgggcagttcaggtcgaggtcgaaagggacgggcttccttgagggcggcgacggcgccagatccaccaccgacgaggagtcggagtcgctcggggacacggacgccacggtcaccttcggggcctggctgtacatgtggcagccgccggcggcggcggccgccgcctgtccgaagaagtagtacgggtgcgacacggggtagccgctgaaggggaagcgcatgccggcgccggcgccggccccggcggtgctggtggccgcccggtggaacacgtcgagctccagggacggagggagcggcatggcctgcatgggcgccctgcacgtcgccgtccaaggactcgacggtgctgctgttgctgctcccgctgccctcgcccttgagggccgcgcggccggccggcgcctaggccgaagcaagcggaacttgggctcagcctcgttgcccgcgtactcccggctcggccgctgttacgcccggcgcgccccctcggccgtctcgtaacttccgacctccacccgcgctccttttggccgattagcgcatctcggcggtcgtacgctccccaacgggtccctcctccagccggccagcctcggggactggaacccccacccacctccctccacctcacacccattctatccaatcccccacctcttcactcacctccactatacgcctccccccccaccctcgacatctcaacctcaagagatccgctctcttgcaaacgtgcgctccaacgatctgcggggtctctgcgccccgtccccgcgccgccactctccacctctcgtctcacctgtcctctctatggtgcgaccaagcgtcgctatcccaccgcgagaa

SEQ ID NO: 2205 - DNA, 1086 bp, Triticum aestivum
  misc_feature (17)..(21): n is a, c, g, or t
  misc_feature (25)..(25): n is a, c, g, or t
  misc_feature (31)..(31): n is a, c, g, or t
  misc_feature (33)..(36): n is a, c, g, or t
  misc_feature (38)..(38): n is a, c, g, or t
  misc_feature (40)..(44): n is a, c, g, or t
  misc_feature (47)..(48): n is a, c, g, or t
  misc_feature (51)..(51): n is a, c, g, or t
  misc_feature (64)..(64): n is a, c, g, or t
  Predicted polypeptide sequence is orthologous to G1020
ttttttttttttttttnnnnntttntttttntnnnntntnnnnnttnnttntttttttttttcnttcttccctctcctcaagctctgaacataaggcctattcaaggtgttttccaaaaaaaagtttgtacaaaaaagttttcccctaccggtccggaattcccgggatatcgtcgacccacgcgtacgagaccattccccccacgccgaaccgcaacaacaaccgtcgcgcacgcgccgagcacggtcgaacacttgccatggctcccaagaacgcgctccccgtcgccgtcgccgccgccgcggacgccggcatggagcccaggatccgcggcgtgcgcaagcggccgtggggcaggtacgcggcggagatccgcgacccggacaggaaggcccgcgtctggctcggcaccttcgacaccgtcgaggacgcggtccgggcctacgacgccgccgcgctccactaccgcggggtccaaggacaagaccaacttccccgtccggaaccgttcgcggctttcggccaacgtcccgttccccgccgacccaagggagatgggccgtaaagcacccaacaataagcacccgtatcaagtagttacgatacccggacaacaccgacggtacccgttgagtccccgactggttcacggactgaatggattgacccccccaagtgcacccccgtcagaccgaggctcgagacctcggaaggacttggtcggcaagtacggaggctcattgggatgagtcgacctgctcacgacccgccaccccgagattacctcgaggatgaaacgaagaagtgcggagagagagaaaaccgaaagaaccacgggtgacactttagcacaaacactaatcactctcacaatcatacctaagacttgaaaacaacggcacgcctaacgagaaagaaacccaaaagtcgagaccggcagctgcatcgcaggctagcgaaactcggagcacgcgacgggacacgcggggtgtagccacctcatatgcagaatctaaacagaaccgccgattctagtcgaaccgaagcgggacatgatcaagcaatacgggtacggactatctaca

SEQ ID NO: 2206 - DNA, 1166 bp, Triticum aestivum
  misc_feature (15)..(15): n is a, c, g, or t
  Predicted polypeptide sequence is orthologous to G1020
tgcgacccacgcgtnccgcgactggagcacgaggacactgacatggactgaaggagtagaaacaccccagatcctgcacgccatccatcagcttgatacgcacacacccatccgtcaacaagaaaaagaaagccagccatggcgcccaggacgtccgacaagacggcgacgccgcccgctgccggggccgccgcgaccgggctcgcgctcggcgtcggcggcggcggcaacggcgggggcgtcgggccgcactaccgcggcgtcaggaagcggccgtggggccggtacgcggcggagatccgcgacccggccaagaagagccgggtgtggctcggcacgtacgacaccgccgaggaggccgcccgcgcctacgacgccgccgcccgcgagtaccgcggcaacaaggccaagaccaacttccccttcgcctccgcctccgcgccgcccgccgccgcggccctcaccggcgacggcagccggagcagcaacagcagcaccgtcgagtccttcgacggcgacgtgcaggcgcccatgcaggccatgccgctccctccgtccctcgagctcgacctgttccaccgcgcggccaccagcaccgccggggccggcgccggcgccggcatgcgcttccccttcagcggctaccccgtgtcgcacccgtactacttcttcggacaggcggcggccgccgccgccggcggctgccacatgtacaggcaggccccgaaggtgaccgtggcgtccgtgtccccgagcgactccgactcctcgtcgggggtggatctggcgccgtcgcccgccttcaaggaaagccgtcccttttcgacctcgaactgaactgcccgccggcgggcggagctctgatcgggcgccggaggttatgtagcctgatatgactgctagtttcctccggcggcctccttttttggcccctagtaaaacgaaaaaaaattgcgttgttaaaaaaaaaaaaagggcggcggccttaaagttcccccgaggggccaggctttacgcgtaccaggttttttgacaaagggggccccaataggggggcgtattaaaagcagggccgggcccgggttataaagctcggggatgggaaaagggaaccttgggatttgggggaaggaccttcactcgtggggtgggcaattttgggcaat

SEQ ID NO: 2207 - DNA, 816 bp, Triticum aestivum
  Predicted polypeptide sequence is orthologous to G1038
gccacagcacgctccgcgctgacgagcacgagtttgacgcgcacgcggcggcaatggcgaacggcgaccaggacatggccaccgacgaattgatggagacggaggggttgaaggtccttgccgtggacgacgaccccatctacctccattccttgacgcagatgcttcggcgctgcggctacgaagtgacggccaagccgtcaccagcagatgcggtgagggaggtggagaagaacccgaacaggaccgacttcatcatgacggtcgtgcagacccgggggcgagggatggacggcttgggcctcctcaagcgtctcgggaaacgttacccagtcgtactcatgttctcgggcgaagagagcatggagacgagaataaggggaaatcaggggggcgcttgctacttgctggagaagcccctacacgacacgcagatatacttcctctggcagcatgttgtgcgatggaggctcaatgccgccgccgctgccacggcaaacgctaaccctcaccacagccaaggcgtccatctggatgacacgcagaggaagagaaggcaaggaatgaacgattccaacaaggggcaggggggcttttcgagggcggcctggcactggggaccaccaagaaggaaaaagcttgagtgggactgcagaaatgcatgaattgttcgtcaatggcggggacccacttaagacaacaggaggggcgtgaaaatcataccaaaaggcatgcatggcacaatacatgaatccttcccttgggacccttttttaatttttccatgcttaagctggtttggtttttaaataaatg

SEQ ID NO: 2208 - DNA, 706 bp, Triticum aestivum
  Predicted polypeptide sequence is orthologous to G1038
ccacgcgtccgaccagcagtaccttctgaagagcgcaaggtgtgtgcgtgctatggagaacgacaacgccttcccttctggtgtcagcagggacactttgccccaggatttccccgtcgggatgagggtcctcgtggtggaggacgacccgaacgacctcgagcacttgatgcaaatcctcgagaggtgcggctacaaagcgacagcaaaagcgtcaccgagagaagcgctgaaagaggtggaggagaacggagagggcttccacttcgacatcatcatgaccgtcgtgcacggcggcgaagaaggagatggattcgacggcttcgacctcctcgagcgtgttcgggatcgttacccggtcatcattttctctgccgactattctaaggagatggtgatgaggacaatcaatgaaggcgcctgcgacttcatgccaaagcctatgtgctaccaggaggtgcgcaatatatggttccatgtcaacatgcagaggggattagaagtggacgaccctgacgagggggtagaaggacctagcaacaatgagaatccccctgagatcaaatagctcgggggacatctatgacttcctctcgatgaataaaggtggcaccattgtttgctccgcaacagctctggcgactctggcgtgagtcttaggcactcgggcaagcttctattctatagtagctacaaaattacttca

SEQ ID NO: 2209 - DNA, 823 bp, Triticum aestivum
  misc_feature (518)..(522): n is a, c, g, or t
  misc_feature (546)..(547): n is a, c, g, or t
  Predicted polypeptide sequence is orthologous to G1038
aagctatgaccttaggcctatttaggtgacactatagaacaagtttgtacaaaaaagcaggctggtaccggtccggaattcccgggatatcgtcgacccacgcgtccgtggatgtagtggtactcattacagcgattcaggagttgggaaatactgagtacattattacaagttgagttaatgaggttagcggaggaatttttgtaatctgtaaaagcaagttcagggtgtgttgggaaatacgtacattaatggtcgtccttgagtcgagttgtagttatcgttcacacaatctcattttgcgcccataagagggatgcagatatggtggttcattttcagagtagatattcaagtccgacgaaactgaacaagcttcaaccactgcaatcccttctggagacgtccttcatcacctcgttcatgcccttttttctttcagttagacacatcgacagtcaagctttgcgcactactgtagatgttgttgcagttttggctgtatacaaattccaacnnnnnaaaaaaaaaaaaaaaaaaaaaaannggggcggccgctctagagtatccctcgaggggcccaagcttacgcgtacccagctttcttgtacaaagtggtccctatagtgagtcgtattataagctaggcactggccgtcgttttacaacgtcgtgactgggaaaactgctagcttgggatctttgtgaaggaaccttacttctgtggtgtgacataattggacaaactacctacagagatttaaagctctaaggtaaatataaaatttttaagtgtataatgtgttaaactagctgcatatga

SEQ ID NO: 2210 - DNA, 503 bp, Triticum aestivum
  Predicted polypeptide sequence is orthologous to G1063
cttcacatcgcggcgctgcagccggtggaggtcgacccggaggcggtgcgcccgccgaagcgccgcaacgtgcggacctccaagggacccgcagagcgtggcggcgaggctgcggcgggagcgcatcagcgagcgcatccgcgtcctgcagcgcctcgtccccggcggcaccaagatggacaccgcctccatgctcgacgaggccatccactacgtcaagttcctcaagtcccaggtgcagtcgctcgagctcgccgccgccgccaccggcgcggccgcccaccgcgccgctgccttcgcctaccccgccatgcagcacgcgccgtggtagcccgtcctcatcagcacggctcgtcgacgcttcagctaccatgatagcagtgattcaataatccttccttccgtttctgtcgccggcccgcgccgcgcgcaccagctcgtcgtcctcgatccgcttttggagttcctcggatgatttctgtagctctgtgcggctgtgtgca

SEQ ID NO: 2211 - DNA, 425 bp, Triticum aestivum
  misc_feature (413)..(413): n is a, c, g, or t
  Predicted polypeptide sequence is orthologous to G1075
ggccggcggtggcatgccgttcggtgttgatccgtcggggggctcgacaggagctgggctccagttcttcaacctgccgatgggcatgccgccaatgcccgtggacgggcacaacggctggccgggcgctgccggtggcgtcgagaggccgccgttctcgtgacggatcttggccggcggtgaggacagcaggtgcgtccgaggacacggacatgtacaacaacagttagcctctacttcttatcacggtcgatcgattatctctttttcattgtgatgaaggaaatctcctgatattttttgcgttaacctggataaatttgggttggtgttagtttgctgggtccctgtttgtttaattggaatatatgttgcgagaacgtgcactcataaattcaccaatttaaattaanaaaaaaaaaaaa

SEQ ID NO: 2212 - DNA, 720 bp, Triticum aestivum
  Predicted polypeptide sequence is orthologous to G1084
atttaaaacagaggggggaagcagaactgagtatatacacataaaagtgttgttatagccctggtattaacaggcgcatgcaagcctgatgagtggcagtcttagagattacatgcaacagggtaacttgtaggtgctcaaaagcaagcgatggcagcattcatcatgtcataaagcacagctagacgcttgtagagtcggtcgccggcgttgacggaggcaagggagatgttgaacttggtccagatgtccctgatggcagccctggtcctctcaatggcgaacagctccgcactgttggcgtcctgaatcctcagttgcgcgaccttcttctcgtaggagcgcaaatgtgttccattttcatatctttggcttgactcattctttggacttctaatgattatacaaattcttggagaagcaagtgtactcgattgaacgtaccctgactttaggctctccttgtgcctctggaagagctggaatggctctgatgaagcttcgcaaatgccgacttgctcgttgccattgttatcctcaacaaattcttggagaatcaagtgtcctcgattgaacgtaccctgactttaggctctccttgtgcctctggaagagctggaatggctcaggcgaagcttcacaaacaccgacttgctcgtcattgtcgttatcctcaacatcccctctcggagcagctggtttaaccttaatttgaggcca

SEQ ID NO: 2213 - DNA, 700 bp, Triticum aestivum
  Predicted polypeptide sequence is orthologous to G1084
cgaaattcttgataaacttattatatttatacatcacgtgagaaagaaaataatattccatcacagacaacacacaacaattataataccatcgacagaagcatcttgctgcatggcaactaataagatacaacaatagaaattgcgcatgtgtaggccccaacggcggtggtgtgcctctgatgcctccgaccgtgtggtgactatgggagaagctcgctcacctcatccactatgcgcttcatcacccggtgcacgtcgccaatgactcgccacatccttgccagcatttggaggagtcgcagatgacaactaccctccgggacacgtctttgacaaaggcgacggtgatgttgagcttggtccggagattcctgatggtagccctggtcctctcgatggtgaacggctctgcaccgttggcatcctaggtcctcagttgcgtgcactttttctcatacagcagcggaacgcactccccttccttcgtcgggaggctcctgtagtgcaagcagtcatcgcagagcatatagagcactcccaactcctacaacaattactcagggtaaaccaaactccaaaaagttgtcctcacaataatccaaactcctcaacatgaaccaaagactaaatccaatttctaaatgtgagaacgatcattgtagcacatgcaaggaggcacaaaaattgatcttcctcc

SEQ ID NO: 2214 - DNA, 574 bp, Triticum aestivum
  Predicted polypeptide sequence is orthologous to G1084
cggcacgaggcctagtatgatttgtcagagcgacatctaccctccctgccacaaatgattgatccttttaaccagattcagaatccgaactttcgtttcattaaaaaagaaaaccgaggttggtcatccatgatgcatttatagatccatttgatgatgaatcccatcccatcttgaatacccctcccttcatttcaaagccaagttatgaactggaatgcatttgcaagcagaggagcgtgtccggctgttgtcgtacgagaagaagctagtgtgtgcagctgaggacccaggatgctaacggtgtagagtcgttcaccatcgagaggaccagggcttccatcatggtcctccggaccaagctcaacatatctgccgccttcatcgacaacttgtcctggaggatcattgccgtctgcaacgactcacctgaatgtacgcctgtgatggcattttagtttcttccccacgtgatgcatcaatacaataagtttatcaagaattgcatgaatgtgctatccagatccaaaaagaaaatgaaggtgtcgttccccaaaaaaaaaaaaaaaaaaaa

SEQ ID NO: 2215 - DNA, 670 bp, Triticum aestivum
  misc_feature (26)..(26): n is a, c, g, or t
  misc_feature (35)..(35): n is a, c, g, or t
  misc_feature (49)..(49): n is a, c, g, or t
  misc_feature (55)..(55): n is a, c, g, or t
  Predicted polypeptide sequence is orthologous to G1108
catttgcattgtcaaggagtgtgtgncagcgagangagctgtaacttcnccaagnttaaaaaaaaggacaaaaaaaaccttgggacaccatcgctacaatccatagatcaaaagcatcaactttatacatgcagaccggcaccgcgagcaaactatatgcttatgtatcacctcggaagatggaaggcagaccaatctaatgcatttcgatctcctgcgtcggtactgtatggtcgatgtggcgagtatcagatgtgccagatgagcttgctatctcggctttgcacagagggcatagtgcatttatcttgagccatttgtcgacacattccttgtggaagcagtgtgtgcagggaagttcacgaagctcttcgttgtgtgcatacttggcaaggcagatgcagcaaacagcatcttcagcagaaagcgatcgctccttgtcagtccctgcagccactatacctccctcttggccttcggcttcattacctgaaccatggcggcgtttcttggttttgaatttataagttggcaaagtattgatggattcccgaagtggcccctcttgtattgtttgtgtcttctctgaagcccatgacggatataatgcaggggagacaacagcatatcattgcacagaggatgaaaggcatggcatacccaatacagc

SEQ ID NO: 2216 - DNA, 731 bp, Triticum aestivum
  Predicted polypeptide sequence is orthologous to G1108
catgctccaaccctgtttctggtgaatgccacatttgacaaatactgagtataatcactagctaagcaggtgtgagtatttacaatatatacgagacaattccgccagaatgggagaaatggacttgcgtcctacttatagcgtgttccatccatcctcatgcccatgctcatgggacgaagcagaagaacagctaccgctgtgactcgacgtcgcctctttccctgttttcattctgttggtgttggccctcggggccagcctcggaagacgccgccgttgagccgcccagctcggacttgcaaagagggcacagcgcgttgatcttgagccacttgtcgatgcactccatgtggaagacgtgcccgcagggaagctctcgcagatcttcgttgtttgagaaccttgataaacagatgcagcaaacggcgtcttccgcggagatagtccgctccttgtcggtcccagatgccagaaccccgccattgtcttcccccacttctcctccatcgcggatcctcatcgacttgtacttgtacgccaccagcgtgttgattacttccgcggtagcgcctttgttcatatccagatcctcgtggaagcctaccatggagattatgcagggcaggcaacagcatatcatcgtgcacaggatgaatggcagtgcatagccgatgaagccgaatgcaaggaacactatacacagcctgtacaagttaggagcgtcatgg

SEQ ID NO: 2217 - DNA, 1101 bp, Triticum aestivum
  Predicted polypeptide sequence is orthologous to G1108
acgcgtcccgaggaggaggaggactgaggaggaagacgaattcgactccgagttttgaatttggccatttggcccaatcttgccgtccggcgatttttctttggatttctttggtgaaaccctcggcggatggtcgcttgggagccaggcatttgattcgatcttaagtggtccaggcgattggaggagcagctggctgctgctgttcccggggagtggattttcttgaggtgcagtgaatctctcctgctgtcataggttaaaaaaaacaattcaaattgcctggccttggatcaagtccattttcctatagagattgtctgtcttaagtcaaagcagctatatttctggcaaacacaacgagctagtttcatatgcagcgttcagttgatggctgctcatcctgttgaatcagaagcaagcagtgaaacagacaatcaccctttactgatagaccacatggaaaatactgctcatctcgagattgcaattgagagcccaagggatgatgttgcttcatcgtcaaccgctcgtcgggaggataatgatggcttggatcgattgcctcacatctcagaaagttcttcggagacaactactgcatctaactctcaaagtgctccctctagcagaagagatgctaatcgtgctcgtcgtcggcaaagtccgttgaattctagttgctggatctccattgagcttgttgtaacagttagccagattatagcggccatttgtgttctgtcattgtcaaggaagggacgtccgcattctccattatttgagtgggtcattggttatacggtaggttgtgttgctactcttcctcttctctactggcgctatctccatcgcaaccgcccaaacactgggcaagacccagcagtcagaactccctccgaacagcatacctgagtccatttctcacacacaaattcggccctggcatgtctgagctgttttgtaactgaccaaatggagttcccaaaacacgtgttaccaaaatttagggcccagcttttgcgatcactcaggatgcccctgactttttttccccgttgttgttttggggaagtttggatttgggggcattccctgccc

SEQ ID NO: 2218 - DNA, 938 bp, Triticum aestivum
  Predicted polypeptide sequence is orthologous to G1108
ggtgccccaccgcaggctggaccggtcctgacttcccgggatatcgtcgacccacgcgtccgtgtgtgcagcgatatgctgctgtttcccatgcttaatttccgttttgcgcctccaagaggatttgggtcaaagtagaggagcggctcaagagctaattgatgcattgccaacctacaaatttaaaccaaaacgaagcaaaaactgggtgcttgatcatgcttcgagctccgagaatcttagtgagggtggcatcctgggcccaggaactaaaaaggaaagggctgtttcttcttaagatgctgtttgctgcctctgcctaactacatactgatatgccccccacctccgcgagggggcgtggcaacaatatgcaatcatgcgcaatgatgcccgacaaaagcctcaacacaaatgcacccatgcgccacccctgccgctaccgcacactaacacgcgcggcgactcatccaacccactagcacaaaccccgcaaagccaacccgcccacacaccaaacgccccgccaacacaaccaacaccacccatcaataccaaccaaacccaagcaatacaccaccccccatgcccttatcgcccccgaatccacccaccacacccacttctcgaccaccggaccgaccaccccccagccaatccacctatcgaacgataattgctctcacacacaaccaaatccaaacgatcccccgactcgccctcccctccctcccactactaacacaggatcgcactcaacctaaccatccgaccacgccagctaagactcctagacgaacactcaccaccaccccccatcgcagaccccgacccccgcatgtcgatgagggcaacgtcaaccacgaagcacgcagtatacgtccatcacaacacgagagacgcacgatcaactctactgaacgcctgcgctcacgccc

SEQ ID NO: 2219 - DNA, 901 bp, Triticum aestivum
  misc_feature (679)..(679): n is a, c, g, or t
  Predicted polypeptide sequence is orthologous to G1145
tgcggccgcgtccccgacctccttcttctcctctgccgcggcctccttcccccgcatcgcgcccgtcgacgccggccccgcgcgccgcgcgctggagcgcgagatgtgctacggccacggcgccgccgcctggcccggggcccccggcgctggcgggggcgccgccgcgcccgtggaccggcgcaagaagcgcatgatcaagaaccgcgagtcggcgtcccgctcgcgcgcgcgcaagcaggcccacgtcacccagatcgagtcggaggtgcaccagctgcgcgaggagaacgagcagctccgcctcaagtacgaccagctcaaggcttcggtggaggtgtcggtgccggtgaggaagacgctgcagagggtgctctcggcgcccttctgatccttcttccttcccgaggggccgagatcgaagcaagcagctgctccagccaccaccgtcactactactactcacatagctagagtgttgcagtagctagcacttactagtaactattaccagctactactacggtgatcatccatcatcgtccctgtaaatccatatggatgttattgtgttcctacttttccttctatcactaggccggccggggttgtctcaatcttattggtcactcaactaaactagaagtggcaatgcgcgaggaaagggaaaaagactcancagcttaatttgtacagcggcagctgctaccagtagtagaactcctaataataatacccggtgtggattagccaggcagcacctggttcttgttttggtgacttggattaatgaattatggggcacttaattacggtaggtctatggctatttggtatacggtggagtacccggaaaaaaaggggggccgtccaatctcccttaagagtggtaaaattatga

SEQ ID NO: 2220 - DNA, 650 bp, Triticum aestivum
  Predicted polypeptide sequence is orthologous to G1145
aattcggcacgaggtgagcctcagcggcttcagctccctcccctccatctccagcactgcccatccgcctgcccgcctgccctccctctccctcagcatcggcaacggtagtgccgacggagaggatcagcagctgggcgtcagcagcgacgacggccacaagagcattcgggcgatgaagaacagggagtcggcgctgcggtccagggccaggaagagggcctacacgcaggagctcgagaaggaggtccgccggctcgtcgaggacaacctcaaactcaagagacagtgcaaactgcttcagtcggagattgctgcactcaccgcccagcaggcaagcaacaagcagagcagcccacacaggagaacctcgtccactcagttctagcaaccgctacatcagggctgcattttcctctagcaagcaattcattagtattagcagtgcacttgtagttggttcttggcctcaatcaactcagctgcccgatcgatatgccagcgcgtggtccgtttatctcatgtgcatttatctgcatgtattgctgtgtgcactagtcagactggatgcctggaccagagcacatgcaacctgcctgcgattaattgtgttgcagagcacctttattaataatgctgaatcgtaatcc

SEQ ID NO: 2221 - DNA, 774 bp, Triticum aestivum
  Predicted polypeptide sequence is orthologous to G1145
gcagaaaagatccaacgcatatataggtttagatcgatcttgtacataggtatacatatgaactgtagacgaaatgtgcacaggtttgattaattttctcctaaatttgtactgccaaaatacgcctgtgctcagcgtcttgggccgtctgatcccctttcagaactgagtggatgaggttcgccggagagagctcttggtaggcaggatgagggcggccacttcccgcttcagctctttgcactgcttcttcagcttgaggttgtcatccaccaggcgccgaacctccttctccagttcctccacatatgccctcttcctggcccttgagcgcagcgcggactccctgttccgcatcatccggatggtcctcgggtcctcgccgctgctgccaccgccctgccgcagctccatgtcgacctcatagccgccaggaaacccgccaaacgagaccggcgtggacggcagcgagcgcgcgccggcgaggaggtggaggtcggtgtcgtcgtcccgcaggccggagatggagaagagggagctgcacccactcatgaggctcagctgcgggctctccggctccctccatgccgcagccgctgctgccgccatctcgtagtgcccgttgccaccgccgccgagccggtagttcgccatgggagccggaactcaagacacctcgattgatcgagctgatcgagcaatcgatctaccagtggtgctgcttttttgtgctgcgtgggtgctgggttaagctaaactaagatgctttggtcg

SEQ ID NO: 2222 - DNA, 554 bp, Triticum aestivum
  Predicted polypeptide sequence is orthologous to G1145
ccacgcgtccgcccgtctactgtctacaccacaccacagtgcgcacaccacacgggggaagcggggcgtagatagggatgtcgtgggaggagcccggcatcccgcagctgagcctgagcggcttcagctccctcgcctccatctccagcaccgccgctccgcccgcccgcctgccctccctctccctcagcatcggcaccggcggggaggaccagcagccgggcgtcagcagcgacgacggccacaagagcgtccgggcgatgaagaaccgggagtcggcgctgcggtccagggccaggaagagagcctacacgcaggagctcgagaaggaggtccgccggctcgtcgaggacaacctcaagctcaagcgacagtgcaaacaggcacgccttcttctccccttcttcttcttcctccagctccatctctctttcttgcttgcttgcttgcttgcttgtgcatgggtaattagttaactcatcaatcccccgcttctttctccatctcctcagcttcagtcggagatgccgcgctcacgcccagcaggcaagcag

SEQ ID NO: 2223 - DNA, 1197 bp, Triticum aestivum
  misc_feature (849)..(849): n is a, c, g, or t
  misc_feature (891)..(891): n is a, c, g, or t
  misc_feature (893)..(893): n is a, c, g, or t
  misc_feature (924)..(925): n is a, c, g, or t
  Predicted polypeptide sequence is orthologous to G1145
aaggcatgcatccaacgcgttgggagctctcccatatggtcgacctgcaggcggccgcactagtgattcgagcggccgcccgggcaggtgttttttttttttttgaaagcagatacagggttcattgaatttaccatgcggctacagaggttacagcagcgaaaacttacagcaagtattagcaagaaacttcgcagtacgatccatacactgggatccgtgccgcaagaatatttgcaacaaccagatttacaaaacctgaaacctaagggccgggaggacatttcacaagattgttgggtgtcctaggcctttacaaattacaagcaaagcaaactgcacacactccatagatacatgcgaggagaaagcaaaagagcgatcaaaatctaccagaagcctgtactctacacacaatcagaatgaggtcgatctcgttctccgaagatgccttttcggttctggagggggcgcggacttcaataacatgtccaactccttctctctcttcagcctcttgttctcctcttccagacaagacagtttgcattcgagctcgtttgtgtaggcctgtttcctagctcttgaacgtgcagccgattctcggttcttgatcatcctcttctgcctccgatcagcaaccttgtataccacatcctgggaagacattctcttacgactaggactttgaagatcagaaagttctagagatgacgaaatactcatttgacgatctgggtagatggaatccattgtcgaagggattgcaacactcaacggttgcgcaaccgactgacgtacaatatacgcatcaattgcacttgttccctgtgggaaatcctgcactcntggtcatcaatgagcactttctcccagtccctacagatcaantnactcctcagcatccttctgatactgcccagnntacatgcagcccttgcagaaactctcagtgtatctccccaacgactctgtgatcacaactgaaactctttccatcatcctactctctcttcctgctgatgtcttccaaattcatcactgtcttctgctcatggcggggcacagtatgctgtgccctgagttcaaaccaaagctgacgtgcttgactgctgattccaggcccattgggtatggagggtctttcaattggaggaggtccttaattgggaaaggttccttaaaagatttaggtca

SEQ ID NO: 2224 - DNA, 1071 bp, Triticum aestivum
  Predicted polypeptide sequence is orthologous to G1145
ctggcttttttttttttttttttttttttttttcttttgcgactttcaaattctcaccgggatctcagcaaaaacagaggtatcggcggacatacgctctgtctggcaaaaacagcaacgaaaagacactttctttgggcatggccacatacatgaccaccatatgatgagatagagacagacataacttaccatgtacaaaggagctctgataaaattaaaacataacctggcagatttacacacattgacaaactctgaaccaccggggtgggacatgctaagggctgctactcatctacaaactctgaaccaccgggctgggacaagctaccaactgcccctcaggctactatcgacgtcaaacaggggcagaacttgttctccggagttgatacttgggttctgggggaggcgcggaggttatcatcatgtccaactccttctgcttcttcaacctctcgttctcctcttctagacgagacaccttgttttcaagctcattagtgtaagcctgcttcctcgctctggagcgtgcagctgattccctgttttttatcattctcttctgccttctttctacaactttatcagttacaccatctgatgcaccacgcttgcgcctaggtgtctgaggatcaaaaagtgcatcgagcatgggtgacgtaatctggccatccgggtaaattggttccatgatagcacctgtagcaacagaaactggctgaagacccaaatgacttgccatgaaagggcctgccatgcttggattctggggcctccaggtactgctgtaaccaatgcgcccccgggtttaaaacggggcgcaggggccgttaccttgctcccaaccgcacccatgttagcgggcaagtcaatcggatcctttcaaatgccctttagacaaaaccccacgcttcccccagaaatccccaagtgtctattcccccaagggtgggtggcttcccggccttcccggaatacctccctaacaatttttttcggggaaatttggtgcccttcacaccctggccaaccgtttttggtaaaatcaggagcctttgtgagtcc

SEQ ID NO: 2225 - DNA, 1083 bp, Triticum aestivum
  misc_feature (23)..(23): n is a, c, g, or t
  Predicted polypeptide sequence is orthologous to G1145
acccagtcgtctcggtggtgctnccgccgtcgcctcctcctcccttccccaatggtaggcgccagactgagccagctctgaccgccgcgcggggccttgatccggcgccaggcggtcgggaatcgcgcgggtgccccgttcaattcgacgcggactccagctgggaggtcggagcggcggagatccggtcgccggacttgcctccaatccgctggtcgccgtcgttcccggaagaaaaatcgaggaggttcgttcgccggcgcgtgctgtgcgcggtctcgtggatctgcggctcggcgacttgtgaccgggtctttgccggtggaaagggggctgctttgggcatcgttgttcccgaggtgtttgtccccataggggcgaccagttcaagagagcgccggttcatgattcaggcaatggcgtcgcaatcgcaggcaggaggcggcggtggcggcggctatgctggcccggggcagcgcgggcaggcgcagggcctggcgaggcaaggttccctgtacagccttaccctcgatgaggtgcagagccagctgacagagcctttgcttagtatgaacctcgacgagctgctcaagagcgtgtttccggacggcgtggatcctgtcggtggcgtcgctggccagtctgagccggccccgggcctgcatcgccaggggagcatcacaatgcctcctgagctgagcaagaagacggtggacgaggtgtggaagggcatccaagattcgccgaagagaagtggtgaggagggtattcggtggaggcgggagaggcagccgacctttggggagatgacacttgaggatttcctggtgaaagctggagtggtcgctgaagggcatttgaaggatccgattgacttgccagctaacatgggtgcggttgggagcagtgtaacggccgctgcgcccagtttgaaccccggagcgcattggttacgcagtccctgaagccccgcattcagcatggaaggcctttcagggaaagtcttgggtcctcaccatgtctgtgcaaaggtgctacatgggacaaattcccggatgccgattactcccaaggtcggtgcca

SEQ ID NO: 2226 - DNA, 539 bp, Triticum aestivum
  Predicted polypeptide sequence is orthologous to G1146
gtacattcatgagccacatcacaagttcccagcaaatgtaccaccaaatcagcaaatgtaccgcctaattaagcagcaagccaacaaaacacacgactcccatgaacttgtcaatgggccgattcaacaatagaacatcacgtccttgacgttatccctgatcctggggaggcgacggtatgtcccaggaggaccagcagctcctgcgccggtggcagctgactcccgggtgccaccgctgacgatcgaggcgctgtccgagccctccgatggctcgtcgtaataccgtgcgcggaacgcagccaggtgagcgtagtaggcaggaggaacaacagagacagagcgagtacatcgagcgtatgtgtagcacaggttgttggtgagcagctgcagcccatcggcagtgaaacggttttcatcgaagaggacatggtagtgagttggtctgcttgtgccctgaatcccggcatggctacacaggtagaaatcaaactcggtgggatggcatatgttggtgtcgaccacggttccaggaagga

SEQ ID NO: 2227 - DNA, 614 bp, Triticum aestivum
  misc_feature (7)..(7): n is a, c, g, or t
  misc_feature (48)..(48): n is a, c, g, or t
  Predicted polypeptide sequence is orthologous to G1146
tgcaggnaattcggcacgaggcacattatcatgttctgtgggacgagnaacaatttcacggcggacgaaatgcagacattgacaaacaacctttgctacacgtatgcgcgttgcacacggtctgtttctgtcggtaatttcttcttccttctcgcgcccctgctgaatacattttcctctttcgacgtaacaatggtgacaaatctgaagtttggcctttggtctgttgtgttgtttgagcagtgccgcctgtttactatgctcatctagccgcattccgggcacgtttctacatggaccaagatagcctctcggtgaagaatgccaaccggacgaatggaagtgccatgaagactatgccagcggtgaaagagagggtgaagagggtgatgttctactgctgacaggcactcggacatgctatatagctaacactaggaattagaggtttatattagattttagatatgtaggacgggaagagtgaagaactaggtatcttgtcctatataaacttggactatgttttgttaagattgggcacaacatcctccgtaatatagctaatagattggcaatgtcagtccggaaaatgtgcacacataaaaaaaaaa

SEQ ID NO: 2228 - DNA, 711 bp, Triticum aestivum
  misc_feature (17)..(18): n is a, c, g, or t
  misc_feature (684)..(684): n is a, c, g, or t
  Predicted polypeptide sequence is orthologous to G1146
tgtactctctctgatcnntattgattatcgcagattaatgtagtacaatggataggagggagtaattaggatctactcagaaacatgattagtattaaactaaagctcaagctcaatgtaaattgttctgggctcctattcacccatatcaacactttcaaaactgctttagcagaaaaacataacacctttcacattttcactgagaacgggaaaggatccctcatgccctcgtttgatataaagtcgtccccgcgaagccaaaagatgtgcatagtagacaggaggcacaactgaaacagaagaggtgcatctcgcatacgtgtagcataggtggtttgtgagcgtttgcaaagcgttagccgtaaacttgttttcatcccacagaacatgataacgcacaggtcggctcactcccttagtgacagcatggctacacaaataaaaatcaaagtcagtgggatggcatacttctttatcaatcactgtaccaggcagtacatttccacttccataaattgtactcacaacatcatagttatcagaaaacagacgggtatgatgacgtttctgaacgacaacaaaggtaactcgtgggcttttttatggcagaaagttcaacatccaaaacctgattaagctgtccattgctgacaccatccctgtaaaatatgattcttccangtatgcattcagttgcccttctgaaag

SEQ ID NO: 2229 - DNA, 334 bp, Triticum aestivum
  Predicted polypeptide sequence is orthologous to G1146
ttttttttttaaacgcaaggcgtggcttgaatgctctggttttcaagctccaaacctcaaaagtactcgaggttcaacgtttacagcatgacaaagtacacacatagatggtacttaagcaagcatagaccagcatagtagggcgcactgcgacagccgctggcaaattattactactttcttcacataattacaatgacaaggggcgacatgctgacttaaggagcattttaatctccgccttcacgggcttcaacagtaaaacatgacgttcttcacattgtccttgagggctggaaggggcttaacagctgcaccgccgggggcccgggta

SEQ ID NO: 2230 - DNA, 630 bp, Triticum aestivum
  Predicted polypeptide sequence is orthologous to G1146
caattattgaagggcagaggytcaccaggaagcttaacgagaaacaagtgactggcatacygagagcyacgtgcgaacgyccccgtgatagggagaagagcayacttaagayggtggagcacaacaacyattcagctgataagctggcacaggagtttggaatcgatgttacggataaaatggtcaatgtgcaggctcgcgtgctacctccccccatgctcaaatatcatgaatctggaaaggacaaagcttgtgcaccaagtgttggccagtggaacatgattggcaagaaaatgataaatggagggaatgttcagagatggacttgcttgaacttyycacgtttgcayattgatggagtcaaaaggttttgtggcgacttagtcaaaatgtgcacgccatcggcatggttttcaatcctatgccagtggtagaaattctctcagcgtctgccaataacatagaaggtgctttgaagcatgctcaccagagtgcccataacctccagttgcttattgtgattctcccggatgttactggccattacgggaaagttaagaaggtgtgcgagactgaccttggtatagtatctcaatgtctcaagccagacaaggtcgaaagagcacacaa

SEQ ID NO: 2231 - DNA, 584 bp, Triticum aestivum
  Predicted polypeptide sequence is orthologous to G1146
ccacgcgtccgcgctgccgacaaatttccttatcccgtctgccgttccttcacctcgatccccttctctggtccttttctcatctgatccgcttcgcctctactgcttcgcctctcctcgtctccgtgtgattcgccatcaccacctcgccgcttccctactggttgtgacggcggcgctcgctggatggcatggtggaggtggtagagggtggcggaggcggagcagtcgaggtcctcggcgtcgcgcgtgtggtggggcagaaagtggaaggggaagaatgacgccatccagagaaggaggcataggatctaaaagatcgagcctgcccctcacgcaagctcaagaaggagttttccgggtgtgtggatgatagtttgttcagcagcatggaccatgccatgaaattggtgacggcaagactcccagactcatatgacaaaaaggaaggagttacaggagatggaaccactggtggggcggtagaatttttttctgttgagggcgatagtgtgtaagagcaacctttcctttttaagataatgtgtggacatgtatttacttttttggggtgtgtgctccag

SEQ ID NO: 2232 - DNA, 635 bp, Triticum aestivum
  misc_feature (389)..(389): n is a, c, g, or t
  misc_feature (405)..(405): n is a, c, g, or t
  misc_feature (410)..(410): n is a, c, g, or t
  misc_feature (435)..(435): n is a, c, g, or t
  misc_feature (467)..(467): n is a, c, g, or t
  misc_feature (469)..(469): n is a, c, g, or t
  misc_feature (487)..(487): n is a, c, g, or t
  misc_feature (537)..(537): n is a, c, g, or t
  misc_feature (567)..(568): n is a, c, g, or t
  misc_feature (571)..(571): n is a, c, g, or t
  misc_feature (580)..(580): n is a, c, g, or t
  misc_feature (589)..(589): n is a, c, g, or t
  misc_feature (621)..(621): n is a, c, g, or t
  misc_feature (635)..(635): n is a, c, g, or t
  Predicted polypeptide sequence is orthologous to G1146
ttttttttttttttttttgacccttaaaagtactcaaaattcaatgtttatacagcatataaagtacacacatagatggtacttaagcaagcatagaccagcatagtacggcgcacgagacagcggctggcggattattactaccctcttcacataattacaatgacaagaggcgacacgccgacttaaggacatattaagctcggccttcatgggcttcagcagtagaacatgacgttcttcacattgtccttcagggctggaagaggcttaacagctgcaccgccgggggcccgagtaccacgtgacgccgacgagccggacgtcggtccacgcccaccgggcccacttgccatagagccgctgtcggagctctctggctccatgtngaaacgggcgcggaangcggncagatgagcatagtatgcaggtggnacaatcgacactgaccgagtgcactcgcgtangngtacagaggttgttggtnagactctgcaaccatcactgtgactttttcgtccacaagactgataagancggacggtggtcctgatcagatatgacaanngantcaataccngatacagtntctgtcaaacgtctggatatttcacccgtcanggtctacatggatn

SEQ ID NO: 2233 - DNA, 629 bp, Triticum aestivum
  misc_feature (315)..(315): n is a, c, g, or t
  misc_feature (319)..(319): n is a, c, g, or t
  misc_feature (333)..(333): n is a, c, g, or t
  misc_feature (350)..(350): n is a, c, g, or t
  misc_feature (353)..(353): n is a, c, g, or t
  misc_feature (360)..(360): n is a, c, g, or t
  misc_feature (382)..(383): n is a, c, g, or t
  misc_feature (393)..(393): n is a, c, g, or t
  misc_feature (411)..(411): n is a, c, g, or t
  misc_feature (425)..(425): n is a, c, g, or t
  misc_feature (457)..(457): n is a, c, g, or t
  misc_feature (463)..(463): n is a, c, g, or t
  misc_feature (467)..(467): n is a, c, g, or t
  misc_feature (484)..(484): n is a, c, g, or t
  misc_feature (515)..(515): n is a, c, g, or t
  misc_feature (518)..(518): n is a, c, g, or t
  misc_feature (521)..(521): n is a, c, g, or t
  misc_feature (526)..(526): n is a, c, g, or t
  misc_feature (542)..(542): n is a, c, g, or t
  misc_feature (557)..(557): n is a, c, g, or t
  misc_feature (563)..(563): n is a, c, g, or t
  misc_feature (572)..(572): n is a, c, g, or t
  misc_feature (580)..(580): n is a, c, g, or t
  misc_feature (583)..(583): n is a, c, g, or t
  misc_feature (586)..(586): n is a, c, g, or t
  misc_feature (596)..(596): n is a, c, g, or t
  misc_feature (600)..(600): n is a, c, g, or t
  misc_feature (615)..(615): n is a, c, g, or t
  misc_feature (618)..(619): n is a, c, g, or t
  Predicted polypeptide sequence is orthologous to G1146
ccgtcttcctctctccctcctcctggtccactctttcccgagatacgtacgagcccaggacagccatgaagttcttcggttcctccacgtccaagaaggagaacaaggggaagaagagatccaaaaggagcggcaacggcggctccttcgcctcgaccgcgtcgtccgtcggcatcagatgaccagtctgttacaacgctgagatccgtcctgccgtcgtcttcgggggccggcggtaccgtccggtcccgggacgaccaaagaaaccggcctgggcgccgtgacgcggctggactggaggttggcgctgcgtanatcntgtcgaccgaggangactggccgcgatgtcnccnaggggangccgctccccctttagggattnntggcgccgangcgcggacaaggcaactnaaggacaatttccngtgtttgaccttacgggacgaagtttccgccnaaggancctncctgttggctcctggcnacaacggtgtcgttgagaatgcgcccatatnggnggngtcanacgacgggacggttcncgcttacagttaccnatatangcttccctnatattatnaantgnctacaattanaaanccacactttctatanagnnaatagttttt

SEQ ID NO: 2234 - DNA, 2511 bp, Triticum aestivum
  Predicted polypeptide sequence is orthologous to G1146
gcacgaggctagacatccggatgagttaaaacgagaccctaacaagtggatgattgacatcgagtactatttgtcacagcagattcatcctgtcgtttctcgtctgtgtgcttcaattgagggtactagccctgcccgactggctgaatgtcttggacttgactcatcaaagttccaatcaagatcaattgggtctagcaatgaggatacgtctaccatgctcttatctgtaattgatgatgaagatgagagatatcgtggctgtgagccactgcgtttatcatgcccaagctgtaccaataccttcgagtgcccccctgtgtccagtctgattgctagtttatcagatccaaatgaaggaaaagatgctactgtgaatttctggcgtcggatgcggtgcccaagatgtccagatgatactgatgagtgcagagtttctcctgctgtgcttgccaaccagataaaaagacaggctgataatttcatcaatcggtattacaaaggtttactgatgtgcgatgacgagggttgcaaatattcaactcacattgtgaaccttagagtgatgggggattctgagagaggaaccatctgcccgaactatccacaatgcaacggccgtctagtaagacagtacacagaggcagatctatacaggcaattgtcctacttttgctatgtacttgatgcaacccggtgtcttgataagttggaccagaagatgcggcttccttttgagaaagagtttgcagtattaaaccaaacaataagctccgcatttctggagattcagaaaatccgagacagatgtgctttcggatgggttcaattgacagatctagcagtgtcaatctgatgagctactgtttgccgtaatctcaagcagtgctgatctgagcatgggccgtgggatattgtgttgttgaaactagatctgttgttgaaggtgaaaggaactggaaaccagatgatggccttggccactagctgctgacgggtttcctggcctgcaaaggatggagttgcccacatcatgttgcatttaaatacaaatgttctaaccagttgtttcagagaccctccttggtgccatccctaattttcgaagtgtatattgtactactgttgtaaatatgttgcatccatcagtcccatggttttgtagtgacatactttgaatactaaatttgtcatcagtcagtttttatcatcttaaaattatcacaatccagatgcttaaaaaaaaaaaaaaagaaatactgtacttgttgatgctttgtcaaggagaattccccttgttagtgacagaccaaccattatatttggtgctgatgttacccatcctcatcctggagaagattctagcccttccatcgcagctgttgttgcttctcaagattggcctgaggtcaccaaatatgctggattggtgagtgcacaaacccgtcgtcaggagttgatacaagatctttttaaagtatggcaagatcctcagagagggactgtaaatggtggaatggttagagaacttctcctttcctttcatagatcaactggacagaaaccccaaaggatcatattctatagggatggtgttagcgaaggacagttctatcaggttctgttgtatgagcttgatgcgattagaaaggcgtgcgcatccttggagtccaattatcagccacccgttacctttgtggtggtccagaagcgccatcatacacggctatttgctaataaccacaacgatcagcgaagtgttgatccaaaaagtggaaacatactgcctggtaccgtggttgattcaaagatatgccatcctaccgagtttgatttctacctttgtagccatgctggtattcagggaacaagccgccctgcgcattaccatgtcctttgggatgagaacaattttaccgcggatggtttgcagactctcacgaacaacttgtgctacacctacgcaaggtgcacccgttctgtatcgattgtgcctccggcatactatgctcacctcgccgcttttcgagctcggttctacatggaaccggatacctccgacggtggctcggtcgcgagcggtgccacgacaagccgtgcccctgctggtgcacgctgcggtagagctgcagggaatgctgctgttaagcctctgcctgacctcaaggaaaacgtgaaacgtgtcatgttttactgctgagtttaggatcccaactgaattacatgttgatttgccaatcctttctttgcggcagaaaagcaatcctcattcatcacatgagtgtatcagtgctgccatgtttcctgtgcaacctgaacatctcaattcctcttcgccccctacagattttcaaatgacattgccctgtttgtcttgaccacattattggcctgcacattcaaacatccgtccagatttgtaactttggaggttccatgtaatgctacgacgaagaccctatataatatttccccacctttttttttaaaaaaaaaaaaaaaaaaaaccac

SEQ ID NO: 2235 - DNA, 791 bp, Triticum aestivum
  Predicted polypeptide sequence is orthologous to G1146
ctcgtgccgaattcggcacgagaacttcctcaaatacgcaacgcatgccgcctgaaatatcctgcaaccgacaccaaacgagggctccccaggatcacaattgttgtctgtggtaaacgccaccacactcgattctaccctaaaaacagcggtgacgctgataaatcatcgaatttgatggctggaactgttgtcgatcgtggcgttacagagactcgaaactgggacttttacctacaagcccatgcatgtcttcagggaacagcccgtgcctgtcattactatgtgataatagacgaaattttccggtccaataaggttaagggtggtcacaaaaatcacgctgatgcccttgaggaattgacaaacaatatgagtcatctgtttggacgagcaacaaaagccgtcagtctttgtcctcctgcttactatgctgatttactctgcacaagggtacgctgctacttatctgaagttttcgacccaagtgaggcccagagtgtgatgagtggcggcaccaaccaaacgatcgaggacattgttattccgccgagtatgagggattccatgtactacatctaagctcattgcatgagaatgagaatcattaaaccataaccttcggtgttagttacagaattagctgtgtcaagtcattatagacgaaataccatttctgtattgtagactttgcgttccgaaatattttatgcacacgcaaatgtatagccaaaaaaaaaaaaaaaaaaaaaaaaaaaaaaaaaaaaaaaaaaaaaaaaaaaaaaaaaaaa

SEQ ID NO: 2236 - DNA, 690 bp, Triticum aestivum
  Predicted polypeptide sequence is orthologous to G1146
ccacgcgtccggtaacgttcctccaggtccaccaagaacagttcccgagctgcaccaagccccgtatgtccaatatcaagccccggtggtttcaccatccgcatcaggagctggctcatcctctcagcctgtgtcagaggtgagcagtggacaagtccagcaacagtttcagaaacttgcgattgttgatcaaagttcaacaagccaatccagtcaactggcaccagcatcaagcaaatcagttagatttccattgcgccctggaaagggtacacatggagataggtgtgtcgtgaaggcaaaccatttctttgctgagctccctgataaagaccttcaccaatatgatgtctccataactccagagattacatcacgtggtgtcaatcgtgctgtgatggcagaacttgttaggctctatagacattctcaattggatggacgcctacctgcgtatgatggaaggaagagcctatatacagctgggccattgccatttccttcaaagacatttgaaattactctgcatgacgaaaaagaaagccttgttggtggtcaagtcgcaccaaggcgtgagagacaattcaggttggtgatcaaatttgctgctcgtgctgatctccaccatttggatatgttcctaaatggaaggcaaactgatgaaactcaagaaactcttcaggtgcttga

SEQ ID NO: 2237 - DNA, 706 bp, Triticum aestivum
  Predicted polypeptide sequence is orthologous to G1146
agatcccaacatgatcatatagactttcaaactaacaggtagaagtccttcccaaaccagaaatgatttcaggggtagttcaaatacgaccacagataggtagatggttacacagagtttcacacggtacaacaatgaaagtttgcatggcggtgttctcccagcgccaccaatgcagtgcaaatacttttaacacacccaaactcagtcgaatatcttcaggtttgcatattagggtgaacaataaccaccacgaccttaacagtaaaacatgacccgcttcacgttttccttcagggcggggaggggcctgacagcaacattcccaaacggcctggtattgcgtccaccctgtggagggccacgggcaccgcttgccatggacccactgtcagaggtatccggctccatgtaaaacctagcccggaaggctgccaaatgtgcataatatgctggaggcacaattgatacagagcgggtgcacctagcatacgtgtaccacaagttgtttgttagagtttgcaactcatcagcagtgaatttgttctcgtcccatagaacgtgataatgagcaggacggttagttccctgaatgccagcgtggctacacaagtagaaatcgaactcagtcggatggtaaatctttgaatcaacaaccgtgccaggcattatgtttccacttctatcaacagtacgctgatcattg

SEQ ID NO: 2238 - DNA, 1152 bp, Triticum aestivum
  misc_feature (859)..(859): n is a, c, g, or t
  misc_feature (882)..(882): n is a, c, g, or t
  Predicted polypeptide sequence is orthologous to G1146
agctccaacgcttcccgagctctagcaatggtcgacctgcaggcggccgcactagtgattaagcgtggtcgcggccgaggttttcctttttttttttttttttttttttaatttattcaagcataacaaaaaaaactaatatccagcacatttcagaaacacgttgaaaaaatggcacatgataattgttgtggctaattcaaaacagaaatggatacatttgaaatggaacttcaattttcaaatgtaaatacaatttttcaaattaaaacaagtacgtttagacaaagctcggcaataatttttcatttcttcaactccaccacaaccacttgaaggccctgcgctttagcagaagaacatgccacgttttttcacattgtccttgatatcaggtagaggattgatgaatggtttacaggatatatcgatatttaatgaaattcccatctgtgtgttttgtattgtctgataaaaaccacagcagtttttcaagccctcgtcaggttgagatttataaaatgaccggccaactaggcaataccttccaaggaacaattcatgtagaatagtattaaatgcttgatagaattcttcaccatcaattcgtccgaacaaaactttatccaatgttatctggaccctaaaatgtctcttaccccttgggaggccacaaagaatattttcctggtcaggtagtgttactttaaaagcctcacaagtaaatggaaatggacgagatgtatataagcttttctttccatcatatgcaggaagacgaccacccaaacgtgattgcccatacagctttgcaagttgtatcatgacatcaccagctgaagtaggcttaggatctatnaatacatgatatcggcaaagagnttcattataagttagtttaaaatggttggccttcacatatagctttcaccagcagaaacgaatccagggcgcttttagcttcggcggggacaaattttggagttaaggattgaccatggactgtactgatggcccaaaactatctgcctcgggaccacattgaatgaacggttattcttctcacatgggacaaacctcgccacaacacacggtgatcgccccttccaccgctaccttccggaggaaaatcaaaacggtcgccaatttaca

SEQ ID NO: 2239 - DNA, 917 bp, Triticum aestivum
  misc_feature (14)..(14): n is a, c, g, or t
  Predicted polypeptide sequence is orthologous to G1146
aaccgccacttgantgatgacgccacgctattcggtggactactatagaatactcaagctatgcatccaacgcgttgggagctctcccatatggtcgacctgcaggcggccggactagtgattagcgtggtcgcggccgaggttgcggggcgtcaaagtcgaagttactcaccgggaaaatgtaaggcggaagtaccgcatttcgggggtgacagcacaaccaactcatgaactcatcttcccaatcgacgatcaaatgaatatgaagtctgtcgtagagtatttcaaggaaatgtatgggtttactattcagcaatcacatcttccttgccttatggttggcaaccaaaagaaggcaaactatctaccaatggaggtctgcaagattgttgagggtcagagatacacaaagaggttgaacgaaaagcagatcacatcactgctaaaggttacatgccaaaggcctagagaaaaggaaatggatattctacagacagttcatcaaaacggatatgaccaagatccttacgcaaaggaatttgggatcaacataagtgtgaagctaacatccgttggagcgcgcgtccttcctgcaccttggctgaaatatcatgatgctggaaaggaaaaggagtgcctgccacaggttggtcaatggaacatggtgaacaagaaagtgatcaacgggggcaaggtaagccactgggctttgtataacttctcgaggagtgttcaagaaacaactgcacgcggattctgcccagagttggcacaaatgtgtcaaatttcgggcatgggatttcacagtgaacctgtgctccaaatatattcagctagaccagatcaagtagcgaaggcactaaagcatgtgtataatgtagcactacacaaactcaggggtaaggacttgagcttct

SEQ ID NO: 2240 - DNA, 1049 bp, Triticum aestivum
  misc_feature (13)..(13): n is a, c, g, or t
  misc_feature (849)..(849): n is a, c, g, or t
  Predicted polypeptide sequence is orthologous to G1146
cgacccacgcttnccgctgggcctgtgtgatttttcacgcatgcgtcctgaggcggtacacaggttctgttgtgatctgattcagatgtgcaatatgactggaatgtctgtcaattcaaggccacttgtagacaaccgatcagcgagccccaaccacattgagaatgctttgagagatgtctacaggaggacaacggaaatgctttccaagcagggacacgaaaaacagctacaactgttaattgtaatcctacctgaaatcagtggttcttatgggaaaatcaagaaggtttgcgagactgaccttgggattgtgtctcagtgttacctgccaagatatgctgccagaccgaacaagcaatatctggagaatgttgcactcaaaatcaatgtgaaggtcggactgccaccttccattgagaaggcctttgctcgatttggtgttcctgctgttacaaaagtcccaacaatcatctttggtgctgatgttacacaccccccacctggagaggactccacatcatctattgctgtggtggtggcatcaatggactggccagagatcaccaagtacagaggtcttgtctctgctcaaccacacaggcaggagataatcgaagacctcttcagtgtcagcaaagatccgcagaggggcaatgtcaatggtggcatgatcagggagttactgattgccttccgctggaagacaggccggaggcctgagaggatactcttctacagggatagtgtgagtgaaggccagttgagcactgtacgttttcatgaaatgaatgcaatcaggaaggcctgtgctgctttggaggaggggtatatgcccaaattatatantatggctctgataaatgacactatactcatgctcggttgcaccggtggggtctctgttgtcccaccgggggtacaacgcggattttgcggaattccgtccgggctattagttggaaggggacagctcggacggcgggtaacccccaggaacagcaggaagaaggcgaacctgggagagggccctgtgaaggtgcaattaa

SEQ ID NO: 2241 - DNA, 709 bp, Triticum aestivum
  Predicted polypeptide sequence is orthologous to G1146
gatggagtgagtgaaggccagttctaccaagttctactgcatgagcttgatgccatcagaaaggcatgcgcatcgctggaagcaaactaccagccgctggttacgtttgtcgtggtccagaagcgccaccacacgaggctgtttgcgcacaaccacaatgaccagagcaccgtcgacaagagcggcaacatccttcccggcactgtgattgactccaagatctgccaccctacagagtttgatttcttcctgtgcagccatgccggcatcaagggcacgagccgccccgcgcattaccatgtcctgtgggatgagaacaacttcactgctgatggactgcagaccctcaccaacaacctttgctatacttacgctaggtgcacgcgctcggtgtctatcgtccctccagcatactacgctcacctggccgccttccgcgcccgcttctacatggagccggacagctccgacagcggctccatcttgagcgcgcgcaagtccggctcgtcgacgtcccgcagcacccgcgccgccggcgccggggtcgtcaggcccctccctgcgctcaaggacagcgtgaagaaggtcatgttctactgctgatgatgctccacaatctactgctgccctaataaaaaggctccacgcctgctcacctgcaccttaagtgatgaattcactgaaggtgttgttgcaccgatacttaagt

SEQ ID NO: 2242 - DNA, 881 bp, Triticum aestivum
  Predicted polypeptide sequence is orthologous to G1146
acgcttgaccttaggcctatttaggtgacactatagaacaagtttgtacaaaaaagcaggctggtaccggtccggaattcccgggatatcgtcgacccacgcgtccgctgggcatgtattaacttctctcggaatgttcaagataatgctgccaaggttttctgtcatgagttggctataatgtgccaaatatctggaatgaactttgcacctgaacctgtgctgcccgtacttagtgcgaggcctgaacacgtggaaagagcactgaaggcacgttatcatgatgccatgaacgcaagcaaacccccgggcaaagaacttgacctgctaattgttatactgccagataataatggttctctttatggcgaccttaaaagaatttgtgagactgaacttggattggtatcccagtgttgtcttacaaaacatgtttttaagatgagcaagcagtatcttgcaaatgtagctctcaaaatcaatgttaaggtggggggaaggaatactgttcttgtggatgctttggcaggaggattcgccttgttaccgacagaccgaccataatatttggtgctgatgttacacatcccccaccctgaaagaagattctagccccttccaattgccagctgtggttgctttctcaagaactggccctgagataacccagtaccgcaggattagtgagttgcccaaaccccttaaggcaaagagctgaatacgggatcctttttaaaagtattggcaaagatcccccaaagaagggaacctgtttactgggttggcaatgaatccaagggaagcttcctcattattcttttcaaagaagggccaacttggaacaaaaaccctcccgaaagtattctttatttttaacgggg

SEQ ID NO: 2243 - DNA, 851 bp, Triticum aestivum
  misc_feature (757)..(757): n is a, c, g, or t
  Predicted polypeptide sequence is orthologous to G1146
acgcatgacattaggcctatttaggtgactctatagaacaagtttgtacaaaaaagcaggctggtaccggtccggaattcccgggatatcctcgacccacgcgtccgcagatcttgggctagtctctcaatgttgtcttgcaaagcatgttttaaagatgaaaccacaatatcttacaaatattgcccttaaaatcaacatgaaggtggggggaagaaatactgtacttcttgatgctgtggtagggaatctcccacgtgttagtaacacaccaactattatatttggtgccgatgtcagtcatcctcatcatggagaaggacgttctagtccttctattgcagctgttgtagcttctcaagactggccggaggttaccaactatgctggattagtccggcggcaagcccgtcatgaagagattatacaaggcctttttaacgaaaatgattgtggaagtggacgtatatctggtggaatgatcaaagagcacctcatttctttcatgaggtcgactggacatataccccggaggatcatattttacagggatgttgtcagcaaaggacggctcaatatggttattgagcatgaactttctgccattaaaaaggcatgtgcgtcgctggatcctatttataatccacaagttaccattattatggttcagaaacagcaccacacacgtttgttcgctggtaactatggtggtgggagcacatttttgaaatggaaatgtattgccaggtactgtggntgataaaagaatatgccatcccactgactttgatttttacttgtgtaaccatgcctgcactaaggaagtcgcccggcctgttcgtatcatgttc

SEQ ID NO: 2244 - DNA, 1062 bp, Triticum aestivum
  misc_feature (792)..(792): n is a, c, g, or t
  Predicted polypeptide sequence is orthologous to G1146
gcgacccacgcttccgcgaccgggagcgtgatataacccagatggtcaaacacaatgcttatcaagaggatccttatgcgaaagagttcggcattaagattagcgattgtctggcatcggtagatgcacggattttaccggccccacggcttaagtacaacgagactggtagagaaaaggattgtatacctagagttggtcagtggaatatgatgaacaagaaaatggtaaatggtggcaaagtcagaagctggatgtgcgtcaattttgcccgcaatgtgccggacaagcttgctcgtgatttctgccatcaacttgctcagatgtgccaagactcgggaatggacttcgctctggagcctgttctcccacctatgagtgcacgtccggatcaagtggagcgagctctcaaagctcggtaccatgaggcaatgaacattcttggaccccagcgccgggagctcgatctgcttattggaatccttcctgataacaacggctcgctttatggtgatttgaagcgcgtgtgcgaaatagatcttggaatagtttcacaatgctgttgcacaaagcaggtgttcaaattgaacaagcaaatttatgcaaatattgcactgaagataaatgtcaaggtggggggcaggaacactgtgctggtggatgcattgtcgaggcgtattcccctggtcaccgatagacctacaatcatatttggtgctgatgtgacccatccacatcctggcgaggacagcagtccctcaattgctgctgttgtagcctcccaagattggnccgaggttacgaggtacgcggggttagtttctgctcaggcgcaccggcaagagctgatagaggatttgtacaaggtccgggcagatccacagaaaggaccagtcagtagtggcatgatttaggagctacttatatccttttagaaatcaactggtgagagccctcagcggatattattttaccagggatggcgttagcgagggcccattttaccaagttctgtggtttggaaccaaggcgaaccgaaaagccgtgtgttcccttggggga

SEQ ID NO: 2245 - DNA, 2204 bp, Triticum aestivum
  Predicted polypeptide sequence is orthologous to G1198
gaattccggcgacggcggcagtctactaccccgtagttcggatagaggcccctcttcctatcgagtgtttaggcatatatctgcagctttgtcacaacaaaggaatctctctgggagttacattgagcactatgaataatctgcaatggcagaggccagccctagaacagaaacgtcaacagatgatactgatgaaaatcttatgcttgaaccagggaatgctgctcttgctgttgtttctgactctagtgacagatccagagacaaaaacggagatcaaaagacaatgcgtcggcttgctcaaaatcgcgaggctgctaggaaaagtcgtttgaggaaaaaggcatatgttcaacaattggagaacagcaggctaaagcttacccagctagagcaggagttgcaacgagctcgtcaacaaggcatttttatatctagttcagcagaccagtcccattccatgagtggaaatggggcgttggcttttgacacggagtacgcacggtggttggaagaacacaatcgacaagttaatgagctgagagctgcagttaatgctcatgcaggcgatactgagctgcgtagtgttgttgagaagatcatgtcacactatgatgagatttttaagcaaaaaggaaatgcagccaaagcagatgtctttcatgtgttatcaggcatgtggaagacaccagctgagaggtgtttcctatggcttggaggtttccgaccttctgagcttttaaagcttctttcgacccagcttgaacccctaactgagcagcagctgtcagggatatgcaaccttcagcaatcatcacaacaagctgaggatgctctttcacaaggaatggaggctcttcagcagtctttggcagaaacgttggctgggtctatcggctcttctggatctggatcaacaggaaatgtggcaaactacatggggcaaatggccatggccatgggaaagcttggaacccttgaaaatttccttagtcaggctgacaacctgcggcagcagactcttcagcagatgcaaaggatcctgaccacaaggcagtctgcccgtgcacttcttgtgataagtgattactcatcccggcttcgtgccctaagttctctttggcttgctcgaccgaaggaataacaagcgcgtgtgatttgactgcaatacattttcgcaatttgggggtgatggtggtggcagtcatgcaacagacttgattcagagaaacttgcacatactataatccaaagagatgctgtgttcaggtagcttagccatatagtgaagttgagtgcattagggaagggtccttgttgtaccgttaaccgctgtaaaattggcatctaatggttgccaagtaatctttaagatactaatttgcagagagccatccctttagatgtgcatttataactcttttgttgctaatcggaaaaaaaaaaggaggaagagcgagctaggcaagaggctatcgcgaaaaaggctgcagaagacaacaaggatcagccctcaagctctaccgatgctattatggctgaagcggaacttaccttaaatgctcctgctgatcttgacgcagatctactcaaggatgatgatgatgctcagctactacagcaagcacttgctatgtcaatggatgagggtgcttcaggagctgcagccgtggctgatgctgctatggcagaagctgctgcagatgaccaggatttggcattggctcttcaaatgtctgtccaggacgctgaggcggctggtcaatctgatatgagcaaagtgtttgaagacagatcatttgtgacatccatccttaattcgcttcctggtgttgaccccaatgacccatctgtgaaagatctactggcatctttgcatggccaaggagagcaggaggagaagaaagataaggaggacaagccagacatttctgaagatgggaagaactgaaggcaatgaacatctattttctcggaaaagtgcaggcgcatgaagtgaagaagattgcctgcattagctgcttttacactcgggctctatgaatttacttaatcctcttgtaactgcgttgatgataactgccgagagaacttgtattatgtctgctctcacgaatgctccttcatgtttgtcttaagtgattacatgttgcaaattcatttgtacactttatgtctgttgaaggtgaaattgaacggaattc

SEQ ID NO: 2246 - DNA, 1505 bp, Triticum aestivum
  Predicted polypeptide sequence is orthologous to G1198
tggagagtaggcgaggaggaggagggccggcagcggccgcagcggcggcgggcgacccgcgcgggccgatgccgggtttcggggctcctcagcacaccatcccaacaaatgtgaacgtcatgcagccttctcgagttgctgatttgggggcgctcgcccactctgctggattcagaatagaagatctcgctaatttcagtacaaataatttattcaatctgaagccaaatacacatgcatataccagtgacccccttcagtttggaaattacggaaagtccatttctccgactgatctagctactacggcggcggcagcagcagcggtaacagcagttgatcctcaggccctactacagcaaaagggagtgcaaccaaatctagtagctttaagaactcataacaatgataactggggagagtcaagtatggctgatacaagtcctaggactgatacatcaacggatccggatatagacattgatgaacgcaaccaaatgtttgaacaaggacagcttgctgcccccacagcttctgattctagcgacaaatcaagggacaaattagatcataagtcacttcgccgtcttgcccaaaaccgtgaagctgctaggaaaagccgtttgagaaagaaggcatatatccaaaacctggagagtagtagattgaaacttactcaactagagcaagagcttcagcgtgctcgtcaacagggcatcttcatttcatcttcaggggatcagtctcagtcagcgagtggaaatggagctgtggcatttgacatggagtatgcccgatggttggaggaacataacaagcatataaatgagttgagggctgcagccaatgcacatgctggcgatgatgatcttcggaaaattgttgatagcatcatgtcgcagtatgatgaatttttcaggctcaagggtgtagcagccaaagcagatgttttccatgtgctgtcgggaatgtggaagacccctgctgagaggtgcttcatgtggttaggtggcttcagatcatccgagctccttaagttactggcaggtcaactagaacctcttactgagcagcagcttactggcatatgcaacctgcaacagtcttctcaacaagctgaggatgctctttctcaagggatggaggcattacaacagtcacttgcagaaaccctagcatctggatccctgggccccgcaggatcttccggtaatgttgcaagctacatggggcagatggcaatggccatgggaaaacttggcaccctagaaaacttcctccgacaggctgataatctgcggctccaaacccttcagcagatgcaacgcatattaaccactcgccagtctgcacgagctctgcttgcgataagcgactacttctctcggctacgcgctttgagttcactttggcttgcccgtccacgggaataaattgaatcgattcataaatagcataataatattaggtactgcatcttgagtgttgcattagccagccccata

SEQ ID NO: 2247 - DNA, 596 bp, Triticum aestivum
  misc_feature (13)..(13): n is a, c, g, or t
  misc_feature (47)..(47): n is a, c, g, or t
  misc_feature (52)..(52): n is a, c, g, or t
  misc_feature (68)..(69): n is a, c, g, or t
  misc_feature (89)..(89): n is a, c, g, or t
  Predicted polypeptide sequence is orthologous to G1198
atacaatacgatnaacactaatgacaaacaattacacatgatatatnccggntcaccagcgctacaanntctccctgttttcttatagnaatttcatcgctacaccatcatcatcatcacaccaaaacatgtatttacacatccttgatcccttgacccggccacctgatcgaccttaattaccctgttttactctgtcatcgtccggaaaacatgcaagcacgcacgcacctacggcgcggctctgaatgcctacctcttctcccttggacccagcgagatggatctcttcgtcctccgctggccagcagatggatggattactacgtacgtacgtactaacttcttctgcgccatcatcgatctctctctgcttccgccattgctacgtgatcgagcacagtttagcttatggcggactcgcgcgggcgggccgcccagagcgtgctgagcgcgcgaaggcgctggaagtagtcccccagcacgagcaggcccttggccgcctgccgcgtcgtcaggatcctgtgcatgttctgcagcgtctccagccggagatggtccgcctgctgcacgaagccgacgaggcccttgagctt

SEQ ID NO: 2248 - DNA, 607 bp, Triticum aestivum
  Predicted polypeptide sequence is orthologous to G1198
tttttttttttttttttttttttttccaaattctgtcagatagctcacctattcaattcaagatattttggtagtggtgcatggtagaaggtgttcttacaaaatgcagccagaagtaatgaaaataacacaaattgacaataatgaactctgggtgtcctccatttgttctcactccaggatacattaaaccatttgactcaagaaaatctgatgacagttgtacgcattctgacaagttctcccatttctggagcttcctttgtttcccagctctctgtttctcacatatctgctacattacatccaaaaaatttcttcccagttgttttgcttatgctcctactttgaaggttagttccaagatacatttgaatcagtaggctgaatattggctttcagctggatgtgctgcaatgcttagctctccacaattgccttcatctgtcatcagtatctctcgagggcgagaacccagagggagcttagggcacggaggcggttatggtactcgccaatagccaagaaacatcgagctgcctgcctaactgtcagaatcctgtgcatctggtgaagagtctgctgcctcaagttatcagcctgtatg

SEQ ID NO: 2249 - DNA, 758 bp, Triticum aestivum
  Predicted polypeptide sequence is orthologous to G1198
ccacgcgtccgttctcgaagcttccccgattcgccgccgctccccccaccaaatccccgacgccgcgagccggagctgctacaggaggaggagtcgccggcctccgggcagaagccgcgcgtgaggccaggccgtaccggattcggtgctgcggctctgaggctctcccccatccatccccggcgggggcccgagggccgaccacctaccatggccgcggcccgccggcgccacgccgagccccgctcaggacgaccgcgccgaccgcaccccaccatacggttgtagtaaatcctcggcagctactgacttgggctcttggagagaaattctggcaacgatcgatctcgcgcagcaaagggctgggctcaccgctttgctgttaggaaggggggagcaaagtgatttgctgtctccttgtgattgtggtccgctgagtgatggcagatgctagctcaaggactgacaactcaactgttctagacaacgacggcaagatctataggttagaacaaggacaaagtggtggggcaatcatggcttctaattcttcggataggtctgacaggtccgacaaacccttggaccaaaagacattgcgtcgtcttgctcaaaatcgtgaggctgcaaggaaaagtcgattgaggaagaagtcatatgtgcaacagctagaaagcagcaagctgaagcttgcacaactagagcaggagctccagaaagctcgtcagcagggaatcttcatttctagctccggagac

SEQ ID NO: 2250 - DNA, 865 bp, Triticum aestivum
  misc_feature (22)..(22): n is a, c, g, or t
  misc_feature (521)..(521): n is a, c, g, or t
  Predicted polypeptide sequence is orthologous to G1198
caaccccccctgcggtagtggnctttcatacgacgttagattgggaccactttgtacaagaaagctgggtacgcgtaagcttgggcccctcgagggatactctagagcggccgccctttttttttttttttttcaaaaatggtacgaacttgttcgatagttgataatctgatgtcatctacaggcagcaatatccactgaacatttgctgtaaacattcatcacatgattctgatccaaacttctcgccaatacaagaacattgtgaagaatctagggagtagggaatacctgaattcctatggggctggctaatgcaacactcgagatgcagtacctaatattattatgctatttatgaatcgattcaatttattcccgtggacgggcaagccaaagtgaactcaaagcgcgtagccgagagaagtagtcgcttattgcaagcagagctcgtgcagactggcgagtggttaatatgcgtttcgcatctgctgaagggtttgtagccgcagatatcagcnctgtcggaggaagtttctagggtgccaagtttccccatggccattgccatctgccccatgtagcttgcaacattaccggaagatcctgtagggcccagggatccagatgacagggtttctgcaagcgactgttgtagtgcctccataccttgagaaagagcatcctcagcttgttgagaagattttcggaggttgcatatgccagtaagctgctgctcagtaagaggtctagtttacctgcccagtaacttaaggagctccgattattctgagaccacttaaccaattgaagcactcttcagaggggttttccccattccccggaaggcaatggaaaactctgc

SEQ ID NO: 2251 - DNA, 850 bp, Triticum aestivum
  misc_feature (19)..(19): n is a, c, g, or t
  misc_feature (39)..(39): n is a, c, g, or t
  Predicted polypeptide sequence is orthologous to G1198
ttaaccgccgttcgttagntagcttccatacgagttagnatagggaccactttgtacaagaaagctgggtacgcctaagcttgggcctctcgagggatactctagagcggccgcccttttttttttttttttttttttttttttttttttttttttttttttttttgaatcttaaaacatttcacctcgtcaggcggtatgatttatttaggcgattatacaccacaagaacatcacatcataggatctcaaattattctgcaagtttttacatccccattttttcaaaaatgctacgaacttgttcaatagttggtaatttgatgtcatctacaggcagcaatatccactgaacattcaccgtaaattttcctgacatgattctgatccaaactgctcgccgatacaagaacattatgaagaatctagggagtagggaatacctgaattcctatggggctggctagtacaacactcaagatacagcacctaatattattaattatcctatttatgaatggattcaatttattcccgtgggcgggccagccaaagtgaactcaaatggcgtagccgagagaagtagtcgcttattgcaagcagagctcgtgcagattggcgagtggttaatatgcgttgcatctgctgaagggtttgcagacgaaaatatcaccctgtcgtaggaagtttttttgttgggtgtccaagttttcccatggccattgccatctgccccatgtactttgcaacatttccggaagaattcttagggccccggggttccaaatttccgggttttcttcaaccaaattgttgtagtgcttccatccctttaaggaaggacattctt

SEQ ID NO: 2252 - DNA, 365 bp, Triticum aestivum
  Predicted polypeptide sequence is orthologous to G1198
caatctgaggcagcaaacgttgcatcagacgcgccggattctaacaacccggcaggcggcccggtgtttcctctccattggggagtactaccgccggctccgagcactcagcagtctctgggcttcccgtcctcgcgagaacttcatcgggactgagagccttagcccaacaggaacggagctacaaggaatgcagcaccaccaccaaccgcaacagaatcagttctccggattttgaggcttctcctggagggtgtaacgtaggggtcagtgatgttagaaagagaggagaagacaacgagggactgtaatgttctatcattgattaaagtatttgagaaagcaacaaaaaaaaaaaaaaaaaa

SEQ ID NO: 2253 - DNA, 849 bp, Triticum aestivum
  misc_feature (653)..(653): n is a, c, g, or t
  Predicted polypeptide sequence is orthologous to G1198
acgcttgaccttaggcctatttaggtgacactacagaacaagtttgtacaaaaaagcaggctggtaccggtccggaattcccgggatatcgtcgacccacgcgtccgatgccatgagtggaaatggagcaatgactttcgatctggaatacactagatggcttgaggaccaaaacaagcaaatcaatgagttgaggactgcagttaatgctcatgcaagtgacagtgacctgcgccttatcgtagatgggataatggcacattatgatgaaatatttaaggtcaaaggtgtcgctgccaaggctgacgtgttccatatactgtcaggcatgtggaagacgcctgccgaaaggtgcttcctgtggcttgggggtttccgtccatccgagctcttaaagctcctggtgaatcatctggagccgctaaccgagcagcagatgttgggattgaccaacctccagcaatcttcccagcaggcagaggatgcactgtcacaaggaatggaagcattgcagcaatcactggcagagactctggctggatctctgggttcctccgctggctcttcggggaatgttgcaaactacatgggtcagatggccatggccatgggcaagcttggaacgctcgagaactttcttcgccaggctgacnacctgcgacagcagaccttgcatcagatgcagcgaatcctgactatccgtcaggcctcccgcgccctcctagccatacacgactacttctcgcgtttgcgcgcgctgagctctctgtgccttgctaggcccagggaataaccaaggatcatcgctcgccggattcccccctaactgatgtgacaccgctgggggtg

SEQ ID NO: 2254 - DNA, 1109 bp, Triticum aestivum
  misc_feature (675)..(675): n is a, c, g, or t
  misc_feature (803)..(803): n is a, c, g, or t
  Predicted polypeptide sequence is orthologous to G1198
aagcaggctggtaccggtcccgaattccctagatatcgtcgacccacgcgtccgcgaaaaagtcgtctgaggaaaaaggcgtatgtacaacaacttgagagcagtaagctgaaacttgcaagcctggaacaagaactccagaaagctcgacagcaaggaatcttcatttctagctctggggatcaaactcatgctatgagtggaaatggagcgatgacatttgatttagaatatactcgatggctagaggagcaaaataagcagataaatgagctgaggactgcagtaaatgctcatgcaagtgatagtgacctccgtcttattgtagatggaataatggcacattatgacgaaatattcaagctgaagggcgctgctgcaaaggctgatgtgtttcatatactttcaggcatgtggaaaacacctgctgaaaggtgttttttgtggcttgggggttttcgttcgtctgagcttctaaagctccttgtaaatcagctcgagcctctaacagagcagcagttgatggggttatccagcctcgagcaatcctcacaccaggccgaggatgcactatcacaaggaatggaggcattgcagcaatctttggctgaaacgttggctggttcccttggtccatcaggatcttcaggaaacgtggcaaactacatgggtcanatggctatggctatgggaaaacttggaacccttgagaatttccttcgccaggctgacaatctacggcaacaaactttgcatcaaatgcaaagaattctgacaatacggcaagctgctcgagctctccnttgcatacatgactatttttcacgtttgcgtgccctgagctctctctggctttgcaggccacgggagtaaaacatgtgcgccatcttttggcgcctcatgagctgatccaggaaatgtggacaaaatgcgacgcatttgcagaagattggggttcagttccctctgaaaataatttgacaccttgtgttctcatattgtacctcgacgttgtacaagtagccagggagggggtaaggcttgtacttgtaatttacatgaattttatgattggaaatttggtaaaaaaaaaaaaaaaaaaaaaaagg

SEQ ID NO: 2255 - DNA, 1117 bp, Triticum aestivum
  Predicted polypeptide sequence is orthologous to G1198
cgtgcgacccacgcttccgcccttctgaccaacccggccgcccccagtttcttctcctcttctctctccgcgctgccgtcccgaccccgtcttctgctcctccgcttcacgcggcgccggccgccggccgccggccggcctccctccaaatccgtacgccgagcgggccctccctccctttcgacctcctcccctgccgcagacactgccccccgtgatcccgtgcctacagataatttgactctgaaaaggtgacggctctggcctcggagtgatctgacacataaaggatacaggcgcccttattaccctgcttgaactaaaggggcaacaaagcgatttgttgtcctgttgttttgagctggaaaacccccggtatggctgatgctagttcgaggactgacacatccatagttgtggacactgacgataagaatcaaaggattgttgtacacatttgctccagtgcctaaagaaacaacacacttcttaaattagatatcaacttgcaaaagtgaacaggactactgctgctgcactatcagtttcatcagatggaaaacggacaaaatggagctatcgtgccttctaattcatctgaaccatctgacaggtccgacaggcctatggaccaaaaggtattgcggaggcttgcccaaaatcgcgaggcagcacgaaaaagtcgtctgaggaaaaaggcgtatgtacaccaacttgagagcagtaagctgaaacttgcaagcctggaacaagaactccagaaagctcgacagcagggaatcttcatttctagctctggggatcaaactcatgctatgagtggaaatggagcgatgacatttgatttagaatatccccgatggctagaaggaccaaataagcagataaatgacctgaggactggggtaaatggtcatgcaagttaatgtgacccccgtcttattgtaaatgggatatgggccattattaccaaatatttagccttaggggcctctgcaaaagcggagtgtttcaaatacttcagggctgtgaaaaaccctcttgaaagggtttttggggctgtggggtttccgtcgccttaacctttaaaccctctttaaataaggcgagcccttaa

SEQ ID NO: 2256 - DNA, 741 bp, Triticum aestivum
  Predicted polypeptide sequence is orthologous to G1275
tcggcacgagggtagcacgctagtgcgtagtccgtagctcgtctgtgcagtgcacttatggcggcttcgctaggacttaccagccatgaagcctgctgcacggtccaccccaccggctcctccttgtacaacttccaagccgatgaccccttcgtggcagcagcggacggtgccgcggagctgagcttcccggagctcgtggaagccgctcgggcctccgactactcgccgcttccggcgttcggcgtcgctggaggcgagacgatgaacatgtacgggcggagcgtcgtcttccctatgacgacctcgtactactgcgacggcgccgggatgttcgacggcgacgcttcggcgagggggagatggggagggatcggtgctatgaccgggcggccgtcggggaggatcgggttccggactcggtcggaggtggaggtgatggacgacgggttccggtggaggaagtacggcaagaaggcggtgaagagcagccccaacctgcggaactactaccggtgctccgccgaggggtgcggggtgaagaagcggatcgagcgcgaccgcgacgacccgcgctacgtcctcaccacctacgacggcgtccacaaccacgtcacccccggcagcacgtcgtcgagggcagcgccggcgtactcggcgccgacggcgcccgcttggacctggagcgagctgcatgcggcggcgcactcctcggagtcctactgaacggagctactgatc

SEQ ID NO: 2257 - DNA, 396 bp, Triticum aestivum
  Predicted polypeptide sequence is orthologous to G1275
ttttttttttttttataaatatatttcttcgattaaatggggtcaaaagcaatatacatttgccttgacatcatatcatagtacaaaagaatgtgatatcacagtactagtagcacaaaagaatagcaacagcaataacaccaaatcgacctcgtgccgaattcggcacgagcccaaacccaaggaactactaccggtgctccacggaggggtgcagcgtgaagaagcgggtggagcgggaccgggacgacccggcgtacgtggtgaccacgtacgagggcacgcacagcacgtcagccccagcaccgtctactacgccagcaggacgccgcctccggcgcttcttcgtcgccggacgcacccgccgccaggctcatcaactgagttacctaacca

SEQ ID NO: 2258 - DNA, 706 bp, Triticum aestivum
  Predicted polypeptide sequence is orthologous to G1290
ggtaggaggcgagacagaaatcttacaaattctgtatcacagttgatccgttaggaggaaagtaagtttacgcactaatgccataccaatctatagcaacgggcgatcaagcaatcctcctactcccgttgtcagtaccagccacggcgccctgcccctggacctgctctaccacatcttgctccgccatgctgctctgctgcttccgcttacctgcagtgaacgccttctgaagcacatctggcaggtcatgaaacctattcatctcagaggttgtaatcgcttccgagggcagccagccctggttcatcatccatcatcttctccagcacatccgaacaacgcgggaagaagcgtttgccaagttcaactgttttggagagcactctcatccgagctaagtacacatccttcattttgaaaggagtttcatttagatcaaaggttgtccgttgtatctccgtaagtggatttgcactagaaccaagggtaaattccaaagtaccattcacttgagcaacttccattgctactcttgcctcggctgggaacaatatcatcgccaaagcaactcggttttcaaggtacaacaactttccatgtaggcagtcaccagccattgcaagagaaaccgatgcttccccaagttctggttcccttctttcagcttgctccaatatcccaatacataatgtatttttaggag

SEQ ID NO: 2259 - DNA, 722 bp, Triticum aestivum
  misc_feature (234)..(234): n is a, c, g, or t
  misc_feature (665)..(665): n is a, c, g, or t
  Predicted polypeptide sequence is orthologous to G1361
aatttgagagtacgttaagacgtaagttacgtatacatatatgtgtatataatgaacaatgtaacaaagattgatccctacgcttcatcacctgtgcagccactcaacacttttattgtccagtagtactgtttcgaaactgcttcgcgcgcactgccagtgccattttatctgcctgccatcctctcagtacgtgtctcctggcctctaacctagtagtagagtatatatcangtcaacgaatagaactgctttgctttagttggctttgcaattcttggtcagggaccaaagcccgtccctcccgtgtgcacctcgaagttaggcatcaaatgagcagaagcagcagcagccgcggccgccgccctgttgttaggaggagccgcctggctgctgtacccgattagtgctgcagcagttgggctgtagaaatctaccattcctgcagcttccttcagcatattgttgttgtggccatcctcgtggtgatgacggtgatgatcactagttgcacctgcaccgccacccttgatgatattgcccgctgtgatggcggcgtccctgacagcggcagccgtcgagccgccgcactgccgtggctgcgtctgatagaacaccttggagacgacgagctcgccatccttctcctcctcatcggagcctangtggtattgatgcatcacccagttggtcttctctggcttgcgctgcttgccgtagtt

SEQ ID NO: 2260 - DNA, 1130 bp, Triticum aestivum
  misc_feature (630)..(630): n is a, c, g, or t
  misc_feature (762)..(762): n is a, c, g, or t
  Predicted polypeptide sequence is orthologous to G1361
ccacgcgtccgatgcatcaatccacctctacttggtagtacaactagctccctcgtggcgtatcgatctccttggcaagcaacaacccaaaagttggtgagaattctattcctctgtaccagatagagagagaaacccagcacccagcagcagcaacaagcgcaggcaatggtagctagcttgtaacagggacaagcttcctctctaacctctttttctctttgttctcttcgcaggccgctttgttccctcgcccgccctctttagccagccaccagccccgatctccctcgatctcctctcctctttttaccctgtcactcattccctcccagccggcagggccggccttgatcctgccacatatggggacgggctagcaaagcggaactgcggacaccgagaggctttccatatcttcatccatccatcatcattaagtacgtggtggtggggcgcgggagtgccgtgtcggccggccatgacatggtgcaatagcttcaacgacgtgcgcgccgtggagaacaacctggcctccgccgcggccgtcgcggcggcggccgccaagaagcagcagcaccaccagcagcaggcctcctcccacgtcagcctcgttaggacgtgccccgnctgcggccaccacgcgcagtatgaacagttgcaggcggcgtcgacgatacaggatctgcctgggctgccggccggcgtcaagttcgaccccacggaccaggagctgctggagcacctggaggggaatggcangccggacacgcgcaagctccacccgctcatcgacgagttcataccggcgattgagggagagaacggcatttgctacacccatccggagaggcttccaggagttggcaggacgggcttgatccgcatttttccaccgtccatcaaagggctttacgaaggggactagtcagcggggcaggtggacaccgaaaaacagggcggcgaaacaaaatgcacaaacggggcaaaccccccccgttttctggaggggaagctcagggggtaaaaaaatctggtctcttatcaactacggaaagcggcaaccccaaaaaaccaaggggtttgttcaaaacccctaagcccctaaggagaaaagggggtgcccctca

SEQ ID NO: 2261 - DNA, 651 bp, Triticum aestivum
  misc_feature (581)..(581): n is a, c, g, or t
  Predicted polypeptide sequence is orthologous to G1361
cggcacgagggtcgagccatatcgctgttctcagtcagtactcggtagagacagatcggcaagtccttgcaagcgcttcgctgaacctcctctagtcctcttcctcccagaactgccgcattaggtttcgatccactggtcgcgatggtcgttgatccagttctcaagggatttgacctcaacatcgcggcagtagatgagtcaagccctttggaaggaatcggccttggcctgtatgcgactgagttcatccacaagtacctcagattcaatcccacggaccaggagctgatggagtggctcgaggccaaggtgagggatggaggcgcgagatctgaccctctgattgataaattcatacccaccatagaggtcgagtacggctacccccatcctcagcaacttccaggtgtgacgatggacggcacgatcaagcattttttctgccgtccgagggcgttcgagagtggacggaggaaacatcggaagataaaggcggagcgcaacgatcgtaccgcatggcacaagaccggcaaaagcatggcattgaaggccaacggccggctgacgggctggagaancatcctggtgctctacaccaacaccaggaagaccaactgggtgatgcacgagtatcgcctcagcgacgtc

SEQ ID NO: 2262 - DNA, 851 bp, Triticum aestivum
  misc_feature (814)..(814): n is a, c, g, or t
  Predicted polypeptide sequence is orthologous to G1482
acgctatgaccttaggcctatttaggtgacactatagaacaagtttgtacaaaaaagcaggctggtaccggtccggaattcccgggatatcgtcgacccacgcgtccggagagagagcccgagataactctattggcctggccccgtgacctaccttgcctatctctcaccgccccctccatctctctctcgcgtggcggggtcgaagctgcgtgcccagatcgtgccatgaaggtgcagtgcgacgtgtgcgaggccgaggcggcctccgtcttctgctgcgccgacgaggccgcgctgtgcgacgcctgcgaccgccgcgtccaccgcgccaacaagctcgccggcaagcaccgccgcctgtccctcctccacccatcgccggcctcctcctcgtcgccttcgccgaagccgcctctctgcgacatctgccaggagaagagggggctcctgttctgcaaggaggacagggcgatcctgtgccgggagtgcgacgtccaggtgcacacggccagcgagctgacgaggcggcacggccggttcctgctcaccggcgtgcgcgtctcgtcggcgccggcggagtcccccgcgccgtcgggtcaggaggaggaggggaacagcaccagcccctgcatcgccgactcctgcagcggcgacgccagtggcacggcgagcgccagcgcgagcgcgagcgacggcagcagcatctccgagtacctgacgaaacgctgcccgggtggcacgtcgaggacttccctctggacgacgccgccgtcgccgtctcctcgaacagccgtaatcaggggaggagggnctggctaggatccgtgggccccaagaaggtgaaggta

SEQ ID NO: 2263 - DNA, 740 bp, Triticum aestivum
  Predicted polypeptide sequence is orthologous to G1537
ttttttttttttttttttaatagaattcatcatcacattaaaacaaagtacatacatagttctcatctaacaacatatatatagctctccagagcatctaattaattaaaccatacattgaaactatgtaaaacatttcaatgcgaaaacaaatgcgatcataatcgcaaccaaggtaacaattgatccaacggcataatgataccaagcctcggtatgaatggcataatgataccaaaggcataatctttctaatcttcaagcgcattgcatccatcttgatcttgtgatcatcgacgacatccgcaacatgcaactccaatatcaccttcttctcctcaattttttttattttttccttcaagtaattgttttcttcttcaactaaatttaacctctcgacaatagggtcggttagaatttccggttcaaccacctccacatccgaatcatagacaggacgagggccgacgggggcggataccaaaaccatcgcacttgtagcaagttacttctcgtctggagctcgcggacaaccactactttagaaattaacaaaaagggcatcatatagctcgtttgcgtcgacattgatcccaccgtgcaacctccttcttgtattgctctcccaccgctacggcgccaaattgtcatgaccccctggttgtagaggctcgaggatggatagatagatgtgtcaagtcaggcgctgctaccgattatatggctacgaaaagggc

SEQ ID NO: 2264 - DNA, 444 bp, Triticum aestivum
  Predicted polypeptide sequence is orthologous to G1539
ttttttttttttttttttttttttttttcacccaaatcaaattatagatctgcagcaagaagctgctgctgctgctacatgctgctgacgacgatgtacagtaaaaaatccaggcaaatacaggtaaggcaatcaactacaactactactaggtggcaattacagtaagggactgatcgatcgagggatccgtcctgtcaaccaagaagataagtaccagtaggggaagtaaaactgctactgctgctgctcctgctgctgggaaaaatcaggattaaggaggtgaggtgataatggtgggagtatgtgtaacgagcgagtgaaagaaaaagttgttgttgatgaatcggtggttggttggttggttaggctataatgcttcttttcttctttccggagcatctttttcccttggcctttctacacggccggccggccggccgg

SEQ ID NO: 2265 - DNA, 685 bp, Triticum aestivum
  Predicted polypeptide sequence is orthologous to G1560
ggattgaccggctgaaaagggacaagcaactgttgatggcagaagtggtgaagctaaggcaggaacagcagaacacgaaggcgcgtctgaaagccatggaggataggctacgtggtaccgagcagaagcagcagcagatgacttcattcatggcacgtatcttgcggaaccctgaattcttgaagcaactgattgccaagaatgggatgaggaaggagctccatgacgctatctcgaagaaaaggaggcgccgcattgacggtggacctgaagcttatgccgtgggtgctagtagcagcagcctggagcaagagttgcctgttgtgtttgattctcatgggtcagtggaacttcttgccgaggggtcggtgccggtggaactccttgctgacgggatcccacccgatctggaaggctcagtggaactccttgctgacgagatcccacctggcctggaaggttcagtggcactccttgctgacggcctggaaggttccgtggaactccttgttgatgggattccatctgatctcgacggctcaggtatcgactctaacggcgtaacagagccacaggattatggtctcggtacctgtgaagcgcagcagaacagagccctggggctgttccatgataatttctgggaggagctgctgaacaaaggacttcagcgttgagaacgacg

SEQ ID NO: 2266 - DNA, 703 bp, Triticum aestivum
  Predicted polypeptide sequence is orthologous to G1560
atcaggcccttggctcctgcctcgaggttggccagttcggattggacgaagaaatcgaagtgctaaagcgcgacaagaacgccttactcgaagaggtggtgaaactgaggcaggagcagcagagcagcagagctgacatgcgagccatggaagagaggctgcaccgcgtcgagcagaagcagctccagatgatgggtttcctggcaagagcaatacagaaccctgacttctttcttcagttgatccagcaacaagataaactgaaggatcttgaggacgcttattcgaacaagaggaggaggtccatcgacgtaatgccgttccttggccctgagggggccagtcagagtgagccactcgagtccacattcatatttgaggacagggaattttcagagctggagaatttagccatgaacattcaggggatcaggaagggcatggagggtgacagaggtggtcgggatcaaggctgcggtgaggccgaactgactgacgacttctgggaggagctgctgagtgaaggaatgagggatgaagctgagatggtagagctggaaaggaggagatctagatatgtcgacgcgtagcgcaaagtatgggtcatttaagtacagcgatccaaaatctaccagaattcataaccatttaatctatataccattgtattgatagctgtattgtatattgtagtgctaattca

SEQ ID NO: 2267 - DNA, 1100 bp, Triticum aestivum
  Predicted polypeptide sequence is orthologous to G1560
ccgcccttttttttttttttttttttttttttttttcccacggggtactcttctatttatttctcatacggatactgacaatgccaatacacacgagctagcagaaacactgcagttcgttagaccgacagtagctagcagaaataactgataccaaatagaatcctcccgaaagctgaactaaacacggcaatgacgaaaataagaccgacaccaagataatatggtagcatcatcaccaaaggcggcagtgatctactcgactgactgatcatggccgacatggacatatatatacacatatataacaacaggcttgctggtaaggattctcggggctgctcggcgatggattactgtccagactttgtgttcttcaagtggagctagtccatcttctgagccaacaagttcatgtcatctggaaccacaaggttgctggcctcctcgccgagccccccttcatgcagcaggtcctcccagaaatcatcatttagctctccactgggcctgcctctcagttgctccgaacggctggaagcgacactctgctgcacctcagctccctttgtgtcgacggacgagctttcaagatcggatatgacaccgttcacgagcgagtccactggctcctgcttctcaaacattacctgtgacccttgttccagggtagagccagtgcccatgccatcgacagcttcaggtccttggtcgatgcggcgccgtcttttatttgagatggcatcttcaagctccttcctcatctcactctgggagatcagctggcgtatgaacatggggatctgcatgactcgcgccaagaatgacatcatctgctgtggcttctgctcggttcctggcagcccttttttcatgggttggaagatctgacttgtggttctgttgcccctgtctgagcttcaccatttcagccaataagaggtggttggtcccttttcaaagtgactatcccccaggtcatgttcaaaagtctcccaccctcagggtaagaacccaaaaaaatgggtgattttgaaacccatgtggtaggggtcccggggcgttaatatttctggggggggggccctttgcccctccca

SEQ ID NO: 2268 - DNA, 600 bp, Triticum aestivum
  Predicted polypeptide sequence is orthologous to G1594
ccacgcgtccgctcaggggacaccggtgcatccgacgccggcatgcaagagcagagctcccggttggccgaccgcgagctcagggagatgctgctcaacaagtacagcggctgcctcagccacctccggaccgagttcctgaagaagaggaagaaagggaagctccccaaggatgctcggcttgctctcgtggactggtggaacacacactaccgctggccttacccgacggaagatgataaggtgaggctcgccgccatgactggcctcgacccgaggcagatcaacaactggttcgtcaaccagaggaagcggcattggaagccgtcggaggacatgcgattcgcgctcatggaaggcgttaccggaggaggaggggggtcctcttacgacacgacactctgcttcggcacggacagcatgagatagttgctcatttcccgcgggcatgaagctcttctgcacacggtggttgtgtgactagcaaggaaggggtacatcaaacgatgaatagccccatgatcattttctcaatcattgtgtacgtatgtagtacatgggcgctgtcagggaaaacttttttgaaaaaaaaaaaaaaaa

SEQ ID NO: 2269 - DNA, 773 bp, Triticum aestivum
  Predicted polypeptide sequence is orthologous to G1594
gcggccgctctagaactagtggatcccccgggctgcaggaattcggcacgagggcgcagtggaggcgccgcagccgccggggagattggcctcgaccccgagctcgacgagttcatggaggcctactgccggctgctgtcgcggtacaaggaggagctgtcccggccgttggacgaggccgcctccttcctcaccaccatccgctcgcagctcactaatctctgcggcggcggcgccaccgccacctcgccgcactccgatgaaatggtggggtcgtcggaggacgagccgtgctcgggggacgccgacgggtccgacgccggcatgcaagagcacagctcccggctggctgaccacgagctcaaggagatgctcctcaagaagtacagcggctgcctcagccgcctccggtccgagttcctgaagaagaggaagaaagggaagctgcccaaggatgctcggcttgctctcatggactggtggaacacacactaccgctggccttaccccacggaagaggacaaagtgaggctcgccgcgatgacggggcttgacccgaagcagatcaacaactggttcatcaaccagaggaagcggcactggaagccgtcggaggacatgcggttcgcgctcatggagggcgtcaccggaggagggggatcctcttccggcacgacgctctacttcgacacgggcacgatcgggccatgagatggatggatgattgctcatttccggcggccataaagcttactggctctattgcacacaga

SEQ ID NO: 2270 - DNA, 1999 bp, Triticum aestivum
  Predicted polypeptide sequence is orthologous to G1635
ctcgtgccgaattcggcacgagctcgtgccgcgcctcttcgcctctcttctcttctcctgcctgcccctccctcctcgcgctccatcgacaacgagcacctcgtcttgttcttggtcttggcttttggtgtggcgacgttgggtagtgtgattatcttgttctcgctggcaggagatggcctgtacgcaggagaacgccatggcaaccgacgaaagcacggcggatcatcgcgggagtcgtccgagttcccacgacatggatttatcaggggatgaccacgtgccaaaggcacgcaagccgtacaccatcacgaagcagcgggagaagtggaccgaggaagagcacaagcgcttcctggaggccctgcagctgcacggccgcgcctggcgccgcatacaagagcacataggcaccaagacggcagtgcaaatccggagccacgcgcagaagttcttctctaaggtcaccagagagtcgtccgggagctgcagcggctcgggcgccgcggccgcgacggcgacggcggcgatccagatccccccgccgcggcccaagaggaaaccgacgcacccgtacccgcgcaaagcggacgacggcgcggcggccggcggtaagcacgccccggggctcacgcatctggagaggcctcccgtgcggatgggcgagcaggaggaagggtcgccgacgtcggtgctgaccgcgtcgcgggtcgaggcctccggtggccgcttctcctacaactccagcggcagcaggtcgccggttccgtcggccgccggctccctctacggctcgtcggtggacagaggggacggctgcctctcgcctaatacgactaaggcttcagagttcactgcaaatggtgatgtcaaagaggggtcatgtacaggatcagcgacatcagtccttaagctattcggcaagaaagtcgtggtgaatgattcattccagaagccgaataccagcaccggcaacccgcagaatggtggcgacgtcggaactgaagcttcagacgatacaaccacacaaggaagcagaaacctaccttctggcggtgccacagaaggaagctcatggaatccatggccgagcagcatgcagcagtttgtgtattttgttcctcaaccggatggtttcgccacacaatctgcggtgccatggtttggcaccctgcctggtgcaatgttctaccagcaagccatggctccaaatcagcaccagcgccatcgctcagagaccgcagaccacaagttcatgcagagggaaggatcctggacaggatcaaacactggccctggatcagctgcgcataattcagatgctgccgactcccgagggagaggaaacagcagtgagagcgacaaaacgcctgtgccgcggttaacaaagtgcgagagctctgtttcggtcagtctgcaaagaggtttcatgccatacaagagatgcgcggccgagagcgaatcgctgcggtcggaggcgcccagagaggagaccgacggtgagttgacgaggctgtgcttgtgacagccgaagattcgacacgctcttcacagtttagatgtttgctagttttgctctagactcttgagctggtggtgtgatctgcagtgggaagaagcgaccactcatcctgctggttttgcctgtcggtatgtcgcacttctccgaagcagctcgaagccgcattagattgagcatttctggttcttgctcgtgaatatatatagttggaatatgtagtatccatgtttttgttctctacagagtgtctctgcagtttttaccccaaatcgggaggctcagagttcagtgttgttgcctgtatcaacctgggcctgagagagggttgtcgtagtcttaactgcatgttgtaagctaggcaggcttgtatcactctgtagtctgcattctgtaaaacatatgataggcagaagacgaacaaaaacgtcgaatgctctgtatatctaaagtataacataatataaaaaaaaaaaaaaa

SEQ ID NO: 2271 - DNA, 819 bp, Triticum aestivum
  Predicted polypeptide sequence is orthologous to G1635
gcttgacattaggcctatttaggtgaactatagaacaagtttgtacaaaaaagcaggctggtaccggtccggaattcccgggatatcgtcgacccacgcgtccgctttgaagagagaaacaacaacaaagattaggagctgctgattttgcctctgttcttcgtcgcccgcctctcagcccgatttggcttcgccggtgctccgattttgaaggatccagagagagatatggctcgttttcaggaaaccaagccggatctgctgaattccggcagcgatacgcggatgatggccgaagcccgcctccccaaggcgcgaaagccgtacatgataaccaagcagcgggagaaatggaccgaggaggagcacaagctcttcctggaagccatgcagctccatggccgcgcctggcgccgaattcaagagcacataggcaccaagacggccgtgcagatcaggagccacgcacaaaaattcttctccaaggtcacccgggactcgtccggggacagcggcggcagcagctccggcgccgggccgccgatccagatcccgccgccgcggcccaagaggaagtcggtgcacccgtacccgtgcaacctgaggagcgcgcagccggggaagcgcgcccccgcgctcctgcgggtcgacaagcctcagctgtccatgtgtgagcaggggaatggctcgccgacatccgtggtgaccacctcgcagataggcttggggcggctccgagagcttcgacagcgacacctcgaccatcgacgttgaagagcgatgccccacgccgagcacgggggaccgccgaggtcgctg

SEQ ID NO: 2272 - DNA, 533 bp, Triticum aestivum
  Predicted polypeptide sequence is orthologous to G1795
ggctggtggggcaacataattctgacacatatcaaaagcaaacattttagccatatcaaaatggcatatgacagaacaaaacattgtgcaaactatatctccaggcctggttgttagtatgctttgagtttgagtggcctggatcctgcaccatataaccagatccttgctactgccggtggacagcgtacgctggcgagcacgctaggaaaggacgtcaaagatgcagccactaatggctcggctcgtctgcttcagcggccgacacttctcctgcctactcccgatgagagagtgcggcgaccatgagggcccgtccacctgcagaagcagcttgtcctcatcagagcaaccacgtcagggggtaggaggagggagcagccatgagagctcgtgtctcgtccacctgcagcagcagcagctccaccccctcttccagatcggagcagcatagtcggaggacccgtggatgagctcgccggagatgccctcgccgggagatggcctgcagccggcgcacgtccttggagggc

SEQ ID NO: 2273 - DNA, 859 bp, Triticum aestivum; identical to SEQ ID NO: 675
  Predicted polypeptide sequence is orthologous to G1795

SEQ ID NO: 2274 - DNA, 596 bp, Triticum aestivum
  Predicted polypeptide sequence is orthologous to G1798
gaattcggcacgagctaacaaccaccgagggacaaaaacagagcgagagacgagcggcggccggtggggatggcgcggcgcgggcgtgttgagctgcggcggatcgaggaccggacgagccggcaggtgcgcttctccaagcgccgcgcggggctcttcaagaaggcgttcgagctcgcggtcctctgcgacgccgaggtcgcgctgctcgtcttctcccccgccgggaagctctacgagtacgcctcctccagcattgaaggtacatatgatctctatcagagatttgcaggagctggaacgaacttgaatggaggcgatgcaagtagcaacaatgatggtgatccttcaaacatacagtcaacgcttaaagagatcgcttcctggtctattcaaaacaatgctgatgtctcagatgctaataagctagagaaactggagaaactcctgacagatgctttgaggaatacaaaatccaagaagatgtcggcgcaacaaaatagcggggcaggcacgagtggcgagaacgccaatggtcctaggggaaagaagaagcgaggaaggacttgagagcagtcatgtggtgtgtctgcatt

SEQ ID NO: 2275 - DNA, 734 bp, Triticum aestivum
  Predicted polypeptide sequence is orthologous to G1798
tcggcacgaggccatggcgccgtcgtcgccggcggcggcggcggtggcggagggagacgagcagcagcagcagcagatcgtggcggcggcggcggcggccaagaagggcggcgggaagaggggccggcgcgagatgcggcggatcgaggacgccaccagccgccaggtgaccttctccaagcgccggagcgggctgctcaagaaggccttcgagctgggcgtcctctgcgacgccgaggtcgccctcatcgtcttctccccccgcggccgcctctacgagtacgcctccgcgccagatttgcagaaaacgattgatcgctatctgaaccacacaaaagggacatctgccaatgagaaaactgttgagcaaccagctgctggcgtccagatgtgtagatccgaagctaccgccttgaagcacaagatagacgcaattgaggcataccagaggaagctatctggagaaggactggggtcctgttcggcccatgagctgcaagagctggagctgcagctggagaagagcctaagctgcatccggcaaaagaagcaacagaaaatgctggataaaatcttggagctgaaggagaaggagagaaagctgttgacggagaacgtggtgctccgcgaggagtacaaggcgctgcctctgctagagctggccactgctgctgctgctgaaagatcgcctgacggcgccggagctgaagaagctgaggaggacgagcggcggc

SEQ ID NO: 2276 - DNA, 635 bp, Triticum aestivum
  misc_feature (438)..(438): n is a, c, g, or t
  misc_feature (449)..(449): n is a, c, g, or t
  misc_feature (453)..(453): n is a, c, g, or t
  misc_feature (534)..(534): n is a, c, g, or t
  misc_feature (537)..(537): n is a, c, g, or t
  misc_feature (541)..(541): n is a, c, g, or t
  misc_feature (560)..(560): n is a, c, g, or t
  misc_feature (574)..(574): n is a, c, g, or t
  misc_feature (583)..(583): n is a, c, g, or t
  misc_feature (591)..(591): n is a, c, g, or t
  misc_feature (607)..(607): n is a, c, g, or t
  misc_feature (621)..(621): n is a, c, g, or t
  misc_feature (634)..(634): n is a, c, g, or t
  Predicted polypeptide sequence is orthologous to G1798
ctcattttcgcccgctcccctctccatccaatcatcgagagacgtacgccagcgagcgagcggcagcccgaaggaggaaggaggcgaggcgagggatagcgcggcgcgggccggttgagctgcggcgtatcgaggaccggacgagccggcaggtgcgcttctccaagcgccgctcgggcctcttcaagaaggccttcgagctcggcctcctctgcgacgccgaggtcgcgttgctcgtcttctcccccgccggcaggctctacgagtacgcctcctccagcatagaagatacatacgaccgctatcaggcatttggaggagccggaaagaacctgaatgaaggcggtgcaagcaccaacagtgatggagattcttcaaatatacagtcaagcttaaagaattgcttcctggtctcttcaaaacaatgctgatgaccanatgctaatganctanagaaactggagaaactatcacagatcttggagatacaaatccaagaaatgttggcgcaacgaaatacgggcaagaacaatncancggngcaatcataatctaagganaggagaagaaggantgacatcanttatgatnattgcgtatcaaaggncttcttggtttcanatcgttgatctant

SEQ ID NO: 2277 - DNA, 532 bp, Triticum aestivum
  misc_feature (430)..(430): n is a, c, g, or t
  misc_feature (495)..(495): n is a, c, g, or t
  misc_feature (501)..(501): n is a, c, g, or t
  Predicted polypeptide sequence is orthologous to G1798
gttacccctaacaatcaccaagatacaaaaacagagcgagagacgagcggcggccggaggagactggtgggatggcgcggcgcgggcgtgtggagctgcggcggatcgaggaccggacgagccggcaggtgcgattctccaaacgccgcgcggggctcttcaagaaggcgttcgagctcgcggtcctctgcgacgccgaggtcgcgctgctccgtcttctcccccgccgggaagctctacgagtactccacctccaggttccataggaaatctactttgataaatattcactgaagtgggaattgctgcaacaactgggagttataggatctttgcttcgtatagtgggtgatgggtgcctacaatgatataaaattactatgttttactagtataattgttggcatgattggttgatatacatatactngaatttatccaacattgtctaatgtaaacttcatacacttgaatattgctactttacaatcatgngacccntcaattgaagttaatttgtaaaaaaaaaaaa

SEQ ID NO: 2278 - DNA, 507 bp, Triticum aestivum
  misc_feature (482)..(483): n is a, c, g, or t
  Predicted polypeptide sequence is orthologous to G1798
gcacgagggagaggacgaggctggtggggaactggggatggcgcggcgcgggcgtgtggagctgcggcggatcgaggaccggacgagccggcaggtgcgcttctccaagcgccgcgcggggctcttcaagaaggccttcgagctcgcggtcctctgcgacgccgaggtctcgctgctcgtcttctcccccgccggcaggctctacgagtacgcctcctccagaattccactattcgctggtgcttctacatgctttcattggatattccagaccaccttagtcggagttcaacaagcttctcttcaatcaacgccacccctacctcatcatgtattcactcttcataattaaatcctttattgtagggccacgcatccaccttagcatgtgcatcttagtgacacatttattggatgtggtgtctcttagtagcccaacactctgctccatatatcatcacaggttcgttcgatgtcctaannaaattaccttttaaaaaaaaaaaa

SEQ ID NO: 2279 - DNA, 757 bp, Triticum aestivum
  Predicted polypeptide sequence is orthologous to G1798
tttttttttttttttttttttttttttttttgacagcaactttgtaatttctatatatacagccaggccaagaaacaattggtgtgctgggcgtttcaacttgagttcagtcgtgagaggttctctgcaggtttgtcatcgtcgcagccgctaatttagctttgcaagacattacagattctgtctaaatatagagaataacagaaatggtggactactgatcgggcacttcaaggatctgtagagagtttattggtgtgaggctcaaccttcgggctggttacctatttggcttgacctgaccgcaggctggagcagcgaaccccgggcaacccaatgtagagctccgtctccacgtcctcgtccctctgtaccggctcctgctctggcgctggctagccacgtggctgcaggggtgccacgctgttcggggcaggaagcaacagccgcgcctcaaggttgcgctgctttccgcgcaagtcttcgttgtctttgagaagcgtcctctccttctctttcagtttagctatctgctgttcgagcagctgggtcttctttcctctgagaacgcggagactcttctcaatttttccttccagaaaatgcagttcttcagtagagcatcctcctaaattttcgcccaagatctttcgcttcgaatcttcaagagcttcaagtttctttgccaagcttagagcatcagctttgacttgctgtatatctggctgtactgtcttgttattaacagtatcctttg

SEQ ID NO: 2280 - DNA, 742 bp, Triticum aestivum
  Predicted polypeptide sequence is orthologous to G1798
cgcctccaacgcagagtgctgttccttctggcactggctatatagttcttcattgtcctgccgcaacttcatctccttctgcctcaacgtagagagctgctcttcgaaccgccgagtcttcattgccctgatgcctagaaggcttctttcaattttgacctctaagctttgcagttcttcaatagagcattcttccaaattttggcccaaaagtttgcttttgcaagcttcaagagcatcaagcttctttgacaagccctcagcatcagcttttactttctctatatcttgctgtaccgtctgtctgcccaaattatcctttgtgactgtcttataacgttcaattgtgttcttcatgctggagctggcgaattcgtagagcctgccgcggggggagaagacgacgagcgcgacctcggcgtcgcagaggacggagagctcgaaggccttcttcagcaggccgccgcggcgcttggagaaggtcacctgccggctcgtcgggttctctatccgcttcatctgcgtcttcccccgcaccattttcgcccctcttctcttctcccaccacaaatctaatcggaaaccaaaccaaaccagaaaaatctccctcctccgatcagccggccaaaaacggcaagcgcggcgcggtgaggtcgctgggtgtagggttcggccgtactggccgctgctcctcctcgatcacccaccaccctccccctccttctctccactggctttcctt

SEQ ID NO: 2281 - DNA, 1118 bp, Triticum aestivum
  misc_feature (794)..(797): n is a, c, g, or t
  misc_feature (799)..(823): n is a, c, g, or t
  Predicted polypeptide sequence is orthologous to G1798
gacgacccacgcttccgggaggaggatggcgcggcgcggacgggttgagctccggcggatctaggaccggacgagccggcaggtgcgcttctccaagcgccgcgcggggctcttcaagaaggccttcgagctctcgctcctctgcgacgccgaggtcgcgctgctcgtcttctcccccgccggcaagctctacgagtacgcctcctccagtcagagcatggtccttcaagcggcttcattcacaagggacttcagcctaaaactagcattgaaggtacatatgaccggtatcagcaatttgcggtgcccggaaggaacttgattcaagaagatgcaactgtcagcaacgatgaagatccttcaaatatgcagtcaaggcttagcgagattgctgcctggtctctcgataataatgctgacaattcagatgccagtagtttggagaaactggagaaactactaaaggatgctctgagaattacagaatctaagaagactttggtgaaacaaaatagtggcgggagcacgagcggagagagctcctacggacctacggggcaggagaatgggaggaaggcttgagcagagcaaagttcccctgtgctgtgtatgcatttggtactatgttgcttcccccaacacactgttccccagttaggctgttaatgggcaagaattagttgccagggctgctacttgtaagttgtaagggaggaaattttagcgaaagcgtggcttaataatactaataataatacagtgtccgtgctataaagagaccccgttgtaccttnnnnannnnnnnnnnnnnnnnnnnnnnnnnaaaagggcggccgctctagagtatccttcgaggggccaaggcttacccgtacccagctttcttggtacaaaggggtccctatagtggagtcgaattattaggctaggccctggccgtcggtttaaaaaggtcgtgaactgggaaaaatggttacttggggatcttgggaaaggaaccttacttctgggggggggacttaattggccaacctaccttaggaggattaaaggcctcagggtaatttaaaattttaaagggtataaatgtgttaaactaaccggatatgcgtgcgggg

SEQ ID NO: 2282 - DNA, 1174 bp, Triticum aestivum
  misc_feature (3)..(4): n is a, c, g, or t
  misc_feature (8)..(8): n is a, c, g, or t
  misc_feature (17)..(17): n is a, c, g, or t
  misc_feature (25)..(25): n is a, c, g, or t
  misc_feature (141)..(141): n is a, c, g, or t
  misc_feature (708)..(708): n is a, c, g, or t
  misc_feature (716)..(716): n is a, c, g, or t
  misc_feature (733)..(733): n is a, c, g, or t
  misc_feature (739)..(739): n is a, c, g, or t
  misc_feature (750)..(750): n is a, c, g, or t
  misc_feature (756)..(756): n is a, c, g, or t
  misc_feature (776)..(776): n is a, c, g, or t
  misc_feature (824)..(824): n is a, c, g, or t
  misc_feature (838)..(838): n is a, c, g, or t
  misc_feature (848)..(848): n is a, c, g, or t
  misc_feature (860)..(860): n is a, c, g, or t
  misc_feature (862)..(864): n is a, c, g, or t
  misc_feature (867)..(867): n is a, c, g, or t
  misc_feature (881)..(883): n is a, c, g, or t
  misc_feature (891)..(891): n is a, c, g, or t
  misc_feature (893)..(895): n is a, c, g, or t
  misc_feature (903)..(903): n is a, c, g, or t
  misc_feature (916)..(916): n is a, c, g, or t
  misc_feature (922)..(922): n is a, c, g, or t
  misc_feature (927)..(930): n is a, c, g, or t
  misc_feature (936)..(938): n is a, c, g, or t
  misc_feature (940)..(940): n is a, c, g, or t
  misc_feature (943)..(943): n is a, c, g, or t
  misc_feature (947)..(947): n is a, c, g, or t
  misc_feature (952)..(953): n is a, c, g, or t
  misc_feature (956)..(957): n is a, c, g, or t
  misc_feature (962)..(962): n is a, c, g, or t
  misc_feature (964)..(964): n is a, c, g, or t
  misc_feature (969)..(969): n is a, c, g, or t
  misc_feature (977)..(977): n is a, c, g, or t
  misc_feature (981)..(983): n is a, c, g, or t
  misc_feature (985)..(986): n is a, c, g, or t
  misc_feature (990)..(990): n is a, c, g, or t
  misc_feature (992)..(992): n is a, c, g, or t
  misc_feature (995)..(995): n is a, c, g, or t
  misc_feature (1001)..(1001): n is a, c, g, or t
  misc_feature (1005)..(1005): n is a, c, g, or t
  misc_feature (1007)..(1007): n is a, c, g, or t
  misc_feature (1009)..(1009): n is a, c, g, or t
  misc_feature (1011)..(1011): n is a, c, g, or t
  misc_feature (1013)..(1013): n is a, c, g, or t
  misc_feature (1016)..(1016): n is a, c, g, or t
  misc_feature (1018)..(1019): n is a, c, g, or t
  misc_feature (1022)..(1022): n is a, c, g, or t
  misc_feature (1025)..(1026): n is a, c, g, or t
  misc_feature (1029)..(1029): n is a, c, g, or t
  misc_feature (1031)..(1031): n is a, c, g, or t
  misc_feature (1035)..(1037): n is a, c, g, or t
  misc_feature (1042)..(1042): n is a, c, g, or t
  misc_feature (1046)..(1046): n is a, c, g, or t
  misc_feature (1049)..(1049): n is a, c, g, or t
  misc_feature (1054)..(1055): n is a, c, g, or t
  misc_feature (1057)..(1060): n is a, c, g, or t
  misc_feature (1068)..(1070): n is a, c, g, or t
  misc_feature (1075)..(1082): n is a, c, g, or t
  misc_feature (1094)..(1095): n is a, c, g, or t
  misc_feature (1100)..(1100): n is a, c, g, or t
  misc_feature (1104)..(1105): n is a, c, g, or t
  misc_feature (1108)..(1108): n is a, c, g, or t
  misc_feature (1113)..(1113): n is a, c, g, or t
  misc_feature (1120)..(1120): n is a, c, g, or t
  misc_feature (1123)..(1126): n is a, c, g, or t
  misc_feature (1128)..(1129): n is a, c, g, or t
  misc_feature (1132)..(1134): n is a, c, g, or t
  misc_feature (1139)..(1143): n is a, c, g, or t
  misc_feature (1146)..(1152): n is a, c, g, or t
  misc_feature (1154)..(1157): n is a, c, g, or t
  misc_feature (1160)..(1161): n is a, c, g, or t
  misc_feature (1164)..(1165): n is a, c, g, or t
  misc_feature (1173)..(1174): n is a, c, g, or t
  Predicted polypeptide sequence is orthologous to G1911
tgnnatgntgttttganccctattnaaccctcactaaagggaacaaaagctggagctccaccgcggtggcggccgctctagaactagtggatcccccgggctgcaggaattcggcaccagatcagggcttctgaagtgcanaaacttcagcgctaactgagctcggtttccgagaaacatactaccaattccgatccaggttgagatgtcagggagctcatcccgcggcggcgacgacgcggcgtggagcgccaaggagaacaagctgttcgaggaggcactcgcctaccacggcgagggcacgcccgaccgctggctcaaggtgtctcgcgccatgggcgggaccaagacggccgacgaggtgcgccgccactacgagatcctcgtggacgacatcaacctcatcgagtctggcagggtcccgttccccaagtacaaggacaactgattcctcatggagcgaagcatctgaattctgaagatccggcaatcaggagaacctgtttataatctagtccttagttgggaccatgttactgaagcaataaaaagaagaaaacatgtgtgtgtgtgtgtttgtttgtgtgtgtgtgtgtgtgtgtgtgtgtgtaattttaggtttgtaagcaaatcaagtgcgcctagtcttgcatacagtaccatgtaatttccgtgcctatacttagcttttactccttcagtcctctncaatatgntttggagtaaacatcantggtgnaaatccccggnacttgnttgcaatggttatgaacccntgcttgtacaatatacatgctttgctaaaaaaaaaaaaaaaaaacttnagggggggcccggncccaaattgncctatagggagncnnnttncaattaatggccgnnntttacaangnnngaattggnaaaacctggggtncccaanttaannnnctttgnnnanatncccnttttnncannttggngnaatancaaaaggncccnnncnnatgncnttncaaaanttgncnancntnaangnnaanggnnaantntaannntaaantttngtnaaaanncnnnnaaaatttnnnaaaannnnnnnntttttaaccaannggccnaaannggnaaaanccctttnaannnnannaannnccccnnnnnggnnnnnnntnnnnccnnttnnaaaaaaann

SEQ ID NO: 2283 - DNA, 690 bp, Triticum aestivum
  Predicted polypeptide sequence is orthologous to G1911
ccacgcgtccgccaaagcttctccaagagcaaaggacttcctcaattccacaggagcaccccaggcacaagaaagtagtgttattagttcgagtagaacatcacatctcacctgaaagatgtcttccgggtcgtcgtctcggagcacctccccgagctcagactcggagtggagcaaaaaggagaacaagatgttcgaggaggcgctcgcctactacggcgtgagtgcccccaacctctgggagaaggtggccagcgccatggggggcaccaagtccgccgacgaggtgcgccgccacttccagatccttgtcgatgacgtcaacagcatcgagcatggccgcatcccattccccaagtacaagacccagggcttctggaccaaataaaaggatcgatgaagcagtgtaagctccagtggacagtgaacaaagttctagaaaatagatctcttaagaatgggctgatgttctaggaggaagcaagggtatccagcattggttagaataacaggaaggaatagagtattgtctattgtgtggacaaagtattgttaggccctgtccaaggttaagtcttttagattctcgtctacattcatgaaccggatgttgttcattatctcctcgaaccaagtcgtcaaataaaatgtcatgtaaactcatgtgtttgtgttatttgtagaagttta

SEQ ID NO: 2284 - DNA, 1068 bp, Triticum aestivum
  Predicted polypeptide sequence is orthologous to G1911
gagccaaagcggccgcccttttttttttttttttttttttttttttttcctttttttatttttttttttttttgtttgttggcatcatcatcaatttcttttctctttggatgggtagggacatattgttacatgtgcagacaatataaatattgtacattaaaatacatacgaaataagttaaacccatgcagcaaggaaacaggacgatcccgccataaaccacttgctactgaagtattatgaacatgcatgcatctgcatagccttgcatgggtacgttgacttggacaccatgcacgaaacttatctcatgcacatgcacatgcttccagttccatcgatctatgtggggtgtatcattcattgtccattgccgcctaaatcttcaagtgcttcaacctgtcggcctcgtaaccggcgttgtggcccgggcctgggcagggggaacggtaggcggggaaggccaccttgccggcctcaatgcgggcgatgtcgtggacaaacagctcgtaatagcgtttgacatcgtcggccgatttgccgccaccaacggcacgagcgacgttgtgccagcggtcgggcgtgtcccggtcatgcactggcagtgcctgctcaaacagcttgttctgttggggggtccatccagccctcccggccgggctcattgacagcgacgccattgctcgatctacctagctgggattgggcttatgatgttggtaccgtgaacccgttggttgcacagggctgcttctgaaatggattttcaactccttcagtccatggtagtgtccccgggtcccaatgccccaaccttccggggagcgtgggttaacaaattcccgggaaatcccgaacgggacccacctggttttttggtaaaaaccgtgtcctaaaaggccccccaaaaatggccaaagggccaaaccggtccccggggtgaaaattggaaacccccccccggcccaaggctaaaaatcccggggggtggactcggcccgggttttttttatggggggcaaacaacgcgggggatgggttcctcaggggaattgggacggttcc

SEQ ID NO: 2285 - DNA, 1141 bp, Triticum aestivum
  Predicted polypeptide sequence is orthologous to G1911
tgcgacccacgcttccgcccacgcgtccggactggagcacgaggacactgacacggactgaaggtagtagaaaaccaaaccaaaccaccagcgcttctacaagagcaaaggactacctcacttccaggagagcaccccaggcacaagaaagtagtgttcttagttcgagtggaacatcacatctcacctgaagatgtcttccgggtcgtcgtctcggagcacctccccgagctccgactcggggtggagcaagaaggagaacaagatgttcgaggaggcgctcgcctacgacggcgtgagcgcccccaacctctgggagaaggtggccagcgccatggggggcaccaagtccgccgaggaggtgcgccgccacttccagatccttgtcgatgacgtcaacagcatcgagcatggccgcgtcccattccccaagtacaagacccagggcttctggacctaataaaaggatcgatgaagcagtgtaagctccagtggacagtcaacaaagttgtacaaactagatctcttaagaatgggccgatgttctaggaggaagcaagggtatccagcattggttagaataacaggaaggattggagtattgtctattgtgtggacaaagtattgttaggccctgtccaaggttaagtctgttagattctcgtctacattcatgaactgcatgttgttaattatcccgtggaaccaagtcgtcaaataaaatgtcatgtaaactcatgtgtttgtgttatttgtaagaagttgtacctgtagcaaaaaaaaaaaaaaagggcggccgctctagagtatccctcgaggggcccaagcttacgcgtacccagctttcttgtacaaagtggtccctatagtgagtcgtattataagctaggcactggccggtcgtttacaacgtcgtgactgggaaaactggtaccttgggatctttgtgaaggaaccttattcggtgtgggacataattggccaactacctacggaaattaaggcctaagggaaatttaaattttaagtgtttatgtggtaactagctgcattgcttgcggttgaaagtttgcctccgggtttattttgaaatttttacccggagcgggggcctattggtggggtttaaattcaagcccag

SEQ ID NO: 2286 - DNA, 832 bp, Triticum aestivum
  Predicted polypeptide sequence is orthologous to G1911
acgctatgacattaggcctatttaggtgaactatagaacaagtttgtacaaaaaagcaggctggtaccggtccggaattcccgggatatcgtcgacccacgcgtccggcctgagccgatgcccaaaccaggtccaagcatccaagcatagttcaggtcataacttaaggtatataatagcagctgattgatcaaggaaccaatagtcgagtgacatccatggcttctctgtcgatgagcgcggggtggacgccgaagcagaacaagctgttcgagcaggcgttggcggtgcacgacagggacacacccgaccgctggcacaacatcgcccgtgctgtcggggggcggcaagtcggcggacgatgtcaggcgctactacgagctgctcgtccacgacatcgcccggatcgaggccggcaaggtgtctttccccgcctaccgtccaccatgccccggccccggccacaacgccagctacgaggccgacaggttgaagcacttgaagatctagctaggcggtaatctggtaatggccaagggatgatacacaatacacagatggactgaacgaagaagcatgtgcgtgcatgggggtaccttgtaatactcataagcgtgtgcatggtgtccatgactccatgtcaatgtatacatgcactactagccggcagaaaagttggccgattatgcagatgcatgcatgttcataatactctagtggctagtggtctataagtatgtacgtgagatttactcacatgggtttaacttatatcctatgtatctaatgtacaatattaataatatcctttatattataaaaaaaaaaaaaa

SEQ ID NO: 2287 - DNA, 833 bp, Triticum aestivum
  Predicted polypeptide sequence is orthologous to G1911
aaagctatgacattaggcctatttaggtgaactatagaacaagtttgtacaaaaaagcaggctggtaccggtccggaattcccgggatatcgtcgacccacgcgtccgcggagcttcggaagtgcaaaaaccatcagaaaaagcatcagcgctagctcggtttccgatccagttggagatgtcttctgggtcaaggagcgcatcccgcggcggcgccaacccggagtggagcaagaaggagaataagctgttcgaggaggcactcgcctactacggcgagggcacgcccgaccgctggctcaaggtgtcccgcgccatgggcgggaccaagaatgccgacgaggtgcgccgccactatgagatccttgatagcgacatcaagctgatcgactccggcaggctccctttccccaagtacaacacccagggccagggggcttggaactgattcatcaatcaaggagaaaagcttctgaattctgaagatcctgcaaacacgataatctgttcataatcaagtccttagctgggaccatgttattgaagcaagcataattatgtaccgtaaaacaaagattatgagcacttggttaggaataaaagaaaaaacatatgtgtgtgtacataatattaggtttgtaagcaaatcaagttcgcttggttttgcagacggaagcatttatttttcattgtggaacagaatactcctccccaataagttttggggtaaacatcattggagtaaatccccagtactctccgtactccctttaagaaattggggctcaaaaaaaattcatgtttggtcaaaaaaaaaaaaaaaaaaaaaaaaa

SEQ ID NO: 2288 - DNA, 805 bp, Triticum aestivum
  Predicted polypeptide sequence is orthologous to G1911
gcaggtcggtaccggtcccgaattccctagatatcgtcgacccacgcgtccgcggacgcgtgggcgactggagcacgaggacactgacatggactgaaggagtagaaaatccatctcagaagcagccctgtgcaaccaacgagttcacggtaccaacatcataagcccaatcgcagctaggtagatcgagcaatggcgtcgctgtcaatgagcgcggccgggagggctggatggacgccgcagcagaacaagctgttcgagcaggcactggcagtgcatgaccgggacacgcccgaccgctggcacaacgtcgctcgtgccgttggtggcggcaagtcggccgacgatgtcaaacgctactacgagctgctcgtccacgacatcgcccgcatcgaggccggcaaggtggccttccccgcctaccgttccccctgcccaggccccggccacaacgccggctacgaggccgacaggttgaagcacttgaagatctaggcggcaatggacaatgaatgatacacaccacatagatcgatggaactggaagcatgtgcatgtgcatgagataagtctcgtgcatggtgtccatgtcaacgtacgcatgcaaggctatgcagatgcatgcatgttcataatacttcagtagcaagtggtctatggcgggatcgtcctgtctccttgctgcatgggtttaacttatctcgtatgtattctaatgtacaatatttatatcgtctgcacatgtaacaatatgtccataccaatcaaaagagaaaagaaattgatgatgatgcaaaaaaaaaaa

SEQ ID NO: 2289 - DNA, 673 bp, Triticum aestivum
  Predicted polypeptide sequence is orthologous to G1930
tttttttttttttttttgctagaattgctcttagtttcgtccaaaagagcccaaagtagctaatacgcactacatttcgaaataatgccaaaaaacctatgcgcattacatagaggaacggagggagtaactgcttggggaatacacaataccaattggtgtagcaaaaccaatcatactcgccaatgtcattgcctcttgaacaactccagctccgctggcgccgctagccccctcatctctccggcgaggtcgacgccgaacagcctcacgacacgggcttgttctcctttgcccgtctccaccaccggcggcggcggtgacgccgacgcgccgctgttcaccgtcgtggtcttcttgtagtcgatgtagaactgcttctcgtggccgtactctgagcaggagaacacgacgacgtcgccggcgacgaggcccttctcccggacgaagcggctccagcccttggtgagcacgtagctctggctgctgttccagtacgagtacctgaaccgccacaccttcccctggccatcctcgaagttcagcagcacggccttgtcagcggtggtcgttgtctccggcgcgcgcttcagggggatgtgcttctcggcgtgctgcttcggcaacacgatgcgattcagcttgccgacgtcgctcggcgtcagcaccttct

SEQ ID NO: 2290 - DNA, 746 bp, Triticum aestivum
  Predicted polypeptide sequence is orthologous to G1930
cgcagccgacgccgtcgtgggcacgggagcccctcttcgagaaggccgtgaccccaagcgatgtcggcaagctcaatcggctcgtggtaccgaagcaacacgccgagaagcactttcccctgaagcgcaccccggagacgacgaccaccaccggcaacggcgtgctgctcaactttgaggacggtgaggggaaggtgtggaggttccggtactcgtattggaacagcagtcagagctacgtgctcacaaagggctggagtcgcttcgtccgtgagaaggacctcgctgccggcgactccatcgtgttctcgtgctccgcgtacgggcaggagaagcagttcttcatcgactgcaagaagaacacgaccgtagacggcggcaaatctgcgtcgccgctgccggtggtggagactgtcaaaggagaacaagtccgcgtcgttaggctgttcggtgtcgacatcgccggagtaaagagggtgcgagcggcgatggcggagcaaggcccgccggagttattccagaggcaatgcgtgacacacggtcggcactctcctgccctaggttccttcgtcttatagcatctgcacatacacctatatatttatacttttcctcccttttcttcttgttgttaaatgatatatgttgatcctgttcatgaattagataaattctctgtagaactcaattttcaagtcggattgcaaaatgagttgtaataaaaaaaaaaaaaaaaaaaaaaaaaa

SEQ ID NO: 2291 - DNA, 1470 bp, Triticum aestivum
  Predicted polypeptide sequence is orthologous to G1930
gcacgaggctagcttcagcttttagctaagctctacttccctcccgagctaagcatcttcttgatttctcggtgatcggattcggatggacagcgcaagaagctgcctcgtggacgacgtgagcagcggcgcgtccacgggcaagaaggcctctccgtccccggccgcgccggcgaccaagccgctgcagcgcgtgggcagcggggccagcgcggtcatggacgcgccggagcccggcgccgaggcggactccggccgcgtcggcaggctgccgtcctccaagtacaagggcgtggtgccgcagcccaacgggcgctggggcgcgcagatctacgagcgccaccagcgcgtctggctcggcaccttcacgggggaggccgaggctgcgcgcgcctacgacgcggcggcgcagcgcttccgcggccgcgacgcagtcaccaacttccgcccgctcaccgagtccgacccggaggacgccgccgagctccgcttcctcgctgcccgctccaaggccgaggtcgtcgacatgctgcgcaagcacacctatcccgacgagctcgctcagtacaagcgcgcctacttcgccgccgctgcggcgtcctcccctacatcgtcctcggtgcctcccgcctcgtcgccctcttcggcggcttcgccctcgccggcggcgcggcgcgagcacctgttcgacaagacggtcacgcccagcgacgtggggaagctgaaccggcttgtgataccgaagcagcacgccgagaagcactttcctctccagcttccttccgccggcgccgccgtgtccggcgagtgcaagggcatgcttctcaacttcgacgactcggccggcaaggtgtggaggttccggtactcgtactggaacagcagccagagctacgtgctcaccaagggctggagccgctttgtcaaggagaagggcctgcacgccggcgacgccgtcgggttctaccgctctgcctcaggcagcaaccagctcttcatcgactgcaagctccggtccaagaccacgacgatgacgacgactttcgtcaacgcggcggccgccccgtcgccggcacccgtgatgaggaccgtgcgactcttcggcgtcgaccttctcacggcgccggcgccgagtcacgcgcccgagcacgaggactgcagcatggtgcccaagacaagcaagagatccatggacgccaacgcagcggccactccggcgcacgcggtctggaagaagcggtgcatagacttcgcgctgacctagccagctagcgtttttcctccatggttgctttgcttgcctccaaatttccatgttagtagcttagagctcttgatcggtccaagtgtttgccttttttttcctcttcttctcatacacaagttagctctaaatccagtcttctttaattaatctactgtaaattaagcccgttctcgaaaaaaaaaaaaaaaaaaaaaaaaaaaaaa

SEQ ID NO: 2292 - DNA, 611 bp, Triticum aestivum
  Predicted polypeptide sequence is orthologous to G1944
tttttttgatacatgtaaatttttaactattggcggcatcgatcagttcagttcagttcagttcacatggtgtataaatttccaactatttgaattcctccgaatttctccgcacgtttgcagagccctgagagcttctgagcagggctggctggctggcgagctctcctcctcttcaccctccggagacggggaccttggccgcctccgacgacggcgtcctcctcgcctcggctgcgggcggcgccgatgccaccggctgggcggtccagttctccaccctgaacgctgacgcacccttgccggcccgtgcctggcttccgctgtacgagtcctccatgtcgccgccgctggagatggtgaaccccatggccggctgcgccgccaccgtcttcatctcgatcaccggcttcttgccgttctgctccatctggtagctcggaaggaagcttcccaccacaacctgaaccgggcttgcggcaacaaggaggccagtcacgccgcctccgatgacgcggccatcggcggtcgccctttctttttttttttttttttagacaaggctgaacccaagcttagtgcgagattcagtaccctaattagcaaggtca

SEQ ID NO: 2293 - DNA, 826 bp, Triticum aestivum
  misc_feature (5)..(5): n is a, c, g, or t
  misc_feature (575)..(575): n is a, c, g, or t
  Predicted polypeptide sequence is orthologous to G1944
cacangctattagatatatggctatctaggtgactagattgaacaagtttgtacaaaaaagcaggctggtaccggtccggaattcccgggatatcgtcgacccacgcgtccgcctttcctccaaaatttcacatcgcacgcaaccttctctcgtgccgccgccgccgccgccgccgcctcttctctcccccgattctcctcgcgactgctccgagcccctcctcttccctgtgtcggctgctcgacgcgccaccgctgcgggagaaggtgaacacgaggagatgcagggtgggtggcctcgccggaagagggtgacgccgggaaccaccggctggccaaggaccgtgtgggctggcacttccccgcggcgccctccttccccgacttcgccgtcgccactgccccctcccctcctgtcaaggctgagcgtgcacagagtggacgagtcgatcgcggcggaaccagagtcactcgaggccggggtgcgagatgatgtccagcaggcggaggggtggccatgggaggagtagcccacaatgaaatccattttctctttgtgtgtgtgtgtgtgtgtnggatttggatcgaggaaggggatggcgtggggatgaggcggtggacagaggaagagggcgatgctggctggctgagcgggcggatctggtctcgtttgttctgtagagcgggcagaggagcaggccaacataacaccaacgtggtgagctttccctcctcccacatctacccccagatctgaacatcaactacaatttgtacgtttgggtatctctattcagttatacaattcgtttgggtaactctgctg

SEQ ID NO: 2294 - DNA, 1128 bp, Triticum aestivum
  Predicted polypeptide sequence is orthologous to G1944
cgccgacccacgcgtccgcctctggcggcacgttaacttatgagggacgctttgagttgctgtccttgtctggttccttcatgccaactgaaaacagtggcgcacgaagtcggtcaggtggaatgagtgtttctcttgccagcccagatggtcgtgttgtcggtggtggagttgctggccttctggtagcggctagtcctgttcagattgtcgtgggaagcttcctgccaagctatccgatggaaccgaagcagaagaaggcgagggtggtcgcggcaccaatccttagccaggcaccccctgctgttcagctctctagtgcggatacgcacagcagcgagcaagggcagcacagctcggccgccccaagaatgaacgtcgtaacttcttcagcgtacagcgcagaccagaactgggcatccaccgttgttcagtcggctcctgccgaggcatcaagaagcgcatcgtcgggcgatctgaacctcactgcctctggatcctgaagcccatcgagccaaacccgaggaattcatccacagagtctctgtgtggtgcatttcctttctgacatgtaaaagatgtatccactaggttggttttcaaaaaccccactaggttttctgtcgggcagctcaagagtctaactgcatttgctgtagctatgtgacgttagtacctgtcgatcttgttggacattgtgtagctacactctattgttagtgtgtcttagcctcttaggcctacttcatctgttggattacatggattaattttgagttagagtttttctcaaaaaaaaaaaaaaaaaaagggcggccgctctagagtatccctcgaggggccccagcttacgcgtacccagctttcttgtacaaagtggtccctatagtgagtcgtattataagctaggcactggccgtcgttttacaacgtcgtgactgggaaacctgctagcttgggatctttgtgaagaacttacttctgtggtgtgcataattggacaactactacggagatttaagccctaggttaatataaattttaagggtttatgggtaaactaactgctttgctggcggttgaaaatttgcttcctgggttgatttggaaaatttttcccggcgccta

SEQ ID NO: 2295 - DNA, 889 bp, Triticum aestivum
  misc_feature (563)..(563): n is a, c, g, or t
  misc_feature (614)..(614): n is a, c, g, or t
  misc_feature (644)..(644): n is a, c, g, or t
  misc_feature (662)..(662): n is a, c, g, or t
  misc_feature (691)..(691): n is a, c, g, or t
  misc_feature (736)..(736): n is a, c, g, or t
  misc_feature (850)..(850): n is a, c, g, or t
  misc_feature (863)..(863): n is a, c, g, or t
  misc_feature (872)..(872): n is a, c, g, or t
  misc_feature (874)..(874): n is a, c, g, or t
  misc_feature (876)..(877): n is a, c, g, or t
  Predicted polypeptide sequence is orthologous to G1944
aacagctatgtacgatgattacgccacgctatttaggtgacactatagaatactcaagctatgcatccaacgcgttgggagctctcccatatggtcgacctgcaggcggccgcactagtgatttgtcgcggccgaggtgaatgatctcaaaaaccgaatgggctattccaaagtatacatttggtattctttttgggaacagaaaaatctctcaagagatggaagtgtcgacaaatatgagctatcctctagaagagttgatatcaatgttggaacttcgtgtgtcaaatatcccagagctaggccaccctcccgtcgatacaacggagggcggcgacgttaggttttggttatgtcctgagctgggcgacaccacatctggcccagcgccggtgagcgagtcgggaccgaaagccggtggtttcgcggctttcttggactttgatttggatcctccttgcacaaaagtccctagcaccacctgcacagtactggcagccaccaatgctccacccaggacacctccaatgacatgcctctccgggctgcagagcgtgacgctnatcccgtcggtttgattttgctggccctcgttcggattgtaagagccggantaactcaggatttcatacaatccctcgtanatggcagggttattgtangaaggaggatgatctgccgggtggcgcangacgggcctggagacggaccccatcgctgagagcacgcacaccgncctcggtggctggctcgcgaatgccgcgatcttcccgcgacgtcctctgaaggagatgctgtgatgatgtgggggagtaaagctcgtccagctgaaccaaggaacgcattgccngagggttactgcntgggactcngncnnggacacgctatc

SEQ ID NO: 2296 - DNA, 692 bp, Triticum aestivum
  Predicted polypeptide sequence is orthologous to G2052
gcgggggccgcgggaccgcaagtaccccaacgggtcgcggaccaaccgggccaccaccacggggtactggaaggccaccggcaaggaccgcaaggtgtcgtgcgacggcggcgccgtctgcggcgtcaggaagacgctggtgttctacaagggccgggcccccggcggcgagcgcaccgactgggtcatgcacgagtaccgcctctgccaggacctcctccacggcgcctccaacttcatcggcgcctacgcgctctgccgcgtcatcaagcgcaccgaggccggcctcctgcacggcgacgcggttgccaaggccaagccgggccaccagcagatgaccaaggttgggagcagctcctccctggtcaccacggaccagcagctgagctccctcacgcccagccctccgcgcctcgacatcgtcggcaacgccttccagcttcacagctccccctctcccctgtacggaggggaggtgatgtccggcatgggtgcgcccctggggttcccgcagcaggacgccgccggcacattcttcatcgacggcgacctcgccggcgcaggcgagacgacgcaggcgcacatgcctttcttcgacgacatgggcgtggtctcggaccacgagctcagatgggacaccttgccgctctgcactaacaacaccttctccttcaccgccggcgccgcggagc

SEQ ID NO: 2297 - DNA, 539 bp, Triticum aestivum
  Predicted polypeptide sequence is orthologous to G2141
ccctggtgccaagctgcaacaagatcaccggcaaggcactcatgctcgacgagatcatcaactacgtccagtcgctgcagcgtcaggtcgagtttctgtccatgaaattgtcgaccatgaatcctcagttggagctcgacgagcagcacatcccgtccaaagagatgaaccagatggcagtgcccggcttctcctacgccggttcacccgtcgccgtcgcgaccggccacggccacggggcagagctagaaggcaccttcagctgggagcatgacctccagagcatggtgcagatggggggagccagcagcagccataggcaggacccccaagctttctacggcgagtgaaatactaccaatcacctttccttggttgcttcatgtcctgaaaacggccggttctcgattctgtgctgaggttgccctgtctggcccgttccatgtcattgaatgcaggcagtggccagccggcgactacagtaaatacatgaaggttgaaccaaaaaaaaaaaaaaaaaaaaaaaaaaaaaaaaaact

SEQ ID NO: 2298 - DNA, 745 bp, Triticum aestivum
  misc_feature (26)..(26): n is a, c, g, or t
  misc_feature (711)..(711): n is a, c, g, or t
  Predicted polypeptide sequence is orthologous to G2141
gtggggctgctcggccccctttttcngttccagccccgaatacaacaagaacacgcccgatccatccatggatcgatttacacacggccacgcacgcacggcgcagttaaaggctccagctgtgcactgcacgcacgcacgcacgggcggcagcagcttcagtggtcatattgctcgtgcatgtggcctctgctctgctgcccgtcccgttggcggtcagatgattgatggctaggcctaggccagctagctggacaaacaaactcgggccgggtggctcttcaggaggctggctggcgatggcatcaatcacatttggtaggcgtcctgggacggcctgatgctgaggtcctgcgagtgcgagtgcgaggagcccatggacgggtacgccatctgcgcaacgtgatcgctgaacgggccattcaatgcgtgggccatctgtgaatgggatccatcttttgctcctagttgcgcttgcatgattcttctgaacacgtccgagttcgccatggcggcggcgcctccctgcatcagccccggctgcgacagctgcagctgcgggtgcatcatctccggggagaatcccatcgacgaggaggacaccccagggaagcgaagaagatcctttgagagaagcccttctatgttgaggtcaagcctcgggtttactgtcgccagcttcatcgataagaactcgacttgtctttgcanggactgaacatagttgatgatctcgtcgagcatc

SEQ ID NO: 2299 - DNA, 998 bp, Triticum aestivum
  Predicted polypeptide sequence is orthologous to G2141
gggcggatgcgacgacccacgcgtccgaaaacgatattgagacgtctagggagatgaatgtggaccaaggttgaaatggtgcattattgagcggtgataggcagcaaggagacaccgagagttcacatggtgttgatgcctctagcaaggagttaagcaagccggagtgcagtggtggcgctggtcaggatgaagggcctagtgtctcttgtcccaagaagaggaaaagaccaagccaggatcgtggggtgaagcatgtacaagaagggagccagcaattggcaactctggctgcgaagcgggagaaagatgacgacgacaaagatgaaccaaagaggcctgttgggacatccagaaagtccaacgggaagcaaactgaggataaatctgatgcgccaaaggaagattacattcatataagagctcgaagtggccaggctacaaacagccatagtcttgcagaaagggttcggagggaaaagattagtgaaaggatgaaatttcttcaggaccttgttcctggttgtagtaaagtcattggtaaggccgttatgctggatgagataatcaattatgttcaatcattacagcggcaagttgagtttttgtcgatgaaactttcagctgtcaatccagcactagacttcaacatagagcgcattctatctaaggatttatttcagtctcaaggaactgcatcgtctacctttggcttcttaccagacattggccatcaatttttgcatccaccaaaacattctcaagctgcgttgcacagcattgtaaatcccgccgatgcatttggaagggtaacaaatgctccggtaggatgtacattcaaagaaggcacacatcaggtgcccaataaatttgatggagagttccacaacgtgattgggatgcctttaccctgttttatgaccatgattcaaatgataaacctgagcaatagatccgcaaccgaagcaagaatcataacgggccagagattcaacgaa

SEQ ID NO: 2300 - DNA, 836 bp, Triticum aestivum
  Predicted polypeptide sequence is orthologous to G2141
agcttgacattaggcctatttaggtgacactatagaacaagtttgtacaaaaaagcaggctggtaccggtccggaattcccgggatatcgtcgacccacgcgtccgcgggaggaagcagggcaaggacggcgcctccaagctcccggagccgcccaaggacttcatccacggccgggcccggcgcggcgaggccacggacagccatagcctggccgagagggtgagaagagagaagatcagccagcggatgaagctgctgcaggacctcgtgcccggctgcaacaaggtggtgggcaaggccgtcatgctcgacgagatcataaactacgtgcagtcgctgcagcggcaagtcgagtttctgtccatgaagctggccacggtgaacccgcagctggacttcaacaacctgcccagcctcctcgccaaagatatgcagcagcagtcatgtgggcagctgcagcagggctcgtcgcatttcccgctggatgcgtcgggcgcgccgctcccctacatgggccaggggagcggcgaccctctcggctgcggcatgtccgacggcggcggcatgggcgacgatcagggcgccatgcaccccggtggaccaggccttctgccggcccatggggttcctcgcagcagcagcagcacttcctcagcgacgccgcctctcaggttgggggctttctgggcagatctgcagagcgtggttcagatggacatggggcagaaccaggagatcgccacttcttccaacagctacaaacggtcgttgcaaacggccaacatgaaatggagctttgactcaccggcggggagaaactccatccgaccggaa

SEQ ID NO: 2301 - DNA, 811 bp, Triticum aestivum
  misc_feature (29)..(29): n is a, c, g, or t
  misc_feature (649)..(649): n is a, c, g, or t
  misc_feature (661)..(661): n is a, c, g, or t
  Predicted polypeptide sequence is orthologous to G2226
ccccgcggtattagatataggcctacctnaggtgatagattgaacaagtttgtacaaaaaagcaggctggtaccggtccggaattcccgggatatcgtcgacccacgcgtccgccaccacaccgcagccgctcagaccgccccgcccccgaaagaaggcgcaaattgcagacgggtccacggatcgatccccaatcccaatcttcccggccgccgcgatgggcatctccagcatgccggcgcccaaggagagcctcctgatctacctgctctaccacgccgtcgtctcgatcgccgccctggcgggcctcctccgcgccgcgctcgtcttcctcggcctccccgcgccgccctcgctgctggccggcgaggacgccgacggcgccgaccagctcacggcggccaccccggcgggccccagcctggcggagcggttcaggagcaggttccgccccgcgcggttcggccggagaaggggcgcggcggcgtcggcgacacccgactgccgcgtctgcctggtgcggttcgaggccgacgccgtggtgaaccggctcccctgtgggctgctcttccaccgcgcctgcctcgaaatctggctggactacgaccacggcaactggccggtctgttcgtcttggcttctcccgggncggcgcctccgncggcgacgaatcgtggtctgcgccgggggccaccctgaacggcctggattttgagaagacgagcgaagagaccaggaagagagagattccgcccgtccgcgtccccccgggctatgtgttagctcccgggtgtgggcgtctccgggttga

SEQ ID NO: 2302 - DNA, 1106 bp, Triticum aestivum
  misc_feature (637)..(637): n is a, c, g, or t
  Predicted polypeptide sequence is orthologous to G2251
acccacgcttccgcgactggagcacgaggacactgacatggactgaagcgagtagaaagattttagcttagatcaagtacatatatcctctgttcctcccccgcaaacgatagacaggcctggccggcgcagcctgtgacgttcgagctcccgccgggcgtccacgcgtcgtctccggccatggggttccccctggtgtgctactgcgttgccatccccaagccggtcatcgccttctgcaagctcgtcgccgccgtcagggacgccttcctcctgctgctctccctcgtcggcctctgccgctccccgcgccgctccgtggacgacgccccgctgcccgaggaggtcaaggagcgcctcccggccgtcgagttctccttgctggcgcgtccggcaaagcaggggtgccacgacggggacgacgacgtcgccgccgcggcggccacgtgcatcgtgtgcctggagaggctgcgggcggcggacgaggtgcggcggctgggcaactgcgcgcacgccttccaccgcggctgcatcgacgggtggatcgacctcggccggaccacctgcccgctgtgccgctcccacctgctgccccgcgcgcggagggacggcccgctcgccagcctcctcacgcgcngttggtgacgaccaaccgcgccactcgttagctcggaagccacgtctttcgttgtcccagcgcggtggcggccgacacagagaatcgcgatctcgaccgggtgcacgtatatttaaaaatggtgggtttacattcgtctcaaaatcggggatttattttagtttagggcgccaatttggtatagcccatccactcaagaaggcacccaataagggccccaagccttagtttttttttccgtaaagaaggatttagttggtcccaaatatatccccgggccgggtttgggctaagtggatcctcgaaaatgttaaacagcccccaaaagccattttcgctggttcgaaattgtaacaatcccaacccggggggaactcccaacgtaaaaagtgggtattaacccaaaaccccttatggcttcaattaaaaaaaaaaccttggagggttgtgttaaaaaaaaaacaaaaag

SEQ ID NO: 2303 - DNA, 436 bp, Triticum aestivum
  Predicted polypeptide sequence is orthologous to G2346
ttttttttttttttttttttttgaaaatcaaaacaaattaatcgaccaagtcctgcgagtcagatttcatggctgaccatcacagagggccaatttctgggttgaacaagcgtacaaaatggaagaattcgttacaaagttgaccattacaagggcacaacccatttctgcatcacagccaccggaacgtaatcatagatacctgctcaacaagtacatcacagtagcatacctaaccagataatcatcttatgtgctgtgaaagatcaactccatcatgtccaccaccaatttctatttctgcagtgtagacactttcgaatggatgatagtgagaaagggttctggtctcaccaagtttcttgaactgcaaagactcaagattgaccataaagaggacaccgtgtgtccacacaaacaccacattattctcctc

SEQ ID NO: 2304 - DNA, 678 bp, Triticum aestivum
  misc_feature (13)..(13): n is a, c, g, or t
  Predicted polypeptide sequence is orthologous to G2520
gtcgcttcctttntcttaagaatgataccgctacagaaatcctggaatacatgaaggttgcgaatacatgaggaacagtcctgaatccgaaggtcaaaacaaaaaggcaccgtgctcggcggttctctctaaatacatgtctgacgtctctaccggcaattacagctccaaaaactatgaataaaaccgcatttggaacgagatggtggcgcaaaaaaaaatgatctacggtatgaaagtgggggttgcttggccgaggattcatggcacgctttgttgggcgccaccctggacttttgttctgctcacgtcactctttcgtaggtgccaccaatctgcatgtgaagccattctgcagccggcgagccctgggcgtactcccttggtgtttgcgggtcaaatgttaaccctggagctgtgttgtatgccggcgcagcgaagtctttagttggaaatgtttcaactccgttgtgagcatgggcatgggcgttaaccgcctcgagcttcatggacaggaactcaatttggcgttccaaagcttggacataattgattatctcatcaaggactgatgctttcccaataaccttattacatccagggacaagatcttggagaattttcatccgctcggttattttctcacgccgtgccctttctgcaaggctatggctgtca

SEQ ID NO: 2305 - DNA, 381 bp, Triticum aestivum
  Predicted polypeptide sequence is orthologous to G2574
attcggacgaggccgaccaccgccgcgacggcagctgcagcatcatcacgattccctccctacgttgttacgacgcaaggcccggcgggctgggttcagaagaatggcttccattcgctggccaggcccacctagtagaccaagaactaccacgacccaggcgttcgttcaccgatcgtcttccacggcagagccatcggtcgatcatttgatttgacccaagggcaaaaggagtcctcgaaccactgcacggcggcgacgttaaattttactgccggagaaaacccccccgctttctttccctttacccttgttctgtgttcttgattgggtgagacatggatccgaggatggatggacctgtaaaaaaaaaaaaaaaaa

SEQ ID NO: 2306 - DNA, 611 bp, Triticum aestivum
  Predicted polypeptide sequence is orthologous to G2574
ttttttttttttttttttttcccaagaaaaatgcttaccacttggtgctgtcaccagctacaaactctcatgtggtcggatgttaatgaattacacaagtggcaggctacgtacactgaatttatttacagtgacaacacacatctacaaaggaacacatattcagagtatagatgttgctgccgccatgacaaccatttcttttttggatcaaagctagctagccagtatctgaagatacaatctcggaatacagtttctcccttcttctgcatgcatgcagaaatgcaacgcaagaaagacagtggagcagagcattatactgtgtgaatgtaccagttggatgtaagatatcggggacgatgagtcgtcggccatggcggtcgaaaagcacacaccaagccacctaattaacttgttcgtcggcgcacatggagcagataacagacggtagtagcttccgcagctcactcaagaaccactaacttcagacttgacagtaaagaacaatacacaaaaacgaacctgcatggcgtgctgcggatgaatcaggtgagaagggtgccgatagggctgcaaccacattgtccttcttccctcctctcagcgca

SEQ ID NO: 2307 - DNA, 1066 bp, Triticum aestivum
  misc_feature (39)..(39): n is a, c, g, or t
  misc_feature (815)..(815): n is a, c, g, or t
  Predicted polypeptide sequence is orthologous to G2574
cggtatccgtgcgacccacgcgtccggggggtgatcacncaaaagttatagatctttttagcacaaattgttccggtagtttcaataggcgtagtgaagcttggtgtagacaggtagaggttcctcctgttacagatgctcgaagtgcatgcagatacagaaatgctatgatggattatgccaatgtaactgttccaaaaccaaaagtagctcctgaatccaatgatgaaccaaatggcaggcttaacggctttgctgaagttgatgattttagtgatcaaacgggaagtggccatgacttcagaccttctagcttctcaagtgctaaacattatgaggaccagattgttgatcgtggctttcctgtttcaaagcgtggcgaggtcaataatactgtgaaagcaagagacgtcaaccttaattcatgcctggacacaatatctttcccgattgctagtgcaaacaatcaaacttctactgctgttgatgaggctaatcaatcatccattgctggaaaatgcttcattggcagttttaataataatgatggtgcatctactacatcatcctgttctggctcaaataataaagtatctggttcccttggtggatctaacggatcctctaatgctgccagatgcatcggtggtagttatggtaatgatgctgcagctaacatttttggaaacaagaacaataccatggtgtaccagcctagtttgaacacatgccccatctctcatgttgcaactaatgtggattctcttgtttcccgttcaacacatgcaaagaacagtgacaaagagcgtgcatancatacccaggaaacaatgaataccacacagaacagaggcagtaatgaagctggtgaaggctataataatgatgtctatactggtagtatcactgaaaggagtcttgccagtgtattaataattgagttacccaaaaaccacattctgagccgctgtggactaacggactcaagcactttgaagccagtaatttaccaggggttttggggtcaccggctgaaatggtcttttggttataaaaatttgccaaa

SEQ ID NO: 2308 - DNA, 323 bp, Triticum aestivum
  Predicted polypeptide sequence is orthologous to G2583
tttttttttttttttttttttttttgcaaacgtgtacagatcagaacatatacaactgtccacaaatgtaatacatgataacttgggaggaacatatacaactttcggttactctatacatgacaggcagagccaactattacaatcatcctttggttaattaccgaaccggtccacaacaataagtgcaatggttgtagtcaaaaacaatgggcgaactgggccaagcatctaaaggtcctttggttaaagcaggtctaccctttcacccacagcaagtacttggatattcattacttctccatattcacccaaaaggatac

SEQ ID NO: 2309 - DNA, 459 bp, Triticum aestivum
  misc_feature (209)..(209): n is a, c, g, or t
  misc_feature (257)..(257): n is a, c, g, or t
  misc_feature (286)..(286): n is a, c, g, or t
  misc_feature (293)..(293): n is a, c, g, or t
  misc_feature (303)..(303): n is a, c, g, or t
  misc_feature (322)..(322): n is a, c, g, or t
  misc_feature (327)..(327): n is a, c, g, or t
  misc_feature (345)..(345): n is a, c, g, or t
  misc_feature (361)..(361): n is a, c, g, or t
  misc_feature (365)..(365): n is a, c, g, or t
  misc_feature (372)..(372): n is a, c, g, or t
  misc_feature (389)..(389): n is a, c, g, or t
  misc_feature (407)..(407): n is a, c, g, or t
  Predicted polypeptide sequence is orthologous to G2686
cttgatggcaatgaattaccatgtcaatacatccaatagcgctttgtgggatcacatgccaatggttttccacacctgacctgagccgaaatttttgcaccgtacttccgccatgttaggccgcgtttcatcttttgcttgttctgatagtatttcaaccctttttgtgggaaaagctgatattgggttagatgttgggtatagaagancatagagggaacctggacaaagcatttccggcagcacggccatccttncatatgccctgactttgggtgcattgtgntattaantgggtacctncctttgagcaacccgatgnacctngtccctggtaggtttggnaaactatcctggccangcantaataantattgtgaaagtttaanacaggcaaatccatacanacaggtattaacaaatttgggtattttttttgaaacctggaaaaaaaaaaaa

SEQ ID NO: 2310 - DNA, 868 bp, Triticum aestivum
  misc_feature (5)..(5): n is a, c, g, or t
  misc_feature (30)..(30): n is a, c, g, or t
  misc_feature (663)..(663): n is a, c, g, or t
  misc_feature (671)..(671): n is a, c, g, or t
  misc_feature (685)..(685): n is a, c, g, or t
  misc_feature (693)..(693): n is a, c, g, or t
  misc_feature (737)..(737): n is a, c, g, or t
  misc_feature (749)..(749): n is a, c, g, or t
  misc_feature (769)..(769): n is a, c, g, or t
  misc_feature (783)..(783): n is a, c, g, or t
  Predicted polypeptide sequence is orthologous to G2741
cacangctatttcgatataggcctatccangtgactatgtagaacaagtttgtacaaaaaagcaggctggtaccggtccggaattcccgggatatcgtcgacccacgcgtccgatcccatgttatcccctcgcgtcgtccggccccagcctcacgacggcacggcctccgccggctcatcctcgtcgcggcgccacatggtggaccgcgtgtccgagtgggagctcggcctcccctcggccgccgagctgacgcccgtctcgcagccgctcatcccgccggcgctcgccgcggccttcgggatcggccccgcggacgcgctctcctcccccgtcgacaccggcttcctccacgactcgcccacctcccatctcacatccaggttcgacgagtacgacgaggaggacgaggaggagggggagggcgagaccgacgacgccgccgccggggcgcggaggggcggcggcggcgggaagaaggcgaggatggtgtggacgccggagctgcaccaccggttcgtcgaggccgtggagcacctcggcgagaagggcgccgtgcccaaggccatcgtgcgcctcatgaacgtcgacggcctcacgcgggagaactcgccagccactccagaagtacgactctatctaactcgaggcgctccagccccggngctggcgngccctcgccaccgncaccgccnttcttttcccgcttcgacgtccaacgaccgcatcaagactccgncaccggagcggntactgcgcgtacccgtatgnttctaccagaagcntcgatgcgataagcgcatagtcacatgttgtcgcgttccgactgatcgtgattgtctaaacatgcaccacggtagtcatgtcctt

SEQ ID NO: 2311 - DNA, 884 bp, Triticum aestivum
  misc_feature (643)..(643): n is a, c, g, or t
  misc_feature (652)..(652): n is a, c, g, or t
  misc_feature (682)..(682): n is a, c, g, or t
  misc_feature (814)..(815): n is a, c, g, or t
  misc_feature (864)..(864): n is a, c, g, or t
  Predicted polypeptide sequence is orthologous to G2885
ttacacagctatatcgattgattacgccacgctatttattttgatactatagaatactcaagctatgcatccaacgcgttgggagctctcccttatggtcgacctgcaggcggccgcactagtgatttcgagcggccgcccgggcaggtgggcttttttttttttttttatttttttgatacaaacaaactcttagactgaacaacgatacaagctcacagactaagtaggaacagaagccatggagaaactgtaagcaacaacacatagcttccaaaccttcttgtgacatcagtacacacatctaacataaacataagacgcacaagaaatgcacctgagcaaagcaccaacacatgagatcagctaaccaaatgtcttagaaaccagtcacactgcactccaattccacacactgtttggagcagctgagccaacgagtctagtactctagtcctcaccggagtagtcagattcgctcggctccgacgcatcttcatcctcggactcatcatcttcgctcccagaatccgcgtagactaccgtcaccttcctctcccttactgtccttctcggtgcaaccagctcagcagagctgccggaaggaggagcacctcggccgcgaccacgctaatcccgcggncatggcggncgggagcatgcgacgtcgggcccaattcgncctatagtgagtcgtattacaattcactggccgtcgtttttacacgtcgtgactgggaaaacctggcgttacccactttatcgccttgcagcacatcccccttttcgcagcttgcgttatagcgagaggccnngcacgatcgcctttccaacagtttcgcagcctgaattgcgaatggaccncccctgttaccgcgcataat

SEQ ID NO: 2312 - DNA, 681 bp, Triticum aestivum
  misc_feature (492)..(492): n is a, c, g, or t
  Predicted polypeptide sequence is orthologous to G2990
gtttggtacgtagcattgaggctctacatctggaccactggacgtgacacaaccaacggcgggttcgaggttgtgtgtccatctacgaaagagtggtgtgtaatctttgtcaagcaagtgacatcgtggaggccatggacgtcaagtaccccagcggctctgtcaagaaggtgaggcaggcagctgtggcgccggcggtgcaagaggcgaagtacaacgagtgcggcaggaaccacgcactggctagcggtgggcatgtcgtggacggctgtggggagtggatgcccttgagggacctcaaccccgccgacgcgtcgtcgtacaagtgcgcagcctgcggctgccaccgcagcttccaccgcaaggtgatgacggagaggtcgccgatgttggcgcccatggtggagacagtgctccacggcctgccgcagcgcaggaaggaggagacgccggaggactggctcccgggtgtcgactctgacaccaactcanatggcatgaagtacgactcggatgccacagagtacgactcagaaggcacggagtacgatgacgagcgctccgtgccccaaccactgcaacctccacctgtgtaccatccagcacaggtgacgcaacaactctcttctgggcaacataacttcctgccgagggcactgcagatccacaggcttgccaccc

SEQ ID NO: 2313 - DNA, 894 bp, Triticum aestivum
  misc_feature (816)..(816): n is a, c, g, or t
  Predicted polypeptide sequence is orthologous to G2990
caccacgctatgagattgattacgcccagctatttaggtgacactatagaatactcaagctatgcatccaacgcgttgggagctctcccatatggtcgacctgcaggcggccgcactagtgattagcgtggtcgcggccgaggtaaagactgacctttttcttctcatgagctaaaaatcaagagttcaaagctgctacttgaaaagtgcatctgcatctacaactattttgctatacaaatgtgcatctcaaaaaaagaaaccacaagatcaggaatcaagatcagccaaaacttctcatacaaacgttgactaaagtagccactagcctttctgagttttgcatccctcatggtagaattatccatcactggtgatggaggcaatggaactgcaaaatttacaccacacatcacgcatgcatgcgctcccatgtgcaaatgcatcaacagccactcacccaaaaacatgtacacccgggcatgcacatacggcacacacgctgatgcgaggaggaactgtacgccttggcctttatttgggggggggggggggggggggcttgttctgaaattgatctctggattaacccggtttctggtcattggtggaaaaccccctttttctggactaatttaaattctccccccgggggcagaacattaacgttacattttctggggccacccttggttgcacctattaaaaaacgcgcatggctttggatgtaatggctgatggggcacatatttaacattaggtacacttccaatttggggaagttttttgggatgggctttttagaaggccggtaancaccacaagaaggtacttcccgtggttgggcggttagcacattcataagtccatctggccctctcttttgctgggtag

SEQ ID NO: 2314 - DNA, 630 bp, Triticum aestivum
  misc_feature (623)..(624): n is a, c, g, or t
  Predicted polypeptide sequence is orthologous to G3044
ggtcgagttcctctcgatgaagctctcggcggtcagccccgagctgaactgcgatctcgatctccaagacatcctttgcccgcaggacgcccgctccacgtttccgggatacggccagcgattgggcaacgttcatcccaacaacaatatgtacagggcgtcgcagccgggcctctcgcgtccagaactatacgggaacgggatcatcatcccaaaccacccagcaagtgttcatatggcgaggacggctcagcagctgtctgcgtttccccataggagcatcgtctgggacgaggaacttggcaatgttggtccgtctgctttcccgtcggacgtcgtcggcgccagcagcttggagaactccgagtcgatgaaggtggagtagctaggcaggctgcagctgacggttaaccatgtgcaaaggctgcacagatctcctcgggctttagcgagtttaactgctgtcgttgagaggacgattctctatgtgtgtgtgtgcgtgtgtgacttttgtacagtttgactaagcagacggatgaaaagcttgtggtccgctgtgatgtgcctgcctggactagaattattagtggtaataatgattgggtttgatgagttgatctaannaaaaaa

SEQ ID NO: 2315 - DNA, 1783 bp, Lycopersicon esculentum
  Predicted polypeptide sequence is orthologous to G2
gaggaaaaaaaaagtgaataaaactagttaacatacaaaagcaaaagtatattaatgaatgattgaacaagagtaaaaagccaagttactagggacaaagaataaagaaagagagaaaaatgtgggatctaaatgaatcagaagaaggttgttcttcaccgatagagtttgaaggcgatgatgagaaaggtaaacgggtcggatccgtttcgaattcaagttcatcagctgtagctgttgatgatatatctgaagaggaattagatggagaaagagggaagaaaaagagaggtaaaattttcggcttctctatggtgggtctgggtaacggcgatgaagaacagccggtgacccgacagttttttccggttgatgagtcggaaatgggtggtgttgctgctgaaaatggatgcccgaattttcccagagctcactgggttggagttaaattttaccaaacggagacacttggcaacacgggattggccaggcctgtagatatggttcagcagcaacagcagcctattaagaagagccgccgtggaccaaggtctagaagctcacagtaccgtggggttaccttctaccggagaactggccggtgggaatctcatatatgggattgtggaaaacaagtttatctaggtggatttgatactgctcatgcagcagctcgggcatacgatagggcagccataaaattccggggagtagaagccgacataaactttagcttagaagattatgagtccgatttaaaacagatgacaagtttaacaaaggaagaatttgtgcatgtgcttcgaagacaaagtactggttttccgaggggaagctccaagtatagaggggtgactttgcacaaatgtggtagatgggaagctagaatgggacagttcttaggcaaaaagtacgtttatttgggactctttgatactgagattgaagctgccagagcgtatgataaagctgccatcaagtgtaacgggaaggatgcagttacaaattttgatccaagcatttatgagaatgaactaaactcaattgaatctaccgataacgtggctgatcataatctggatttaagtttgggtggttcaagctcaaagcaaggaagtcaagaattgggggataatagaggtcaaaattcttcatcaataatgcaattggatattgattggcagcgccatggtttaaggcctgagaagcaatctgccttaattgatgctcgaagaagagaaaacaggtacaatgaaacagaaacgttgcaacttttaagccagacgcacttgcattctccagcctccttgaagcataacaataataataatagtcaagtgcaacggtttggccaatttatgagacctggtgatcaatcccatatgattcaaatgtttccacagcaatttggctcatcaaattatcaaattcaatttccaagtggcagcaatggtggaagaattggagctacaaatgtaagagatctatcgcttgcggcgacgagtaatggttcttcacaatggcaatccaattttcctcctcagatatttgtagctgctgcagcatcatcaggattccctcagcagatagtaagacctcagaattggtcctcagaaaatggtttccatcattcactcatgagaccttcttgactcatttaataacttgccatatttctatttgtgttttttttaagataatgtgtagattaaagggttgatattcttaatactccatatatattacctaaggctcttggtttgaaatcaaaaaaaaaaaaaaa

SEQ ID NO: 2316 - DNA, 827 bp, Lycopersicon esculentum
  Predicted polypeptide sequence is orthologous to G2
cttgcaaccaaatatcgaaaaatacactcattttaattctatcgacaaaagaaatgtggaatttaaatgattcccctgatcagacaatggagtatgaatccgatgaaggtataacggttagatcggaatcaaattcaatttcatccgctctacttgttgtagaagacggtaattcatcagaagaagacggtgaaaaaggtaaaaaaaagaaaagtaataatacaccaggtaaaatattcggattttcgattaaagaccacaatttggaatcgccggtagttacccggcaattttttccggtagataacgagtctaccaattttccaagggcacaatgggctggaattaaattttgtgaatcggaaccgccacttgtcaatggattagtggggaacaaaattgacgtgttgcaacaacagccaattaaaaaaagccgtcgtggaccacgttcaagaagttcacagtaccgtggtgttaccttttaccggaggactggccggtgggaatctcatatatgggattgtgggaaacaagtgtatttaggtggatttgatacagcacatgcagcagctcgtgcatatgatagggcagcaatcaaattccggggagcggaggcggacataaactttacctcgaaagattatgaagatgacttaaaacagatgagcaatttaaccaaagaagaatttgtgcatgtactaaggagacaaagtactggtttttccaagagggaagttccaagtatagaggagtcactttgcataaatgtgggtagatggggaagctagaatgggacaattctttagggcaaaagtatgtttatttag

SEQ ID NO: 2317 - DNA, 535 bp, Lycopersicon esculentum
  Predicted polypeptide sequence is orthologous to G2
agaccaccaaaaaattaaaaacatttatttagtagctgtacttgtggatggtataaattggcagcttacatgagtaagaaatctagttcaatatctcttcttcagttagctttgtaccaactatatccatagagttggaatctctcaaaagcttttttttaccatcaagattaacccttgtaaatattatattacattatagtttacatcacaaccctccttcaggtgcgtgcggttcgctaactctcttagacgcaaaatattccatgcatcgatcgactgtctcgatagaaaattaattggatggtctggtgagagagtagttaaagccacttttgtgaggccagttttgatgtcttaatatctgctgagggaatcctgatgatgctgcagcagttgcaaataggtgaggaggaggaacagtattgctttgccattgttgagtatctcttctattgctgctgcttggaaactgaacttgataatttgaggaggtgaattgtggtggaatcatttgggagtcaccagctctcat

SEQ ID NO: 2318 - DNA, 696 bp, Lycopersicon esculentum
  Predicted polypeptide sequence is orthologous to G2
ttgtcgcaacaagtgcagccaatgaaaaaaagccggcgtggtccaaggtctagaagctcacagtaccgcggtgttactttttatcggagaactggccgctgggaatcacatatatgggattgtggaaagcaagtttatctaggtggatttgatactgcacatgctgctgctcgtgcgtacgatcgggcagcaataaaatttcgtggaatggaggcggacataaacttcaacctcgaagattatgaggaagatttaaaacagatgaagaatttaacgaaggaagaatttgttcatgtactgaggaggcaaagtactggttttccgaggggaagttctaagtatagaggggtgacattgcacaaatgtggtagatgggaagctagaatgggtcaattgttgggcaaaaagtacgtttatttgggactctttgatactgaaaatgaagctgccagggcttatgataaagctgccatcaaatgtaatggcaaggatgcagtcactaacttcgatccttgcatttatgaaaatgaacttaattcatctgaatgtagtaataaagcagcagatcacagccttgacttaagcttaggtagttcgagctcaaagcaaaacagccgtgaaatggaggatactaataagaatcaaaattatccttctatccaatttgatggtgattggcgacaccaagggtcgaaa

SEQ ID NO: 2319 - DNA, 469 bp, Lycopersicon esculentum
  Predicted polypeptide sequence is orthologous to G8
tttttttttttttttttttctaaaaattatccaatccacaaaaatggtattcatacaaaagaaatcaatgactatgtttatacctatattactagttacggataagtacatgttatggaagtggtaggcggggattaatctggtaaaagcactgcgaggcatttgttgaagttgctaatgcagatgttgatgaagtgatagaagtagtagatggaatgaagaatcctgatgatgctgccgtgcagaacattgtcaatgggctgtttgtatcaacctgactaggcatttgcagtgcccaatttggaggtccttgtgatgaacctgtgtcctttctcttgtcatatgctcttccctcatagctggaagagaaattagaatagattccagtccacaattgagcttgttgggacgacattggtagtcccttgagatgtgaacttccaactattactgaaccaggtttatccat

SEQ ID NO: 2320 - DNA, 882 bp, Lycopersicon esculentum
  Predicted polypeptide sequence is orthologous to G12
cggccggggatatcacattttctcctttctccatcttctttcttctgaaaaaaactaacaaaacaagtgaatatatttaatttttttcagtatgatggaaggagagaagagaaaacagaggcaacaccagcaagataagccatacagaggaatacggatgaggaagtggggtaaatgggtagctgaaattcgagaaccaaacaaacgctctcgaatttggcttggttcttattcttcccctgttgctgctgctcgtgcttacgataccgctgtattttacttgcgaggtccttcagctaggcttaatttccctgaatgtataggggatgaccatgaaattcacgatctatcagctgcttctattaaaaagaaagctactgaggtaggtgctcgagttgatgctctgcaaactgcgattcacaattctactgttaattctgttgaatcaaactgtaattcgaattctaaatctacaaggatgatgatgaagcctgatttgaatgaatatcctagcccggaaagttgcgacgaagataactgaatctctgcgggttaacagaggccaaaagggggattatttttatgttgattagatatactgaggatccatgtatgaaatataatccgaagggattatatgttaatattatcaattatgatagttattaaaggaaatttaatctccaaaaaaaataaaacaaaagaaagaaaaaaaaagaatgagaaaacccaaaaaaaagaaaaaaaaaagctggcggccgcttcggcccagtcaactctaactcgagaagttatgcatgcgccgcaatcgagccatgccaattcgccttaaggagtcgattacatcactggcgtcgtttacacgtcgtgactggaagcctg

SEQ ID NO: 2321 - DNA, 467 bp, Lycopersicon esculentum
  Predicted polypeptide sequence is orthologous to G12
ggcttatgatacggcggtctattatctaatatgcccttcggcccgattgaattttcccgagttgttagttggtgatggtgggcttaatgatttgtctgctgcttcgattcgtaaaaaagccatagaagttggtgctcaagtagatgctgtacagaactcgcttgcaacccatcataaccatacagaggaaaaggtgcactctgagacggcaagcccctcagaattgaagccttgttggtttcaagagaagcccgatttaaacttgaagcccgagcccgaagatccagaagtggattactggtaatatttagttaatatcgatattaccaataacagtatctctactagtgtaatttttaattatttttttggctttttgttggttgggggaagaggaagtgctttggtaagaatacaagcgccgctccaggttgtgtagcttggtagcctaagattgttattttctt

SEQ ID NO: 2322 - DNA, 547 bp, Lycopersicon esculentum
  Predicted polypeptide sequence is orthologous to G202
caaaactctttctccattctccccactatccataaaaaaaaaaatctttttttccctcttaccttcaatacccagaaatcaagattcttcagtaagagggagttgggtgataaagacaaacacccatctcaaaaaaaatctcatctttcaatttgtacacttgtctttttccaaccccatatcttgtttatcacctggtttgtttagattcttttgtcaatctttaagttgagataaaaaggagagatctttattatctttttttttttgttttgtttttctttcctttttgatggtttaagttatagtctttttattagttctaagtagtaatccaagtggtaacttgttatgattcaggttcatctgttaaccaagttggagttggagtcataaagattagatcttgttggggttttaaggaagatgaggatcgggggattttagtagcttagtttggttggcttaaaagggttttgattcatcaggttccttaacccccaaataaggaaggatgaaggaagaaagattcaattggtttgcttag

SEQ ID NO: 2323 - DNA, 2735 bp, Lycopersicon esculentum
  Predicted polypeptide sequence is orthologous to G214, G680
aacatggctttcttcgaaggtttaggcatcatgcggttcgttttgtagtgttacattatcaggttcttttgtacaacaccacggatagactatatttgatagtaactgatgttgtggggagaatcggaagaagatttgttctgtatcccctgtttgtccctgaggatttgaagcagagatagctagctttggttcctttattttgatggacccttattcctcaggggaggaacttgttgttaagacaaggaaaccttatacaatcactaagcaacgagagcgatggacggaggaggagcacaataggttcctagaagctttgaaactttatgggcgtgcttggcagcgcatagaagaacacataggaactaaaactgctgtgcagatcagaagtcatgcgcaaaagttttttacaaagttagaaaaggaggctcttacaaagggggtcccaacaagtcaagcacttgacattgaaattcctcctccacgacctaaaaggaaaccaagtaatccttatcctcgtaagacaagcgcagcaggtcactcatcacaggtgggagcaaaagatgggaaatattcgacaactttttcttccatctgtgaggaaaggaacttatttgacctggagaaagaaccgattactgagaaacctggcggaaacgagaagctgggcaatgtaaaagaaacccagaacaagaaaaactgctcccaagggttaactaaggaaggtgcttctgcagcctctatgtcttcaggaaagtccttgcaagcacatgtggcacctacagatgtgtgtgcctttagtgagtctgtgtctgtcaccaaaggagtggttaacaatgataacgcaaataaatcttttctcattgttgaatccaaagaacatcaacagtcagaaatactcgatatcagacagtcctttcaaggtaacagctcctgtaacacctttgacggggggaaatcttgccagtcgagtgaaaagttggcacaaggtgagaaaaaacatccatcgtttcagccaaaccatttgggggaattctcaagaaatgatatgcaagtgctacacaactatccaagacatgtgccagtgcatattcttgatggaacaaatggttctcaaatagccccagatatgtttaatcatgaatctacgagtcagcagataaatggggtcccggggctcccaaatttgtattctaaccctgcttcatccaccacatctgagcaccacagtaacgctccacagtcatccattcatcagtcattttcttgtttccaccccattttcacccctattcgtgatccagatgattaccgatcgttttttcaattatcctccaccttctccagccttattgtttctgctttattgcaaaacccagcagcacatgtcgcagcaagttttgccgctagcttttggccttatgcaaatatggaacgtccaacggattctccaactgataacaccgctagccagattaactcagctcctagtatggcagcaattgctgctgccacagtagcagctgcaactgcatggtgggcagcccatgggctcttaccattgtgctctcaatttcaaagcagttttacctgtgttcctacatcagcaacatcaatgcaagtggatgcctgtcaacctagagtagacaagaacgaaggaagagagggaactcatgattctccccatgttcaggaacctgtcccagaatgctctgaagctttgcaagaacaacaatcaggttctaagttgccaccttctctatcatcagaatcggaggagagtgaaggtaggaagctaaaaactgggttaacggccactgatactgagcaaggagctgcagttactaaaattaatgagccaaacgcagaaaagggcgggaagcaggtagatcgctcttcctgtggatccaacacaccttcaagtagtgaaattgagacagatgctttggagaaggatgagaaaggtaaagaagagccccaagaatctaatattaaccttctagctggagaggctgcgaatcggcgttatagaaatttcatcagtccaaccgaatcttggaaagaagtctccgaagagggacggatagctttccaggctcttttcaccagagaagtgttgcctcaaagtttttctccttcacttgatctgaaaaataagggaaagatcattcttgaaaagttgaagcaaaagccagacgagaaagttcaatgtggaccgcagttagatcttaatgatatggcatccaatatctgttccagtcaccaaacaatggaagacaatgtgttattaattggcaacaaagaagatgtagaaacatgcctaccaatgatagaacttggacaagtaaggttgaaagctcgccgtactggatttaagccttacaagaggtgctcattggaggcaaatgatagcagggtgacaagttctaactgtcaggatgaagaaaaaagctcgaaaagacttcggttggaaggagaagcttctacttagtgttgtatcaatgtgcaattctacgagggaacctgtgttgttgcacggagagctctattctatcctgttattatcttttcccagttacgttgtctagttctaatgtacacgaaacttgtcgtgtaggtgtgtaccatattatttttatgttctcttttaattggacttgtatgcaagggactttgaagtatgaacctaaatgtggatgtcttcaacaatcatagcaaaaaaaaaaaaaaaa

SEQ ID NO: 2324 - DNA, 2019 bp, Lycopersicon esculentum
  Predicted polypeptide sequence is orthologous to G261
gatccaaaaaccattgagaagaagtctttgagaaaagggtcaaagtaaacttcatctttctatgtgcttcttcttgttaaggactattcttgattttttcttacaggaaagttcggaaatttctgagttttagagggtgaaacggctatcttttgaattcaagctagcatttgtttgagcacttgtgggaactcatgatgggccgcaatctcttttaacaattctttagcaaatttgtgtgttttgaaagctatccagagctgggacttgaatggaaatgtgtatttgctaagaatttgtatgatcaggtgggagctgcttcaattgaatttatcgaaggaaatcaaggtgataacacttttggttggttgtatctgtatgttgggaatctgataagttgatcttccctgtcagtaaggatttgtcacttgtagttgagcttcgccttgtgagtttcatttcaaggggttgtgatttggatttgaatttaccatggatgaagctccttgcagcgtcaatgcactgcctccgtttattgcaaagatatatgaaatggtggatgatccttccactgatccaatagtctcatggagtttaaacaataaaagttttattgttcgtaatcctcctgattttgcaagagatttgttgcccagatactttaagcacaataatttttccagctttatccgacagctgaatacttacggattcaagaaaatagatcccgaacaatgggaattcgcaaatgaggattttcttagaggtcagccacaccttttgaagaatatctatagacggaaacctgttcacagtcattctgtacagaatattcatagcctctcatcatctgcattgaccgaatcggaaagacaagggtataaggaagatattgaaaagttgaagcatgagaacgaatcacttcatttagttctacacaggcataaacaggatcatcaaggacttgaaatgcaaatgcaggtccttaaccaacgtgtccaacaagtgaaagaccggcaaaagaacgtgctgtctactttagctcgaaccataaataaaccaggattagctttgagtctcatgccacaactggaaatgaatgaaaggaagagaaggttgccaggaaacagttttctttacaatgaaataggcctggaagataatcaagcgagttcttctgaaaatacgactagggaaaatatggaccatacttctctttcgactctcaacaaggaagtgctagatcagttggaatcttctttgaccttttgggagtatacactgcgtgacattgatcaaactagaatgagacggagctcttcaatagacttggatgaatctatcagttgtgccgatagccctgctatatcttacccacaactaactgttgatgttggatctaaggtttctgatattgacatgaactctgagcctaatggaaacactactcctgatgttactccgccagaaaaccgagtagagactgctagtcacaatgtgccaacaggagtaaatgatgtattctgggaacaattccttactgagaaccctggttctactgatgtaaagccggagagagaagatatggagagcaaaataagtgaatccaaaacagttgaggatgggaaattttggtggaacaggaagactgtaattagccttacagaacagttgggacatcttactccagcagagtgaatgtaatgtggcagggtatgtactatttttgatagtaaatgtttatttgcctgtttcttgttgtaaatttagagaaagtgatttgtctgagtacatagaattttggtatattaaccttctttttttttgtttttgcatgacatgatgtagtgaatgatagagtcgatcagtcttaatgctagtctggcacaatttcatgtattatgtagttatattctttccagccttgcctgtccatgttgccgatttgtgttacataagatgagagtaatttttctagcactatgttaatgcaatccttttgctaaaaaaaaaaaaaaa

SEQ ID NO: 2325 - DNA, 501 bp, Lycopersicon esculentum
  Predicted polypeptide sequence is orthologous to G261
agaggttgaagagagaaaacagtcttcttcagtcgtctgcggagaatcaattgaaattcaatggggagtacgaaagtggaattaagtctatggagcaacgtttacagaacgttgctcatagacaggggaaattgatttctcttttagctcaattactacaaacacctggattttcatctgatttcactcaaagcgcgagcaggaagagacgattgttgatatcaaattacttgattgacgaggaaaactcaccaaaattcgacttggaaatggttaaaaagttggattcatcaatcaatttttgggagcggtttctgtatggtgttcaaacacaagatttcgagcatacacattccccaattgttacacatacatcatctaatgattctgccaaacgaaactctcccatcgatcattcaccatcctcctccgagttagggccattgaatcctgtcatgtcatcaacttatgaaaatttaaaacgtcaacttaagccatctg

SEQ ID NO: 2326 - DNA, 512 bp, Lycopersicon esculentum
  Predicted polypeptide sequence is orthologous to G280
gtttcaatggctactgaatttgtcaacaagattcatcctgaatacccggagatgatttatgaagcccttgatgcattgcaacaaaaagaaggctcaaacaagtcatcaatatcaaagtacattgaatctaagtatggaaacatgaatgatgcacactcaaagttgataacttaccatttggatagaatgaaacaaactggtgaacttattttcctaaaaaacaactacattaaacctggtccagatgcaccccctaagcggggccgcggccgaccacctaaacccaaacctatattgccacaaggaacagatattgcagctccaaagccaagaggtcgcccgaaaaaagaccccaatgcaccacctactcccaagaaaccaaaaccaacaagtgtccctagggacttagctcctgtttcgaaaaccggaaggcctagaggtaggcctaggaagattaggccggagccaccacaaaatgggttagagtgaagctgaaaatccgcagacttggt

SEQ ID NO: 2327 - DNA, 745 bp, Lycopersicon esculentum
  Predicted polypeptide sequence is orthologous to G280
gctgaagaacataatctaactttgcctagttatcctgatatgattatggaagctatagatgcgttgaatgaagaagaagggtcgaataaatcagctatatggaagcaaattgaagcgactcatggtacactaccaccagcgcatggtacactccttgcacatcatttgaatcaaatgaagcaagctgggcaattagttatgttgaagaacaactacatgaagccaaatccaaacgcgccgccgcgccgtggtagaggccgtccgccgaagccgaaaagttcagttccggtaccggatgggtatcctagaccacgtggaaggccaccgaaggagcgggatccgtacgcgccgataacggtacctatgaagaagacgagtgagggtagctctgggggaagtgggaagaagcgtggaaggccaaggaagtatccgatgacggaggatacgccggtggtgaagccaattggtgctccgagaggaagaggaaggccgccgaaggtgaaaactccggtagctgcaactgtaggggcttaattgaagaaagacgaattaaattagggacttgtatggcaaaatatgctaacttgttgtttttcactttttatctgttttgaattttcatgtttagtccctgtagttttgttttaattacaatttgtaggaagaattgtgtgactttgtgagtgatttttatcatgtaattgggccaatgtaaatccaaattgagggctttttatttatatat

SEQ ID NO: 2328 - DNA, 785 bp, Lycopersicon esculentum
  Predicted polypeptide sequence is orthologous to G280
gcatctctagaacacacacacacactctctctctatccatggctactcaaagcttcaaccagttcccttcataccctgagatgatttatgaagctcttgatgaactaaatcaagaagggggtgcaaacaagtcatcaataagcaagtacattgaaacaaagtatggagatctgaatgaagatctttcaaagatgctacctttacatttggacaacatgaagcaaaatggagatctgattttcctcaagaacaattacatcaaacctggtccagatgttccagcaaagaggggtcgtggtaggccaccaaaacccaaagctccattgcctcctggtgctgttgaatctgttgaacctgcatcaccaaggccaagagggcgcccaagaaaagaccctaatgcaccaacctagttccaagaagccaaagccagaatctgttgctggaggtcccaattcaacaaatcttggttctactactggaaggcctaggggtaggcctaggaaagttaggccacagcctgctcatgatgatgatgatgatgatattgaggaatgctgaaaacttttaagacttgttattggactcttgctgatggtgatgactctaatgacttagttgtcttaatatcctctttttttttaagtgttagtagtattatcttatgtaatagtttcagtttgagttgccctagtgtgactagggggtcatggtttcaaagttaagactgcgtagaatagactaattgtcgttatgcgactagggtcatggtttacagtgtgcaatag

SEQ ID NO: 2329 - DNA, 1051 bp, Lycopersicon esculentum
  Predicted polypeptide sequence is orthologous to G481
tttttctccctgacatattgtttattattagtttcataaaaaaaattataaaaattttctccattttcttgttcttaaagcttgtgtactatcataggcaaatacaagactgcgtatacatcaatgtcttcggactttactcgtagaattacatttacgacagaataaagttgtgcatatcgtaccacttgtgagattactccgggtaatttctcttttgtattgatcggaacagaatttaggcgatttcgatggcggattcggataatgaatcaggaggacatagagataacagtaacattgagagttccctaagagaacaagacaggttccttcccatagcaaatgtaagcagaatcatgaagaaagctttaccagctaacgcgaaaatctcaaaagatgctaaggaggtagttcaagaatgtgtttctgaattcataagtttcatcacaggggaagcatcagataagtgtcaaagagaaaagagaaagacaatcaatggtgatgatctgttgtgggcaatgacaactcttggttttgaagaatacattgagccactcaagatttatttgcagaggtttagggatttggaagggcaaaaaagtggtgtctctggagagaaggatcatagtggatcagtgggttatgttgaggactaccatggcatgatgatgatggggagtcaacatcatcaaggacacgggtatggcaccggtgtatacaatcatcatacgggggagaatgctgcaggggttggtacaggagggtcgcggtttcctgacgttgggaggcaaaggtgaagctgtgacatccgcggactacaaagatgtatcaggacgcgatgtatcaactgtcaacaggttgaagtatggacactgaaagacaggaacagactttgtagtttgtattctacagagatgtaaattggtaaacatgtgtgtacattacaatgtgggtgtaaacatggattgtaattgtctattacatcattgtttctctaatagttgatgtttgaataagccttttttagtgtaccaaaaaaaaaaaaaaa

SEQ ID NO: 2330 - DNA, 485 bp, Lycopersicon esculentum
  Predicted polypeptide sequence is orthologous to G481
accagcaaaagactaaccactgttctatgtattcagcttttttttgggtatgcatccaaagttctttgttcatcttaaaattcataattgggagtttccatagtctaagccttgtgcaaaagaaccttcatacatgaactgcgtattggacccaagctgacttccaactacatcttttctaacagatgcatcaccaacccttgcagatcccttggcatctccctccatctctctgtatcgagtcaaatagaccttcagtggttcaatgtagtcctcaaatcccaaggtagccagggctgatagtaaatcatctccgttgatcgtctttctcttctctttctgacacttgtcactagcctcgctagtaataaaactgatgaactcagatacgcattcctgaaccgtgtctttagaatccttagcgatcttcccattagcaggcaatgccttcttcattatgcgtccaatattagcgatcggtaggt

SEQ ID NO: 2331 - DNA, 806 bp, Lycopersicon esculentum
  Predicted polypeptide sequence is orthologous to G481
cggccgaattggtaaaacgaacggtgttgatagggcaaaatccaaaactctgcctcatctcagtcgtctccctttctcccttcttctccaacgtccgatcttccagttccctccatccccagtatggcggatggtcaaggttcgtctaggtcaccggcgagtccaaacggaggtggtagtcatgagagtggtggggaccagagtccgaggtctaatgtacgtgaacaggacaggtttttaccaatagctaatattagtagaatcatgaagaaggcacttcctgctaatggaaaaattgcgaaggatgctaaggagactgttcaggaatgtgtttctgagttcatcagcttcattactagcgaggcaagtgacaagtgccagagagagaaaaggaagactattaatggtgatgatttgctatgggcaatggcaactcttgggtttgaagattatattgaaccactcaaggtgtatcttgctcgatacagagagatggagggaacgtcaaaggctgctgatggctctactaaaagagatgggatgcaacctggtcctaattcacagcttgcacatcagggttcatactcacaaggaatgaattatgggaattctcagggtcagcatatgatggtcccgatgcaaggaactgagtaaaaatccgatcttcgtcctgtttgagaagacgggtggagttgaaaacatattatatatatagatggttcttctgctgtaacctctgtaacatggtttattaattctagtgctctctagtgagtgccgtgtcatatttaaagtttgtaaattga

SEQ ID NO: 2332 - DNA, 1423 bp, Lycopersicon esculentum
  Predicted polypeptide sequence is orthologous to G504
ctaaattccttcttgtttatcattttctctcttcccaaaaaaaaaatcccaaaatttaatcataatacaattcgaatttatcaacctcgtactacgtacatatttttgttggtacgtaaaatactgaattcaggtcaactcaaacatcgtaaattgtgatttctttatggaaagtacggattcatcaaccgggacacgtcatcagcctcaactcccaccggggtttcgattccacccgacggacgaagaactcatcgtccactacctcaaaaaacgagtcgccggcgctccgattccggtggatattattggtgaaattgatctttataagtttgatccatgggaactccctgctaaggcaatattcggagagcaagaatggttcttttttagtccaagagatagaaaatatcctaacggggcgaggccaaatcgggctgcaacatcgggttattggaaggctaccggaaccgacaagccggtttttacttccggtggaacacaaaaggttggggtaaaaaaggcgctcgttttttacggcggtaaaccaccaaaaggggtaaaaactaattggatcatgcatgaatacagagttgtagaaaataaaacaaataacaagccacttggttgtgataatattgttgccaacaaaaaaggatctttgaggctagatgattgggttttatgtcgaatttacaagaagaataacacacaaaggtccatagatgatttgcatgatatgttgggatcgataccacaaaatgtaccaaattcaatattacaaggaataaagccttcaaactatggtacaatattgctcgaaaatgaatcgaatatgtacgatggaattatgaataacacgaacgatattatcaacaataataatagatccattccacaaatatcgtcaaagagaacgatgcatggaggtttgtattggaataacgacgaagcaacaacaacaacaacaactattgataggaaccattctccaaatacaaaaaggttccttgttgagaacaacgaggacgatggacttaacatgaataatatttcgcgaattacaaatcatgaacaaagtagctccattgccaatttcctgagccagtttcctcaaaatccttcgattcaacaacaacaacaacaacaagaagaagtattgggatctcttaatgatggggtcgtctttcgacaaccttataatcaagttactggcatgaattggtactcttaaagatataaaaaggcaaaaaatagttagccctgtaaaatcaatcgatcaatcaatcatagatatattatatatggatttcgttatattttacttttagttagaattaatatatagaatatcttctatctcacattaacaaataagaacatttataacaaaaaaaaaaaaaaaaaaaaaaaaaaaaaaaaa

SEQ ID NO: 2333 - DNA, 781 bp, Lycopersicon esculentum
  Predicted polypeptide sequence is orthologous to G504
tttataatcaggtcgctctgattaaatatatttgaaaatttttatcaaataatattgtggtcatggagagtaccgattcatcaaccggctctcatcatcaaccacaattgccacctggatttcgatttcatccaactgatgaagagcttgtggttcattatcttaagaaaagagttgcctctgttcctcttcctgtttctattattgctgaagttgatctttacaaatttgatccttgggaactacctgctaaggcgacatttggagaacaagaatggtatttcttcagtccaagagatagaaaatatcctaacggggcgcgcccaaatagggcggcaacttccggttattggaaggctaccggaaccgacaagccggtgctcaccgccggcgggacccaaaaagtaggtgtcaaaaaggcattggtgttttatggtggcaaaccacccaaaggggtgaagacaaattggattatgcatgaatataggcttgctgataataaaacaaataataagccccctggttgtgaccttgccaataaaaaatcactaaggctagatgattgggttttatgtaggatttacaagaagaataatactcaaaggccaattgatcatgaaagagatgatttgaatattggatatgatgatgggatcatcatcaattcatccatcatgtataccaaattcaatgtcaatgccaaatatatttggtcaaccaaaaataccacaactaaaatcttcaaattttggcactacattaattcatgatcaaaatgacc

SEQ ID NO: 2334 - DNA, 2119 bp, Lycopersicon esculentum
  Predicted polypeptide sequence is orthologous to G559
ggtcctccctgtccgaatttatagtgtttccattctcacacagatttgcctctttgtttatcgtctctcttctccacaagcttttcccttttctctctcgcatgtgataaagctgcttccttctgcttctgcttcccttttcacatttttcccttctctgcacatctaatttcaaagctaatcgaaaccgtagggaattgatctgggataagcttgtttggtgtttgcggaatctacagggtctcagcaaggggtttcatgttctgaggaaaagcaacttggattgtgattttatggttttcctgctataatgttcttgctttgaccggggaaaagtatcattacttgttgatttttggttttctgttggtacggttcttgttggagtatatatatatgtgtgggatgttgggtttgttcctgtgctgttaacatttggaatttgaagggttggggttttttctgtttggatttggagggtttgtatggataaggataagtcttcttcaagccatataggaggttcgttgcctccatcagggagatactcattattttcacctcccggtagtagctccaatgtaaagtcagaacaacctggattagcaaatttacctcccttaggacctggaaatgcttcagaatcaggtcattttggtcatggtttgtcggcagattcaagcctgtttagtcttgatataagccgaatgtctgatagcccaccaagaaaatttggtcataggcgtgcccactcagaaattcttactcttcctgatgatattagctttgatagtgatcttggcgttgttggactagatggaccgtctctgtcagatgagactgaggaggacatcttgtcaatgtaccttgacatggataagttcaattcttcaactctgtcttctgaattccaagtgggtgagtcttcttcagctgctccaggttcatcacaaacaacagcaatggcttcaggaacaaataaatttgctcctactgttagtgagaagccaagagttagacatcagcatagccagtccatggatggttcaactacaatcaagccagagatgctcatgtcaggagtggaagagccttcttcagctgaaactaagaaagccacgtcagctgctaagcttgctgaacttgctcttattgatcctaaacgtgccaagcggatttgggccaacaggcagtcagctgcaagatcaaaggaaaggaaaatgagatatatagcagagcttgagagaaaagttcagactctgcaaacggaagcaactactttatctactcagttgaccctattgcagagagatacaaacggcctgaatgctgaaaacagtgaacttaaactgcgtttacaaacaatggaacaacaggttcacttgcaagatgcgttgaatgatgctttaaaggaggagatacagcatctgaaagtgctaactgggcaaggcatagcaaatggtggacctatgatgaacttcccagcaacctttggaggcaatcagcagttctactctaacaaccaggcaatgcatacattgttggctgcacaacaacttcaacagctccagctacattctcataagcaacaacaccagtttcagcaacatcagctacaccagtttcagcagcaacagttgcagcaccaacaacagcaacagcaacctcttatgcagcagcagcagcagcaggatcaactttcacaagccggagatgtgatgtcaagaggttctctgtcatctcctcaaaatgaaaacgcttctgatgttagttctgtagcaaaggattgaacagctgatggccagagagacaggagatggtgtatgttttaaaaatcatcatgtgttttcccatctagcagctcatttttgtgtttcaaaatcatcacgtgttgaaacaacatctagctcaggttctcttgctttcagttagctccttcatctgcattttagtacttttgtagggtcatttgacttttagttgaaattgttcaaatcccattctatgcatatgtcattttgtcaactatcaacatgattttcttcatgttaccaatattgttggtggtagtttttttggacatcaatcacttatatctcttttgaaaaaaaaaaaaaaa

SEQ ID NO: 2335 - DNA, 504 bp, Lycopersicon esculentum
  Predicted polypeptide sequence is orthologous to G594
ttacagttgtttgcaaacatgttacaaatgagtgttcttgaaagacaaagagcagtgttggaacgtatttataatcattctaagcagcagctttcttctctagtacctcaacaagaacttgctcatttgattaccggctgcgttcaggggaattttaacatgtttggcgggggagattctaattttgttaattttcaagaaatggctcgtccctctttctccacaatatcgaattcatcgattacaacagtgtctccgccaccagagaaagaaagtgacttaagtagtatgatagctccaagggaaaatgttgtttctaccaagaagagaaaagcagagtttattgaggaagaggattgtgagaaaagcccggggaatgattcaaaggagaattcgaagacgtctgaggttcaaaaacctgattacattcatgtaagggcacgtcgtggccaagctactgatagccatagtttagcagaaagagctagaagggagaaaatcagt

SEQ ID NO: 2336 - DNA, 825 bp, Lycopersicon esculentum
  Predicted polypeptide sequence is orthologous to G663
atgaacagtacatctatgtcttcattgggagtgagaaaaggttcatggactgatgaagaagattttcttctaagaaaatgtattgataagtatggtgaaggaaaatggcatcttgttcccataagagctggtctgaatagatgtcggaaaagttgtagattgaggtggctgaattatctaaggccacatatcaagagaggtgactttgaacaagatgaagtggatctcattttgaggcttcataagctcttaggcaacagatggtcacttattgctggtagacttcccggaaggacagctaacgatgtgaaaaactattggaacactaatcttctaaggaagttaaatactactaaaattgttcctcgcgaaaagattaacaataagtgtggagaaattagtactaagattgaaattataaaacctcaacgacgcaagtatttctcaagcacaatgaagaatgttacaaacaataatgtaattttggacgaggaggaacattgcaaggaaataataagtgagaaacaaactccagatgcatcgatggacaacgtagatccatggtggataaatttactggaaaattgcaatgacgatattgaagaagatgaagaggttgtaattaattatgaaaaaacactaacaagtttgttacatgaagaaatatcaccaccattaaatattggtgaaggtaactccatgcaacaaggacaaataagtcatgaaaattggggtgaattttctcttaatttaccacccatgcaacaaggagtacaaaatgatgatttttctgctgaaattgacttatggaatctacttgattaa

SEQ ID NO: 2337 - DNA, 490 bp, Lycopersicon esculentum
  Predicted polypeptide sequence is orthologous to G663
taatgaatactcctatgtgtgcatcgttgggagttaggaaaggttcatggactgaacaagaagattctcttttaagagattgcattcaaaaatatggtgaaggaaagtggcatcttgttcctgctagagctggtttaaatcgatgtcgaaagagttgcagactaaggtggctaaactatctaaggccacatatcaagagaggtgactttgctccagatgaagtggatctcatcttgagacttcacaaactcttaggcaataggtggtcacttattgctggtagacttccaggaaggacagcaaacgatgtgaagaactattggaatacacactttcacaagaagttaagtattattgctcctcatctacatcctcattctcgtcctcgttctcatcctcgtctacagattaagcataagagcatcgcggttactaagaatgaaataataagacctcaacctcggaacttctcaaacgttaagaagaatga

SEQ ID NO: 2338 - DNA, 833 bp, Lycopersicon esculentum
  Predicted polypeptide sequence is orthologous to G668
atcggccgaattgacacaactcttgaacaaaatttcctataaagagagtaaagcaatacctaaaaacgaaagatacatccttttattttcattgatcttcaagtcataaaaagaagaaaaagatcattttgttcctagatatcgatcgatcgtgtaggtagaatgggaaggccaccttgctgcgataaaataggggtgaaaaaaggaccatggacaccagaagaagatatcatcttggtttcatacattcaacaacatggtcctggtaactggagagctgttcccagtaatactggtttgcttagatgcagcaaaagctgtaggctcagatggactaattatctccggcccggaattaaacgtggaaacttcactgaacatgaagaaaaaatgattatccatcttcaagctcttctaggcaacagatgggctgcgattgcttcgtatctcccacaaaggacagataacgatataaaaaattactggaatactcatctgaggaaaaagctgaagaaacttcaagggaatgatgagaatagtactcaagaaggagaaagctcatcatcatcacaatccaatttctcaaagggacagtgggagaggaggcttcaaacagatatccacatggctagaaaagccctttgtgaggctttatcacttgacaaatctgattcatctgctaatccaattccagctcaacaacccgttacaggatccagctcttatgcttccagtgcggaaaacatttctaggttacttcaaaattggatgaaaaattcccccaaatcatctgaattaagtcgatcaaattctgagacaactcaaagctcgtt

SEQ ID NO: 2339 - DNA, 1354 bp, Lycopersicon esculentum; identical to SEQ ID NO: 585
  Predicted polypeptide sequence is orthologous to G668

SEQ ID NO: 2340 - DNA, 584 bp, Lycopersicon esculentum
  misc_feature (499)..(499): n is a, c, g, or t
  Predicted polypeptide sequence is orthologous to G913, G1753, G2514
cctaccaccccacccccctatagaaatctacatatacatacacacacacaaaaaaaaacatatatatatatggctgactctcaaaattctaccaagtccacccaaataattcaacctcctaatcaatcaagtgaaagtacgaaaatacccttcaacactacccttcctccaccactaccaccgttgccgccgcctccggcgccaccggagacacatattcaaataaccaatacattatcatcaaaattagaaaacacaaatacaactccaaaaaccgttattattccaactgcaatcatgagttccacctcatcgagcggcttgggatctccgagccgctcaataggcggaaaacatgcggtattccgcggaatacgatgtaggagtgggaaatgggtgtcagaaattcgagagccacgtaagactacgagaatatggttaggtacttatcctacacccgaaatggctgctgctgcatacgacgtcgctgcaatggctntaaaaggaaacgacgccgtaattaactttcccggtaatattaattcgtatccttcactccctccttcgcccgccgcggcggatat

SEQ ID NO: 2341 - DNA, 1041 bp, Lycopersicon esculentum
  Predicted polypeptide sequence is orthologous to G977
tacttttttgcgaacacacacacttcaattaactacatttgtaagattgtcaatattatggctagggcacaacaaagatatcgaggagttcgacagagacattggggttcttgggtctccgaaattcgccatccattgttgaagacaagaatttggttaggcacttttgagacagcagaagatgcagcaagagcatatgatgaagcagcaaggctaatgtgtggtccaagagctagaactaatttcccatacaacccaaacatgccacaaacatcttcctctaagctactctcaactacattaacagccaagttacacaaatgctacatggcttcacttcaaatgaccaaaacctcaccacaaggacaaaaattagcaaaaaatgcaaccaatgttcaagaaagtgttattaattcctataaaatgaaacaacaaatgttggtaccaaagccatcagtactattgactcatcatgatcatcatgaggaagctaaagtagtcaacttgggagtgggagtaattaggaaagttgaagatcaagtacttgagggtataccacaatttgtcaagccacttgaagatgatcacattgaacaaatgattgaagaattgttggattatggatccattgagctttgctctaatgttgttccttctcaccaaatccagtgagcttgctcgtaaatcgactattgcctaatacttgctacatttgatcagtgcaggtattagataactcttctactgatgttctctctcagtaattgtctctttttgggtcctacattgttctgtactagaaagatactcattttgctaatttaaccccatttgtatagccgttcccgatttgtttgggactgaagcttagttattgttgtattaagtcttttaagtagtctccctctgtttaaaatctatgtatcgttagtaggtctaggcattttctctttttggttcctagagtttttactctaagagaaccttctactagttgtaaaattccattataatataatcttttctctcttttaaaaaaaa

SEQ ID NO: 2342 - DNA, 926 bp, Lycopersicon esculentum
  Predicted polypeptide sequence is orthologous to G1020
gataaaacaccaattcaaaaaatcgtatcagcacctatggctgtgaaagataaggctgtgaaaggaggtaatgtgaaagtgaatcatggagttaaggaagttcactacagaggtgtaaggaagaggccatggggtcgttacgctgcggagattcgtgacccgggtaagaagagtcgggtctggctgggtacttttgatacggcggaggaagcggctaaggcttacgatgccgctgccagagagtttcgtggacctaaagcgaagacgaatttcccctttccggcggagatgaataatgttggtaacaataacagtcagagcccgtgtgggagcagtaccgtggagtcatccagcggagaaacggttgttcacgcgcctaatacgcgacacgcgccgctggagctggatctcacgcgccgtctcggtgccgctgctgaaggtggacgtggaggtgtcggctacccgatcttacaccagcagccgacggtggcggttctgccgaacggtcagccggttttgttgtttgattctatgtggagaccgggagttgttagtaggccgtatcaggttgtaccggcgacgatggagtttgccggtgtcggtgccggagttgttactagtgtgtcggattcgtcttccgttgtggaagagaaacattatgggaaaaagggacttgatcttgatcttaaccttgcgccacctatggaagtttaaattaatgacgacgataatctaattttgtgagagagattaagagagtgacagagctaatggctgatttttgtatataagttcaaaagaattgattgcttttttttttttggcagctgaaactttctcgtgctgtttctaccatttgtaactctaaatccttttaattaatgagaaaattccatattttctcctttccaaaaaaaaaaaaaaaa

SEQ ID NO: 2343 - DNA, 630 bp, Lycopersicon esculentum
  Predicted polypeptide sequence is orthologous to G1047
tttccggccatgttgtccactttcccggccactactctgtccgccgacggacttttttccaatttatttccggcatttgatggaggattcactccttgggaatgtatcgaaccggcttttctattttcacaacaagtggaatcggttgtttcacccaaggaatccccaccacctgaaccggttatttcaaactccgattcaggttctgatgactccaaacctaattctgttcactctagttccggttcagatgacccgaaccggaataataacaataataataagtcgaaccggtgtcctgacgagagaaagcggcagcgcacgacatcgaaccgtgacatggatgagaggaagcgtcgacgtatggtatcgaaccgggaatcagcaaggcggtctcgcatgcgaaagcaaaagcatctggaaaacctgcggaaccaagcgaaccggcttaaagtagggaaccgggaaataatgaaccggttacggttaatcactcaccagtgccaagtggtccagtgtgagaacgagcggctgaggaccgaatcggctatccttcggcaaagacttgagggtatacgtcaaatatggatcaaccggcaatttaattcttattctgcatgggcatgcaat

SEQ ID NO: 2344 - DNA, 622 bp, Lycopersicon esculentum
  Predicted polypeptide sequence is orthologous to G1063
tgtggtatcccttttagcccatctttcattctaatatttctatatatcctcttgtttttttatttttaccttacaaaaacaaatcatggatttacaaaatattgctcactcactagaacttggattctccaatagcaatattgaaatgatacctttacaatcaccactccataactccaattacttaatgaattctcctccatctaatttctcattcatgggcaatccaattgaagagccagccgcgatgccaatactctcatcgatcgatgaaattatagcatcgactcatggtaatggaaatgattactcatgtttgcagaggaggaattctatggaggctatgagggagatgatttttcgtatcgcgatgatgcaaccaattcacattgatccagaatcagttaaacctcccaagaggaaaaatgttaagatatcgaaggatccacagagtgtggcagccaggcatcggagggaacgaataagcgaaaggataaggattttgcaaagactagtccctggaggaactaaaatggatactgcttcaatgttagatgaggctgtccattatgttaagtttttaaagaagcaacttcaatcactagagcaagccgcggttaat

SEQ ID NO: 2345 - DNA, 1082 bp, Lycopersicon esculentum
  Predicted polypeptide sequence is orthologous to G1075
gaaatttcttgtgtgtttttttttttttaatatatacctattttcttactcatgctcattaattaatttcccttataattaatcatatatcatagtttattataccttagttttctgttcactacttttgttattgttatcgttatcgttatggctggtttggacttaggttccgcttctcatcatcgttttctccctcgtcatctccacgatcctcaagacgatgaaatcaatcgcaacaacactcaattttccgatgatgacaacaacaacaacgataacaataacaataatagccccggggtagcacgtagacctagaggtcgtcccgcggggtccaaaaataagcctaagcctcccgtgatcataacacgggagagcgctaacgcgctccgtgcgcatattttagaagtgagtagcggacatgatgtctttgaatcagttgctacttatgctagaaaaagacaaagaggaatttgcatactgagcgggagcggtacggtgaataacgtcaccatacggcagccacaggctgccggttctgtggtgacgttacacggaagattcgagatattatctttatccggatctttcctaccaccacccgctccccctggggccaccagcttaacgatttatttagcgggtggtcaaggtcaagttgttggtggaaacgttgtgggtgcgctaattgcatcaggaccggttattgttattgcttcgtcatttactaatgttgcttatgagagattgcctttggatgaagaaaatgagtcaattcagatgcagcaacaaggacaaagtggtaattttgctgatccatctaatattggattaccttttcttaatttgccattaaacatgccaaatggtggtggtcaactacaattggaaagtggaggaggtgaaggttggaatggaaacacaacaaacaggccacaatattaggtcaggttttattaagaaattaattttctacttttttttttttacttgaaaaaaaaaaaattctctcaatggattaatattatcatttgtacattattaagcttggtttaaatttttctaaaaaaaaaaaaaaa

SEQ ID NO: 2346 - DNA, 618 bp, Lycopersicon esculentum
  Predicted polypeptide sequence is orthologous to G1082
tggattttgaacatgaggctgttaaggaagttcatgaggatcaaaggtttgtagatgaggctgcaactgcaagtggaagttattcaaaggcagttgaggagaatgagaaggcagctgattcagagtccatacaccaccactcaagaacaagttcatctgtggaggatgacccgattgagtatgaggtacacgtcgtggataagaaagtggttgatgatgcgaatcggggaaatgtagctggttccaagggtcgtagtttcaatagtgattctgatgtggtgaaggagattcaagttcaatttgagagagcttctgaatcagggaatgagcttgctaagatgcttgaagttggaaaacttccccacaatcgtaagcacgcgacatatcaagggatagtttcttccaagatgttgcacgcgattaccccttcctcggctgtactctcgctaccgtctactttaaagaacgatgcgattgagattgctgatcatgccattttagatgtagaaggagatattagttcaagagctagaaacatttcttccacattgcagaagctgtacctctgggagaagaaactgtctgaggagggtcaggggcgagagaaagataaggtgc

SEQ ID NO: 2347 - DNA, 1929 bp, Lycopersicon esculentum
  Predicted polypeptide sequence is orthologous to G1108
gactttatcgatcatcaaatataatcgctggtaggctttgcttgtgagtataaggtggtagctgaaccagtagcaatattttcttgagatttatggttgaatggctgttacctcggaagaacttaatcaagagaacccaaccgacagatttcctttgctcatggagcaagcagaaagtcatgagaggaatgaacatgttattgatgtagaacaaggaagtagcccctcatcatcaggctcatctgataatgattctcctcatgaattggaaatacccaaccatgaaaatagaccatcaaatcgacattccgtctcttcttcgtccaacgaatcagattctcatagcccttctagtgctaggagagctgatggttctgatcgtcgttggagcccatttaatactctgttgtggctttccattgagctaatattcaccttaggacagattggtgctgccgttgtcgttttatccttgtcaaaagaggaaaacccagaaactccattatttgcttggattgtgggatatgcaactggatgtgcagcaacccttcctttactgtactggcgttatcttctccgttaccaaaccatcagtcagagatcagctcaactgcgtcaagattcaccccaagtcaattccactgcagagccaaattcttatattactatctcattaactcggtcctcggatgaggaagatggaaggaatacacctaccgacatttggaccaggcaaagcaatgcaagacttggttcattggtagatcatttcaagatggccttggattgcttctttgctgtgtggtttgtcgttggcaatgtttggatctttggggggcactcttcttcttctgaggctcccaatctgtacagattatgtatagcttttcttaccattagttgcattggatatgctatgcctttcatcttgtgtgcgatgatatgctgctgcctgccttgtatcatttcaatcctcggtgtgcgtgagaatatgcatggagtgagaggagccacagaagagtccatcaacgctcttcccacactcaagtacagggtcaagacagatggaactggaagtaatgaaagtaaaaatctagaagaggaggaaggtggttgtgtagctgctggcacagagaaggaacgtgccatatcaggtgaagatgcggtgtgttgtatttgcttagcaaaatatgaggacaatgacgaactgagggaattgccttgctcgcatttcttccatacacagtgtgtagataaatggctgaagattaatgcgacttgccccctctgcaaatctgaaattgacgccaagaacagagatctaccttctgtagaagaggaacccctccaacaatcctaaggtgatgcagaaaccaacttcttatggttgaaacacagatcatcgcggctagcttgttgcatggggaaccagtagagtatatcccaactgttacttcttctgctgttgctgctactgctactgctgtttctaccacacgaatttcagtttgtatagttgtagctcataccaggtatccataacaagcttgaaagaagaggtaattccattgttgatacccttacatctctctcctgcctcaccagctatatgttgctcggaacttccaaaaaaaatgtcagctgcactcgtgttggatcttcaaaaaatgcatagcttttggaagatctaaaccgggcgatatttttgaagtgtccatcatctaatgcaaacatagcacactgtataaatagatttaagggtaaagctgggtgtacaccgttctcctcaggcgtcgctattgggattacactagagatgctgttatctcgaactttagtctctactttgttataagcttttttttcttcttataacactaaacaactgtcattattaacagtagtttctttgtgaaaaaaaaaaaaaaa

SEQ ID NO: 2348 - DNA, 639 bp, Lycopersicon esculentum
  Predicted polypeptide sequence is orthologous to G1108
cacccacgagctcctctagcccaatggatagttggttatgcatctgggtgtgtagcaattctccctcttctctactggcgttttcgtcatagaaaccaaaattcagatcaggattcatctcagcagccacagatttcttcccaggttgaactctcagccagaccatcctcaagtacaaggagttcagaaggtgaaggtcgtcagacaactgctacagcttctacaggtggtcaaagtaatgaaatactgagcacaaggataaaatcatttgttgagtacttcaaaatggcattagattgtttttttgcagtgtggtttgtggttggaaatgtgtggatatttggcggacactcctcttcctctgaggctcccaacttgtacaggtgatctttcactgttgttttcattttggggtgtttccttactttctatcatctctaccagcatcatatttgctcatgtttctattcatccgtaggttgtgtatagtatttctgacctttagctgtatcgggtatgccatgccatttattctatgtgcaacaatatgctgctgccctccctgcatttattcagtcatgggcttccgagaagatctgactcaaaacaaaggcgcccacacagaatcaattaatgctc

SEQ ID NO: 2349 - DNA, 726 bp, Lycopersicon esculentum
  Predicted polypeptide sequence is orthologous to G1146
gacgcagatgggattatccctgaatattgatatgtcttccacagcattcattgagccactgccggtcattgaatttgtgagccagcttctgaatcgggatatctcttctagaccattgtctgatgctgatcgggttaagataaagaaggccctgagaggtgtaaaggtggaggtcactcatcgtgggaatatgaggaggaagtaccgcatatctggtttgacatctcaagcaacaagagaagttgactttccctgtagatgaaagaggtaccatgaaagctgttgtggaatactttcgagaaacgtatggttttgttattcagcatactcagttgccttgtcttcaagttggaaatacacaaaggccaaattatttgcctatggaggtctgcaagattgtggaggggcagaggtactccaaacgcttgaatgagaggcagataacagcacttctgaaagtgacctgccagcgtcctcaagagagagagaatgatattcttcagactgttcgtcacaatgcttattcagatgacccatatgcgagggaatttggtattaagattagcgagaagcttgctcaagttgaggctcgcattttgcctgcaccttggcttaataccatgatacaggtcgagaaaaagactgtctaccacaagtgggccaatggaatatgatgaataagaaatgggtaatggaggaacagtgaacaacctggatctgtataaa

SEQ ID NO: 2350 - DNA, 544 bp, Lycopersicon esculentum
  Predicted polypeptide sequence is orthologous to G1146
gaccagaaatcaccacctgaccaggagtgggaacatcctacctggtacctgtggtggatacaaaaatatgtcatccaactgaattcgatttttatttatgtagtcatgctggaattcagggaactagtcgtcctgcacattatcacgttctctgggatgaaaataatttctccgcggatgaaatgcagtctttgacaaacaacctttgttatacatatgctcgttgcactcgttctgtttcagtagttcctcctgcatattatgctcacttggcggcctatggagcgcgtttctacgtagaaccagactcacgtgacaacggttctatacgtggcacacgtgcaacgaatggttctgtcaacgtccggccgctaccagcattgaaagagaaggtgaagaatgtgatgttctattgctagagggtgaatgttgagtttatgttatatagtagtagtgagtagataaaatgtatgaaattaggatatgaaatgttatgggtatgatatacatcataattagagtcaataaattataatttaatttt

SEQ ID NO: 2351 - DNA, 801 bp, Lycopersicon esculentum
  Predicted polypeptide sequence is orthologous to G1146
ggtgtgaaggtggaggttactcatcgtggaaatatgcggcggaagtaccgcatcgccaatttaacatctcaagcaacaagagagttaactttccctgttgatgaaaagggcactttgaaatctgtaattgaatattttcgagaaacttatgggtttgttattcagcatacccagtggccttgtctgcaagttggaaatcagcagagacctaattacttaccaatggaagtctgcaagattgtagagggacaaaggtactcaaagcgcttgaatgagaaacagataactgcacttctgaaagtgacctgccagcgcccccaagaaagggagcgtgatattcttgagactgtgaagcataatgcctatgctgaggacaaatatgcgaaggagtttggcattaagattagcgacaagttggcacaagttgaggctcgtattttgcctccaccttggcttaaatatcacgataatggccgagaaaaagattgtctgccacaagttggccaatggaacatgatgaacaagaaaatggttaatggaggaactgttgccaattggatctgcataaacttttctcgcaatgtgcaagacactgttgcacatgggttttgttctgagcttgcacaaatgtgtggaatatctggaatgaacttcaacccgaatcctgttctgcctcctgttagtgcacgccctgatcaggttgagagaagtttgaaactcgattcatgatgccatgacaaactgcagccgctatcgaaggagcttgatctcctggtcgctatcttggcagacattatggct

SEQ ID NO: 2352 - DNA, 413 bp, Lycopersicon esculentum
  Predicted polypeptide sequence is orthologous to G1146
tttttttttttttttttaaataactagccatgctcttcaatagcaattgttcaagccacaatgtacaaacatcacttgcgaataaactactgtttaactgacaactgaactttcataaacatcaaggtgagataatcacatacaatttgaaaagaaattactccagcatgtccatatcatatagcctggttagagaggacttctaacaatagaacatcacccttttgacattctccttgagagcaggaaggggccttacagcagcaccaacacctggcgcccttgtgctccttccaacagctcctacaccacctttgtacggagcagctccgcttgtgacagatccaccgtcagatgtctctggttccatgtaaaaacgagcacggaaagctgccaaatgtgcataatatgct

SEQ ID NO: 2353 - DNA, 611 bp, Lycopersicon esculentum
  Predicted polypeptide sequence is orthologous to G1146
aaaatataattgaacatttactgtcagctgtgatcataacttcgtcacacaacgtgcagttgcaaaaagcataaccatgatctgtaaagcccacagaccaacttaaaaaaaaatagtttaacataaaagaagatttctactgaatacttcttcagcagtaaaacatgacctccgacacattttcatgaatcttaggaagttgcctgaattgtgctgctgctcctccctcaccaccttcattagcagctcttacatccacgtcattctccatgtaatagcgtgcacgaaaggcagctagatgtgcatagtaggcaggtggtactaaggaaactgatcgtgtacacctaacgtacgtgtagcacaggtagttcgttacattctgaatgccatctgcggtgaaattgttctcatcatacagtacatggtaatgcgcaggacgactggtacccttgatcccagcgtggctacataagtaaaaatcaaactcagttgggtggcatatgttggtgtctaccacagtacctggcaaaatatttccactcctgtctgtcaaagtacgatcatcatgattggaagggaatagacgtgtatgatgtcgcttctgcactacc

SEQ ID NO: 2354 - DNA, 666 bp, Lycopersicon esculentum
  Predicted polypeptide sequence is orthologous to G1146
catagtgaaagccaatcacttctttgctgagctgcctgacaaagacttgcatcagtatgatgtcaccattactccagaagtatcttcacgaggggtcaaccgtgctgtcatggcacagctggtgcttctttaccaagaatctcatcttggaaagagacttccagcttatgatggaagaaaaagtctatacactgcagggccccttccatttgttcaaaaagagttcaaaatcactcttactgatgatgaggatgggcctggtggtgccaggagggatagggaattcaaagttgtgatcaaattcgcttcccgagccgatcttcatcacttagggatgtttttagaagggaggcaggctgatgcaccccaggaggcgctgcaggttctggatattgtgctgcgtgagttgccaacatctaagtattgtccagtaggtcgttctttctattctcctaatttagggagacgacaaccattgggagagggtttagagagctggcggggtttctatcaaagtattcgccctacacaaatgggattatcattgaacatcgacatgtcttccacttccttcattgagccattgctggtcgttgattttgtggcacagcttctgaaccgggatgtgtcatctagaccactgtctgatgctgaccgtgtaagatc

SEQ ID NO: 2355 - DNA, 1642 bp, Lycopersicon esculentum
  Predicted polypeptide sequence is orthologous to G1198
atgttatttgtgtgaacattttgtcatatcataatacatgggcaacaataacagttgacagcaagcagtcaacttctttgagtacttagttgtatttcttttgtcattttgcttctctgcctttatccttctttatagctatggagattatttttttaactctctttactcttttagtttaaaggtttctttaaatacctaagaaggtcagtaattgcttctaatttgcaaggagagtatcttcactgtactgatgaacaggcagaaattctgatttacaggccatgaacatgacttctccaacaactcaatttgcccccacaagaaggatgggcatatatgaaccatttcaccagatgagcgtgtgggaagacgcgtttagaggtgacattatgcctagtgctgatgcatgtatggtttcacacccaaacgataggccagatgacaagtcggggtatacatccggtgaacaacatatgccctctggctctggagataatcaagggccgaggagttcttcagacaaggtacaacgacgtttagcgcaaaatcgtgaagctgctcgtaaaagccgtatgcggaaaaaggcctatgtacagcagctggaaaccagccgtttgaagctggcacaactcgaattggagctcgagagagctagacagcagggattatacatgttaggttcaaatagcaatatgggactattaggaacaattaatccaggaatagctgcattcgagatagaatacagtcactgggtggaagagcaacaaaaaaagaacgcagaattgcggagtatattgcagtctcctgtaagcgatatggagcttcagttgctagtagaaaatgtcttaagccactatttcaatctctttcgcatgaaagctgatgccgccaaagctgacgtgttttacttaatgtctggggtgtggagaacttccgtcgagcgctttttcctctggattggaggattcaagccatcagaactcataaatgtggtgatgccacaactcgagcccttggccgatcagcaaatcattaaagtgtgtaatctgcgacactgttgccagcaagctgaagatgctctcacacagggaatggataaacttcagcagactctggctcagagcatcctaaatacgaacacgggagctggaaattacacttcccaaatggtttcttctatggaaaatttagaagcattggagagctttgttaaccaggcagatcaccttcgacagcaaacactacaacaaatgtctattattttgacaacacaccaagcagctaggggcttgcttgcttttggggagtatgttcaacgtcttcgtgctctgagttcactctgggcagcgcgtcctcgtgaacctacctaaatgatctgttcatcagacaactgggatagatgagcttaactagattatgtttgaatgctcgagctgtaaatgggaatgtacgttatcatagttttgcttgcttaggcggatttagctatttactagtatttgaaatacatatttgaaatttgtgtaaatatatttggatgttgtatataggctataaagcaatgaaataattttgttggatgtttttgaagatttatgtgaggctagaaaacttataactaaaaaaaaaaaaaaaa

SEQ ID NO: 2356 - DNA, 719 bp, Lycopersicon esculentum
  Predicted polypeptide sequence is orthologous to G1198
ttgaagtcacaagctataatttgattaagcataaaactttctaaaaatatctattacacttcttaaaaatccctaaactttttccttgtaaaactaaaaacacaggtacattattggttcctaagtcacaaagtaaaattttggcattctataaacctaaggagaaagaaaacaaattctgcacttccacaagcacatacaataccactttatacataagagtaactttgctggatctcatataccggccagtgtatcgaagtagtatatctgagtttcagtagaatatcgcaatgcatgtcatacttattgctctcgtggtctggcaagccaaagagagctgagagctcgaagacgtgagaagtattcacttattgcaagaagagcacgggctgattgtctggttgtcaatatgcgatgcatttgttgcaatgtctgttgacgcaggttgtccgcctgacggagaaaaccttcaagagtccctaatttccccatagccattgccatctgacccatataattagctacatctcctgatgacccttcagtagcaggagatccgttagctaatgtctctgccaaggattgctgcaacgcctccataccttgtgaaagggcatcttctgcttgatgggatgactgctgcaagttgtaaatgccagctaactgttgctcggtcagaggctccaactgattgactagaagcttaagaaagtccg

SEQ ID NO: 2357 - DNA, 741 bp, Lycopersicon esculentum
  Predicted polypeptide sequence is orthologous to G1198
gattttagcaactttcacctgcttctcatctgggtacttccggcactgcttgatttattgatttggtgattctaaacttcagttgatttctcactgattcactgaaaagctgagggacacagaagggctaaagaaattgaagggggaaaaaaccccaacagaaaattacaagatttgatgattctattgtcttattttagctttctggcaaagcttgagccttttgctatagacccttttcgtttcttgaactaagatactacatctgatttgtgttccaatttcaattgattatccacaaagttggctatagtccacgatggctgatatcagtcctagtacatcaacagatgccgatactgaagataagaacaggttcctaaatcaacaacttgtgtgccgtagcttctgatggaagtgacagaccgaaagatcaaaagacactccgtagacttgctcaaaatcgtgaagctgctcgaaaaagccgtctaaggaaaaaggcatatgttcaacagttggagagcagcaggatgaagctgacacaactagaacaggagcttcaacgagctcggaacagggaatatttatttcaggttcaggagatcaatcgcagtcgatgagtggaaatggagccttggcatttgatgtagaatatgcccgatggttggaagagcagaaccgacgaattaatgaattaaggggagctgttaattctatggcttggtgatgctgaacttcgca

SEQ ID NO: 2358 - DNA, 684 bp, Lycopersicon esculentum
  Predicted polypeptide sequence is orthologous to G1198
gatggatgcaatgggtgatagcgaaggccataggattgtgagctctactgcgttgtggaggggtgaccgccggccagcccaaattgtccaggtatcgcagttggagcaggacattgaacgagcacctcaacagggagaaagtgggcccgtagcatttgatacagattatattcgatggttagaagaacacgacaaacacatcaatgagttaaggaacgctgtcaaatcacatgcacgtgatcctgaactgcgaagaattgcggataatgtcactgcacattacgatgaggtctttaggatgaaaggaaatgcagccaaggcggacgtagtccatgtcttgtcaggcatgtggaaaacccctgctgagcgttgttgtatgtggattggtggtttccgcccctcgttactgcttaagcttctagtcaatcagttagatcctctgagtgagcaacaagtagctgactttaacaacttgcagctgtcatcccatcatgctgaagttgctctctcacaaggtatggaggcgctgcagctatcattgggggagacattagccatgggatctccatttactgaatcagggaatgtagctactacttatatgtgtcaaatggcaatggctatggggaaattaatgactcttgaagattttctccgtcaggcggacagcctgcgtcaactagt

SEQ ID NO: 2359 - DNA, 713 bp, Lycopersicon esculentum
  Predicted polypeptide sequence is orthologous to G1198
cctttcttctttgtataatttcataattcagttttaattattttgaaaaactccaatttgtagaagagtttctttgtacttatgaacagtcaatgaacatgagttctacatcaactcagtttgcccccacgagaaggatgggcatattcgaaccattccaccatatgagtatgtgggaagacgcgtttagaggtgatattatgcccagtgttggtgcgtgtatgatcacaccggcaaatgacagggcagatgacaagtcgggatatacttctagtgaccaacttataccatctggctctgaggataatcaagcaggaaagagtatttcagacaaggtaccaacggcgtctagcacagaatcgtgaagctgcacgtaaaagccgtatgaggaaaaaggcttatgttcagcagcttgaaaaaagcaatttgaagctagcacaacttgaaatggaacttgagagagctcgacagcagggacctatacattttaggttcaaatgggtaatatggggctaagttcaacaattaatccaggaatagctgcatttgaaatggaatatagtctctgggttgaagagcaaccaaaaaagacggtagagttgaggaacatattgcaatcccatgtaagcgaatggagcttcagttgctggtagaaacccgtctaaaccactactacatctattccgaatcaaagctgatgctgcgaaagctga

SEQ ID NO: 2360 - DNA, 1363 bp, Lycopersicon esculentum
  Predicted polypeptide sequence is orthologous to G1198
gaattccgggcttttagagttttgaagtgggaaaaaaaaggtttcttgaagacttagctgttgttggctttaagtcggaaggcaatgaattcttcaacatatactcaatttgttgcttctaaaaggatgggtatatgtgatccaatccatcagattggcatgtggggagatttcaaaggtagcagtttcccagatagcttgattcttgaagtcgagaattgcctcgagaatgagatgcctattatggagaaaagactagagaatgagatagaggaaccatcacaagtgacagttggaacgtctaacagatatgaacctgaaacaactaaacgtattgataaggtgcgtagacgccttgcacaaaaccgcgaggctgctcgtaaaagtcgtttacggaagaaggcctatgtccagcagttggaaaatagtaaactgaagctgcttcagctggaacaagaactagaacgtaatagacaacagggtttgtatgtaggtgatggtttagatgctagtcagataggttgctctggaaccgcaaattcaggaatagcttcttttgaaatggagtacggccattgggtggaagagcaagatagacaaacagatgatttaaggaatgctctgaactcccaaatgggtgaaatagaattgcgcattcttgtcgaggattgcttgaatcactattttgatctctttcgcttgaaagctacagccgcaaatgccgatgttctctaccttatgtctggcacatggaagacatcagctgagcgcttcttcttgtggattggggggtttcgcccctccgaacttctaaaggttctcacgccacatgtggaaccattgtcagatcaacaaatccaggaggttagcaacctcacccagtcttgtcagcaggcagaagatgcgttgtcccaaggaatggtaaaactccatcagattcttgctgaggctgttgcagctggtacactaggagaaggagttatccttccacagatgactgctaccattgagaagttggaagctctagttagatttgtaaatcaggcagatcatctccgccaagaaacccttctacagatgtcctgcatactggctccgcaccaatcagctcagggtctccttgccttaggagattactttaaacgtcttcgtgctcttagctcactttgggctggacgtctttctgaacctgcttaaagaggtaagaaagaacctgtgggttttcaactttgccaatcaaagctgtgtgagctaagtaacaagtatgagttggcgctcatttgaaatgtgtatataagttctggtatgctgtaattgaaacattttcttttgttatcacattggttttgatgattgtaaatca

SEQ ID NO: 2361 - DNA, 776 bp, Lycopersicon esculentum
  Predicted polypeptide sequence is orthologous to G1228
gaagatgagcatctcactgtatacaccagtttctcccaaaaaccaattacaagtatttttgaaaccaaatcagaatccccttctactaggtgattctgttcttccaaaacgtgtttcatttgctagaagaaaatgtaccacaagggctctgctttcacattccaaagatgctgttttgaaagagtttcacgagaaaaaagcactaaagattatcgcaggattgcaaaatctggacaaagagaatgtggcttctgttgttactgctgcagataagggaggagcaacacatgtagatatagcttgtgaccctgagctggtgaaacttgctataagcctgacttcccttccggtttgtgtttcttctgtggatccttcagcatttccagctgctgtggaagcaggagccttgatggttgagatcggaaactatgactcgttctatgagaaggattggtgttctctcctgaacagattttgaacctaacgaaggagacaaagaagttacttccatcagtgatattatcagtcactgtgcctcacacgctaagccttcctgatcaggtcaagctggccgagcaattagaaactggaaggtgttgacatcatccaaacagaaggaggaaaatgctctactccatcaaaaggctgtattcttggattaatcgagaggcaacaccaacactagcagctgcttattcgatttcaggggctgtcatatccccgtcatgtgttcatctgggattgagtgcagtcacagcaccaatggcaatcgtagc

SEQ ID NO: 2362 - DNA, 1731 bp, Lycopersicon esculentum
  Predicted polypeptide sequence is orthologous to G1290
atggatagtagaactgctttttcggattccaatgatattagtggaagcagtagtatatgctgcatgaacgaatcggaaacttcactggcagacgtcaattccctcaaacgtctatcagaaacactagagtctatcttcgatgcgtctgcgccggatttcgacttcttcgctgatgctaagcttctggctccaggcggtaaggaaattccggtgcatcggtgcattttgtcggcgaggagtcctttttttaagaatgtattctgtgggaaagatagcagcacgaagctggaactcaaagagctgatgaaagagtatgaggtgagttttgatgccgtggtcagtgtgctcgcctatttgtatagtggaaaagttaggcctgcatctaaagatgtgtgtgtttgtgtggacaatgagtgcttgcatgtagcttgtaggccagctgtggccttcatggttcaggttttgtacgcatcctttacctttcagatctctcaattggtcgacaagtttcagagacacctattggatattcttgacaaagctgtagcagatgatgtaatgatggttttatccgttgcaaacatttgcggtaaagcatgtgaaagattactttcaagatgcattgatattattgtcaagtctaatgttgatatcataacccttgataagtccttgcctcatgacattgtaaaacaaatcactgattcacgtgctgaacttggtctgcaagggcctgaaagcaatggttttcctgataaacatgttaagaggatacatagagcattggactctgatgatgttgaattactaaggatgttgcttaaagaggggcatactactcttgatgatgcatatgctctccactatgctgtagcatattgcgatgcaaagactacagcagaacttttagatctttcacttgctgatgttaatcatcaaaatcctagaggacacacggtacttcatgttgctgccatgaggaaagaacctaaaattatagtgtcccttttaaccaaaggagctagaccttctgatctgacatccgatggcaaaaaagcacttcaaattgctaagaggctcactaggcttgtagattttaccaagtctacagaggaaggaaaatctgctccaaaggatcggttatgcattgagattctggagcaagcagaaagaagagatccactactaggagaagcttcattatctcttgctatggcaggcgatgatttgcgtatgaagctgttataccttgaaaatagagttggtctggctaaactcctttttcccatggaagcaaaagttgcaatggacattgcacaagttgatggcacgtctgaattacccctggctagcatgaggaagaagatagctgatgcacagaggacaacagtggatttgaacgaggctcctttcaagatgaaagaggagcacttgaatcggcttagggctctctctagaactgtggaacttggaaaacggttctttccacgttgttcagaagttctaaataagatcatggatgctgatgacttgtctgagatagcttacatggggaatgatacagtagaagagcgtcaactgaagaagcaaaggtacatggaacttcaagaaattttgtctaaagcattcacggaggataaagaagaatttgctaagactaacatgtcctcatcttgttcctctacatctaagggagtagataagcccaataatctcccatttaggaaatag

SEQ ID NO: 2363 - DNA, 1405 bp, Lycopersicon esculentum; identical to SEQ ID NO: 745
  Predicted polypeptide sequence is orthologous to G1421

SEQ ID NO: 2364 - DNA, 803 bp, Lycopersicon esculentum
  Predicted polypeptide sequence is orthologous to G1482
ctcttgttcaaccttctcctaaacaagctcctatgtgtgacatctgtcaggaaaggaggggtttcttgttttgtcaacaagacagggctattatgtgtagagagtgtgatattccaatacacaaagcaaatgaacacactcaaaaacacaataggtaccttcttactggtataaaactctcagcaaactctgctctctactctgctccatcacaatcacaatcacaatcacaatcagcaatctcctccgcggattcgtgtgtttcaaatttgaagtctaaggattccactagtaagcctgttgctggttctgtgtttgtttctcccgcgattattagcaacagtactaagggaggagcagtatcatccgctgtggaatcagtgaaagttgttaaagagaaagttggtggatgtaataataatgtgcaatttgtgaatggagggggaaataacttaacaagtagtatatcagagtatttagagatgttgcctggttggcatgttgaagattttcttgattgttcaactcctaatgtttactccaagaatattggtgatgaggatatgttgtcattttgggatactgatcttgagagtcaatttagttcatttccaccacaaaatgttgggtatttggggtcccctcagcccctcctctttcagagtcaaagcaagagactcagatccaatttttcccttcacaaattttgaactttggtgggcaaattggtctaaagaatcaagagaagtactaatatcaagtccagtagaaagtgacagatgacaattcatttgctgtcccac

SEQ ID NO: 2365 - DNA, 202 bp, Lycopersicon esculentum
  Predicted polypeptide sequence is orthologous to G1482
tttttttttttttttgttaaacaacaacaacaacaataataattatagtaattatgttaaaagtccaagttagtcgataggaaatgactacgttgtctcctcgtaaggctttgcttaccaaaccaaattaaagatcattaacgttgtttcaacaaataccagagagattttgaaaaaaatgtgaaaggaggtaatacatgtg

SEQ ID NO: 2366 - DNA, 1198 bp, Lycopersicon esculentum
  Predicted polypeptide sequence is orthologous to G1594
gctgttttgatgatggatgaattgagcaaacttcattctgctattgtttgttcacacagtagacgacaacaagaggttgaggttgaggctgaggccgggccgacaattattaataacactactactagttttgctgctgttcatcatcattattgtcaattagaagcagcggttgctgctgatcataatcatcatcaaaataatactaaatccaccaccaatatgtcagatcttattaaagctcagattgctaatcatcctctttatcccaacttactttctgcttaccttcaatgtcgtaaggttggagcaccgcaagaaatgacatcaattctcgatgaaattagcaaagagaacaacttaatatccagctcacgtcacagtagtgaaattggagctgatccagaacttgatgagtttatggaatcatattgtgcggtactagtgaaatacaaagaggagttttcaaaaccgtttgatgaagctacaagtttcttgagtaacatagagtcacagctcagttccctatgcaaagataatttaatcacttccacaagtttcaacaattatatatctgatgaagcaggtggttcctcagacgaggatctaggctgtgaggagatggaagcagcggatagtcaagaatctcctgctaactgtgaaggcgataatgagctaaaagaaatgctgatgcgcaaatatagtggctatcttagcagtttgagaaaggaatttctgaagaagaggaagaaaggcaaattacctaaggaagcaagaattgtattgctggactggtggaagaatcactatcgatggccttatcccacggaagaagagaaaaataggttatcggagatgacagggctagaccagaagcagataaacaactggttcattaaccaaaggaagcgacactggcgcccatcggaagacatgaaatttgctctaatggaaggtgtaagtgctggatcgatgtattttgatggatctggaggtactggaaatattggcacttgaaaatgacaaaacaaaaaaaaaatggaacctcctgctagctaacacgtagtgtatagtgtgacagaaagtatgtgttttgaagtttataaatcaacaattggtaatcatatactctcgtctctcttcctatttttagagctaacaaacgagtttgaaattttaaaaaaaaaaaaaaaaaaaa

SEQ ID NO: 2367 - DNA, 1149 bp, Lycopersicon esculentum
  Predicted polypeptide sequence is orthologous to G1594
cgagtttagttctctccctttttaaaaaagaaaaaagaaaaaagaaaaacacaacacccacttgaaatatcaaacaaattcctgatttgattattttgtattttttttagatatatggatgatgaaataatgtatggttttaattccacaagagatgattatgccgataaagctttgatgtcaccggagaatttgatgatgcaaactgagtacaacaatttccacaactataccaactcctccatcatgtttggatccgatcctattcaattatcatcggaacaaacgcttcaaaataatatttatcgtggaaattgttgtggaggcagtggaagtggtggtgataacaataataataatgatgaagatggttcaaatattatcaaggctaaaatcctctcacatccttattatcctaaattactcaacgcttatattgattgccaaaaggttggagcaccagcgagtatagtaaatctgctagaagagataaggcaacaaaatgattttcgtaaaccaaacgctacttgtttatgtataggagctgatcctgaacttgatgagtttatggaaacgtattgtgatatattgttgaagtataagtccgatctgtctaggccttttgatgaagcaacaaccttcctcaacaatattgaaatgcaattaggtaatctttgcaaagatgatgatgaggaggaggaggaagagttaagttgtggtgatgcatcatcatcaatgagaagaagtgaggataatgaactgaaagataggctgttacgtaagtttggaagtcatttaagtagtctcaagttggaattttcaaagaaaaagaagaaagggaagctaccaaaagaggcaagggaaatgttacttgcatggtggtatgatcactttagatggccttattctacggaggctgataagaattcactagcagaatcaacaggacttgatccaaagcagatcaacaattggtttataaatcaaaggaagagacattggaaaccatctgagaatatgcaattagctgttatggataatctaagtgctcaattcttctcatcagatgttgattgagtttcgaatactgctctcatcatttctctttttattatataaattgtatatttttcaaaaaaaaaaaaaaaa

SEQ ID NO: 2368 - DNA, 694 bp, Lycopersicon esculentum
  Predicted polypeptide sequence is orthologous to G1635
attggtctagggattgctgaatattcagttgctgagcagcagaactctcgcttttcaccagtctcttgtactacggatgcacacactgcaaatataatttctacggagaatgatgatgagagtatgagctcaaactccaacaatgtggatgcaatccacgtcacgttaaaaccagtagctgctagtatcagtctgattaccaattcagagttcatggaatgtaatatagttcatatggagaattcttgtaatggtgaaaagctagctgttgaaccaccttctgcaagtatcaagctgtttggaaagactgttttcgtaccagatgccaataaccttgctccgccagctccatacaacacagaaaaggaaaaggagatcagctatgaagatgtacttcatggattccaagctaaccaagcaaattcaccatttgtacttgccatggttccaggcaatatgattccaccagcatcttggttgtcacaaaacatgcttgaaaacaatcgtgagagtactgcggccttccctgcagctacaatttcttggtggtcctggtaccaagatctcttatatcggtccatctcatcgtgtggccaaacaaccgtggaggctgcttctcattgtcagggactaaaagatgaagaacctcaaagagagggatcatcgactggttcaagcattggctcaactagtg

SEQ ID NO: 2369 - DNA, 672 bp, Lycopersicon esculentum
  Predicted polypeptide sequence is orthologous to G1635
taaaagtgaacagggtgtgaagagctacagttctgtatgtgggggttgttagatcgtgtgattttttggaattaacggttgatatttctgggttttggaactgaagagaatttaattgggtaaaactgggtttcttctattttaggactcaacgagtactgattcagcagaaatgactataggggatcaaagcgagtcggactcgatacttccttgtaggaataggatgtcagttgatgttggagctccttctccaaggagtatccagatggatgagcaagttaatccaggagaagaatatgctcctaagataagaaaaccatacaccatttcaaagcaaagggagaggtggtctgaggaagagcacaaaaagttccttgaagcattaaagcttcatggtagggcatggcgacgaatagaagagcatgtgggaactaaaactgcagttcagattagaagccatgctcagaagttcttttcaaaggttgttcgtgaatcgagtaatggtgatgcaagctctgtgaaatccattgagatccctcctcctcggcctaaaagaaagccgatgcacccttatccaagaaaaatggcaactccacttaaaagtggaaccctggcttcagagaaattgaacagatctggttcacctgatctctgtctctctgagccaga

SEQ ID NO: 2370 - DNA, 801 bp, Lycopersicon esculentum
  Predicted polypeptide sequence is orthologous to G1655
ctctctctctctacataatccttctctcctccgccacctaccgccgccgtctccgccgtcaaactcaaaactcagtttgcatctatttacagaagagaagcaaacgtacaattcgcgagaatcattccgaattttgcatcagaaaattgttccttctgatggcgtcatctcaaaccgtctcgaatcccgatgttaactccagtcactcgcgagaatccaagcgcaaaaagagaagaaaaattggagatgatggggaaattgagcaacaaacgagccttgatcaatccaggtggagaacggataccgagcaacagatctactcttcaaagcttctccaggctctccgtcacgttcgccggagtaatgacaatccatctccggttaatgccggacgcgccgtcagggagaccgccgacagagtcctcgccgttacagcgaagggaagaagtcgttggagcagagcgattctcactggccgtctcagcctcaggcttagccaaatcaataaaaagcataagaaagcaaaactgaatagcggcaatataaaatcaaagaaaccagcggcgaagaagcgattgcctgctttgcaacggaaagttcgtgttctcggccgtttagttcccggttgtcagaaactcccgtttacgaaccttctagaagaaactaacgactacatatcagctctacagatgcaaatcaaagccatgacttttctgaccggcctcctctccgccggtggagcaggatcagttgccgctcaccccgatcggctcggctaagtggcttgggtacacatgtccc

SEQ ID NO: 2371 - DNA, 1359 bp, Lycopersicon esculentum
  Predicted polypeptide sequence is orthologous to G1798
tgcatacatcaaacccataaataaagatccttcatatatatatattcttgtttcttcttctgtttatatatatatatatattttctaggaatctaattccttaattattttcttttccatcctctttcctttttcccggaaaatcggaataaaaatggtgagaggaaaagtagaaatgaaaagaatagaaaattcaacgagcaggcaagtgacgttttcgaaaagacggaatggacttacgaagaaagcttatgaattatcagttctttgtgatgctgaagttgctttcattattttctcacataaaggaagactttttgaatttgctagctccaacatgcagaagataattgagagataccgtggacgtacaagagaaacaacgacggtggataaaagcactgaactcgagcactacatggagaacttgaagcatgaaacagctaatatggcgaagaagatagagattctcgaaatttctaaacggaaactaatggggcaaggattagggtcatgttcaatggatgaactagaagacattgacagccaactggagaggaccctcaaaattatcagggctagaaaggctcaattgttcaaagaggaaatagaaagtctaaagcaaaggagagattattgctccaacaaaatgcaagtttacgtgaaaagtgcgggcttaggccaatgcaatcagagtcagcacccgcacctgcacccgaacccataccagcaccaccatcaacaccaccggctcaatcgaaagaaaggggaaattgtagccaaagtacaaagagttgggaagtggagactgaattgtttattggccttcctcaaacgcgctgcttatagtagcttggatcagtggttgagccaggttttttttttttatcaaaggaattcaaacctcgaagaagtacacagagaaggcaaaattgggttcaatctctactctatatacactacattaaaagataaattttaactatatatgttataatgttatttttcgctgtaggagaatcagttaaacaaccccaccaatcctacgtggctccgccccgaccgggacaatgggaccatttgttcatattttgtttatggttctcctcagttatttagattaagaggttaggatttctcagttatttacaaccataaggagttgcaaaattcaataaataataccttacaataagagtgtaatatttctttctatttttcatgtatttatagtatactttctatttttcaaacattctaaacagctcaattgttttgagtgtatcacaagtttgtttttggtttataatggattataaaatttataggtgaattcaaaatttgaaaaaaaaaaaaaaa

SEQ ID NO: 2372 - DNA, 585 bp, Lycopersicon esculentum
  Predicted polypeptide sequence is orthologous to G1798
gtgtctttccattttagctccaaatagtccttttgcaaccaaaatcttgtctgagatttttctatatttgggattgatctaaagatatggttcgaggtaaaacccagatgaggcgtatagagaacgccacaagcagacaagttactttctcaaagagaagaaatggtttgctaaaaaaagcttttgagctttctgtcttatgtgatgctgaagtgggattgattatattttctccaagaggaaaactatatgaatttgctagttcaagcatacctgaggtaattgaacgatataagaggcatactaaagataaagttaaatctgatgaaaatcaatctgtggatattcagcatactaagcaagagacagcaagtttgatgaagaagatagaactccttgaatcatctaaaaggaaactcttgggagaaggtttaggatcatgcagccttgaagaagttcaacaattagagaagcaattggagcagagtgtcattactattacggctcgaaagatgcaagtctttatggaacaaatggaaagattgaaagaaagggagagagcccttacagctgaaaatatgatgc

SEQ ID NO: 2373 - DNA, 573 bp, Lycopersicon esculentum
  Predicted polypeptide sequence is orthologous to G1798
gatttttttaaatcaatttctatgtgattaattccttcttcaatattaagtttttttttttttttttttttaattaaggggattgatctaaagatatggttcgaggtaaaacccagatgaggcgtatagagaacgccacaagcagacaagttactttctcaaagagaagaaatggtttgctaaaaaaagcttttgagctttctgtcttatgtgatgctgaagtgggattgattatattttctccaagaggaaaactatatgaatttgctagttcaagcacgcaggagataataagaggcaataagaggcatactaaagacagagttcaacctgaaaaccaagctgggccacagtatctacagtatatgcagcatgaggcagcaaatttaatgaagaagatagagctccttgaaacagcgaaaaggaagttcttgggagaaggtctgcagtcctgtacccttcaagaagtacaacagatagaaaaacagttggaacggagtgttggcaccatccgggcacgaaagcttcaagttttcaaggaacaggttgagcgactaaaaaaaaaaaaaaaaa

SEQ ID NO: 2374 - DNA, 828 bp, Lycopersicon esculentum
  Predicted polypeptide sequence is orthologous to G1844
ttactcttcacaaaaaaatcataacaataatgtgtagggtaatcaatttcaagtactccattatacaacttaaaaagagggaaaaataggcatataagtcaccctctagtaaatatgtcaaagtagagaagttaactttaatcatcatccattagaaacaagaacaaggatgaataattattagttttattgaaactaattttgcaggttcctctggtgcagaagcaaggcttttcgacgaatacgacgataatcactagaagaaattcagggtaactttttgttgtccacaaatcatgtggggtgctggaaggtcagacatttcattcacttttgtgtttttcttgatactagctatattgtcctccagatgtttcttttcctctagcagcagtttttccttctcatgaagaaccttagcagattcaagcatcaaatgtgtctttctagctctgagatgtattagagcagtttgaagttcgttttccaaatggataaggtcagtcaaagtgagaccatcagcatttgtttcctcgagttgcctttctgttgtttgtagcagttctcccattgttgtgaaccccgacacctctgcgacctggatttctgcattgatctctttttctgctccaacatggctttcatatcgtcgaagcatcgctgtcatactgttattgctggagaattcatggagtctaccacgatttgagatgataacaacagcaacatcgacatcgcagagaatagaaaattctttagctttcttcaataaaaccttcctccggttacagaacgcaacttgcctgcatttttatcttgaattcgctt

SEQ ID NO: 2375 - DNA, 667 bp, Lycopersicon esculentum
  Predicted polypeptide sequence is orthologous to G1844
atttattaccctgttatcactgtttggcacaaaggcaagacttcttatttccccaaaagaaccaactcttccaacgacacttcaagatagaaaaccaacttttgggttattatgctcaaatagccaactaaaatttcagtggctttaataacctgtattttgtttatgactgggtttacagtgtaaaatgttgagttgtgttatttcttcatgcaatctgacaggagttattcaccgatataacaaccacatgaaagcagaagataaggcctctgcagaagtcgatgacaccgaggaatcaaaatatgcaagtttcatgacaatggaagaactgctacagacggcagaaaagcaactcgaggagcctgatgttgatgatctcagcattactgatcttgtccatctggaaaaccaagttgagactgctctgacacaaaccagatttagaaagacacacttgttgattgaatcaattaagaatcttcatgacaaggaaaagcagctgattgatgaaaacaaagttctggaggatgagataggtaccataaagaacagcgaagaaaatgagatggcaatgaatctaaataacatcgcaccaacccatatggattgtggacaacagagggagaccctgaattttctctagagtctagacacactaatggca

SEQ ID NO: 2376 - DNA, 700 bp, Lycopersicon esculentum
  misc_feature (625)..(625): n is a, c, g, or t
  misc_feature (653)..(653): n is a, c, g, or t
  Predicted polypeptide sequence is orthologous to G1844
gctgggtaggtgtaacgccgatgatagaagaatcttctagacatctgaaatttgtggattagggcttttcatcggcgaaaaaaaaaatggggcgaaggaaggtagaaattaagcgaattcaagataaaaattgcaggcaagttgcgttctgtaaacggaggaaaggtttattgaagaaagctaaagaaatttccgttctctgcgatgtcgatgttgctgttgttatcatctcaaatcgaggcaggctccatgaattctccagcaataacagtctgacagaaatgcttcaacgatacaaaagccacgtcgaagcagaaaaagagatctctacagaaatccaggtggcagagcactctaaatactcagggttcataacaatgggaaaactgctacaaacaacagaaaggcaactcgaggaaactaatgatgatgttctcactgtgactgaccttatccatttggagaacgaacttcaaactgctctaatacaactcagatctagaaagacacatttgttgcttgaatctgctaagggtcttcatgagaaggaaaaactgctgcaagaggaaaagaaacatctggaggacaatatactagtatcaagaaaaacacaaaagtgaatganatgtctacggatttcgctgactttccancccccattcgatttctggacacagaaaataccctgaatttcctctat

SEQ ID NO: 2377 - DNA, 679 bp, Lycopersicon esculentum
  Predicted polypeptide sequence is orthologous to G1902
cagagcaaacagaagctcacaatatgcaagatccatcatcaatatattcacagatcaatcctcagttcccagatcaacaagtcctgaaatgccctagatgtgattcaatcaacacgaagttttgttactacaacaattacaatctttctcagccacgccatttttgtaagaattgtaaaaggtattggactaaaggaggtattttgaggaatattccagttggtggaagctctcgtaagaacacaaaacgatcttcttcgaatagctgtaaacgctcctcaacgatgacgatttcatcttcaacttcatcagaacaaaattcaaaaacagagcattttgatacccctgttgttcggaacagcccgattgttgacgccaatgggcctttcggctcgctactagcatcaaacgggccggagatagggaattttttaaatgttttgaatcctaacgggcccgattcgggctcagacgctgctgccgctcaaagtgggaatagtaataataatcatgaatttttgggtgaagattctaattgttggaatggtactaatggttgggctgatcttgctatttacaccccaggttcaacctttcagtaattaattaattaattaattacaatagattattagaactttgtattagtactactaatacttatgaaaatgcacttatc

SEQ ID NO: 2378 - DNA, 612 bp, Lycopersicon esculentum
  Predicted polypeptide sequence is orthologous to G1911
ctgcttagtactctcttcttctttgtatctctttttctacatttttcacaacttgtgatacttaacaaaagatcatcatgagctcgatgtcgtctcaacatggttcttctggatcatggactgcgaaacaaaacaaggcgtttgagaaggcattggctgtgtatgacaaggaaactcgcgatcgttggtccaatgttgctaaagcagttggaggcaaaacagcagaagaagtgaaaagacactatgaaatccttttgagggatgttttctttattgacaatggtatggtgcccttccccaaatacaaaactactggaggatcccataattccacctctgattaacattatttttactaaaggagcaaaacctaacacttcatcgaagtaacaaacgtcaataagcagactagaaaagtgcaaataatttgccttggaacctgccttttaaaatatttaattttcaagttgtatatttaatttctttgtccaattaaattttaaacgctgagtttatttagtattaattacctacggaaggaatcatttgaattctgtctgctcttgtactcgtcatgtccccctctaatattaattaattatattgttcctt

SEQ ID NO: 2379 - DNA, 658 bp, Lycopersicon esculentum
  Predicted polypeptide sequence is orthologous to G1930
gtagttacaccgagcgacgttggaaaacttaataggcttgttattccaaaacaacacgcagagagatatttccctttggttgccaaagtaaataaaaatgataatacttctaaaggggtattattaaatttcgaagatatgaatgggaaaatgtggcgatttcgatattcgtattggaatagtagtcaaagttacgtattaactaaaggatggagtcgttacgttaaggaaaaaaagttgaaggccggagatatagtgagtttcaaacgatgttctggagttgaaatcgaagataaacttcttattgattcgaagaacagaataatacgaggcgaacaagtaaaaatggttagattatttggagtgaatatatgtaaggttcaagatgttagtaataatgttgttgttgagaaaaatatgagtgttggcaaaagaatgagggagatggagttgttggcatttgagtgtagcaagaaacaaagggtaataattgatgccttgtgaatttttcttttgtttgtaattttttttttttgtactttggtttttttagatgttttaatttatataacttccaattgtatattagtgttattaggaaaaaaaaaagggctcaaaaagagagctaatcaactatggtgtaaacatagatgaaaat

SEQ ID NO: 2380 - DNA, 556 bp, Lycopersicon esculentum
  Predicted polypeptide sequence is orthologous to G1935
aaattcattttgcttcactctaatacactaaactagaagcttctctctaaaactcacatgcagtggatcggaaaaagttccactgctgttttcatctccaaagctaaggcgaaaatattagaatttttcatctaaaagctcccaagctaacttcatgcttctctccaagcgatttttttcgaagtagagtactacggatccaaaagatttcatttcaatctaccaaaatcaagttctagtttgcatcttctcatgggtcgcaataagattgtgatgaagaaaattgaggattcaacatcccgtaaacagttctattcaaatcgcaaggatagcattgtgaagaagtcaaatgagctggcggttgtatgtggtacagatgtggggttgttgatgttttctccatctggtcagctgactacctattctagcaaagaaagtattgaggacatcatgatcgaagctatgaacaagtctgtgaatccgcgacccataccaaatctaaatgaacagcttttgatgcagagtctcaaacagtcaaaatctgaaggccaatggt

SEQ ID NO: 2381 - DNA, 519 bp, Lycopersicon esculentum
  Predicted polypeptide sequence is orthologous to G1935
gcttggattggcttgacctaaatagaaggaagctcgagctacattgcaaaagcttttatcagcttgtgatgaagaaaattgaggatccaacatcccgtcaacagttctattcaaagcgcaaggataccatccttaagaagtccaatgagttggctgttttatgtgatgtggatgttggtcttctaatgttttctccagccggcgaagtgactagctattctagcaaagaacgtcttgaggatgtcatgctccttgctatgaacaaggctggtgaactgaacaagctatctcctgaaaatccaaatgaacaggctttgatggactctctcacacaatcaaaacatgaagccgaaatggtggagaagatagcgattgttgaggctcatgaggagaagcttaatggggtcaaagaaagactaagtgaagcacaacagaaaataaggtattacgaaccacaagtggagagtatcaactctgtccaagaagctgatgcatatgagaagttcattttgagtgctc

SEQ ID NO: 2382 - DNA, 744 bp, Lycopersicon esculentum
  Predicted polypeptide sequence is orthologous to G1944
ggagcagtttgcaaagcattaatatctgctgaaaaaaatggagtcaagggaagctatagctccagaagctccatcaaactatcatatggtatctagaacagaatctactcctataccacctggtacattggcggtgattccccctccggtggctaccgcctttccaattagctcagagaagaagaaaaggggacgtcctaggaagtatgggcctgatggagcagttgcaaggacaatttcacctacgcctatttcagcagacttcttgtcgaagaaagtgagtgttgcccgtcctgaatcggagaaaaaggctcgaaacaaagtgggagctgaaaatttaggtgaatggatttcatgttccacaggtggcaactttttgcctcacatgatcacagttgaagctggtgaggatgttaccatgaagataatctcattttctcagcaagggcctcgagctatttgcattatttctgctgttggtttgatatcaaatgtcactctacgccagccaaattcatcagggggaactctaacttatgagggtcgatttgaaatcctttctttgtctggatcctttactccaacagagtttggggggttctcgtactactagcagaaccggaggaatgagcatttctttgggcagtccggatggaccgtgtgtcgggagaacacttgcaggactgctaatagctgctagtcctgtccaggttgtagtggggaagttttctaccaagcaactac

SEQ ID NO: 2383 - DNA, 551 bp, Lycopersicon esculentum
  Predicted polypeptide sequence is orthologous to G2052
agactctgatcactcaaatttagcaacttctcaactatttagaattgatagtactagaaaaaaaaaacaacctttttttcatgttttgacaaaccatatagtgacattttgtgccttgtgggataaggcagttttgaacctttattttttttcctggaagatgattgaattgttccagggatattgcatcttatgtgaacttacaaaattcagtgtagctaaaagtttttatttttggatatttcaaattttcaataggtacagtttgaacatttagctaaatttcatattgtaatttgtgtgtagttatagcagttggaaaaatatttacttatatggcaggaatatcgttacctcccggatttcgtttccatccaactgatcaggaattggttggatattacctgaaaagaaaaactgatgaacttgaaattgagttggaagttattccagtaatagatctgtacaaatttgacccatgggaccttccagagaaatctttcttgccaaaacgtgatatggaatggtacttcttctgctctcgggacaag

SEQ ID NO: 2384 - DNA, 801 bp, Lycopersicon esculentum
  Predicted polypeptide sequence is orthologous to G2141
aaataacaacaaaaaagacattgtataacatttaaaaaaaaagaaaaaaagtgtgtactgtgtacagactacagagtaacagcaaaataaggcacaaaactataatcttgttccttcaatttctctacctgtatggatgtgtaatgaagtggaggcatttcaccagctgaacaatcgatccctctcgtcggatctttgaaagtggccaattgtttgatgtgtatcttatagattgttaatcttgaggcaaggggattttttttttttagtttaagtttgattcatttcccaaataatggatatgggtagcaagaatgatactcaaggacaaaagaggaacaaggatgctactaattttcagtcaccaaacatatcgttggactggcaattaagtggaagcaacttgacaaatgcatcaatggggatgatccctaatagcaatcctttagtagattcagtttttcccactatttgggatcggcctcccaattcgtcacacttaggtttctatggtaataataatgctaatgctcaaatcagtccttgcattatgaatcagcacgagactgcagcaattggctcggtccctacgagaggtagtatgagttggaatccactgaattcgatgctgaaaggggctatgtttgtaccacctattcctggaatgattcctcaaagcttagctcagcttccagctgatttgggtttcattgagagagctgcaaggttttcgtgcttcagtggaggaaacttcaatgatatgatgaaccggcctttaagcgtccctgagtctactaagcc

SEQ ID NO: 2385 - DNA, 577 bp, Lycopersicon esculentum
  Predicted polypeptide sequence is orthologous to G2226
caataaatttctctcccaattctcttaatatttcaaatttcaaagaattttctaacatcttctagctcctactacacctataggcaataatataaagtccagttcagtcagctgttccagaagttgttgctagtagaaatctctaagttacagcctagattccaatccagtatgggactctcacagtatccaactccagcagatgcaggagtgctctgtgttattctagtgaacacagccatatccatctccattgtcaaggagatgggccgatcgatccttcatgtgattggcatccacattgcatcatgggacgattattccatcgaaggctccttggactcgtttgaatgtcgcagaagcccatcagagtcatatatggaggaattcagaagccagacccctgcaattcgttatgattccatctgtgtctctaaccacgctgagaaagagtgctcactctgcctgacggattatgagccggacgcacagataaaccatctgtcatgtggccatgttttccacaagcattgattagagaagtggctcaagtactgccaatgtaacttgtccactt

SEQ ID NO: 2386 - DNA, 610 bp, Lycopersicon esculentum
  Predicted polypeptide sequence is orthologous to G2226
caagaatgctctgtgtgcctgacaaaatttgagcctgatgcaggggtaaacagcctctcatgtggtcatgttttccataagctgtgtctagagaagtggctcaggtattggcatgtaacttgtcctctttgtagaaattacttgatgcctcaacaagaagaggacgatacatgtccaatgtgagattaaacgttttacggtgccacttcatccatttgctgatgttattatgtacagcttagtagtgtacaggctgagtatgtgtatgcttgatctttgatgtgatatagtctgttagcttgtcatatttgtgatggtttgcgtcctctcagagtgacgggtctctttcgtgtgaccaaaaaacttatactatgttgtacatgatttagtcctgtagcttcttgtgtttgtaatgctttgcgtcctctcagagtgacgggtctctttcgtgtgaccaaaaacttgtacattatagtacatggtgtagtcgtgtagcttattaatgcttttcgtcctctccaagtgacgagtctcctttggcatcaccaagaacttctacattgttgtacattgttgtacatataacctaaaactttctcttatgttactt

SEQ ID NO: 2387 - DNA, 719 bp, Lycopersicon esculentum
  Predicted polypeptide sequence is orthologous to G2226
ggttataggaaacaaaagttcgcttcttttttatggggtcttgataaaaaatccagtgcattgagttcttccaaaagtttggcttgaagaagaaattcctcacatctacactaggttcctattcataatgggactctcaccatatacgactccagcagatgcaggagtgttctgtgtgattctggttaatacagccatatccatctctattgtcaagggaatggttcgatctatccttcatgtgattggcatcaactttgcatcatgggaagaatattctattgaaggccctttggacccatttgagtgtcgtgggagcccctcggtatcatacatggaggagttccgaagcagaacccctgctgttcgttacgattcattgtgttctaatcaccctacacaagaatgcgcggtatgtctggcagagttcaaacatgacgaggagataaactgcctctcatgtggccacgtttttcataagctgtgtctcgagaaatggctaaagaattggaatgtcacctgtcctctctgcaggaattacattatgcctaaagaaggtgaggaagatacttgtccaatgtgaattttgtagtttgtcaggcctgtttgatatgttctgatgtacagcttagttgggtaaaaatttattgatgactgcctgatctttgacactgcataattctgtaaccttttatactgtaatacttttgcgtcctatc

SEQ ID NO: 2388 - DNA, 1292 bp, Lycopersicon esculentum
  Predicted polypeptide sequence is orthologous to G2520
gtgaatgcctaataattcaccattcgcttcggatttggatcgggtattgaaatggatccacaagcttccatgatgaaccacgccggaggatttcagtctccgccgtttaatttatctgagatctggcagtttccgatcaatgcaggtgaaggtgagacgccgtatagttttccgttgtctacggcggctgcgccgcagaatgtgagtgatgatgttcggaataatgatcctatggttctagaccggagaactaataattacagcggtggcggcggtggtggtgcagctaggaagcgaaacgaggatgatgaatcagctaaaggagtttccactagcggcaatggcttgactgaatctgctagtaagcggatgaaggttacaagatcaaatgagaattgcgaagctagaggtgacggggaagggaattcagtgaaatctgcagaacaacctgcaaagcctgctgaaccgccaaaagattacattcacgtgcgggcaaggaggggtcaagctactgatagtcacagtctagcagaaagagctaggagagagaagataagtgagaggatgaaagtcctccaagatatagtccctggttgtaataaggttattggcaaagctcttgttcttgatgagataataaattatattcaatcattacaacaccaggttgagttcttatcaatgaagcttgaagcagttaattcaaaaatgccaagcatagagggatatccatctaaagatttcggacagcagccatttgatacaaatgctatggcattcagttcacaagctacaagggaatataccaggggaacatcaccagattggttgcatatgcagcttggtggaggctttgaaagaacaacataaatttgcatcagaaggttaataataagttcattggaaggttccctcttttggtgattgccagaacacaagaccagtccaggtttctttgaaagcttatatccagtatctttatcaagcacaaaattgttgaatgtctagtacagctgataaacagacaaccacgttttccacttcgttcgtctatcgtgttatacttgtggcaggcaccatataagtattcttgtgaaagtgcttgtttaataataggtaaagaattgggtgtattagtatgctgaagttgtagctaaataaagtggtctgtcccgtccttaaaaccattggtagatagcatcaagtcttgtaaatagggaaaatcagtgtttctgtgtttcgattgttcaacaagttaagacaatatactttatatcaaaaaaaaaaaaaaa

SEQ ID NO: 2389 - DNA, 637 bp, Lycopersicon esculentum
  misc_feature (517)..(517): n is a, c, g, or t
  Predicted polypeptide sequence is orthologous to G2520
caggcagaatcaagttctcagacggctaacaaggggactgagcaaagtagtaaacctgagccacctaaggattacatccacgtaagggcaagaaggggtcaagctactgatagccacagtctagcagagagggccaggagagaaaagatcagcgagaggatgaaaattctgcaagatttggttcctggatgtaataaggttatcggaaaagcacttgttcttgacgaaataataaattatatccagtcactacagcgtcaagttgagttcttgtccatgaagcttgaagcagtcaattcaaggatgaaccaccctatagaaacctttccttcaaaagatctagcaccatcagcttttgatacgagtggaatgattttcggcactcaagcaccgagagaatatgctcaagggacacaatccgagtggctccatatgcaggttggcaacagctttgacagagcaacatgacagataccctaatgaattggaatatagattattcaggaacattagcctnccacaattattcatcatgtcttttagagaaccttggtactggatccagcagctgtgttccactatagaagaagcattcttaaatgtgtaatcatataatcatttccagtagaattggctg

SEQ ID NO: 2390 - DNA, 753 bp, Lycopersicon esculentum
  Predicted polypeptide sequence is orthologous to G2574
aagccttgatttaggattggattgcaagttcgaaacaacgccaactgaatgttcaccagtgaattatagtccggagaatagcttagatgatattcaagctaataaggatgaaaatgaagagacgtcgaataaaaatctcaagacgatgagaaataatggagatggagatgatgtttcgcaacaaaaccctactaaaagagctagggtttctgttagagtcagatgtgatgcccctacgatgaatgatggatgccaatggagaaaatatggtcaaaaaatagcaaaaggaaatccatgccctagagcttactatcgttgcaccgtagcaccaaattgcccagttagaaagcaggttcaaagatgtgccgaagacatgtcaatattgatcaccacatatgaaggaacacacaaccatacccttcctctttcagccaccgcaatggcttctaccacctcagcggccgctagcatgctgttatccggttcatctaattcatcagacccaaacccacaagtaactgccaccaccaccactacccctactaccactacttctgccaatatcaacggactcaacttctatctctctgatacctcaaaacatcataaatcgccatattactttcctaattcatccatctcagcatccgcacctaattccctcccctacattacactcgatttgacttccacctcgtcctcgtccccgtcctcctatctcatctaacagaatgactcagaattttcctccta

SEQ ID NO: 2391 - DNA, 770 bp, Lycopersicon esculentum
  Predicted polypeptide sequence is orthologous to G2574
aaggattatcggaatcttcaaatgcaattccatgaagttgcacaaagagatgctgaaaaaactaatactgatgttaaacatgacgaagctgaacttgtttcccttagcctaggaaggacttcaagtgacacaaaaaaggagttatccaaattaattttgagcaaaaaagagaatgatgagaaggaagaagataacctaaccctagcattagattgcaagtttcaatcatcgaccaaatcttcaccatcaaatctcagtccagagaatagtttaggagaagtgaaggacgacgaaaaaggaactgatcaaacatggccacctcacaaagttctcaagacgatgaggaatgaagaagatgatgtgacacaacaaaaccctactaaaagagcaaaggtttccgtcagagttagatgtgacaccccaacgatgaacgatggatgtcaatggagaaaatatggacaaaaaattgcaaaagggaacccatgtcctagagcttactaccgttgcacggtagcaccaaattgccccgtaagaaaacaggtacaaagatgcattcaagacatgtctatattgatcacaacatacgaaggaacacataaccatccacttcctcattcagccacatcaatggctttcaccacttcagcagccgcttccatgctattatccggttcatccagctccggatccggacccacaagtagtacagcctctgccacaacctctgcgctcaactattgcttctctgataactcaaaacaaacccattt

SEQ ID NO: 2392 - DNA, 641 bp, Lycopersicon esculentum
  Predicted polypeptide sequence is orthologous to G2741
cttcattcaacggcatctctctcaaattcgccggaatatactccaccagcggaagaagattgtagtacttgcaaatactgttaccatgggtgaagaagtgagcctgaccgactatgaatcaagcggtggtaacgatgacagacttctctgggaaattggacttcccgatgtcgatgatctcacaccgttgaatatgcagttgattccgtcggaacttgctgctgcgttcagaatttcgccggaattgtcaaagacgatgaccgatgtaaatcgtgcttcgcagaatacgttttcttctctccagagatggcactcacaggatatggcttcgatgaataactctaatttcaagacgtttagctatgagaggagtagagaagagactgttactgaaagagatgaaacggatctgataagagagggatccgactcgaggaagctccggcgggttgaatccggaggcactgaggaggctgattcatctctgtgtaacgagaattttgcggatgattcgtctgctaagactctgaaacggcccagacttgtttggacgccgcagttacacaagcgctttattgaagtagtggcgcacttaggtatcaaaggggctgtgccgaaaacaattatgcagcttatgaatg

SEQ ID NO: 2393 - DNA, 653 bp, Lycopersicon esculentum
  Predicted polypeptide sequence is orthologous to G2990
cacacatgcttttggctctaagcgctgggttttccggggagaaaaatcagaacctccccacatcgactacgccaatggcggtagcaaattctaacgggaggaagcgtttcaggacaaaattcactccagatcagaagattaaaatgctggaattcgccgaaaaagttgaatggaaaatgcagaagagagatgaagatctggtgaacaatttctgcaacgaaattggagttgaaaaaggggttttaaaggtatggatgcacaataacaaaaccacctctatctccggcaagaaattagatcaaccgaacaccgacaacggccacaaccaccagaatggtaactctaactatactgttaatgggttttgtattgttgatagaaataatactactcatcatcacgacaacactgactcggaatttcacattcaccatgaaagcagcatgaacgatgacaacaagaaagaaaattcaagttttggtgctaataatgtcgttgtcactaatgggtcttcttcttcatcttgattttagattagtttgaataatgtttcaattagtagtaattagtgcaaggaagagaaaaactatgaggctgcaactattttactatatatatatatatattagttacctttatttctttgttcctct

SEQ ID NO: 2394 - DNA, 566 bp, Lycopersicon esculentum
  Predicted polypeptide sequence is orthologous to G3061
ttaggcctgaatttatgggacttggattggaccctgcaattagtgatcatcatcaaccacagctcaataatgtggatggacaaaaaccaaggataccactttggttggacaataatatgaacccgaatccaggtaatgatttcttagtagcatcgtcaagctctactactagcaatttgcctcatcatgaattggtccaaatcgccgcacataacaatactcaacaatggttcattaatggtactggtgttggtgatgattctggaattggctcatcctcgtctcaacttccttcacgagtattgctaaaggaggaggaagagaacaaaagaaatatgtcggagacaataagttcaatgtactacaacaatcatcacaacgaaacaacagcaccagctactcatatgtcggctactgcacttttacaaaaagcagcccaaatgggatcaacgaggagcaattcagccctctttggtactggattcgggctaatgggctcgtctttttctaaaagcaatggacaaggacaatttgctactcatgatcagaattttaacggtttaatg

SEQ ID NO: 2395 - DNA, 559 bp, Lycopersicon esculentum
  Predicted polypeptide sequence is orthologous to G3061
tgatgtcggatgatggactttcttcattagctttcattcaagatccaaactcaaaccctactaataataatccaaaccctaactcaaatccatctgctaaacgaaaaagaaatctccccggaaagccagatccagatgcagaagtgatagcactatcaccaaagtcactgatggcgacgaatcgattcatatgtgaaatctgcaacaagggttttcagagggaccagaatttacagctccacagaagaggtcacaacttgccatggaagctaaagcaaaggaacaaaaatgaagttatcaagaagaaagtttatatttgtcctgaaaagacgtgtatccaccatgatccatcgcgagctctgggagatttaacaggtattaaaaaacacttctcgagaaaacatggcgagaagaagtggaagtgtgagaaatgttccaagaaatatgctgttcaatctgattggaaagctcatactaagatttgtggcacaagggaatataaatgtgactgtggaactctattctccagaaaggacagctttataacacatcgagcatt

SEQ ID NO: 2396 - DNA, 671 bp, Lycopersicon esculentum
  Predicted polypeptide sequence is orthologous to G3061
gttttcatttccttcttctgttaaagcagtacttcctcatcatcatcaagaacttcaaacagcaaaccctaaccctaaacctaatacttcttccaaaaaaagaagaaatcttccaggaacaccagatccagatgctgaagttattgcactttcaccaaagtcactcatggcaacaaacagattcatatgtgagatttgcaataagggttttcaaagggaccaaaatttgcaacttcatagaagaggacacaatcttccatggaagctaaagcaaagaaacaagctagaacaagtgaagaagaaagtgtatatatgtccagaaaagacatgtattcaccacgatccatcgcgtgcacttggcgacctaactggaattaagaaacattttagtagaaaacatggagaaaagaagtggaaatgtgaaaaatgttcaaagaaatatgcagttcaatcagattggaaagctcatagtaaaacttgtggaactagagagtacaaatgtgactgtggcacactcttttcaagaaggatagttttatcacacacagagctttctgtgatgctttagctgaggagagttcaagaatcacatcagttggggctaccaaatttgatcaacttcccaaaactgcaactttattgaaccaacacaagcaaattacatggcggat

SEQ ID NO: 2397 - DNA, 311 bp, Lycopersicon esculentum
  Predicted polypeptide sequence is orthologous to G3061
gtttttttttttttttttttaaaattaatctgattttcagataactacaacaaaaaagttactaactttatgaatgaaccttaaaaaacttcccttctccatcaaacttggaacatttttttttataaaagattcagttgcagaaaaaaaaacaagaaaactccactaaagggaacacaaattaaaatactttaacccaatgtataatataccttggaaactcaaaaataaaaccaaaaattgtgcaaatcccacaatttacatcaagaactcataaccccaattcttgttttttgctctttaatctgaaa

SEQ ID NO: 2398 - DNA, 1660 bp, Lycopersicon esculentum
  Predicted polypeptide sequence is orthologous to G2
ataagctgctttaggcttattcttccgaaactagcctcgtctatatccatcatctctctcttaatttttattttttttctttccccaacaacttcaacttctctataagtcataacttccatctttctttcaatttacaacaaaaaaataaataaatcattcttttcttcatttcatacatcaatataggtcacttgcaaccaaatatcgaaaaatacactcattttaattctatcgacaaaagaaatgtggaatttaaatgattcccctgatcagacaatggagtatgaatccgatgaaggtataacggttagatcggaatcaaattcaatttcatccgctctacttgttgtagaagacggtaattcatcagaagaagacggtgaaaaaggtaaaaaaaagaaaagtaataatacaccaggtaaaatattcggattttcgattaaagaccacaatttggaatcgccggtagttacccggcaattttttccggtagataacgagtctaccaattttccaagggcacaatgggctggaattaaattttgtgaatcggaaccgccacttgtcaatggattagtggggaacaaaattgacgtgttgcaacaacagccaattaaaaaaagccgtcgtggaccacgttcaagaagttcacagtaccgtggtgttaccttttaccggaggactggccggtgggaatctcatatatgggattgtgggaaacaagtgtatttaggtggatttgatacagcacatgcagcagctcgtgcatatgatagggcagcaatcaaattccggggagcggaggcggacataaactttacctcgaaagattatgaagatgacttaaaacagatgagcaatttaaccaaagaagaatttgtgcatgtactaaggagacaaagtactggttttccaagaggaagttccaagtatagaggagtcactttgcataaatgtggtagatgggaagctagaatgggacaattcttaggcaaaaagtatgtttatttaggcctatttgatactgaagttgaagctgccagagcttatgataaagctgctatcaagtgtaatggaaaagatgcagttaccaactttgatcgtagcatttatgaaaatgaacttaactcaaccgaatgtactgataatgcaacggaccacaatcttgacttaagcttaggaggttcaagccaagaaatgggggacaataggggtcaaaattcttcatctaatttgcaattggatggccattggggccaccaagggtcatcaaggcataataataaggttcagactccgagcagcaacaatgtaggccaaattggtggaacaagtaattttcaaaataattatgagataattgcaactgctgcagcatcatcaggattcccccagcagataataaggactcaaaataatggcttccatcattattttatgagaccttgaccattcattaatttcttcatgttcttttattaatctttgtaaagagtaaaatcaattaatgttgagattataattaatattctcaaaacataaacaaacagattatattggtagtatataaaatggttgggaggaaattccaacttcttgggaaaagttaagtgtaccttttttttttttttttggtaaatttattattattattggg

SEQ ID NO: 2399 - DNA, 630 bp, Lycopersicon esculentum
  Predicted polypeptide sequence is orthologous to G2
ttttttttttttttttttgagaattatgtattggtaaataacaacatataagtcacaagatagaccaccaaaaaattaaaaacatttatttagtagctgtacttgtggatggtataaattggcagcttacatgagtaagaaatctagttcaatatctcttcttcagttagctttgtaccaactatatccatagagttggaatctctcaaaagcttttttttaccatcaagattaacccttgtaaatattatattacattatagtttacatcacaaccctccttcaggtgcgtgcggttcgctaactctcttagacgcaaaatattccatgcatcgatcgactgtctcgatagaaaattaattggatggtctggtgagagagtagttaaagccacttttgtgaggccagttttgatgtcttaatatctgctgagggaatcctgatgatgctgcagcagttgcaaataggtgaggaggaggaacagtattgctttgccattgttgagtatctcttctattgctgctgcttggaaactgaacttgataatttgaggaggtgaattgtggtggaatcatttgggagtcaccagctctcatatattggccaaacctttgcatttcattgctattt

SEQ ID NO: 2400 - DNA, 1228 bp, Lycopersicon esculentum
  Predicted polypeptide sequence is orthologous to G2
tcagaagaaggtaaaggtgttggatccatttcaaattcaagttcatcagctgttgaggaattatacggttcagaggaagaagatgaatttctcgaacaaaatggactaaaaggcaagaaaaagaaaaatattcctagtaaaatatttggcttctctatgattgctccacctaataataacaatcacaacgacgataacttgtcgtcggagagtgaaccgccggttacccggcagttttttccggttgatgagtcggaaatcggaagtggcaattttaatgatagatcttgtagatttccaagggcccattgggctggagtgaaattctaccaaccggagccatctgctaattcgccagcactattggggaagggtagtgagttgtcgcaacaagtgcagccaatgaaaaaaagccggcgtggtccaaggtctagaagctcacagtaccgcggtgttactttttatcggagaactggccgctgggaatcacatatatgggattgtggaaagcaagtttatctaggtggatttgatactgcacatgctgctgctcgtgcgtacgatcgggcagcaataaaatttcgtggaatggaggcggacataaactttaacctcgaagattatgaggaagatttaaaacagatgaagaatttaacgaaggaagaatttgttcatgtactgaggaggcaaagtactggttttccgaggggaagttctaagtatagaggggtgacattgcacaaatgtggtagatgggaagctagaatgggtcaattgttgggcaaaaagtacgtttatttgggactctttgatactgaaaatgaagctgccagggcttatgataaagctgccatcaaatgtaatggcaaggatgcagtcactaacttcgatccttgcatttatgaaaatgaacttaattcatctgaatgtagtaataaagcagcagatcacagccttgacttaagcttaggtagttcgagctcaaagcaaaacagccgtgaaatggaggatactaataagaatcaaaattatccttctatccaatttgatgttgattggcgacaccaagggtcgaaacccaagcaacctagtccacttgatatggagtatgggcgaagaagaaatgtgtacaatgagacggaaacgttgcaactctttagccaaacgcacctacattctccgggatccttcaagacaaatagcaatgaaatgcaaaggtttggccaat

SEQ ID NO: 2401 - DNA, 554 bp, Lycopersicon esculentum
  Predicted polypeptide sequence is orthologous to G2
tgagattgaagctgccagagcgtatgataaagctgccatcaagtgtaacgggaaggatgcagttacaaattttgatccaagcatttatgagaatgaactaaactcaattgaatctaccgataacgtggctgatcataatctggatttaagtttgggtggttcaagctcaaagcaaggaagtcaagaattgggggataatagaggtcaaaattcttcatcaataatgcaattggatattgattggcagcgccatggtttaaggcctgagaagcaatctgccttaattgatgctcgaagaagagaaaacaggtacaatgaaacagaaacgttgcaacttttaagccagacgcacttgcattctccagcctccttgaagcataacaataataataatagtcaagtgcaacggtttggccaatttatgagacctggtgatcaatcccatatgattcaaatgtttccacagcaatttggctcatcaaattatcaaattcaatttccaagtggcagcaatggtggaagaattggagctacaaatgtaagagatctatcgc

SEQ ID NO: 2402 - DNA, 989 bp, Lycopersicon esculentum
  Predicted polypeptide sequence is orthologous to G2
gttttttttttttttttttaataaattatagtatttcaaatactacatgagaagctagagcccaaatgtatacaagttacaatgagagagaatgggccaaattggcagttcatagtcagaataaactaatacaagtctagttgaaaagcttgccgatcagttagtattggacaaattaacgaggagacatattttccaaaacattttgtctaccttttttttttcttttctaatttcaaaccaagagccttaggtaatatatatggagtattaagaatatcaaccctttaatctacacattatcttaaaaaaaacacaaatagaaatatggcaagttattaaatgagtcaagaaggtctcatgagtgaatgatggaaaccattttctgaggaccaattctgaggtcttactatctgctgagggaatcctgatgatgctgcagcagctacaaatatctgaggaggaaaattggattgccattgtgaagaaccattactcgtcgccgcaagcgatagatctcttacatttgtagctccaattcttccaccattgctgccacttggaaattgaatttgataatttgatgagccaaattgctgtggaaacatttgaatcatatgggattgatcaccaggtctcataaattggccaaaccgttgcacttgactattattattattgttatgcttcaaggaggctggagaatgcaagtgcgtctggcttaaaagttgcaacgtttctgtttcattgtacctgttttctcttcttcgagcatcaattaaggcagattgcttctggaaattaaaacatgtttgcatcagaggtaaaaattgaatttcacaacgaaaacaagatatagctattgatcgtgtaaatatacctcaggccttaaaccatggcgctgccaatcaatatccaattgcattattgatgaagaattttgacctctattatcccccaattcttgacttccttgctttgagcttgaa

SEQ ID NO: 2403 - DNA, 558 bp, Lycopersicon esculentum
  Predicted polypeptide sequence is orthologous to G2
gaaagaaaagaatagagatagagagagaaaatagaggagaatatttaaaagtctaggaaactcaaaacaagtccttttgtagcaatagccaaaaaattaaattgttttctgtttttataatttggattgggtattttttgtagagagaaaaatgtgggatctaaatgaatcagaagaaggttgttcttcaccgatagagtttgaaggcgatgatgagaaaggtaaacgggtcggatccgtttcgaattcaagttcatcagctgtagctgttgatgatatatctgaagaggaattagatggagaaagagggaagaaaaagagaggtaaaattttcggcttctctatggtgggtctgggtaacggcgatgaagaacagccggtgacccgacagttttttccggttgatgagtcggaaatgggtggtgttgctgctgaaaatggatgcccgaattttcccagagctcactgggttggagttaaattttaccaaacggagacacttggcaacacgggattggccaggcctgtagatatggttcagcagcaacagcagcctat

SEQ ID NO: 2404 - DNA, 596 bp, Lycopersicon esculentum
  Predicted polypeptide sequence is orthologous to G2
tcggcacgagggttagttttaccctactgatgacagtgtcgcaatagtaattcaacctagtacgagaggaaccgttgattcacacaattggccatcgcgcttggttgaaaagccagtggcgcgaagctaccgtgtgctggattatgactgaacgcctctaagtcagaatccgggctagaagcgacgcatgcgcccgccgtccgcttgccgacccgcagtgattatcatgatgatttaaagcagatggggaacttttcaaaggaagagtttgtgcatatacttcgacgacagagcactggtttctctagaggaagttcgaaatacaggggagttacgttgcacaaatgtggacgatgggaagctcgaatggggcagtttcttggaaagaagtatatctatcttggactgtttgacagtgagatagaagctgcaagggcgtatgataaggctgcaataaaatgcaacggaaaggaagcagtcactaattttgagctaagcacatatgaaggtgaattaagtactgaggctgaaaatggaggtgcagaccataatcttgatctgaacttgggaatagccccctctgtattagctgatga

SEQ ID NO: 2405 - DNA, 542 bp, Lycopersicon esculentum
  Predicted polypeptide sequence is orthologous to G2
ttttaccggaagactggccggtgggaatctcatatatgggattgtgggaaacaagtgtatttaggtggatttgatacagcacatgcagcagctcgatattgcggagagactcaaggttttggaatgtgtgatacagtgcatatgatagggcagcaatcaaattccggggagcggaggcggacataaactttacctcgaaagattatgaagatgacttaaaacagatgagcaatttaaccaaagaagaatttgtgcatgtactaaggagacaaagtactggttttccaagaagaagttccaagtatagaggagtcactttgcataaatgtggtagatgggaagctagaatgggacaattcttaggcaaaaagtatgtttatttaggcctatttgatactgaagttgaagctgccagagcttatgataaagctgctatcaagtgtaatggaaaagatgcagttaccaactttgatcgtagcatttatgaaaatgaacttaactcaaccgaatgtactgataatgcaacggaccacaatcttgac

SEQ ID NO: 2406 - DNA, 575 bp, Lycopersicon esculentum
  Predicted polypeptide sequence is orthologous to G2
tacactcattttaattctatcgacaaaagaaatgtggaatttaaatgattcccctgatcagacaatggagtatgaatccgatgaaggtataacggttagatcggaatcaaattcaatttcatccgctctacttgttgtagaagacggtaattcatcagaagaagacggtgaaaaaggtaaaaaaaagaaaagtaataatacaccagggcacaatgggctggaattaaattttgtgaatcggaaccgccacttgtcaatggattagtggggaacaaaattgacgtgttgcaacaacagccaattaaaaaaagccgtcgtggaccacgttcaagaagttcacagtaccgtggtgttaccttttaccggaggactggccggtgggaatctcatatatgggattgtgggaaacaagtgtatttaggtggatttgatacagcacatgcagcagctcgtgcatatgatagggcagcaatcaaattccggggagcggaggcggacataaactttacctcgaaagattatgaagatgacttaaaacagatgagcaatttaaccaaagaagaatttgtgcatgt

SEQ ID NO: 2407 - DNA, 506 bp, Lycopersicon esculentum
  Predicted polypeptide sequence is orthologous to G8
tttttttttttttttttttctaaaaattatccaatccacaaaaatgttattcatacaaaagaaatcaatgactatgtttatacctatattactagttacggataagtacatgttatggaagtggtaggcggggattaatctggtaaaagcactgcgaggcatttgttgaagttgctaatgcagatgttgatgaagtgatagaagtagtagatggaatgaagaatcctgatgatgctgccgtgcagaacattgtcaatgggctgtttgtatcaacctgactaggcatttgcagtgcccaatttggaggtccttgtgatgaacctgtgtcctttctcttgtcatatgctcttccctcatagctggaagagaaattagaatagattccagtccacaattgagcttgttgggacgacattggtagtcccttgagatgtgaacttccaactattactgaaccaggtttatccatcttaggttttgttgcgtcttgcatatcgtaaggatga

SEQ ID NO: 2408 - DNA, 625 bp, Lycopersicon esculentum
  Predicted polypeptide sequence is orthologous to G8
aggtggatttgacactgctcatgcagctgctagagcgtatgatagagctgcgattaagtttctaggtgttgatgctgatataaactttaaccttagtgattatgaggaagatatgaagcacatgaagaacttgagtaaggaagaattcgttcacgtgctacgacgccagagtactggtttttcgagagggagctcgaaatatcgaggagtaacgttgcataaatgtgggagatgggaggctcgaatggggcaattccttggaaaaaaggcgtatgataaggccgcaatcaaatgtaatggaagggaggctgttaccaacttcgagccaagtgcatatgaaggggaaataaactctaaccctcacagtgaaggtagccagcaggatcttgatttaaacttggggatcgcaacttcttctgcgaaggaagttgaaaggtcttcgagtttccagtatcatccttatgatatgcaagaagcatcgaaatcacagatggacaaatctggttcaccgatagttggtagttcacattacaaagcattacctgcagtaacatctgaacaagctcacttgtggaatggagcatatgccaatttaattcccaactatgaagaaagagtatccggg

SEQ ID NO: 2409 - DNA, 722 bp, Lycopersicon esculentum
  misc_feature (697)..(698): n is a, c, g, or t
  Predicted polypeptide sequence is orthologous to G12
ggcttatgatacggcggtctattatctaatatgcccttcggcccgattgaattttcccgagttgttagttggtgatggtgggcttaatgatttgtctgctgcttcgattcgtaaaaaagccatagaagttggtgctcaagtagatgctgtacagaactcgcttgcaacccatcataaccatacagaggaaaaggtgcactctgagacggcaagcccctcagaattgaagccttgttggtttcaagagaagcccgatttaaacttgaagcccgagcccgaagatccagaagtggattactggtaatatttagttaatatcgatattaccaataacagtatctctactagtgtaatttttaattatttttttggctttttgttggttgggggaagaggaagtgctttggtaagaatacaagcgccgctccaggttgtgtagcttggtagcctaggattgttatattcttaaaaagaaaaaactatcacctctttctttaattttactttatttttaagaacaaattatcagctgaacagttttggtgttgtaagatgtaaaggggatttgtgttatcattttgtctaatcgcaattctggttgtacttttgcttggttggggtcttttagtggtgggggaaacaaatgttagtgtgaatgatggattatgcatattggtcatcttgaagactaaccaanngtttattatttggggaaaaatgat

SEQ ID NO: 2410 - DNA, 634 bp, Lycopersicon esculentum
  Predicted polypeptide sequence is orthologous to G12
aaaaactaacaaaacaagtgaatatatttaatttttttcagtatgatggaaggagagaagagaaaacagaggcaacaccagcaagataagccatacagaggaatacggatgaggaagtggggtaaatgggtagctgaaattcgagaaccaaacaaacgctctcgaatttggcttggttcttattcttcccctgttgctgctgctcgtgcttacgataccgctgtattttacttgcgaggtccttcagctaggcttaatttccctgaatgtatagtggatgaccatgaaattcacgatctatcagctgcttctattagaaagaaagctactgaggtaggtgctcgagttgatgctctgcaaactgcgattcacaattctactgttaattctgttgaatcaaactgtaattcgaattctaaatctacaaggatgatgatgaagcctgatttgaatgaatatcctagcccggaaagttgcgacgaagataactgaatctctgcgagttaacagaggccaagagggggattatttttatgttgattagatatactgaggatccatgtatgaaatataatccgaagggattatatgttaatattatcaattatgatagttattaaaggaaatttaatct

SEQ ID NO: 2411 - DNA, 468 bp, Lycopersicon esculentum
  Predicted polypeptide sequence is orthologous to G12
gtgaattctctataccatgtgttgctagataatggctagttcgctgtttaatgttctttttgtttggaaattgttctcacgatttcataagttgagtcgttcatttcaaaaaaaaagaacattaaacagcgatcttcattcacttccagcttttgccttttcatgggtattctttctctctctcccagtttagctctagattacagggaaacaaaatttttgtaattcagtccctgtaatttcacataataattattatacagtcaaagatggagataggtggtgggggtcaaagtggagttgctgcaaattcaggggtttgttgtggtgggaagagaaagaacgaaaagccctataaagggattcgtatgaggaagtggggaaaatgggttgcagaaattagagaacccaacaagcgttcgaggatttggttgggttcgtattcaacgccggtggctgcggctcggt

SEQ ID NO: 2412 - DNA, 498 bp, Lycopersicon esculentum
  Predicted polypeptide sequence is orthologous to G15
taagttcttttaatgattgtgaactgtcttgaactatataggagaagagaactatttgtaacggacaaaaacctcaacaactgaatgaagatgaagtctatgaatgatgatcgcagaagtagcaacaataatatcggtaataataaccgtgcggtagcttatcctaactggtggggtttttctctcacaccccacatgaaaatggaggttactaattcttctgatactcaacatcaacatcaatttgcacaaagttactatctttcatcttctcctcctccaccaatgaatgtatcaacaacctctgctctctgttatgaaaataacccttttcattcaaccttatctgtcatgcctatgaaatctgatggttctctttgcattatggaagctctatcaagatctcatgctgatgctatggtgcaaagatcttcacctaagcttgaggattttttaaggggtgcaagtatggggaatagtcaatatggaagtcatgat

SEQ ID NO: 2413 - DNA, 554 bp, Lycopersicon esculentum
  Predicted polypeptide sequence is orthologous to G15
gcctcgtgccgcggagttctagagagagagagagagagattgaggtcaaattgcttcatagttataatgagtaattggttggggttctctcttactcccgatttcagaatcgatgatgatgatgaagaagaagtaaaaaattacgaaaggcgaaacgaagctgctgaaaatacttctttgtcggtcatgcctttaagctctaatggttctctatgtatgatggatcctttcccacgctgtgaacccactgaagattgttggaggtatgagaatcatgaaatgagtactgctaataatccagaagaagagggtccgaaacttgaggatttccttggatgctgttactcaaattctcttcctaatgaagaacaacaaattgctgaaatcaacgttaatattccacccagcataaatcaatctgatcacgaacagcaccagttagaaattggagcgaacatgaaattgattccgtctccacagatgatgattcaaaatagtcaatttcagagctctcatcatgagtttgtgaactctactgatagtgtctatcatct

SEQ ID NO: 2414 - DNA, 329 bp, Lycopersicon esculentum
  Predicted polypeptide sequence is orthologous to G15
ctgtccacaggaaatccattgacacatttggtcagagaacttctcagtatagaggtgtcactagacataggtggacaggtaggtatgaagcacatttatgggataatagttgcaagaaggaagggcaaaccaggaaagggagacaagtttatcttggtggctatgatatggaagaaaaagctgcaagagcttatgatctagctgcactaaaatattggggtccttcaactcacatcaatttcccattagaaaattatcagaaagaacttgatgacatgaagaatatgaccaggcaagaatatgttgcacatttaagaaggaaaagtagt

SEQ ID NO: 2415 - DNA, 769 bp, Lycopersicon esculentum
  Predicted polypeptide sequence is orthologous to G201
ctttttctctctctctctcatcctcacaaagacaataaaaagaagaattttaagcaaaaaaaaaaatcaataaatcaaaggcaaaaaaatggagcaaaaaaatattttttttcttctttctcttatggttttactactaatttcctacacaacaacagctcgtttattgccaacaattaattctcaagaatctaatgggattattagtaataatccaatttcctcacaagtacaagaagatttcaatgatgtaagttctttctcttattttccacccttatatacggtatatgagcttatccgaatcgatatgatcagtgaaaattcatattatcgatttgagatttcacttctttcaaaaacaaaaaaaaattagctagtgagaagattttgtaattagtaaaaaaaattctttgttaattctatttagcgataaattatcaaaatattttgtttgctatgaataataaagcaataatttcaatttgtttttgtgtttaggcctagtaattttttagcctattgattttagctagctcgtatttgaatttttcttttttatggaaaagtaattttttatatatacgatataattttttttaaaaaaatattcagttgatcacctttcatttatttcggagttaagagataaaaaggggttcaatttaaatattttcttccaaaaagtatggcaaaaataattttttttgtacatatataaattgttgaatcgtctagatattacatataacttctaagaatatatata

SEQ ID NO: 2416 - DNA, 763 bp, Lycopersicon esculentum
  Predicted polypeptide sequence is orthologous to G202
gcaggacgcaccactaagttcaatgccagaaccctggggcattgccgcaatgtccatgataggatacgcatattgcgtgaacattggaatggttttcgaagaggatccttgaggcttccttctagcaaagtgactaatgctagtagtgctaaactaaaaccagtgcgtggtagcaattctgctgaacggcctttagtatgttgctcgagtcaaccaaggacttctcagccttccaatcaaaatagacctgacagtaaagggccaacagaggtgaagaaggcgtggaaaatgatgaatatggctaaggcaatagaacaaaatagtgtcgggaacaaaagttctgttcaggcctcaaaacattcagttcagaagaatactagctacaaagaagcaagtgaatcgagctcaacgtctatcaaaatgaagatcgaacagcatcggcctccgtatattcaaaatgttggtccaggtagtcattccgagaatgatgtttgtaagttggacattggatcaaaaggtgcttcaggtgtatataaaggctcttcaatgtcatgcagaccattatatagtgaacttgtatcttcgagggagtctcagaattcacttcagccatatgtttgtgatgcgaacaatggactaccatggaagaataagtcgtgtgctggggccacacatttgagttcttctatcaggttgacatcaatttctactactgtaggtcatgagaaagagatcagttcttcctcgaatagcattgtgaatc

SEQ ID NO: 2417 - DNA, 624 bp, Lycopersicon esculentum
  Predicted polypeptide sequence is orthologous to G214, G680
tgcaattctacgagggaacctgtgttgttgcaggatgaagaaaaaagctcgaaaagacttcggttggaaggagcaccacagtaacgctccacagtcatccattcatcagtcattttcttgtttccaccccattttcacccctattcgtgatccagatgattaccgatcgttttttcaattatcctccaccttctccagccttattgtttctgctttattgcaaaacccagcagcacatgtcgcagcaagttttgccgctagcttttggccttatgcaaatatggaacgtccaacggattctccaactgataacaccgctagccagattaactcagctcctagtatggcagcaattgctgctgccacagtagcagctgcaactgcatggtgggcagcccatgggctcttaccattgtgctctcaatttcaaagcagttttacctgtgttcctacatcagcaacatcaatgcaagtggatgcctgtcaacctagagtagacaagaacgaaggaagagagggaactcatgattctccccatgttcaggaacctgtcccagaatgctctgaagctttgcaagaacaacaatcaggttctaagttgccaccttctctatcatcagaatc

SEQ ID NO: 2418 - DNA, 677 bp, Lycopersicon esculentum
  Predicted polypeptide sequence is orthologous to G214, G680
tttttttttccgaggaactggtccaatcaaggtccattaaatttgctatgattgttgaagacatccacatttaggttcatacttcaaagtcccttgcatacaagtccaattaaaagagaacataaaaataatatggtacacacctacacgacaagtttcgtgtacattagaactagacaacgtaactgggaaaagataataacaggatagaatagagctctccgtgcaacaacacaggttccctcgtagaattgcacattgatacaacactaagtagaagcttctccttccaaccgaagtcttttcgagcttttttcttcatcctgacagttagaacttgtcaccctgctatcatttgcctccaatgagcacctcttgtaaggcttaaatccagtacggcgagctttcaaccttacttgtccaagttctatcattggtaggcatgtttctacatcttctttgttgccaattaataacacattgtcttccattgtttggtgactggaacagatattggatgccatatcattaagatctaactgcggtccacattgaactttctcgtctggcttttgcttcaacttttcaagaatgatctttcccttatttttcagatcaagtgaaggagaaaaactttgaggcaacacttctctggtgaaaagagcctggaaagctat

SEQ ID NO: 2419 - DNA, 586 bp, Lycopersicon esculentum
  misc_feature (307)..(307): n is a, c, g, or t
  Predicted polypeptide sequence is orthologous to G214, G680
gaacatggctttcttcgaaggtttaggcatcatgcggttcgttttgtagtgttacattatcaggttcttttgtacaacaccacggatagactatatttgatagtaactgatgttgtggggagaatcggaagaagatttgttctgtatcccctgtttgtccctgaggatttgaagcagagatagctagctttggttcctttattttgatggacccttattcctcacgggaggaacttgttgttaagacaaggaaaccttatacaatcactaagcaacgagagcgatggacggaggaggagcacaatangttcctagaagctttgaaactttatgggcgtgcttggcagcgcatagaagaacacataggaactaaaactgctgtgcagatcagaagtcatgcgcaaaagttttttacaaagttagaaaaggaggctcttacaaagggggtcccaacaagtcaagcacttgacattgaaattcctcctccacgacctaaaaggaaaccaagtaatccttatcctcgtaagacaagcgcagcaagtcactcatcacaggtgggagcaaaaaatgggaaatattcgacaac

SEQ ID NO: 2420 - DNA, 1259 bp, Lycopersicon esculentum
  misc_feature (1214)..(1214): n is a, c, g, or t
  Predicted polypeptide sequence is orthologous to G261
gtgcatagtcatggataactgtaatggaggatcaagttcttcttctccggcgccttttttggtgaaaacttatgaactggttgatgattcgcatactaatccagttgtttcatggagccataacggacgtagcttcgttgtttggaatccacctgaattcgctagagatttgcttccgaaatactttaagcataacaatttctcaagttttatcagacaacttaatacttatgggtttagaaagggtgatcctgaacaatgggagtttgcgaacgaggattttttaagaggacgtagacatttgttgaagaatatttatagacgaaagccgatccatagccactctgctgcagcaggaacagggcaatctgtagctccattgacggattctgagagacaggagtatgaagatgaaatcgagaggttgaagagagaaaacagtcttcttcagtcgtctgcggagaatcaattgaaattcaatggggagtacgaaagtggaattaagtctatggagcaacgtttacagaacgttgctcatagacaggggaaattgatttctcttttagctcaattactacaaacacctggattttcatctgatttcactcaaagcgcgagcaggaagagacgattgttgatatcaaattacttgattgacgaggaaaactcaccaaaattcgacttggaaatggttaaaaagttggattcatcaatcaatttttgggagcggtttctgtatggtgttcaaacacaagatttcgagcatacacattccccaattgttacacatacatcatctaatgattctgccaaacgaaactctcccatcgatcattcaccatcctcctccgagttagggccattgaatcctgtcatgtcatcaacttatgaaaatttagaacgtcaacttaagccatctgataatcagattgagtgtaagaccagtaaaacatctgaattagtatcaaactcgggtaatgatgtattttggcaacagttcttaacagagacgcctggttgcactgagccacaacaagttgagaacaaagggataaacgaatcaacgcgtgatattagattaggggatagccatagatattggtggaatcgcggagttaatttagaaaatcttgctgaaagaatgggacatcttagtagtccagcaacaggaagctgagttgattcagtatttgacattttatagctattggtgnttttttttttttttcttctagttttgatgatcagatatgtcacat

SEQ ID NO: 2421 - DNA, 666 bp, Lycopersicon esculentum
  Predicted polypeptide sequence is orthologous to G261
tcaaagtaaacttcatctttctatgtgcttcttcttgttaaggactattcttgattttttcttacaggaaagttcggaaatttctgagttttagagggtgaaacggctatcttttgaattcaagctagcatttgtttgagcacttgtgggaactcatgatgggccgcaatctcttttaacaattctttagcaaatttgtgtgttttgaaagctatccagagctgggacttgaatggaaatgtgtatttgctaagaatttgtatgatcaggtgggagctgcttcaattgaatttatcgaaggaaatcaaggtgataacacttttggttggttgtatctgtatgttgggaatctgataagttgatcttccctgtcagtaaggatttgtcacttgtagttgagcttcgccttgtgagtttcatttcaaggggttgtgatttggatttgaatttaccatggatgaagctccttgcagcgtcaatgcactgcctccgtttattgcaaagatatatgaaatggtggatgatccctccactgatccaatagtctcatggagtttaaacaataaaagttttattgttcgtaatcctcctgattttgcaagagatttgttgcccagatactttaagcacaataatttttccagctttatccgacagctgaatact

SEQ ID NO: 2422 - DNA, 1028 bp, Lycopersicon esculentum
  Predicted polypeptide sequence is orthologous to G280
gacactcttttctttcttgtagggacatctctagaacacacacacacactctctctctatccatggctactcaaagcttcaaccagttcccttcataccctgagatgatttatgaagctcttgatgaactaaatcaagaagggggtgcaaacaagtcatcaataagcaagtacattgaaacaaagtatggagatctgaatgaagatctttcaaagatgctacctttacatttggacaacatgaagcaaaatggagatctgattttcctcaagaacaattacatcaaacctggtccagatgttccagcaaagaggggtcgtggtaggccaccaaaacccaaagctccattgcctcctggtgctgttgaatctgttgaacctgcatcaccaaggccaagagggcgcccaagaaaagaccctaatgcaccacctagttccaagaagccaaagccagaatctgttgctggaggtcccaattcaacaaatcttggttctactactggaaggcctaggggtaggcctaggaaagttaggccacagcctgctcatgatgatgatgatgatgatattgaggaatgctgaaaacttttaagacttgttattggactcttgctgatggtgatgactctaatgacttagttgtcttaatatcctctttttttttaggtgttagtagtattatcttatgtaatagtttcagtttgagttgccctagtgtgactagggggtcatggtttcaaagttaagactgcgtagaatagactaattgtcgttatgcgactagggtcatggtttacagtgtgcaatagactaattgtggtccggttcttttctgaaccccgcacatagtgttagcttagtgcactggtcttttttattagtatgtttaatgcccctattagttatacaggttgttaggggtttgtgtgcttgtgtgttttaacactttgtttcaagattcactgtgtagtctgtgtaattgttgcacttttcattatgttgatgaatctttttgttaaaaaaaaaaaa

SEQ ID NO: 2423 - DNA, 830 bp, Lycopersicon esculentum
  Predicted polypeptide sequence is orthologous to G280
gagaactagtctcgagtttttgtttttctctgtaacaaaaatggctactgaagaacataatctaactttgcctagttatcctgatatgattatggaagctatagatgcgttgaatgaagaagaagggtcgaataaatcagctatatggaagcaaattgaagcgactcatggtacactaccaccagcgcatggtacactccttgcacatcatttgaatcaaatgaagcaagctgggcaattagttatgttgaagaacaactacatgaagccaaatccaaacgcgccgccgcgccgtggtagaggccgtccgccgaagccgaaaagttcagttccggtaccggatgggtatcctagaccacgtggaaggccaccgaaggagcgggatccgtacgcgccgataacggtacctatgaagaagacgagtgagggtagctctgggggaagtgggaagaagcgtggaaggccaaggaagtatccgatgacggaggatacgccggtggtgaagccaattggtgctccgagaggaagaggaaggccgccgaaggtgaaaactccggtagctgcaactgtaggggcttaattgaagaaagacgaattaaattagggacttgtatggcaaaatatgctaacttgttgtttttcactttttatctgttttgaattttcatgtttagtccctgtagttttgttttaattacaatttgtaggaagaattgtgtgactttgtgagtgatttttatcatgtaattgggccaatgtaaatccaaattgagggctttttatttatatataaaaaaaaaaggttcagtattaaaaaaaaaaaaaaaaaa

SEQ ID NO: 2424 - DNA, 829 bp, Lycopersicon esculentum
  Predicted polypeptide sequence is orthologous to G280
gctcactctctctctctctctccatctctttgtggggacatttctctctttctctctctgcaagtttcaatggctactgaatttgtcaacaagattcatcctgaataccctcagatgatttatgaagcccttgatgcattgcaacaaaaagaaggctcaaacaagtcatcaatatcaaagtacattgaatctaagtatggaaacatgaatgatgcacactcaaagttgataacttaccatttggatagaatgaaacaaactggtgaacttattttcctaaaaaacaactacattaaacctggtccagatgcaccccctaagcgtggccgcggccgaccacctaaacccaaacctatattgccacaaggaacagatattgcagctccaaagccaagaggtcgcccgaaaaaagaccccaatgcaccacctactcccaagaaaccaaaaccaacaagtgtccctagtgacttagctcctgtttcgaaaaccggaaggcctagaggtaggcctaggaagattaggccgcagccaccacaaaatggtttagagtgaagctgaaaatccgcagacttggttgatggtgacgacttttataactctgttgtgtttttaagttttcttggttgatgttgtagttgtaaggggttgtgtttcttctagctgtgtaatgtagattgttaggagatcctgtacttgttttaatgcttgttgattcgcgattcacagtagatagggaagttgagccacagccagcacagaatggtgtaaagtgaagctgaagatttgttgactttgttgatggtgatgactctcaatgactgtgttatgt

SEQ ID NO: 2425 - DNA, 935 bp, Lycopersicon esculentum
  Predicted polypeptide sequence is orthologous to G481
agagaaaagagattctttttatatatagttataaaaaaatttcagagttttctttgtaaaacgaacggtgttgatagggcaaaatccaaaactctgcctcatctcagtcgtctccctttctcccttcttctccaacgtccgatcttccagttccctccatccccagtatggcggatggtcaaggttcgtctaggtcaccggcgagtccaaacggaggtggtagtcatgagagtggtggggaccagagtccgaggtctaatgtacgtgaacaggacaggtttttaccaatagctaatattagtagaatcatgaagaaggcacttcctgctaatggaaaaattgcgaaggatgctaaggagactgttcaggaatgtgtttctgagttcatcagcttcattactagcgaggcaagtgacaagtgccagagagagaaaaggaagactattaatggtgacgatttgctatgggcaatggcaactcttgggtttgaagattatattgaaccactcaaggtgtatcttgctcgatacagagagatggagggaacgtcaaaggctgctgatggctctactaaaagagatgggatgcaacctggtcctaattcacagcttgcacatcagggttcatactcacaaggaatgaattatgggaattctcagggtcagcatatgatggtcccgatgcaaggaactgagtaaaaatccgatcttcgtcctgtttgagaagacgggtggagttgaaaacatattatatatatagatggttcttctgctgtaacctctgtaacatggtttattaattctagtgctctctagtgagtgccatgtcatatttaaagtttgtaaattgaggagatgttttaagaaatattatagacatgattgtttgtagtaataatgaaaaccattacctagtaaaaaaaaaaaaaaaaaaaa

SEQ ID NO: 2426 - DNA, 1004 bp, Lycopersicon esculentum
  Predicted polypeptide sequence is orthologous to G481
agtgcttcaacatttttctccctgacatattgtttattattagtttcataaaaaaaattataaaaattttctccattttcttgttcttaaagcttgtgtactatcataggcaaatacaagactgcgtatacatcaatgtcttcggactttactcgtagaattacatttacgacagaataaagttgtgcatatcgtaccacttgtgagattactccgggtaatttctcttttgtattgatcggaacagaatttaggcgatttcgatggcggattcggataatgaatcaggaggacatagagataacagtaacattgagagttccctaagagaacaagacaggttccttcccatagcaaatgtaagcagaatcatgaagaaagctttaccagctaacgcgaaaatctcaaaagatgctaaggaggtagttcaagaatgtgtttctgaattcataagtttcatcacaggggaagcatcagataagtgtcaaagagaaaagagaaagacaatcaatggtgatgatctgttgtgggcaatgacaactcttggttttgaagaatacattgagccactcaagatttatttgcagaggtttagggatttggaagggcaaaaaagtggtgtctctggagagaaggatcatagtggatcagtgggttatgttgaggactaccatggcatgatgatgatggggagtcaacatcatcaaggacgcgggtatggcaccggtgtatacaatcatcatacgggggagaatgctgcaggggttggtacaggagggtcgcggtttcctgacgttgggaggcaaaggtgaagctgtgacatccgcggactacaaagatgtatcaggacgcgatgtatcaactgtcaacaggttgaagtatggacactgaaagacaggaacagactttgtagtttgtattctacagagatgtaaattggtaaacatgtgtgtacattacaatgtgggtgtaaacatggattgtaattgtctattaaaaaaaaa

SEQ ID NO: 2427 - DNA, 1295 bp, Lycopersicon esculentum
  Predicted polypeptide sequence is orthologous to G504
ttccagctgattttctgtatttttgtactactaactcacagcacacacaccatttctctctctcttctaagctgaattttcgtatcatacaatttactctttctttcttttttttttattattatttttattatatagttttataatcaggtcgctctgattaaatatatttgaaaatttttatcaaataatattgtggtcatggagagtaccgattcatcaaccggctctcatcatcaaccacaattgccacctggatttcgatttcatccaactgatgaagagcttgtggttcattatcttaagaaaagagttgcctctgttcctcttcctgtttctattattgctgaagttgatctttacaaatttgatccttgggaactacctgctaaggcgacatttggagaacaagaatggtatttcttcagtccaagagatagaaaatatcctaacggggcgcgcccaaatagggcggcaacttccggttattggaaggctaccggaaccgacaagccggtgctcaccgccggcgggacccaaaaagtaggtgtcaaaaaggcattggtgttttatggtggcaaaccacccaaaggggtgaagacaaattggattatgcatgaatataggcttgctgataataaaacaaataataagccccctggttgtgaccttgccaataaaaaatcactaaggctagatgattgggttttatgtaggatttacaagaagaataatactcaaaggccaattgatcatgaaagagatgatttgaatattgatatgatgatgggatcatcatcaattcatccatcatgtataccaaattcaatgtcaatgccaaatatatttggtcaaccaaaaataccacaactaaaatcttcaaattttggcactacattaattcatgatcaaaatgaccaaaatttatatgaaggtggatcacaatattcttcaaaaaggccactagcaaatttgtattggaatgatcaagatggaggagctagtaacgataattctcaatcaacaaaaaggtttttgacagaaaatatggaagatggattaaatatgaatgctcgagcagatgaacaaaatggatctatcgtaagtcttctcagtcaacaacaagttcttgggtctctaagtgaaggagtttttcgacaaccttattcaggcatgaattggtactcttaaaatatcgaattataatataaaaaaaatatacgatattattataccatacaaattaaaggtgtttgattattacaggatcctaactaattaagattgattaacga

SEQ ID NO: 2428 - DNA, 1451 bp, Lycopersicon esculentum
  Predicted polypeptide sequence is orthologous to G504
ctaaattccttcttgtttatcattttctctcttcccaaaaaaaaatcccaaaatttaatcataatacaattcgaatttatcaacctcgtactacgtacatatttttgttggtacgtaaaatactgaattcaggtcaactcaaacatcgtaaattgtgatttctttatggaaagtacggattcatcaaccgggacacgtcatcagcctcaactcccaccggggtttcgattccacccgacggacgaagaactcatcgtccactacctcaaaaaacgagtcgccggcgctccgattccggtggatattattggtgaaattgatctttataagtttgatccatgggaactccctgctaaggcaatattcggagagcaagaatggttcttttttagtccaagagatagaaaatatcctaacggggcgaggccaaatcgggctgcaacatcgggttattggaaggctaccggaaccgacaagccggtttttacttccggtggaacacaaaaggttggggtaaaaaaggcgctcgttttttacggcggtaaaccaccaaaaggggtaaaaactaattggatcatgcatgaatacagagttgtagaaaataaaacaaataacaagccacttggttgtgataatattgttgccaacaaaaaaggatctttgaggctagatgattgggttttatgtcgaatttacaagaagaataacacacaaaggtccatagatgatttgcatgatatgttgggatcgataccacaaaatgtaccaaattcaatattacaaggaataaagccttcaaactatggtacaatattgctcgaaaatgaatcgaatatgtacgatggaattatgaataacacgaacgatattatcaacaataataatagatccattccacaaatatcgtcaaagagaacgatgcatggaggtttgtattggaataacgacgaagcaacaacaacaacaacaactattgataggaaccattctccaaatacaaaaaggttccttgttgagaacaacgaggacgatggacttaacatgaataatatttcgcgaattacaaatcatgaacaaagtagctccattgccaatttcctgagccagtttcctcaaaatccttcgattcaacaacaacaacaacaacaagaagaagtattgggatctcttaatgatggggtcgtctttcgacaaccttataatcaagttactggcatgaattggtactcttaaagatataaaaaggcaaaaaatagttagccctgtaaaatcaatcgatcaatcaatcatagatatattatatatggatttcgttatattttacttttagttagaattaatatatagaatatcttctatctcacattaacaaataagaacatttataacaaatagtgaaactaaactatctaccattagatagacattttgttaaaaaaaaaaaaaaaaaa

SEQ ID NO: 2429 - DNA, 503 bp, Lycopersicon esculentum
  Predicted polypeptide sequence is orthologous to G559
agttagacatcagcatagccagtccatggatggttcaactacaatcaagccagagatgctcatgtcaggagtggaagagccttcttgaggtgaaactaagaaagccacgtcagctgcaaagcttgctgaacttgctcttattgatcctaaacgtgccaagcggatttgggccaacaggcagtcagctgcaagatcaaaggaaaggaaaatgagatatatagcagagcttgagagaaaagttcagactctgcaaacggaagcaactactttatctactcagttgaccctattgcagagagatacaaacggcctgaatgctgaaaacagtgaacttaaactgcgtttacaaacaatggaacaacaggttcacttgcaagatgcgttgaatgatgctttaaaggaggagatacagcatctgaaagtgctaactgggcaaggcatagcaaatggtggacctatgatgaacttcccagcaacctttggaggcaatcagcagttctact

SEQ ID NO: 2430 - DNA, 544 bp, Lycopersicon esculentum
  Predicted polypeptide sequence is orthologous to G559
ggtttgtatggataaggataagtcttcttcaagccatataggaggttcgttgcctccatcagggagatactcattattttcacctcccggtagtagctccaatgtaaagtcagaacaacctggattagcaaatttacctcccttaggacctggaaatgcttcagaatcaggtcattttggtcatggtttgtcggcagattcaagcctgtttagtcttgatataagccgaatgtctgataacccaccaagaaaatttggtcataggcgtgcccactcagaaattcttactcttcctgatgatattagctttgatagtgatcttggcgttgttggactagatggaccgcctctgtcagatgagactgaggaggacatcttgtcaatgtaccttgacatggataagttcaattcttcaactctgacttctgaattccaagcgggtgagtcttcttcagctgctccaggttcatcacaaacaacagcaatggcttcaggaacaaataaatctgctcctactgttagtgagaagccaagagttagacat

SEQ ID NO: 2431 - DNA, 506 bp, Lycopersicon esculentum
  Predicted polypeptide sequence is orthologous to G559
gtgagagagatataagtgattgatgtccaaaaaaactaccaccaacaatattggtaacatgaagaaaatcatgttgatagttgacaaaatgacatatgcatagaatgggatttgaacaatttcaactaaaagtcaaatgaccctacaaaagtactaaaatgcagatgaaggagctaactgaaagcaagagaacctgagctagatgttgtttcaacacgtgatgattttgaaacacaaaaatgagctgctagatgggaaaacacatgatgatttttaaaacatacaccatctcctgtctctctggccatcagctgttcaatcctttgctacagaactaacatcagaagcgttttcattttgaggagatgacagagaacctcttgacatcacatctccggcttgtgaaagttgatcttgcagctggactgcctgttggcccaaatccgcttggcacgtttaggaatcataagagcaagttcagcaagctttgcagctgacgtggcttt

SEQ ID NO: 2432 - DNA, 475 bp, Lycopersicon esculentum
  Predicted polypeptide sequence is orthologous to G594
aaacattttacttctctgctatcactatttcgccgagtttcgttacagttgtttgcaaacatgttacaaatgagtgttcttgaaagacaaagagcagtgttggaacgtatttataatcattctaagcagcagctttcttctctagtacctcaacaagaacttgctcatttgattaccggctgcgttcaggggaattttaacatgtttggcgggggagattctaattttgttaattttcaagaaatggctcgtccctctttctccacaatatcgaattcatcgattacaacagtgtctccgccaccagagaaagaaagtgacttaagtagtatgatagctccaagggaaaatgttgtttctaccaagaagagaaaagcagagtttattgaggaagaggattgtgagaaaagcccggggaatgattcaaaggagaattcgaagacgtctgaggttcaaaaacctgattacattcatg

SEQ ID NO: 2433 - DNA, 515 bp, Lycopersicon esculentum
  Predicted polypeptide sequence is orthologous to G663
gtaaaactatatattatagaaaaaataatgaatactcctatgtgtgcatcgttgggagttaggaaaggttcatggactgaacaagaagattctcttttaagagattgcattcaaaaatatggtgaaggaaagtggcatcttgttcctgctagagctggtttaaatcgatgtcgaaagagttgcagactaaggtggctaaactatctaaggccacatatcaagagaggtgactttgctccagatgaagtggatctcatcttgagacttcacaaactcttaggcaataggtggtcacttattgctggtagacttccaggaaggacagcaaacgatgtgaagaactattggaatacacactttcacaagaagttaagtattattgctcctcatctacatcctcattctcgtcctcgttctcatcctcgtctacagattaagcataagagcatcgcggttactaagaatgaaataataagacctcaacctcggaacttctcaaacgttaagaagaatga

SEQ ID NO: 2434 - DNA, 919 bp, Lycopersicon esculentum
  Predicted polypeptide sequence is orthologous to G668
ctacttttttttcccaagaaaagaagaattccacaaaacaaggcaaaaaaagggttgtgttccaatgggtagagtcccttgttgtgataaaatgggagtgaagaaagggccatggactcctgaagaagatataatgttagtctcttatgtgcaacaacatggtccaggcaattggagggcacttcccactaaaacagggttgcgtaggtgtagcaagagctgcaggctaagatggacaaactaccttaggccagggataaagaggggtaacttcacagatcaagaagaaaaaatgattatccagcttcaagcacttttaggaaacaaatgggctgcaatagcttcgtatctgccagagagaacagataacgacataaaaaactactggaatactcatctaaagaaaaagatgaaaaggcttgaccaatgtcatggatcaaatgatctattttctttagaaaatgggcttactcacttatcatcttcaaattcatcaacttctaggggacaatgggaaaggacacttcaagctgatattaacatggctaaaaaggctttacataatgctttgtcacttgaaaatccaacaagctcacacaataataatattaaacaagaaaatacacaagtttcttctacttctactatttatgcatcaagtactgaaaatatagctagattgctacaaggatggataggatcaagtacttcttccacaaataattctgaaagttcaaaaacttcatcaaacaacattgcaacaactgattcatcttcatgtgatgggactccaaatgctgaaaccaaaggtcagctttctgaattacgtgatcatcttatttaaaagtttaaaccgtcacataaagtcatagagcacatgacttttaattttcttttcaatttgtcttattttatcgcg

SEQ ID NO: 2435 - DNA, 1038 bp, Lycopersicon esculentum
  Predicted polypeptide sequence is orthologous to G668
cttcactgaacatgaagaaaaaatgatcatccatcttcaagctcttcttgggaatcgatgggcagctatagcttcataccttccgcaaagaacagacaacgatatcaagaattactggaacactcatttgaaaaagaagcttaataacaacaagaaggttgaaggtcatgatgatcatcaagaaggaacttcagcatcatcatcatcatctcaatcaaaaatcataaaaggacagtgggaaaggaggcttcaaactgacattcacactgctaaacaagctctttgtgatgctttgtcacttgatacaactccaaataacaaaaacaacaacaataatccacctcctcatgatcaggatcaacaaccaccatcagttcaaacacctactacctatgcttcaagtgctgaaaacattgctaagttgcttcaaaattggatgaaaaattcacccaaatcgacctcgtctagtagctcgaaaattactcctatgtcatccttgaacaacaatttatcaatcggtgcagtttcaagttctagccctagtgaagggacggtaaatgttactcctggacaaggtttggactctatctttagctttaattcatctaataattcggatgtttcgcaatccgtatcggtcgatgagggtggtaatttcagtacacctgagaatcataataataacaacaacaacaatgctgggatttatcaagttgaaagcaagccaaatttgcctgatttcaagccagaaaatgggaattttcaagaggagagtaagcaaaatatggagacacaacaagtgcctttaactatgctggagaaatggctacttgaggatgctaatgcacaagctgaacaagaagatcagttaatgggaattggaatgggaatgggaatgaccttagctgaaactaatgatttgttttgaagaaaaaaaaaattgtttactagtactcccttcgtttcaatttatctgccttgatttgaccgaacatgaagttgaagaaaaaaaataagtaaaacggataaattgaagcg

SEQ ID NO: 2436 - DNA, 553 bp, Lycopersicon esculentum
  Predicted polypeptide sequence is orthologous to G668
aatttcctataaagagagtaaagcaatacctaaaaacgaaagatacatccttttattttcattgatcttcaagtcataaaaagaagaaaaagatcattttgttcctagatatcgatcgatcgtgtaggtagaatgggaaggccaccttgctgcgataaaataggggtgaaaaaaggaccatggacaccagaagaagatatcatcttggtttcatacattcaacaacatggtcctggtaactggagagctgttcccagtaatactggtttgcttagatgcagcaaaagctgtaggctcagatggactaattatctccggcccggaattaaacgtggaaacttcactgaacatgaagaaaaaatgattatccatcttcaagctcttctaggcaacagatgggctgcgattgcttcgtatctcccacaaaggacagataacgatataaaaaattactggaatactcatctgaggaaaaagctgaagaaacttcaagggaatgatgagaatagtactcaagaaggagaaagctcatcatcatcacaatccaatttct

SEQ ID NO: 2437 - DNA, 662 bp, Lycopersicon esculentum
  misc_feature (595)..(595): n is a, c, g, or t
  Predicted polypeptide sequence is orthologous to G729
ctactactacctttcttttgatcaacacaaagataacataagttactagtaagcgcagcgcgctagcgcaaagaaagagaagaagtatatacatggagctattcccagcacaaccagacttatctttacaaataagtcctccaaacaacaaatcatcatcatcatcaacaacaacaacaacaacatggaaggctatgagtagtaataataacaatattgatagagatgagatggacttattcttcttgagaagagctttagaatcaaaacctgataacaacaatactctttttgagctttctttatctaatcctaattataaaccttctcatcatactcaactaattaactcttcccattttcatcccctacaaaacacaaatttcatccaccaacaaaatcaacaacaacttaatatcatgagacctataagaggaattccattgtacaatcaaaaccctcttcctcttcctcttcctctttctcatcatcataataactacccaatatttgctcaccaaacctttgaaaatactgctcctacaacaacacctacattacctatacattcttctggatattgtattagtagttntagtaacaatagtaacaaaactatacctaattcctcaccaacaactatcccttttcatcattctaat

SEQ ID NO: 2438 - DNA, 908 bp, Lycopersicon esculentum
  Predicted polypeptide sequence is orthologous to G729
gatttcaacctttcatatgtaatgcaactaatggatctccttcattcaacattacctttaaccaaagaaaatgtatctcctttgtaaagggtttccccacaatggccatgaatgattgctcggaggtggccaaataaggctaaagaataaggtcccaaggccctaaataagtagaatttgatagtcaaatgtcataattttgattaccatctgaacttgtatcaactgtttgagacaaatgaaataatactgtcaagtgtcaatattcttgtgggcacactagtggtcaagaatgtttatttttaggattaatccaaaaatagtttaattaatccatcagcagcatgtaagtgaagatgtactaatgagtgacatttgtgaagttatttagattgtattcttgaattctacttcttttctctgcatcctgttgagatttgaggttgatgagagttatgtttgacctagattgtcagatttataaggctggtggttcttgatttgtttactactgattcttcaagagttgagtgtggtctagattcactatgataatgataatggtgtgttaacaaggacatgtgaatacttgtcaaaaagagatctggtttgttaagaggggacaaaggtttgtcctgtaaaattcttatgatataaaatgtatttatatttcttttcaaagaaagtggacatcatcttgggactgctgaaagcatgaatatcctttttgggtggaagtgttattttttcgaattatgtcaaacatttcaagtcatcctggagcggaaaaatgtgaaggtttcagtgaagtacataaaatcatgaaattgtttacatcattatggaacctgaattgtgcacatctggtgttgggttgttagtttgattgcacgttcttaatgttcaat

SEQ ID NO: 2439 - DNA, 569 bp, Lycopersicon esculentum
  Predicted polypeptide sequence is orthologous to G729
gttttcacaaacaccattatccccttcttcttcttcctttttcacaaacatgtccacttaaaaagaagataaaagataaaaatcaaaatctttgctcttcactttttcttcacttaccaccaccttggcttttttttactcttttttccacctaaatctatcatcaagaatcaaacttgaagtttgttcatctctctttttccacatcttgtttatgtgtgtttgcaactttttaccttttatttttcatcaattttggggttttttgaggtattaaagaagaaaaaaagaacaaatcttgaattgtcatataattttgtttgctatccaatatgcccttagaaggggtttttgttcaacaaaactcatcttcatcaaaacaaaccccggatctttctcttcatattagccctccaaattcatcatcatcatcaacacgtacaacacataataatagtttgactgagctttgtttagctcatccaactactaccaataatgaagaaaataagagtttttcaagaaacccttttctccaacaaagcccaaacatgaatagttatcatggg

SEQ ID NO: 2440 - DNA, 405 bp, Lycopersicon esculentum
  Predicted polypeptide sequence is orthologous to G729
gatggacaacttcacttcatgctagatttgctcatgctgttgagcttcttggtggacatgaaagggctactccaaaatcagtattggagctaatggatgtcaaagatctcactctagctcatgtcaaaagtcatttgcagatgtatcgcactggtaaaactactgacaaacctgcagcttcctcagatggatcaggtgaagaagatttgttagctattgacaagattatggatcaaagaggtccattagatggatgtgatgaaccttctacaactctttggagcaactcctcaagtagtagagaaagattgtcacaagctaactttaatgaatcaaatggactcatcagatcatcctctttcccatctcaacaaagattcagccatcatatagaggaatgtgaat

SEQ ID NO: 2441 - DNA, 490 bp, Lycopersicon esculentum
  Predicted polypeptide sequence is orthologous to G729
gcacgagataatagtttgactgagctttgtttagctcatccaactactaccaataatgaagaaaataagagtttttcaagaaacccttttctccaacaaagccaaaacatgaatagttatcatggggtttctttattagaccctataaagggtatcccaatttatcatcatcatcatcatcaagatccaaagagatcatcatcatttggatccatttatcataataatttggatcatatatcatattcgaataattcctatgttacaaatgttacttcctcttctccttataatcgaatacctattgtggctaatagatttcaaaatcaacaacacatatattataacggagttggattattaggttcaccttcttctcatgaaagtaataattttttgatgagatcaagatttttacctaaatttccaactaaaagaaacatgagggcaccgcgaatgcgatggacaacttcacttcatgctagatttg

SEQ ID NO: 2442 - DNA, 1671 bp, Lycopersicon esculentum
  Predicted polypeptide sequence is orthologous to G812
attttccttactttagggtagctagccaagatattttcaagcaaatccttttttcacaaacttctaaatattactaccatactatgtaaagaattttcaaatcgaacaaaaaaaaaaacatgtgatgggtaggacagttaaaacaaatttctagacttcattaacatttggtaaaaaattcaataatttttattcatattatattttcttttacataattaaattaattaaatttcaaaataaatatcaaaaatataaaaaagaaaaaaaccagaatcaaggcttaaaagaataacatgagaattgtttcactcacaaagattttttttttttatgatttttaatatggtatctgatacttatattgaagttcaaacaatttcgatcaagaaggaagaaggattaaaaatatctagaatatcatcccacttaatagtaaaagaatgtataaaatattcattgaaccctcactatacttcctttttagttctcattactctcttgctaatatacctccaatattgcaaacatattaatttgtcctaattctttctccctcttacccatactccaaattaatattaaccctatcttttctcatatatccacaaactcctttattacctttgccaagatcctctatcttcttaactttgacattgactcaaaaatattgttatactcatctttgttgaagaatcaaagcatggatcattttggtaatttaataaaagaagagtttgatggatcatttttgacgcctcaaccgaaggagtgtcttcatgagaatggacctccaccatttcttacaaaaacatatgaacttgtggatgatccaagtaacaacgacgtcgtttcttggagtagaggttacaatagtttcatagtatgggatccccagaatttggccattaattttctaccaaggtatttcaagcataacaatttctcaagctttgtcaggcagctcaatacttatggatttaggaaagtaaatccagaccattgggaatttgctaatgaaggttttctgagagggaaaaagcatctcttgagaacaataaggagaagaaaaccaagtaatttcatcaagtcttcgtcatcaattaataatcaagcatcaaaaggctactaaatcacaacttcaagctatggagcaaaagcttcaagggacagaaatcaaacaagagcaaataatgagttttttggctaaagcattacataatccaaattttgtggagcaaataatgcaacaaaatgataaaaggaaacaacttgaagaagcaatgaagaagaagaggaggaggccaattgattattatgaagctggtcctagtaatataattaagttagaacctcaagatcatgatattattaataatgaatttgatgatgatttacaagtggctatgaacatgtcacatgggaacacattaatcaatttagaagaagaaaataatgaaggattttgggaggatatgctgaatgagaatagtaatgttgaagatgagattatggctttgcttggtgttaataatgaacaagaagatgaacaacttcatgtggatattttctctgattaattaattacttgaataaattatcagccaatttctctggctcatcatgatttaaattttaaaaaaaaaaaaaaaaaaactcgagaggggg

SEQ ID NO: 2443 - DNA, 585 bp, Lycopersicon esculentum
  Predicted polypeptide sequence is orthologous to G860, G1760
ctctagcaaattgtttctaccttgtgttaaattacaggtttatggaaacagagatgcaaatggagtgagcagaagtccccttgttgcgaacagtttaagcatcaatgaggaccttcatgctcctgttcatctccagcttagccagccacagcaacagaactatgagacatcaggaactactgaattggggctacaactgcattcgcagtgaaaaccagactcgtaagagtttttagttctcgtgttgaagaagcagctgtgcttacagagctatgttttaattttttaatggtagcaatgatatagaacccagagatgtcaggaaaaagtcttcagttcaaatggttaatgacatcaagtttgacaagtgtgaggtaatccttagcacaactactaaaaagtaagataacaacaaataaagtaatacattggcacagtatctctacatatctttatctttcttggcacttcatgcttatgatgtgtatgcctatatactaggattgtacttgatgacgttttcaaatagctataaatagttgactacttgatcaaaaaaaaaaggaaaaaaaaaaaactcgaggg

SEQ ID NO: 2444 - DNA, 955 bp, Lycopersicon esculentum
  Predicted polypeptide sequence is orthologous to G860, G1760
gagaatattttaaattcattgaacatacagatatttttttctttctcctcctcctcctcctcctcctccattgttctaccaaatcactatttattgtcccacgttccacatcatggtattaatgcttgatcagatttgttagatctttggtgctgagtccagaaagttcttcacccaaaagctgcctgtggttcataaaaaaagaaacacatggaagaagacattgcaatttcccaatttcaaatcttgggtgtcatttccttaataattcttggatttgaattaatcgctctcatatccatgtcaaggagatatataccaactggaagtttcgaggaattgacaaatttggcatatacaaactaaaacctggtatagggcattgtccaatctcaggtgttcctttgatattcccagtccactcttgcgaccaaagaaagaacacaatgaagtaggttaaggtcagctaaaggatttgatggggctaaggatggttccaaaaagagcagctactttagatgaacgctactgtggttgcactatttatttgcatgcatgaaattgacatacgtgtatcctgttcgctcgagccatgataaagatgggtgaattcgatatcaaagggatgaaaagaagctgatagcataatacatgagtaggttggccaagaataaccttgatgatcaagagaactttactgaccatccctaaatcccaacgaaagccttctaccggggctttgctgggaaaacctgcttaaaaaaaatggacatgtgtgaagaccaagagcggttattcacttttcttcttccttagtctaagcaatcaatttgtgagataaattaattctccatttgtagttagatttttgcgtttgtataaccttttttttcgagttctaccttgaaaggaaacctacaatgagattgtacccgaaaaaaaaaaaaaaaaaaaa

SEQ ID NO: 2445 - DNA, 566 bp, Lycopersicon esculentum
  Predicted polypeptide sequence is orthologous to G860, G1760
gagagagagagtatagagttctatattttcttgatgaataagattgccctgtagaagcaatattaatcatcttagtgcaaagataaaagacacatggaagttgttatagtttttctggtaagaccttctgatttagttctctgatttcatccatcagaatctgctcctgcaagaaagtaacacatttaggatccttataataaaaaaaggagtaatacgtttgggagaaatcgtagacttgattttagcataagtttcatgaacacagaagaatttaggattttaccttttgctttcgtactcctttcaaactcatttcaatttggttttccagatttgttagatctttggtgctgagtccagaaagttcttcacccaaaagctgcctgtggttcataaaaaaaagaaacacatggaagaagacattgcaatttcccaatttcaaatcttgggtgtcatttccttaataattcttggatttgaattaatcgctctcatatccatgtcaaggagatatataccaactggaagtttcgaggaattgacaaatttggcatatacaaact

SEQ ID NO: 2446 - DNA, 391 bp, Lycopersicon esculentum
  Predicted polypeptide sequence is orthologous to G860, G1760
cagactgaacccaaaacgacgattgcgaagtcttcttttgtcttctccatcaacagcaacttttttgcccctctctctctcgatcgaaaaattcctccattgatttgttcttctgcttcttctcgtgaatgaaatttctctgagagaggaagtagagagagagagagagagtgagtgtgtgtgtgtgagagagatcggcgatggggagaggtaagatagtgataaggaggatcgataattcgacgagcaggcaagtgacgttctcgaagaggaaaaatggattgttgaagaaggcgaaggagctagcgattctgtgcgatgcggaggccggagttattatcttctccagtactggaaaactctatgaatattcaaacaccagcatgaagtc

SEQ ID NO: 2447 - DNA, 850 bp, Lycopersicon esculentum
  Predicted polypeptide sequence is orthologous to G913, G1753, G2514
cctaccaccccacccccctatagaaatctacatatacatacacacacacaaaaaaaaacatatatatatatggctgactctcaaaattctaccaagtccacccaaataattcaacctcctaatcaatcaagtgaaagtacgaaaatacccttcaacactacccttcctccaccactaccaccgttgccgccgcctccggcgccaccggagacacatattcaaataaccaatacattatcatcaaaattagaaaacacaaatacaactccaaaaaccgttattattccaactgcaatcatgagttccacctcatcgagcggcttgggatctccgagccgctcaataggcggaaaacatgcggtattccgcggaatacgatgtaggagtgggaaatgggtgtcagaaattcgagagccacgtaagactacgagaatatggttaggtacttatcctacacccgaaatggctgctgctgcatacgacgtcgctgcaatggctttaaaaggaaacgacgccgtaattaactttcccggtaatattaattcgtatccttcactccctccttcgcccgccgcggcggatatacgaaaagctgctgacaccgccgccgccctgatgaagattgaatccggagaaaccacctcgggaactcaaccaggtacggatgatcatcggtcattggggaatgtgcatatgatggaaactagggatcatgaatacattgatgaagaagcattatttgatatgcctaatttgctagttgacatggcggaggcaatgatggttagccctccaagaatgagctcaccgcggtctgatgattcaccagaacattctgatgcagaaaatc

SEQ ID NO: 2448 - DNA, 582 bp, Lycopersicon esculentum
  Predicted polypeptide sequence is orthologous to G913, G1753, G2514
aaaataaaagctacctaagtcagtctcatttgtatggctgcttatcattttaatgacaattctccttcattagaaaatctttcacccactgggggaggaagtagcactaggcatcccaatttcagaggaattcgacagaggaatgggaaatgggtctccgaaattcgcgagcctcgaaagaccacacgtatatggttaggtacttttcccattcctgaaatggcagctgtcgcttacgatgttgcagctttggcattaaaaggtcctgatgcgcaattaaactttcctgatcgtgcatactcctaccctgtccctgcttctctgtcagccgcagatattcgtactgcggctgctaatgctgctgctgctagagcacctcctttgtcagaaatcaatacagcagcaggaggaggacaagggcaagagtttgtggacgaagaggaaatatttggaatgccgaaattgcttgatgatatggcagaggcaatgcttgttagcccgccaaggatgcatcagtacgacgaatcacctgaaaactctgatgcagatagtctctggggttatccatgagtaaaatatatg

SEQ ID NO: 2449 - DNA, 618 bp, Lycopersicon esculentum
  Predicted polypeptide sequence is orthologous to G975, G2583
gcctaaccctcatttcatcattcatttctgtgtctacctgaacttctgcaactttttttttttctttttttaaatttgtccccctcttaacaacatggtacaatcaaagaagttcaaaggtgtcagacaacgccagtggggctcttgggtttctgaaattcgccatccgctgctgaagaaaaggatatggttaggaacatttgagacagcagaggaagcagcaagagcgtatgatgaagcagctatcttgatgagtggacaagttgcgaaaacaaacttcccaattgtgaaggagagtactgataacaacaatgacactactaaattccctttaacttcttcatcaacactgtctagtagcatgctgaatgcaaagctgaggaaatgttgcaaggatccagcaccttccatgacctgtctgaggctcgataacgacaactgtcatattggagtgtggcaaaaaacatcagggaaacattcaagttctaattggataacaaaaatctaacttggaaagaaagaggagaagcctcatgatcatcaggatatgaatgctgaacttggcattactaaaccattggacgaagaaaacagaattgctatgcaaatggtggaaga

SEQ ID NO: 2450 - DNA, 451 bp, Lycopersicon esculentum
  Predicted polypeptide sequence is orthologous to G975, G2583
ggacaattgcttgcccacattcaagtatggtacaggcaaagaagttcagaggtgtcaggcaacgccattggggttcttgggtcgctgaaattcgtcatcctttactgaagaggagagtgtggctaggtacgtttgaaactgcagaagaagctgcccgagcgtatgatgaggctgctgttttaatgagcggacgtaacgccaaaacaaatttcgcagtgcaagcaatggatgaaaataaaaaagacaattataaatctaataattcgacattatcaggatcatcatcatcactctctgctatacttagcgccaaacttcggaagagctgtaaatcgccatcgccgtctctcacttgtctcaggcttgatacagagagttccaacattggggtttggcagaaacgggccggagcccggcctgattctagctgggtcatgacggttgaatttgg

SEQ ID NO: 2451 - DNA, 975 bp, Lycopersicon esculentum
  misc_feature (807)..(807): n is a, c, g, or t
  Predicted polypeptide sequence is orthologous to G977
cctcaaccaatttcattttctatctcattcaggcatttcaacaaacacttttttgcgaacacacacacttcaattaactacatttgtaagattgtcaatattatggctagggcacaacaaagatatcgaggagttcgacagagacattggggttcttgggtctccgaaattcgccatccattgttgaagacaagaatttggttaggcacttttgagacagcagaagatgcagcaagagcatatgatgaagcagcaaggctaatgtgtggtccaagagctagaactaatttcccatacaacccaaacatgccacaaacatcttcctctaagctactctcaactacattaacagccaagttacacaaatgctacatggcttcacttcaaatgaccaaaacctcaccacaaggacaaaaattagcaaaaaatgcaaccaatgttcaagaaagtgttattaattcctataaaatgaaacaacaaatgttggtaccaaagccatcagtactattgactcatcatgatcatcatgaggaagctaaagtagtcaacttgggagtgggagtaattaggaaagttgaagatcaagtacttgagggtataccacaatttgtcaagccacttgaagatgatcacattgaacaaatgattgaagaattgttggattatggatccattgagctttgctctaatgttgttccttctcaccaaatccagtgagcttgctcgtaaatcgactattgcctaatacttgctacatttgatcagtgcaggtattagataactcttctactgatgttctctctcagnaattgtctctttttgggtcctacattgttctgtactagaaagatactcattttgctaatttaaccccatttgtatagccgttcccgatttgtttgggactgaagcttagttattgttgtattaagtcttttaagtagtctccctctgttttaaatctatgtatcgtta

SEQ ID NO: 2452 - DNA, 424 bp, Lycopersicon esculentum
  Predicted polypeptide sequence is orthologous to G977
ggttgtccgcttgggttccctgtctttcaaaagccactcttagtcaactaggatagagctaaaccaaaacctcatattaagcatgacacaattgttttgtatgttatgtgatatacgtgttgtatatatgttgtataatagttcattattttaaaatcacttttgttaacctagttttaagaatattcataattcaagtccaattttttgaagttaaatagttggaactacgtttgacctgattcctacttcaacgggatacgtaggcgccattaaggctcggtcatcttccccgtaagttttccaaattttaagaacagaaactggggcaaaattttggggaagtctccaaaattttataatggagatagttgttacaatattaaataccggaggtttgtcgaagctgaaacaggggcaaaaa

SEQ ID NO: 2453 - DNA, 1237 bp, Lycopersicon esculentum
  Predicted polypeptide sequence is orthologous to G1020
gattttgaattagctatggcgcctaaggaaaaaattggtgcagttacagctatggcaatggtgaatttaaatggaatttcgaaagaggtgcattatagaggtgtaaggaagaggccatgggggagatacgcggcggagattagagatcctgggaaaaaaagtagggtttggttaggtactttcgatactgcggaggaggcggctagagcttatgataacgctgctagagaatttcgtggagcgaaagcgaaaactaattttccgaaattagaaatggaaaaagaggaagatctgaaattcgctgtgaaaaatgaaatcaatcggagtccgagtcagactagtactgtggagtcatcgagtccggttatggttgattcatcatcgccgttagatctaagtctctgtggatcaatcggcgggtttaatcatcatacggttaagttcccgagctccggtggaggttttaccggttcggtacaggcggtgaatcatatgtactatatagaagcacttgcacgcgccggagttataaagttagaaacaaatcggaagaaaacggtagattacctcggtggtggtgactctgattcatcaacggtaattgattttatgcgtgttgacgtgaaatcaaccaccgccggtttaaatctggatctcaactttcctccaccggaaaacatgtgacatcaccagagacgacgatgaagacgatcggagatattttgcgagaaacatttttaatttagtacaagttcctttttaatgttttttaatttaaacagaaaaggaaaaaaaaaagtatatagaattagatatatagatgatagaaaactgaagagccatcgccgttgctgctgccgtcgccgccggcgacgattaatcaccgccgatgtcaatatcaagaagggctgatctatttttacccttttttgcaacagaaaaaaaaacaaatctatttgattttgcaaagctgttgtttccattagatcatccttatcatatagttattataatacattgttgccggttttttcagctgaaaataattatcacaattctctatctcattcgattaattcttgattaatcgtaacgagagggagttattcgaatagtaaatatgttcctatttttttgtttttgtgaatcggtcggaatgtgaggagcaggcggcggcgagcgagaaccgctaaaagagtttcgcggtaaacgtgtggcacgtgtggtccatttgatt

SEQ ID NO: 2454 - DNA, 915 bp, Lycopersicon esculentum
  Predicted polypeptide sequence is orthologous to G1020
caaaaaatcgtatcagcacctatggctgtgaaagataaggctgtgaaaggaggtaatgtgaaagtgaatcatggagttaaggaagttcactacagaggtgtaaggaagaggccatggggtcgttacgctgcggagattcgtgacccgggtaagaagagtcgggtctggctgggtacttttgatacggcggaggaagcggctaaggcttacgatgccgctgccagagagtttcgtggacctaaagcgaagacgaatttcccctttccggcggagatgaataatgttggtaacaataacagtcagagcccgtgtgggagcagtaccgtggagtcatccagcggagaaacggttgttcacgcgcctaatacgcgacacgcgccgctggagctggatctcacgcgccgtctcggtgccgctgctgaaggtggacgtggaggtgtcggctacccgatcttacaccagcagccgacggtggcggttctgccgaacggtcagccggttttgttgtttgattctatgtggagaccgggagttgttagtaggccgtatcaggttgtaccggcgacgatggagtttgccggtgtcggtgccggagttgttactagtgtgtcggattcgtcttccgttgtggaagagaaacattatgggaaaaagggacttgatcttgatcttaaccttgcgccacctatggaagtttaaattaatgacgacgataatctaattttgtgagagagattaagagagtgacagagctaatggctgatttttgtatataagttcaaaagaattgattgcttttttttttttggcagctgaaactttctcgtgctgtttctaccatttgtaactctaaatccttttaattaatgagaaaattccatattttctcctttctaaaaaaaaaaaaaaaaaaaa

SEQ ID NO: 2455 - DNA, 565 bp, Lycopersicon esculentum
  misc_feature (507)..(507): n is a, c, g, or t
  Predicted polypeptide sequence is orthologous to G1038
gggagaatagtaaaaccagtgttgggttttcttctccaagaactgatacttttccagctggtttaagggttcttgttgttgatgatgatcctacttggttgaagattcttgaaaaaatgcttaagaagtgttcttatcaagtgacgacatgtggtctagcacgagaggctttgtatgtgctccgagagagaaaggatggatttgacattgtgatcagtgatgttaacatgcctgacatggatggatttaagcttttggagcatgttggacttgagatggatcttcctgtcataatgatgtctgtggatggtgaaacaagcagggtgatgaagggtgttcaacatggtgcatgcgattatcttttaaagcctatacggatgaaagaacttagaaacatatggcagcatgtactcagaaaaaagatgcaggaggcaagggatattggtaatcatgaattggaccaatatgatgaattgtggattcttaatggagctgaaatcctttcangaaagaaaagaaaagattttgagaataagcacgatgaaagagaaatgtccgattcaag

SEQ ID NO: 2456 - DNA, 701 bp, Lycopersicon esculentum
  misc_feature (664)..(664): n is a, c, g, or t
  Predicted polypeptide sequence is orthologous to G1047
cccacccccctttagaagcgattttccggccatgttgtccactttcccggccactactctgtccgccgacggacttttttccaatttatttccggcatttgatggaggattcactccttgggaatgtatcgaaccggcttttctattttcacaacaagtggaatcggttgtttcacccaaggaatccccaccacctgaaccggttatttcaaactccgattcaggttctgatgactccaaacctaattctgttcactctagttccggttcagatgacccgaaccggaataataacaataataataagtcgaaccggtgtcctgacgagagaaagcggcagcgcacgacatcgaaccgtgacatggatgagaggaagcgtcgacgtatggtatcgaaccgggaatcagcaaggcggtctcgcatgcgaaagcaaaagcatctggaaaacctgcggaaccaagcgaaccggcttaaagtagggaaccgggaaataatgaaccggttacggttaatcactcaccagtgccaagtggtccagtgtgagaacgagcggctgaggaccgaatcggctatccttcggcaaagactttgagggtatacgtcaaatatggatcaaccggcaatttaattcttattctgcatgggcatgcaataatatggaacnaagacctcattaattaatcattgggaactatataatc

SEQ ID NO: 2457 - DNA, 598 bp, Lycopersicon esculentum
  Predicted polypeptide sequence is orthologous to G1063
ggaacacttctcatagtgtggtatcccttttagcccatctttcattctaatatttctatatatcctcttgtttttttatttttaccttacaaaaacaaatcatggatttacaaaatattgctcactcactagaacttggattctccaatagcaatattgaaatgatacctttacaatcaccactccataactccaattacttaatgaattctcctccatctaatttctcattcatgggcaatccaattgaagagccagccgcgatgccaatactctcatcgatcgatgaaattatagcatcgactcatggtaatggaaatgattactcatgtttgcagaggaggaattctatggaggctatgagggagatgatttttcgtatcgcgatgatgcaaccaattcacattgatccagaatcagttaaacctcccaagaggaaaaatgttaagatatcgaaggatccacagagtgtggcagccaggcatcggagggaacgaataagcgaaaggataaggattttgcaaagactagtccctggaggaactaaaatggatactgcttcaatgttagatgaggctgtccattatgttaagttttt

SEQ ID NO: 2458 - DNA, 557 bp, Lycopersicon esculentum
  Predicted polypeptide sequence is orthologous to G1075
aatatatacctattttcttactcatgctcattaattaatttcccttataattaatcatatatcatagtttattataccttagttttctgttcactacttttgttattgttatcgttatcgttatggctggtttggacttaagttccgcttctcatcatcgttttctccctcgtcatctccacgatcctcaagacgatgaaatcaatcgcaacaacactcaattttccgatgatgacaacaacaacaacgataacaataacaataatagccccggggtagcacgtagacctagaggtcgtcccgcggggtccaaaaataagcctaagcctcccgtgatcataacacgggagagcgctaacgcgctccgtgcgcatattttagaagtgagtagcggacatgatgtctttgaatcagttgctacttatgctagaaaaagacaaagaggaatttgcatactgagcgggagcggtacggtgaataacgtcaccatacggcagccacaggctgccggttctgtggtgacgttacacggaagattcgagatattatctttatcc

SEQ ID NO: 2459 - DNA, 571 bp, Lycopersicon esculentum
  Predicted polypeptide sequence is orthologous to G1082
gtggattttgaacatgaggctgttaaggaagttcatgaggatcaaaggtttgtagatgaggctgcaactgcaagtggaagttattcaaaggcagttgaggagaatgagaaggcagctgattcagagtccatacaccaccactcaagaacaagttcatctgtggaggatgacccgattgagtatgaggtacacgtcgtggataagaaagtggttgatgatgcgaatcggggaaatgtagctggttccaagggtcgtagtttcaatagtgattctgatgtggtgaaggagattcaagttcaatttgagagagcttctgaatcagggaatgagcttgctaagatgcttgaagttggaaaacttccccacaatcgtaagcacgcgacatatcaagggatagtttcttccaagatgttgcacgcgattaccccttcctcggctgtactctcgctaccgtctactttaaagaacgatgcgattgagattgctgatcatgccattttagatgtagaaggagatattagttcaagagctagaaacatttcttccacattgcagaagctgtacctctggg

SEQ ID NO: 2460 - DNA, 698 bp, Lycopersicon esculentum
  Predicted polypeptide sequence is orthologous to G1082
agtaaccctaattcttacaactatccgaattatcccaattacgctggtgagtttttttcctcgtccattcaaaggccgtatggtgattcatctccaccggcgccatctggagctgggccttcgtcagcgccttctacttcaaaaccgcctcctccgccaccctctccaccgaggagctcaccttgggattttctgaacccttttgagacttttgagagtaataattaccctacaccatatacgccaagccgagactcgagagaggttagggaagaagaaggtatccctgatttggaagacgaggattttgagcacgaggttgttaaggaagttcatggacatcagaagtttgtcgaaggcgaaagtgaagttcacggagggaaccattcaaaggcagtggcagaggaggagagagagaagcaaagtgattcggagtcgctataccatgggaggccaagtgcgtcaatggaaaatgagcaggtggagtttgaggtacacgttgtggataagaaagtggtagatgaagaagggaagtcagggcatgggggaaatgttgctgggttcaaagctcgtgcattcaaggacgactctgatggtgtgaaagagatcaggttcagtttgagcaagcttctgaatctggaaatgagcttgctaagatgctgggagttggaaagcttccccacatcgtaagaacgcac

SEQ ID NO: 2461 - DNA, 499 bp, Lycopersicon esculentum
  Predicted polypeptide sequence is orthologous to G1082
gcttcattcatccatccatccctctctcactatgacttcttttccctttttacttaattactaattccccaattttaaattatggggtgcgcaacctctaagcatgatgacttgccggcggtcgctctatgccgtgaacgttgtgcctttttagaccaagctattcaccaccgttacgcttttgcggaagcccatctagcttatcttcactcattgaaatccgtcggcgcttctcttcaccggtttttccaaaatgatctcgatctttccacttcatcatcgggtagtcctctttccccgattctccctcatcccaaagatgaaacttcctctgcccttcctcatccagttaaaaaaattcaccattctcactctagttccggttcacaccttcacttccactcggaatccgacgaagatgatgattccggttccgactctttgcatcaccatacggaaacccctactcatggtcagttcacttatggtgatcatcaaa

SEQ ID NO: 2462 - DNA, 543 bp, Lycopersicon esculentum
  Predicted polypeptide sequence is orthologous to G1084
ccattacaggggagggagtgggttgaagcactaactgacattgaagaccattttgtcaaggcatatgatgctggaaaggaagtatcaaggatgttagaggcaaattgggtacattcacagcctaatttgggagaacccaaagagaactcaacaaaaatcatcccagcaattacttggaagtctcctgcatctcgttcaccatcatgcaagagtcttgtggcgtctagttccaagagttcttccacatggacagaattcaagaatgatctatttgatgattatggtggaatgggttctgggagccatttgctgacgctaggaaggctgtatgcttgggagaagaagctgtatgacgaggttaaggctggagatagcacttggaaattatatgagaagaagtgcaatcaactaaaaaatcatgatgccagaggagatgaaggacggaccgcagacaaaaccagagcagcagtaaaagaattatatagcaggatcctagtcacaattcgaagtgctgagaccatatccaaaagaattgacgaacta

SEQ ID NO: 2463 - DNA, 432 bp, Lycopersicon esculentum
  Predicted polypeptide sequence is orthologous to G1084
gagaagttattaaggatcttgaaagtcagtttgtgattgcttgtaattctgctaaagaggtgtcaactgttttagaagctatcagggctcagtactcattgcaatcgagtgatcaatcagcgatgaaaatgttgaatccagtagctctgtttcgctcaggatcatcaagatcatcctcgtcgagatttttgattaatccttcaactttaagagatgagggttatcatagcagtagtgacttatccgatgaatctagcgtgctctcaagcagtcatcaatcaaccttggatagattatatgcctgggagaaaaaactatatgaggaagtcagggcaggtgagcggatccggctagcctatgagaaaaaagtggctcaactcagaaatctagatgtgaatggagcagacccttcgtctgtggataaaacgagag

SEQ ID NO: 2464 - DNA, 500 bp, Lycopersicon esculentum
  Predicted polypeptide sequence is orthologous to G1090
gtataacatcagaatatagaggtgttagaaagaggaaatggggtaaatgggtgtctgaaatccgtgagccagggaaaaaaacgaggatatggctagggagttttgagacagcacagatggctgcagctgcgtatgattcagctgcatttcacttcaggggacatgcagctaagttaaatttcccagaattgattgaacatttccctaaaccagcaagttcttcgcctgaagatatacgtttggctgctcaacaggctgcaattacagttcaaaacacgaattcaatggcctcttctagtcatggacatggagcaccagttacagtaggattatctccaactgaaattcaagctattaatgacttccctatggattcaccacatatgtggactactcatgaagacatcaactatacttatgaaatgagtgattaccaagaaatggatgattgtctttgggactactcatcaactaactcattctagaggcctaatatatta

SEQ ID NO: 2465 - DNA, 1035 bp, Lycopersicon esculentum
  Predicted polypeptide sequence is orthologous to G1108
tctgaatttactgggtgattgtgaagaggagaagaatttttcatctggtgaactcatacttcactgcttaagacttttgcatcccatgtttcctataattatctctcagtcagtggacttagatggccatttcctcattggggctacaccggaaaagccaaactaaccagtttcaattattaatggagcaagcagataaccgtagcaacgatgagcatgtaattgacataactagtagcaatgatgcatcctcatcaagcaacccccatgatagaccagttaataatgtgcttcatgtccaagctgaacatcccccatcaacaagcacaacagtgcccgtctcccaacatgcattttcttctgctagtagatccaacttgaggaactcatcatttgctcgaagaggaagtgggcgccgccatcggagtcctctgaattctgtgctctggatatccattgaactagtcttgacattgagccaaataattgcagcaatcgcggtgttggccatatcaagggatgagcacccacgagctcctctagcccaatggatagttggttatgcatctgggtgtgtagcaattctccctcttctctactggcgttttcgtcatagaaaccaaaattcagatcaggattcatctcagcagccacagatttcttcccaggttgaactctcagccagaccatcctcaagtacaaggagttcagaaggtgaaggtcgtcagacaactgctacagcttctacaggtggtcaaagtaatgaaatactgagcacaaggataaaatcatttgttgagtacttcaaaatggcattagattgtttttttgcagtgtggtttgtggttggaaatgtgtggatatttggcggacactcctcttcctctgaggctcccaacttgtacaggttgtgtatagtatttctgacctttagctgtatcgggtatgccatgccatttattctatgtgcaacaatatgctgctgcctcccctgcattatttcagtcatgggcttccgagaagatctgactcaaa

SEQ ID NO: 2466 - DNA, 1052 bp, Lycopersicon esculentum
  Predicted polypeptide sequence is orthologous to G1108
cacccacgagctcctctagcccaatggatagttggttatgcatctgggtgtgtagcaattctccctcttctctactggcgttttcgtcatagaaaccaaaattcagatcaggattcatctcagcagccacagatttcttcccaggttgaactctcagccagaccatcctcaagtacaaggagttcagaaggtgaaggtcgtcagacaactgctacagcttctacaggtggtcaaagtaatgaaatactgagcacaaggataaaatcatttgttgagtacttcaaaatggcattagattgtttttttgcagtgtggtttgtggttggaaatgtgtggatatttggcggacactcctcttcctctgaggctcccaacttgtacaggtgatctttcactgttgttttcattttggggtgtttccttactttctatcatctctaccagcatcatatttgctcatgtttctattcatccgtaggttgtgtatagtatttctgacctttagctgtatcgggtatgccatgccatttattctatgtgcaacaatatgctgctgcctcccctgcattatttcagtcatgggcttccgagaagatctgactcaaaacaaaggcgccacaccagaatcaattaatgctcttccgacctataaatttaaggtaaagaaaaacaaaagtggcaacaaagaggctgctgaaggtggggttgtggctgcaggaacggacaaggagcgtgtgatttcaggagaagatgcggcatgttgcatttgcttagcaaagtatgtgaacaatgatgagctaagggagttaccctgttctcatttcttccacaaggactgtgttgataagtggctgaaaatcaacaactcatgtcccctttgcaaagctgaggtgggtgagacccttttgagctctctaacggaagcaactgcaagtttgcgtcagagttccgcgttttaagttacgactctgcccacatgctagtatagagatgctttttaaaggaatagtagttaccttcatatatattttattttcttccatcactcttct

SEQ ID NO: 2467 - DNA, 919 bp, Lycopersicon esculentum
  Predicted polypeptide sequence is orthologous to G1108
ccaatctgtacagattatgtatagcttttcttaccattagttgcattggatatgctatgcctttcatcttgtgtgcgatgatatgctgctgcctgccttgtatcatttcaatcctcggtgtgcgtgagaatatgcatggagtgagaggagccacagaagagtccatcaacgctcttcccacactcaagtacagggtcaagacagatggaactggaagtaatgaaagtaaaaatctagaagaggaggaaggtggttgtgtagctgctggcacagagaaggaacgtgccatatcaggtgaagatgcggtgtgttgtatttgcttagcaaaatatgaggacaatgacgaactgagggaattgccttgctcgcatttcttccatacacagtgtgtagataaatggctgaagattaatgcgacttgccccctctgcaaatctgaaattgacgccaagaacagagatctaccttctgtagaagaggaacccctccaacaatcctaaggtgatgcagaaaccaacttcttatggttgaaacacagatcatcgcggctagcttgttgcatggggaaccaggagagtatatcccaactgttacttcttctgctgttgctgctactgctactgctgtttctaccacacgaatttcagtttgtatagttgtagctcataccaggtatccataacaagcttgaaagaagaggtaattccattgttgatacccttacatctctctcctgcctcaccagctatatgttgctcggaacttccaaaaaaaatgtcagttgcactcgtgttggatcttcaaaaaatgcatagcttttggaagatctaaaccgggcgatatttttgaagtgtccatcatctaatgcaaacatagcacactgtataaatagatttaagggtaaagctgggtgtacacc

SEQ ID NO: 2468 - DNA, 516 bp, Lycopersicon esculentum
  Predicted polypeptide sequence is orthologous to G1108
cgcataaaaaagttaaaaaaatcgaagccctaatttcagagaaatcttcatactgacgaactttatcgatcatcaaatataatcgctggtaggctttgcttgtgagtataaggtggtagctgaaccagtagcaatattttcttgagatttatggttgaatggctgttacctcggaagaacttaatcaagagaacccaaccgacagatttcctttgctcatggagcaagcagaaagtcgtgagaggaatgaacatgttattgatgtagaacaaggaagtagcccctcatcatcaggctcatctgataatgattctcctcatgaattggaaatacccaaccatgaaaatagaccatcaaatcgacattccgtctcttcttcgtccaacgaatcagattctcatagcccttctagtgctaggagagctgatggttctgatcgtcgttggagcccatttaatactctgttgtggctttccattgagctaatattcaccttaggacagattggtgctgccg

SEQ ID NO: 2469 - DNA, 1580 bp, Lycopersicon esculentum
  Predicted polypeptide sequence is orthologous to G1137
gtctctctataattccctctgcttttactctcttaccatcaaaaaaattcaaaaatctctctgggtttttaattatactcaatttgggttttgtttctgcgattttcattcactgagctttgagagttggtgaaaagcacagaaaaacagtagtcttgaggttattgtttaaattgaggaacagtatgctgtgttgttgtctatctgttgatgtttatcgaaaagtcatctccttgaacttgtactgtcatgtaattctgtagaagtaggaaaaaagaagagtttatttgtgaaatcttgattagtttttcagtttttgaaccttgggaaattgtattcttgttagtaatcttccatgggatccacacatttcattgtcataccgtgttatgttctgaggattagctgagaatctattcctcttcagaatacttagttttactggtgttgtctttgttgttgaatcggggattatcggggatattagttttcactgttgctagttaattttgggtgtggttatctttgtcatttcttctaaaaagtagattgagttaattgcgcggagtagtattgttttccaagcattttttggggggagttgtttgaaatcactggtgtttttgattgttctggtggaagattgtggttgaagggttggaacaagtagttatggtgtgccaagcagctggccagacaagatttcgggcattaaaacatgaaaatggaattgcggggtgtgccaccataattgttagagttatagcatgctttcaacctcttcaggattgccaggctgaatatttccgacagttgttgaaacctgtcacgtagtttcgtctttcttgttgttgcatcttagttaagctggatttttttggattttctgttgtttctcaagtgtacaaggaataatctgcaatttgtattacctgagttatttagaactggtgattgttgtggttgaatggaaagagactttgtatcgtggttccgtcgccagtatcctgatctgcaatctgcccattcgaacttttctagtcgtggactcaatattgggcagcagaattctgttcctatttacatgcctccgtatgcaaatgaggttccagtaaaagggagttctcccttgtcgttttcggggttgctagaaccaaaggcaagccaaccaactgaagctcacaattggttctactgtttaccacagttgcaacagggttttgctcctgttttgagcactgtaccgaacgagaagtttgctcctcagtctgttgacaattacggggtaaatgaagaagccaatgctggccccggattctcgcagaaaagatttcttgtttttgatcaatctggtgatcaaacaactttactttacagttctccaaatggtactcctgtgcaatgcctaccctcttggcatccaaaatccgctgcaccttgtcatctgattaaggaaggccaacagattttagggaacggaatttgtccatctgggaaatactccggtggtgaatattatgaagaaaatcatagagatgatgtataaagtgaattgcatgaggatactgacaaattgaatg

SEQ ID NO: 2470 - DNA, 944 bp, Lycopersicon esculentum
  Predicted polypeptide sequence is orthologous to G1137
gttttattgagtgaaacggttgggaacaagtagttatggtgtgccaagcagctagtcagacgagatttcgggcattgaaacatgaaaatggaattgatgggtctgccaccataatagttagagtaatagcatgctttcaacctctccaagattgccaggctgaatacttccgtcatttgcttaaacctgtcacgtagatcgatctttctttaccgcgttcaagttaagctggagtttttagtttttctttatttagcaagagtgcaagaaataatcagcaatttgtagtttcacagttgtttcaaactggtgattgttaaggttgaatggaaaaagacttggtctcttcattccatcaccaacattcagatctgcagtcagcccatttgaatttttcttatccacgatttgatatagggcagcagaattcttttcctacttacatgactcctcagtcaaatgagattcctttaaatggggattctccatatttcacatttcctgggctgccagtgtcaaatgcaagctggccagcagaaacttgcaattggttatattattcgcctctgttttatcagggctttaatcctgtttcgaccactttacctaaagagaagttagctcctagagcacttgaaaatctggaaggtagcaaacatcctaatggaggcaccacatctactcagaagagattccttgtgtttgatcaatctggtgatcagacaactttgatctataattctgctaatggtactcacgtacaatgcccggcttctctgaatccaaaagccccagccctttataaggaagatccagagatcaaaagaaatgaaacttctccatttgggcatttcttcggtgatgaatattatgaagaaaacaacagagatgatgttgaaagtgaaatgcatgatgatactgaagaactgaatgccctactctac

SEQ ID NO: 2471 - DNA, 571 bp, Lycopersicon esculentum
  Predicted polypeptide sequence is orthologous to G1137
gatgatgttgaaagtgaaatgcatgaggggactgttgaactgaatgccctactctactctgatgatgattacaattattccgaggatgatgaagaaacaagcactggtcactcgcctagtactatgaccactcatgatatgcgagagtgttttgacggaaggggtgaagaagttgctagttctgctggggtgactaaaaggcataaactgctagatggtagctacgatgcaccagagctcagggatactgcaacctccgcaaaagcctatacgtgctccgacttagaggatgatgcacaatccagttgtggcaatggtctcgaacaagactcaggagcaccagattctccatctgggaaaaagaggctaagaaaagataaaatccgcgagacaataagcattttgcaggaaataatccccggagggaaaggaaaagactcaatggttgttattgatgaagcaatccattacttgagatccctgaagatgaaagccaagtccctaggacttgattctctttgagcttcagcttgccactggtcatcatattgagttactaatggtatttttc

SEQ ID NO: 2472 - DNA, 621 bp, Lycopersicon esculentum
  Predicted polypeptide sequence is orthologous to G1145
gattgatcatttgagaacgttgacacattgatattggtgaatggtaattcaagaaatgggatctcgggggggaggtgaagcaaaggcaaatgctttagctacgcaaggatcactctacagcctcactcttgatgaagttcggaatcaattggggaattgtgggaaaccactcaatagcatgaaccttgacgagtttgttaaaactgtatggactatcgagtctaatcaagaagtggtggggggaaatgattacgggccagtgcagcaaggggcttctcagcatcatccatcgagcattacaatgtccagggatctcagcaagaagactgttgatgaggtgtggcaagatattcagcagggggtaaaaatagataatgttgataagagaagccaggagaggcaactaactttaggtgagataactctggaggatttcttggtcaaggctggagtgattgccgagtcgacccaaggcaagagaatttcgggtttagtttttggggttgattcaatgtcattgacacagcaagctcagtggacgcactatcaaatccccgcaatgcaacaggtaccagaacagcagcatcaacaacaacagcagaatataccaccagtttttat

SEQ ID NO: 2473 - DNA, 245 bp, Lycopersicon esculentum
  Predicted polypeptide sequence is orthologous to G1145
ggctcaagacccaaagacaaatgctttggctaggcaaggatcattatacagccttactcttgatgaggttcaaaatcaattgggggatttggggaaaccattgagtaatatgaatcttgatgagcttcttaagactgtatggactgtggaggctagtcaaggaatggggggaacggattacggggtgttgcagcatggtcaggatgcttcggggagttctttgaatcgacaatcgagtatcacac

SEQ ID NO: 2474 - DNA, 654 bp, Lycopersicon esculentum
  Predicted polypeptide sequence is orthologous to G1145
catacaataagggcagaaggtgataaatcttgaggagatgaacagccaggagagagagctaacccttggtgagactactttggaggactacttggtgaaagccgggcttttcgttgctgatgcttctttaggacatacaatgtcattggataatcctacggcaatgcaaaattttgtgcctccaataggcttgtcaccatctccttcgctgtctgatacaccagtttctgaccggaagaggggtgctatggacatcgataagactattgataggagactaaggagaaagatcaagaatagagagtcagctgcacggtcccgagccagaaaacaggcttaccacaatgagctggtgaacaaggtgtcacatctggaagaggaaaacatgaagcttaagaaagagaaggaactggagaacatgttatccgagttgtcgtctgaaccaagatatcagctaagacgaacgacttcattctgatcgagttctttggcagaagttactatagtcattatagatataggatttgtgtatcctctatgaaacatcttattaggtagttgggagatagatgttagaatgtttgatctttgtttttatctgtatatgtttatagatgcacatgaaaaaactgaagatgaaatggactctttact

SEQ ID NO: 2475 - DNA, 2257 bp, Lycopersicon esculentum
  Predicted polypeptide sequence is orthologous to G1146
gctgcaagaattcaggattagtctgaacacgtgatgtgtcatctacaccggtgtctgatgctgaccgtgtgaagatcaaaaaagcactgagaggtgtgaaggtggaggttactcatcgtggaaatatgcggcggaagtaccgcatcgccaatttaacatctcaagcaacaagagagttaactttccctgttgatgaaaagggcactttgaaatctgtaattgaatattttcgagaaacttatgggtttgttattcagcatacccagtggccttgtctgcaagttggaaatcagcagagacctaattacttaccaatggaagtctgcaagattgtagagggacaaaggtactcaaagcgcttgaatgagaaacagataactgcacttctgaaagtgacctgccagcgcccccaagaaagggagcgtgatattcttgagactgtgaagcataatgcctatgctgaggacaaatatgcgaaggagtttggcattaagattagcgacaagttggcacaagttgaggctcgtattttgcctccaccttggcttaaatatcacgataatggccgagaaaaagattgtctgccacaagttggccaatggaacatgatgaacaagaaaatggttaatggaggaactgttgccaattggatctgcataaacttttctcgcaatgtgcaagacactgttgcacatgggttttgttctgagcttgcacaaatgtgtggaatatctggaatgaacttcaacccgaatcctgttctgcctcctgtaagtgcacgccctgatcaggttgagagagttttgaaaactcgatttcatgatgccatgacaaagctgcagccgctatcgaaagagcttgatctcctggtcgctatcttgccagacaataatggctctctttatggtgatctgaaacggatttgtgagactgaccttggagttgtttcacagtgctgtttgacaaaacatgtatttaagatgagcaaacagtatctagccaatgtagcactgaaaattaatgttaaggtgggaggaagaaacactgtgctagttgatgcaatatctaggcgaattccccttgtcagcgaccgtcctacaatcatttttggtgcagatgtcacccatccccaccctggagaggactctagcccatccattgctgcggtggttgcttctcaagattggcctgagattactaagtatgctggtctagtttctgctcaagcccataggcaagagcttattcaggatctgtacacaactaggcaagatcctgttaaagggactgtgtccggcggcatgattaaggacttacttatctccttccgaagagctactgggcaaaaacctcagagaatcattttctacagggatggtgttagtgaagggcaattttatcaagttcttctttatgaacttgatgccatacgtaaggcatgtgcatcattggagccaaattatcagcctccagttacatttgttgtggttcagaaacgtcatcatactagactttttgctaacaaccaccgtgatagaaatgctgttgatcggagcgggaacattatacctggtactgttgttgattcgaagatttgccacccaacagagtttgatttctatctttgtagtcatgctggcatacagggtacgagtcgtccagctcattaccatgttctatgggacgagaacaagttttcagctgatggactgcagtcattgacaaacaacctgtgctatacatatgcaaggtgcacacgctcagtctccattgtccctccggcctattatgcacatttggcagcttttcgtgctcgtttctatatggagcctgagacatcagacggtggatcagtaacaagcggagctgctggcagaggggttggtgcaggagctgctggaaagaatacacgagcaccaggtgcaggttctgctgttagacctcttcctgctctcaaggataacgtgaagagggtcatgttctattgctagagtctcaacaaacaaaagcttcattgaagacttcatttggcgcatgcccttttggtttttgtgttttgcgatcaaacaaaattttatctggttcgacttgccctaatatttgtgacattgatgccagaaaactatttagagtttgtagtattgcgcattattataactgttgggagcattccggtgttcttcatagcctgtgtaatgatgaatactatgcaaatttatgcttgtttttaataaaaaaaaaaaaaaaaaaaaaaaaa

SEQ ID NO: 2476 - DNA, 971 bp, Lycopersicon esculentum
  Predicted polypeptide sequence is orthologous to G1146
tttttttttttttttttggatggacgtttgagtaaaatatcataaaatactgaatgtacgaaaaaggaacagagtaaaatataattgaacatttactgtcagctgtgatcataacttcgtcacacaacgtgcagttgcaaaaagcataaccatgatctgtaaagcccacagaccaacttaaaaaaaaatagtttaacataaaagaagatttctactgaatacttcttcagcagtaaaacatgacctccgacacattttcatgaatcttaggaagttgcctgaattgtgctgctgctcctccctcaccaccttcattagcagctcttacatccacgtcattctccatgtaatagcgtgcacgaaaggcagctagatgtgcatagtaggcaggtggtactaaggaaactgatcgtgtacacctaacgtacgtgtagcacaggtagttcgttacattctgaatgccatctgcggtgaaattgttctcatcatacagtacatggtaatgcgcaggacgactggtacccttgatcccagcgtggctacataagtaaaaatcaaactcagttgggtggcatatgttggtgtctaccacagtacctggcaaaatatttccactcctgtctgtcaaagtacgatcatcatgattggaagggaatagacgtgtatgatgtcgcttctgcactaccacaaaggtaactcgtggcatataatcactttgcagggcaacacatgccttgcggatcgcatccatttcttccaataaaacctgattgaattgtccttcgctgactccatctctatagaagattattctgtcaggcttaatttttgtcgcggcataaaacgctttcagcaggtccattatcattccaccgcgaacaacgccccttttagaatcttccttctccgtgtacaagtccataatgatctcttgcctatggggctgtccagaaacaatacccctatatttc

SEQ ID NO: 2477 - DNA, 1335 bp, Lycopersicon esculentum
  Predicted polypeptide sequence is orthologous to G1146
tcgatctgttgatcgtcatattgcccgacaataatggctccctttatggtgatctaaaacgaatttgtgaaactgatcttggcattgtctcgcaatgctgcttgacaaaacatgtgtttaagatgagcaagcagtatttagccaatgtgtcccttaaaattaatgtgaaggttggaggtataaacaccgtgcttgttgatgcgatctctaggcgaattccccttgtcagcgaccgcccaactattatttttggtgcagatgtcacccatccccaccctggggaggattctagcccgtccattgctgcggtggttgcttctcaagattggcctgagattaccaagtatgctggtctggtttctgctcaagctcataggcaagagcttatacaagatctgtacaagacttggcaagatccaactagaggaactgtgactggtggcatgataaaggaattgctgatttccttccgtcgagcgactggacagaagcctcagagaataatattctaccgagatggagttagtgagggacagttttatcaagtgcttctttttgaacttgatgcaatccgcaaggcttgtgcatctttagaacccaactatcagcccccagttacgtttgtggtggtgcaaaagcgtcaccacacaaggttgtttgccaacaaccaccgtgatcgaaatgctgtcgatcggagtgggaacattttgcctggtactgtggttgattcaaagatctgtcaccctactgagtttgatttctatctctgtagccatgctggcatacagggtactagccggccagcacattatcatgtcttgtgggacgagaaccaattttctgctgatgggctgcagtctttgactaacaacctttgctacacatatgctaggtgtactcgttctgtctccattgttcctccagcatattatgcacatttggcagctttccgtgctcgtttttacatggaaccagagacatctgacggtggatctgtcacaagcggagctgctccgtacaaaggtggtgtaggagctgttggaaggagcacaagggcgccaggtgttggtgctgctgtaaggccccttcctgctctcaaggagaatgtcaaaagggtgatgttctattgttagaagtcctctctaaccaggctatatgatatggacatgctggagtaatttcttttcaaattgtatgtgattatctcaccttgatgtttatgaaagttcagttgtcagttaaacagtagtttattcgcaagtgatgtttgtaaattgtggcttgaacaattgttattgaagagcatggctagttatttaaaaaaaaaaaaaaaaa

SEQ ID NO: 2478 - DNA, 961 bp, Lycopersicon esculentum
  Predicted polypeptide sequence is orthologous to G1146
ggtgggccttctaggccaccaattcccgagctgcaccaagcaaccacacagactcaacatcaagctgtaatgactactcagcccattacttgtggaagaccagctgacacatccatggaagtgggttcctcatctgagccacctgagatgtcagctctgcaagtgacacaacagttccagcaactggctgtgcagccagaagcagctgcaacccatacaattccacctgtgtcaagcaaatcactaaggtttccgctgcgtccagggaagggaaagtttggtcagagttgcatagtgaaagccaatcacttctttgctgagctgcctgacaaagacttgcatcagtatgatgtcaccattactccagaagtatcttcacgaggggtcaaccgtgctgtcatggcacagctggtgcttctttaccaagaatctcatcttggaaagagacttccagcttatgatggaagaaaaagtctatacactgcagggccccttccatttgttcaaaaagagttcaaaatcactcttactgatgatgaggatgggcctggtggtgccaggagggatagggaattcaaagttgtgatcaaattcgcttcccgagccgatcttcatcacttagggatgtttttagaagggaggcaggctgatgcaccccaggaggcgctgcaggttctggatattgtgctgcgtgagttgccaacatctaagtattgtccagtaggtcgttctttctattctcctaatttagggagacgacaaccattgggagagggtttagagagctggcggggtttctatcaaagtattcgccctacacaaatgggattatcattgaacatcgacatgtcttccacttccttcattgagccattgctggtcgttgattttgtggcacagcttctgaaccgggatgtgtcatctagaccactgtctgatgctgaccgtgtaaagatcaaaa

SEQ ID NO: 2479 - DNA, 634 bp, Lycopersicon esculentum
  Predicted polypeptide sequence is orthologous to G1146
ggttgtcatgaaaattgcatgactgacggcatggtcaattggtgtttgcaattggtatatactcctatatcactcttctgtaggcctagtcctttactctgggtctatgagtttgctggtaacttgttatcatgcagactgggattagctttgatagcctaaactgagcccaagttgtagtgacttctggctttctgggactccaagacattgtctgcatgtcttgcatagtttgtaattactttttagaaattcagttgtcgtaagatggctgatggattttggtgcgaacaatggctttcccaaaggacagaaatgctgaaactttgaatgaaggctaagtgtttgcagtagaaaacttaattcatgtattgcgatgcatggaattgagtaagaagaatgaggacaatgttgtcaatcagatgaccatggacttctattttcatgaaatctgaacacactgaaacagagaaactataaaaagttaagtgaggaaagacggcacgtgagaactgaatcagggattttgatgaaagctagttttacttgatcaagaaaaaattaactggataaagataagaggctttctgaagaataataaaagcaggaaagtgtgagttatatattaattact

SEQ ID NO: 2480 - DNA, 898 bp, Lycopersicon esculentum
  Predicted polypeptide sequence is orthologous to G1146
gacgcagatgggattatccctgaatattgatatgtcttccacagcattcattgagccactgccggtcattgaatttgtgagccagcttctgaatcgggatatctcttctagaccattgtctgatgctgatcgggttaagataaagaaggccctgagaggtgtaaaggtggaggtcactcatcgtgggaatatgaggaggaagtaccgcatatctggtttgacatctcaagcaacaagagagttgactttccctgtagatgaaagaggtaccatgaaagctgttgtggaatactttcgagaaacgtatggttttgttattcagcatactcagttgccttgtcttcaagttggaaatacacaaaggccaaattatttgcctatggaggtctgcaagattgtggaggggcagaggtactccaaacgcttgaatgagaggcagataacagcacttctgaaagtgacctgccagcgtcctcaagagagagagaatgatattcttcagactgttcgtcacaatgcttattcagatgacccatatgcgagggaatttggtattaagattagcgagaagcttgctcaagttgaggctcgcattttgcctgcaccttggcttaaataccatgatacaggtcgagaaaaagactgtctaccacaagtgggccaatggaatatgatgaataagaaaatggtaaatggaggaacagtgaacaactggatctgtataaatttttctcgcaatgtgcaagacagtgttgcccggggattttgttctgagcttgcacagatgtgcatgatatcgggcatgatcttcaacccgaatcctgttttaccaccagtgagtgctcgccctgatcaagttgagagggtcctgaaaactagatttcatgatgctatgacg

SEQ ID NO: 2481 - DNA, 498 bp, Lycopersicon esculentum
  Predicted polypeptide sequence is orthologous to G1146
tttttttttttttttttttaacctggctataatgctaaactaattaccattaattgaaaataaagccgctttacatcattaaaactaacatgacaattaacctaggatgatcaacatacatttacaaacaaagattcatgtggtctgaactgaaccccctacttactatttgttacatttgctactcacttgttatctcttcttcctaacaataaaacatcactctcttcacattttctttaagagcgggcaatggcctaacacccgtctctcgtatagccttgctgctgccttgatgagggctgcctgaattagtttcaggcatgtctggttccatgtagaatctggctcgaaatgcagctaaatgtgcataatatgcaggaggaaccacagagacagaacgtgtgcatcttgcatatgtatagcagagattgttagtcaaggactggattccgtctgctgtgaaattgttttcatcccacagaacatggtaatgtg

SEQ ID NO: 2482 - DNA, 634 bp, Lycopersicon esculentum
  Predicted polypeptide sequence is orthologous to G1146
ccggtaaccttcatagttgtccaaaaacgtcaccacacacgtcttttgccaaataaccacaatgacagaaatcaccacctgaccaggagtgggaacatcctacctggtacctgtggtggatacaaaaatatgtcatccaactgaattcgatttttatttatgtagtcatgctggaattcagggaactagtcgtcctgcacattatcacgttctctgggatgaaaataatttctccgcggatgaaatgcagtctttgacaaacaacctttgttatacatatgctcgttgcactcgttctgtttcagtagttcctcctgcatattatgctcacttggcggcctatggagcgcgtttctacgtagaaccagactcacgtgacaacggttctatacgtggcacacgtgcaacgaatggttctgtcaacgtccggccgctaccagcattgaaagagaaggtgaagaatgtgatgttctattgctagagggtgaatgttgagtttatgttatatagtagtagtgagtagataaaatgtatgaaattaggatatgaaatgttatgggtatgatatacatcataattagagtcaataaattataatttaattttcatgcaataaaaaaaaaaaaaaaaaaaa

SEQ ID NO: 2483 - DNA, 445 bp, Lycopersicon esculentum
  Predicted polypeptide sequence is orthologous to G1146
gctttatgatctttcttgtttgttgttcattagggtaccagtcgtcctgcgcattaccatgtactgtatgatgagaacaatttcaccgcagatggcattcagaatgtaacgaactacctgtgctacacgtaaagtcttttgaactttatttacttggaattagtatatctttttattatctcaaatcatataatcatcatctttttttcatctcacaggtacgttaggtgtacacgatcagtttccttaggttagttttcgcctacttggtggttttaaaaatttgtctgttttacagttactgaattatttgcacaacttattatggcgttatttacacagtaccacctgcctactatgcacatctagctgcctttcgtgcacgctattacatggagaatgacgtggatgtaagagctgctaatgaaagtggtgagggaggagc

SEQ ID NO: 2484 - DNA, 1184 bp, Lycopersicon esculentum
  Predicted polypeptide sequence is orthologous to G1198
gatggatgcaatgggtgatagcgaaggccataggattgtgagctctactgcgttgtggaggggtgaccgccggccagcccaaattgtccaggtatcgcagttggagcaggacattgaacgagcacctcaacagggagaaagtgggcccgtagcatttgatacagattatattcgatggttagaagaacacgacaaacacatcaatgagttaaggaacgctgtcaaatcacatgcacgtgatcctgaactgcgaagaattgcggataatgtcactgcacattacgatgaggtctttaggatgaaaggaaatgcagccaaggcggacgtagtccatgtcttgtcaggcatgtggaaaacccctgctgagcgttgttgtatgtggattggtggtttccgcccctcgttactgcttaagcttctagtcaatcagttagatcctctgagtgagcaacaagtagctgactttaacaacttgcagctgtcatcccatcatgctgaagttgctctctcacaaggtatggaggcgctgcagctatcattgggggagacattagccatgggatctccatttactgaatcagggaatgtagctactacttatatgtgtcaaatggcaatggctatggggaaattaatgactcttgaagattttctccgtcaggcggacagcctgcgtcaactagtattgcaacaaatatatcgcatactgacaaccagacaatatgcccgtgctcttcttgcaataaatgattacttctcaatttttcgggttctcagctctatttggctagccagaccacgagagcaataagcacaaaaaccattgcagtattctgctgaaattcggacactactttgatacactggccagtatatgagatgcagctaagttgctatattttgaagtggtggtactgtatgtgccttgtggaagtacaaaatttgtttttcaaagtatagagaaatttagcaggggtggttgtcatttagatagttttcccaaagtggtgtatattgtgcttttgttccacttctttttgtgtggggtgaaacatttaattttgttgaattaaccttctggactctctaatatatcttgtgatattattttctgtacgaattgtaagaacaattgcttaattttatttttcaaaaaaaagttgatgtaaaaaaaaaaaaaaaaa

SEQ ID NO: 2485 - DNA, 1585 bp, Lycopersicon esculentum
  Predicted polypeptide sequence is orthologous to G1198
cttgggcataactctacccaaaaacctagttcattcggtgagagttgctgaagaccatataaagaaggtcccctatttaattctacatctgcagctaatccagcagtgggatttgacgtctctgggaccatcaataggaatttagctccttcaaatacaagtttgtctactgctgctccaggatctcatgtaatacaattgcaatcaaacttagttcctgcagctggcactcatcctgagaattggggcgagtccaacatggcagattctggttctcgcactgatacttcaactgacatggatggagatgatagaaatcaaaggattgagacgggtcaatccagggctattgcagcttctgattccagtgacaaatcaaaagaaaaagtcttggatcagaagacattgcggagacttgcccaaaatcgtgaagctgctagaaaaagtagactgaggaaaaaagcatatgtacaacagctggagaatagccggttgaagctatcacagttggagcaggaccttcagcgagcacgtcaacaggggaagtacatctcaaacatggcagatcaatcaaatggagcgggcgccagtgggaccttagcatttgatgcagaatatagtcgatggttagaagaacacaacaaacacatcaatgaattgagaaccgctgtcaattcacatgcaagtgaccctgaactgcgaagtattgtgaataatgtcactgcacattacgatgaggtctttagggtgaaaggaaatgcagccaaggcagacgtattccatgtcttgtcagggatgtggaaaacccctgccgagcgatgttttatgtggattggtggcttccgcccctcggaacttcttaagcttctagtcaatcagttggagcctctgaccgagcaacagttagctggcatttacaacttgcagcagtcatcccatcaagcagaagatgccctttcacaaggtatggaggcgttgcagcaatccttggcagagacattagctaacggatctcctgctactgaagggtcatcaggagatgtagctaattatatgggtcagatggcaatggctatggggaaattagggactcttgaaggttttctccgtcaggcggacaacctgcgtcaacagacattgcaacaaatgcatcgcatattgacaaccagacaatcagcccgtgctcttcttgcaataagtgaatacttctcacgtcttcgagctctcagctctctttggcttgccagaccacgagagcaataagtatgacatgcattgcgatattctactgaaactcagatatactacttcgatacactggccggtatatgagatccagcaaagttactcttatgtataaagtggtattgtatgtgcttgtggaagtgcagaatttgttttctttctccttaggtttatagaatgccaaaattttactttgtgacttaggaaccaataatgtacctgtgtttttagttttacaaggaaaaagtttagggatttttaagaagtgtaatagatatttttagaaagttttatgcttaatcaaattatagcttgtgactaaaaaaaaaaaaaaaaaaaa

SEQ ID NO: 2486 - DNA, 1614 bp, Lycopersicon esculentum
  misc_feature (1558)..(1558): n is a, c, g, or t
  Predicted polypeptide sequence is orthologous to G1198
gcttcttggaaataagagatttgacactttgtgaccaaaaagtcaaaattggctggtaagagagagaaggagagctgacaaggtataggacgtcatcccattttagcaactttcacctgcttctcatctgggtacttccggcactgcttgatttattgatttggtgattctaaacttcagttgatttctcactgattcactgaaaagctgagggacacagaagggctaaagaaattgaagggggaaaaaaccccaacagaaaattacaagatttgatgattctattgtcttattttagctttctggcaaagcttgagccttttgctatagacccttttcgtttcttgaactaagatactacatctgatttgtgttccaatttcaattgattatccacaaagttggctatagtccacgatggctgatatcagtcctagtacatcaacagatgccgatactgaagataagaacaggttcctaaatcaacaactgtgtgccgtagcttctgatggaagtgacagaccgaaagatcaaaagacactccgtagacttgctcaaaatcgtgaagctgctcgaaaaagccgtctaaggaaaaaggcatatgttcaacagttggagagcagcaggatgaagctgacacaactagaacaggagcttcaacgagctcggcaacagggaatatttatttcaggttcaggagatcaatcgcagtcgatgagtggaaatggagctttggcatttgatgtagaatatgcccgatggttggaagagcagaaccgacgaattaatgaattaaggggagctgttaattctcatgctggtgatgctgaacttcgcataatagtcgatggaatactggcacactatgatgacatattcaggataaagggggatgcggcgaaggctgatgtttttcacatattgtcgggcatgtggaaaactcctgcagaaagatgcttcttgtggcttggtggattccgttcatctgaactactcaagctgctcattaatcagttggagcctttaaccgaacaacaattattggcgatcaacaacttacaacagtcatcccaacaggctgaggatgctttatcccagggaatggaggcattgcagcagtctttggctgagacactcgcagggtctcttggaccttcaggttcctctgggaatgttgcaaattatatgggtcaaatggccatggcaatggggaagcttggaactcttgagggtttcatacggcaggctgataaccttcggcaacaaacattgcagcaaatgcatcgcatattgacaactcgccaatcagctcgtgctcttcttgctatcactgattatttctctaggcttcgagcactgagctctctctggcttgctcgtccccgggaataacatccgctttcttctaatacactactctaaagacccttggtaacatttgtaaatgagaaacctctttgttggaaagctgagctgctgagttttaatggatacatatatttatataatggtatttgtaacattgtttcatatttaactaagatagtgtgtgatcagngaattgttgttgtattttagtatatctaatggttccagttaggttaatggaaatga

SEQ ID NO: 2487 - DNA, 1071 bp, Lycopersicon esculentum
  Predicted polypeptide sequence is orthologous to G1198
gggggtttcggccatccgagcttctaaaggtactcacaccacatcttgagctcttgacagaacaacaactccgggaggtttgtaacctcaggcaatcgtgtcagcaagcagaagatgccttatcacaaggaatggtaaaacttcatcagattctcgctgaggctgttgcagctggtcaattaggtgaagggaattactctcttccgcagatggggcctgccatcgagaagttggaagctcttgttaggttcgtaaatcaggcagatcatctccggcaagaaacacttcaacagatgtcccgcatcctgaatacgctccaagcagctcagggcttactcgccttgggggagtactttgaacggcttcgtgttctaagctcacactgggctactcgtcttcatgagccggcctaatgaagctatagaagatccctcaatacaccattcgacgagttttgccttcagaaactatactatgtaagctaaaatttagctcttgtttatgtcaataaagctctcaatatgaatataggacattatactagttgtacaaagggtctccaagagtctattgtggcttatgtttccgagcaacttttgaacgcgttggagatgagaaattgatatgtatataacatacgtcgagcaatggcatgactaatatcatgttgtgatttctcgtgagaatgttttttcgaagatttgcatctaaatatttacttttacaggttttggttaggaaagagtgttgctcacttagagagacagatccaggatttgaacttaatgagttcagcctcgcaatgaactcatacaagtaaaattatggatttgatccaagtacgtttgttgagttttttactaggttttaagttttaatcgtatacatatatgaactccgtgacgaaaattatggaccgtgtcaaaagttatggattcagataaacatcgtagccaattggctacgtccgttttgctcgcttggtaattggtagggtgtgcataatcaagtcgatcgaatgttatgtttgtgccatttcttataagtattattatctcactatgtttttgc

SEQ ID NO: 2488 - DNA, 1065 bp, Lycopersicon esculentum
  Predicted polypeptide sequence is orthologous to G1198
ggagagaactagtctcgagttttattgtttttctctgcctctaaattccatttcttttttttcctttcttctttgtataatttcataattcagttttaattattttgaaaaactccaatttgtagaagagtttctttgtacttatgaacagtcaatgaacatgagttctacatcaactcagtttgcccccacgagaaggatgggcatattcgaaccattccaccatatgagtatgtgggaagacgcgtttagaggtgatattatgcccagtgttggtgcgtgtatgatcacaccggcaaatgacagggcagatgacaagtcgggatatacttctagtgaccaacttataccatctggctctgaggataatcaagcaggaaagagtatttcagacaaggtacaacggcgtctagcacagaatcgtgaagctgcacgtaaaagccgtatgaggaaaaaggcttatgttcagcagcttgaaaaaagcaatttgaagctagcacaacttgaaatggaacttgagagagctcgacagcagggactatacattttaggttcaaatggtaatatggggctaagttcaacaattaatccaggaatagctgcatttgaaatggaatatagtctctgggttgaagagcaacaaaaaaagaacgtagagttgaggaacatattgcaatcccatgtaagcgaaatggagcttcagttgctggtagaaaccgtcttaaaccactactacaatctattccgaatcaaagctgatgctgcgaaagctgatgtgttttacttgatgtctgggatgtggagaacttcggtggagcgttttttcctctggattggaggattcaagccatctgaactcataaatatcgtgatgccacagcttgagccattgtcagatcagcagatcgtgaaaatctgtaatctacgacactgttgtcagcaagccgaggatgctctcactcagggaatggataaacttcagcaaactctggcacagaacatcctaactatgaccactggaatgggaagttacagttctcaaatggtttctagtatggaaaagtt

SEQ ID NO: 2489 - DNA, 420 bp, Lycopersicon esculentum
  Predicted polypeptide sequence is orthologous to G1198
tggctccgcaccaatcagctcagggtctccttgccttaggagattactttaaacgtcttcgtgctcttagctcactttgggctggacgtctttctgaacctgcttaaagaggtaagaaagaacctgtgggttttcaactttgccaatcaaagctgtgtgagctaagtaacaagtatgagttggcgctcatttgaaatgtgtatataagttctggtatgctgtaattgaaacattttcttttgttatcacattggttttgatgattgtaaatcaatatggtagaggttattgttactccaagttgtgcctctctttgtctatgatgggagccaagcaattttgaatgctttgcagatgtaacaaaatgagccaatattttattgtgcaaaattaaattcatgtttgcaatcaaaaaaaaaa

SEQ ID NO: 2490 - DNA, 841 bp, Lycopersicon esculentum
  Predicted polypeptide sequence is orthologous to G1198
gcagtttcccagatagcttgattcttgaagtcgagaattgcctcgagaatgagatgcctattatggagaaaagactagagaatgagatagaggaaccatcacaagtgacagttggaacgtctaacagatatgaacctgaaacaactaaacgtattgataaggtgcgtagacgccttgcacaaaaccgggaggctgctcgtaaaagtcgtttacggaagaaggcctatgtccagcagttggaaaatagtaaactgaagctgcttcagctggaacaagaactagaacgtaataaacaacagggtttgtatgtcagggatggtttagatgctagtcagataggttgctctggaaccgcaaattcaaatagcttcttttgaaatggagtacggccattgggtggaagagcaagatagacaaacagatgatttaaggaatgctctgaactcccaaatgggtgaaatagaattgcgcattcttgtcgaggattgcttgaatcactattttgatctctttcgcttgaaagctacagccgcaaatgccgatgttctctaccttatgtctggcacatggaagacatcagctgagcgcttcttcttgtggattggggggtttcgcccctccgaacttctaaaggttctcacgccacatgtggaaccattgtcagatcaacaaatccaggaggttagcaacctcacccagtcttgtcagcaagcagaagatgcgttgtcccaaggaatggtaaaactccatcagattcttgctgaggctgttgcagctggtacactaggagaaggagttatccttccacagatgactgctaccattgagaagttggaagctc

SEQ ID NO: 2491 - DNA, 792 bp, Lycopersicon esculentum
  Predicted polypeptide sequence is orthologous to G1198
ggcattgggaaatgtgcagcattttgagaattggggtgattctggtagtgcagaccatagccagcagactgacacttcaacagatgttgatactgatgaaagaaaccatcagggccaaggtgttcagcatggtgcattaatagctgtggactccatggacctgtccaaagtaaagcttggagaccagaagacacttcgcaggctggctcagaatcgagaagctgctaggaaaagccgattaaggaaaaaagcatatgttcaacagctggagaatagtaggctcaaactgtcacagttagagcaagagttaaaacgagcccgccaacagggcatatttattgctaatggatatgcaggagatcagagtctttctgctggtggaaatggggcattggcatttgacatggattatgcacgttggctagatgaacatcaacgacttatcagtgatctccgatcagctgtaaattctcacaggggcgataatgaactgcgtcatctcgttgatggagtaatgtcacattatgacgaaaaattcaagctaaagagtgtaggtttaaaagcagatgtttttcatatgctgtcaggcatgtggaagactcctgtagagaggtgtttcatgtggttaggtggatttcgttcttctgagcttctcaagattcttggcaaccatcttgaaccgtttacagagcagcagctcataggcatatgtaacttgcaacagtcttctcagcaagccgaggacgcgctatcacaaggtatggaagcccctgcacaattactcattgatac

SEQ ID NO: 2492 - DNA, 834 bp, Lycopersicon esculentum
  Predicted polypeptide sequence is orthologous to G1198
ggacgagcactagtgacactatagacgagctatgacgtcgcatgcacgcgtacgtaagcttggatcctctagagcggccgccctttttttttttttttttttttttttttttttttttttttttttttccaaccaatatagacgctggatagtccttccagcattaatgtacttgtattcttattgctaatacaattgcacaatatgtcaatcatgaatccatgataacttacaagttaaatgcaagctttaccctaacttgtacaacactgaagcgcaatatgagaccagaggatgttaatacaacttgtacaaagagaactgaccctccagccatttgcaaatgcgttgcgagtttgcagccagcagccccacatttacagatcggcccagggagggactccaacgggggtgatgcttcttttgcggcctagcgagccaaagagaacttagggcgcgtaacactgaaaagtagttcgtttattgcaagaagccccccagcggctttgccaattgccaggaagccttgcatttgaagcaaggtttgttttcgaaaattggtaacccgacaaggaaattttcagggggccagttttccaagggccatggcatttccccttttggttggcacgtttccgaaaccccgtggcccaaggaccctcccgtttttgcaaggtttgtgaattgttcatcctttaacaagattctatcttgtgggggttgtggaaatggtccctatatggttttgttggggtaagttttaaaggggtggatttgaaagtggggagtttttttgaaaatccctttgagtcgatttaaaaaaccctcttagaa

SEQ ID NO: 2493 - DNA, 597 bp, Lycopersicon esculentum
  Predicted polypeptide sequence is orthologous to G1198
gcaaaattataacaagttgggatggttgcacatcatgattatttttttgtttgtttggttatatcaagaattgtaaatattaggatttttctgccattaatttgattcaaaattgaatcttgataagattttcttttatcttcttctcacaaaattgaatccatttgggttttttcagttgagctgagattttgctgtttggcctttaaaagtctgtacaaatgaattcttcaacatacactcagtttgttgcctcgagaaggatgggcatatgtgagccgatccatcaaattggcatgtgggatgatttcaatgctagttgtccgagtacatcgacaaccatgattctagaagttgagaaatgcctagaggaccagataccgatgatggacaaaagattagacattgagacagaagatacttcgcatggaacagtagggacttctaatagatatgaagcggaaacaagtaaacccatcgagaaggtacttagacgtcttgctcaaaaccgtgaggctgctcgtaaaagccgtttgcggaagaaggcctatgttcagcagttagaaaatagtaaattgaagctgattcaattggaac

SEQ ID NO: 2494 - DNA, 296 bp, Lycopersicon esculentum
  Predicted polypeptide sequence is orthologous to G1198
tctactatttattagtctctttgcttctgaagaaaaattggcctttattcaagatgatctttaaattgaggtaagatcaagaatagtttgaaaattagttattatttgcatggagagtcaaagaattggagatacaacaagtacttcgtcaattgatcatcacatgccttataatacaagtttcatgtatcattccacactaaactttatatggagcatgcataaacagacctgcagcaactctggagatgttcccttcttggcccactaaagtgcatgacaccctaagaggaagc

SEQ ID NO: 2495 - DNA, 569 bp, Lycopersicon esculentum
  misc_feature (286)..(286): n is a, c, g, or t
  misc_feature (471)..(471): n is a, c, g, or t
  Predicted polypeptide sequence is orthologous to G1198
gattatacatgttaggttcaaatagcaatatgggactattaggaacaattaatccaggaatagctgcattcgagatagaatacagtcactgggtggaagagcaacaaaaaaagaacgcagaattgcggagtatattgcagtctcctgtaagcgatatggagcttcagttgctagtagaaaatgtcttaagccactatttcaatctctttcgcatgaaagctgatgccgccaaagctgacgtgttttacttaatgtctggggtgtggagaacttccgtcgagcgctntttcctctggattggaggattcaagccatcagaactcataaatgtggtgatgccacaactcgagcccttggccgatcagcaaatcattaaagtgtgtaatctgcgacactgttgccagcaagctgaagatgctctcacacagggaatggataaacttcagcagactctggctcagagcatcctanatatgaacacgggagctggaaattacacttcccaaatggtttcttctatggaaaaattagaagcattggagagctttgttaaccaggcagatcacctt

SEQ ID NO: 2496 - DNA, 600 bp, Lycopersicon esculentum
  misc_feature (36)..(36): n is a, c, g, or t
  misc_feature (88)..(89): n is a, c, g, or t
  Predicted polypeptide sequence is orthologous to G1228
gtatgattgacgccacccctggttggaactcggtgnggttttttttttttttttttggtgcgtttgctgattggagcttcgttgctcnngggtagatctcgacattcgcgggggggtactttttcccgccagtagtggttgtttgttgaactggaaacctggtggattgtgggttgtgtgggggttaagcttgattgaaggtcggtttgttggctggagaaatgggtttaggtggttataggctcgtaatgtgtggggctaggcaacgctttattggacataatctggaaaaaggagatcttctcaatacgaaacttgtccatgattactaaaataggaaaaagggttcttggatactatggggctttctaactttcgctgcatgcctcatgataattggctttgcgaacatggtttttagatgtttggatgtttaaatttaatgcgtttacacccctattggtctagcctatacaaccttgtattgctacattggcatcccaaaaaatggtttctagccattccttgcttttatagccaagaattcgggcagctaatttaattccaatgggcccaaaaaaacttttttgggaaaaaggt

SEQ ID NO: 2497 - DNA, 560 bp, Lycopersicon esculentum
  Predicted polypeptide sequence is orthologous to G1275
atcacatattctatcaaagactcttttaaagtctttcttctcaaaaataatagtattagagaccatgtttggctcttccacttcccaagaaacaacaaatgtcatttctcatcaacattatcaaaccataaaccctaatttttatgcttttcatgatcctcttatcaacatgaatcaagatcatgtccacaataataattataataagtatcaagattatgacacttcatttcttgatttgtttgttgatggtgatcaagaatattattccaattacacaaacaataatgcttcaatttatttagaaaatcccttcaagcaacaagagataagtagtagtacctatagtactagtggaaactcatcatcagctagttcatttgatgccacaccaacacatgttcacatgaataatgaaaatacaagcatagggattgagaaagaaaaaaaaggtgaaaaacatgcaattgcttttagaacaaaaacacaacttgagaccttggatgatggatacaaatggaggaaatatgggaagaagaaagtgaaaaccaacataaatc

SEQ ID NO: 2498 - DNA, 740 bp, Lycopersicon esculentum
  Predicted polypeptide sequence is orthologous to G1275
ttttttttttttttttttttttttttgcgattaacttatctatatatttagcacttgaaaattcgtgcacaacttttttaaaacatatgtcgaaaatgttcaataaaaacactttatcatataatcaaagtgctccattagaacctaccataatacaaatatataactaaactttactgacacgtttaagaggttctaaaggtgaagattgtgaagggcaatattgttgggagggaattgtgtgtagtgaagcacatgaggactctcgtggttgtgaatcccttcataagtagtaatgacatagcttgaatctttattgtccctttctactcttttcttcacattgcatcccccacttgaacatttgtagtaattccttggatttggattattcttgaccatctttttgccatatttcctccatttaaatccatcatccaacacctccaactctgatctaaatctaaatgcaaccttagactttgcatccaccttctttatacctttcatacattttatgttatgacttgttggagtaggattatttgaatatgaaccactagtatcggaaacactttgaacaatttcattttgtgacaaaaaatcgtcactcgatccatcatcgagaaaaagataattataatcggagagctcaaaattctccgatgcgtcgataaaattagggttagggtttgatgagctatagggaaaattttccatagttgaacggaacgaaaaag

SEQ ID NO: 2499 - DNA, 557 bp, Lycopersicon esculentum
  Predicted polypeptide sequence is orthologous to G1276
ctccattagagacagacaaaattccttgtttccttcttccccactgcctctgtgatctccattgccggcttctcccataaaccaatgcgattctcatttgtcactttactatacccaactcaaaaaaatcccaattctttctttgttttgtttcttttcatcaattctggttctgtaattcaggagtgaaccatttgatatttctatacttttttgtgatacccttttgggcgcactgtagtgggttttcgagatgtttgatcttaatcttagttttgatgatgtttcagtagaacccatctctgttttagcgtcggaaaaggttgatgaaatgttatttaatcaaatggagaactcaggaacttctaattcctctattgttaacatggagacttcaagtactgctgctgatgatgagtattttagtcctgatcatcatcgcgatggttatgcatttgatatattgaaatccgatagggaaagctgggatcgtggtgggtttgttgtaaaagagttgttcccgttggtgaaatggaaaagtgggttggatctttcgg

SEQ ID NO: 2500 - DNA, 525 bp, Lycopersicon esculentum
  Predicted polypeptide sequence is orthologous to G1276
cagatcacacaacccacataagttgcctcacacgtcccatctttcttcttccccaacccctaccccctatctactgctcctatggagtactataactaaatgaaattcatctcaatttattcttcttccattgacgcttacaatcattttggttaactcccacagatattttatagttagtctaaaacagaacaatgttggatctcaatgtaagcgtaatctacaataatgaccttccacaagtttctctacttgatgaatcagccacctccaattcatccttacgaaatgcggaagctacaaccagtgccggtgacgaagattcgtgcgccggtgagttgttcgctttcaattttggaatcctcaaagttgaaggagctgagactagtaggagcagcaacaacgataatgaggaaggatacggtaagaatcagagagttactcattctcaattcgtgactaggcagctgtttcccgttgatgatggtgagttgaaccggaaacaaaccgatcgggtcattctct

SEQ ID NO: 2501 - DNA, 772 bp, Lycopersicon esculentum
  misc_feature (716)..(716): n is a, c, g, or t
  Predicted polypeptide sequence is orthologous to G1290
gcttcctcctcttcttctctgtcccttttcctcccccaattcatcatataattcctaactagctaacaaccccttgttcaatttcttttctctccccaaattcaatggctctttcttccaaatgatccctctattccattccccctttctcccatgaacgtatgctctaatggatagtagaactgctttttcggattccaatgatattagtggaagcagtagtatatgctgcatgaacgaatcggaaacttcactggcagacgtcaattccctcaaacgtctatcagaaacactagagtctatcttcgatgcgtctgcgccggatttcgacttcttcgctgatgctaagcttctggctccaggcggtaaggaaattccggtgcatcggtgcattttgtcggcgaggagtcctttttttaagaatgtattctgtgggaaagatagcaacacgaagctggaactcaaagagctgatgaaagagtatgaggtgagttttgatgccgtggtcagtgtgctcgcctatttgtatagtggaaaagttaggcctgcatctaaagatgtgtgtgtttgtgtggacaatgagtgcttgcatgtagcttgtaggccagctgtggccttcatggttcaagttttgtacgcatcctttacctttcagatctctcaattggtcgacaagtttcagagacacctattggatattcttgacaaagctgtancaaatgatgtaatgatggttttatccgttgcaaacatttgcggtaaagcatgtgaa

SEQ ID NO: 2502 - DNA, 787 bp, Lycopersicon esculentum
  Predicted polypeptide sequence is orthologous to G1290
ggatttgcgtatgaagctgttataccttgaaaatagagttggtctggctaaactcctttttcccatggaagcaaaagttgcaatggacattgcacaagttgatggcacgtctgaattacccctggctagcatgaggaagaagatagctgatgcacagaggacaacagtggatttgaacgaggctcctttcaagatgaaagaggagcacttgaatcggcttagggctctctctagaactgtggaacttggaaaacggttctttccacgttgttcagaagttctaaataagatcatggatgctgatgacttgtctgagatagcttacatggggaatgatacagtagaagagcgtcaactgaagaagcaaaggtacatggaacttcaagaaattttgtctaaagcattcacggaggataaagaagaatttgctaagactaacatgtcctcatcttgttcctctacatctaagggagtagataagcccaataatctcccatttaggaaatagattttgtattaggacatatgaggaagaaacacaggactctctttctttttcatcatttgatgcatacaaaacacatgtaccataaacttgtattgtgaaaaaaagataaaatttcattattagttgagaagcaatcatttgaaagtgaaaaaaaacaaaatggcccacctagaagataagatatgtaacaattgttaatagtattattattattattattatgagttaaatgactaataattgtggattttgtggctctaaaaaaaaaaaaaaaaaaaa

SEQ ID NO: 2503 - DNA, 331 bp, Lycopersicon esculentum
  Predicted polypeptide sequence is orthologous to G1361
ttacataagtggagttgtcaaaggttacaagaaaattttggtactttatacaaattatggtagacagagaaagcctgagaaaacaaattgggtaatgcaccaatatcacttaggtgaaaatgaagaagaaaaagatggagaattagttgtttcaaaagttttctaccaaacacaacctagacaatgtggatcatcaaccataaaaaaaacaattgatcatagcaacaatattattaaccccctccttaaaacaacgaatttcgtcgattattataatcctaatcctttcgtttcatataatgttgagagccaaagctcacctcatgagtta

SEQ ID NO: 2504 - DNA, 857 bp, Lycopersicon esculentum
  misc_feature (824)..(824): n is a, c, g, or t
  Predicted polypeptide sequence is orthologous to G1421
tggaatcggatccaaattggggccccaacctgttttgtctgcgtggtatatgtggcctttcagagctgtacattattgtcccatgcactatatatcttgagcggagtgttaaacccctgccttctctgtttatacttcctctcttttcttccctatttttggctttatacctctaattatattgttctaattatatggtagaaagatctacttcccgccaaaaacaacaaagaaagtaatctctttttctttgttcactcatcaacttgtttctcaaatcatttgtatcactgcaactttttccacacttaaaaactttttatacaataatattggtcactattcactcacttcaaccagttcttgattgttttagtactcctttttgagcttatgatgatttttttttgtgctctttgaaaaaaatatcttttaaatcgaactgtaactttaagtttttggtataccatgacggaaaattcagttccggtgattaaattcactcaacacatagtaactacaaacaagcatgttttttctgagcataacgaaaaatccaattcagagttacaaagagttgtgaggattatacttacagatgccgatgctacagattcttccgatgatgaaggccggaatactgtacggagagtgaagaggcacgtgacggagatcaaccttatgccgtcaaccaaatcgatcggcgacagaaaacgaagatcggtgtctccggattctgacgtcactcgtcggaaaaagtttagaggcgttcgtcaaagaccgtgggagtcgttgggctgcagagattcgggacccgacccggngaaaacgggtgtggttgggtacttatgacaccc

SEQ ID NO: 2505 - DNA, 487 bp, Lycopersicon esculentum
  Predicted polypeptide sequence is orthologous to G1421
aatcctcttatgctttgttgttctccgtgtgggactgactgtgggtgtgtttctcatcttttgatgttttgggtctttttttttgtcagtgaatgatcgtgttttaagcttctctttgacggttccattgctcgttctcatctattaagtgtgctactttttgtggtgtcactctcaaagcaatccatcttttatctttctttctttcctttttaatcaatcaggcttagcattgaaaaataaccaatcgaagatttattcgatggattatcattcgctgtgtccgatcaaatacactgagcatcggaatgttattagaaaagttactaaaccatctttggtgaaatcaaaaaaactctcagaagctgcaaaatcctctcagttgaatccctctgttccaaggactgttcggatttctgtgacagacccatacgcaaccgattcttcaagcgatgaagaagacctgctttttggacggcgacgggtg

SEQ ID NO: 2506 - DNA, 645 bp, Lycopersicon esculentum
  Predicted polypeptide sequence is orthologous to G1421
ggaaaacgggtgtggttgggtacttatgacaccccagaagaagcagctgtcgtttacgataaagctgcagttaagctcaaaggtcctgacgccgttaccaattttccggtatcaacaacggcggaggtaacggtgacggttacggaaaccgaaaccgagtctgttgccgacggtggagataaaagcgaaaacgatgtcgctttgtcacccacctcagttctctgtgacaatgattttgcgccgtttgacaatctagggttctgcgaagtggatgcttttggtttcgacgttgattcacttttccggctgccggattttgctatgacggagaaatactacggcgatgaattcggcgaatttgactttgacgattttgcccttgaagctcgatagtgtacgaggggctatttcgtccatttttgcaaatgggttcactggttagttgactagtgacgtggcatttttggcgggaatatatatatagtgattagcagtctctattcatacgaagactttgtgagagatttttgtttttatttttctgttaattgtgggtgaatattgtaatatgaaaaattttgtatggtgaaattgaattaattaacgatgaagataaggagagtgaaggggggatgtgtgtatttt

SEQ ID NO: 2507 - DNA, 568 bp, Lycopersicon esculentum
  Predicted polypeptide sequence is orthologous to G1421
atatatttccctcttctctctctcactctctctacaacactcattgactagtcgttaaactcatcaagacttgttcttccttttatttctctttacatctctcctataaactcactgtatttcactatcttccatgttcaaaaaatggaatcacaaaaaatcaaaaagaaattagtccacaaaactatcactactaagtatgatcatcacaacaagtggactcctaaagttgttcggatttgttacactgattgtgatgctactgattcttcaagcgacgacgatgacgacgagaggaatcgagtgaaaaaatacgttacagagattaaatttgagaagaaaatggctgctgcagatgtgaggaaatcgttgaattcgaataagaagaagaagaaagcgatcgatttgaagagagatgagaatgttaaaaagtttcgcggtgtcagacagaggccatggggaaaatggtctgcggagattcgagatccggtgaaaaaaacgagggtttggttaggtacttttgataccgctgaagaagcggctatgaaatataatatagccgctattc

SEQ ID NO: 2508 - DNA, 969 bp, Lycopersicon esculentum
  Predicted polypeptide sequence is orthologous to G1482
taaaaactctctatttcttttctttttttctcttttcacttataacaacaatcttgatccattaaaaaaaaaggatataatttgaatttaaatttgaattcaaatgaagattcaatgtgatgtgtgtaacaagaaggaagctatcgttttttgtacagcggatgaggctgctctttgtgatgattgtgatcatcgtgtccatcatgttaacaaacttgctagcaaacatcaacgtttttctcttgttcaaccttctcctaaacaagctcctatgtgtgacatctgtcaggaaaggaggggtttcttgttttgtcaacaagacagggctattatgtgtagagagtgtgatattccaatacacaaagcaaatgaacacactcaaaaacacaataggtaccttcttactggtataaaactctcagcaaactctgctctctactctgctccatcacaatcacaatcacaatcacaatcagcaatctcctccgcggattcgtgtgtttcaaatttgaagtctaaggattccactagtaagcctgttgctggttctgtgtttgtttctcccgcgattattagcaacagtactaagggaggagcagtatcatccgctgtggaatcagtgaaagttgttaaagagaaagttggtggatgtaataataatgtgcaatttgtgaatggagggggaaataacttaacaagtagtatatcagagtatttagagatgttgcctggttggcatgttgaagattttcttgattgttcaactcctaatgtttactccaagaatattggtgatgaggatatgttgtcattttgggatactgatcttgagagtcaatttagttcatttccaccacaaaatgttggtatttgggtcccctcagcccctcctctttcagagtcaaagcaagagactcagatccaatttttcccttcacaaaatttgaactttggtgggcaaattggtct

SEQ ID NO: 2509 - DNA, 563 bp, Lycopersicon esculentum
  Predicted polypeptide sequence is orthologous to G1482
ggaaaacaacacaaagagaaagaaaacttcaagcaaatgttcccatctttattttttctcaatcttctatacacaatttgtgaaaatgagaagcatcaaggtctcttataaaaataataataataataataataataataataataataaatgtagtttataaagtaaatataggatatagattttctcataattttccgtcaaaggtcaattaaacaatcaactcgaaatagactttttaacacgcaattaattcattttgcctgtatatgaagaataataattattttttcattttacatataataacaattgcatctatattataaactaaatggagatgatatgaaaataaatacatgaagatatgactcaaggagttagaaaaagtgtctatggtcagtcaaacataattaattgagttaaaaattaatttatatgaagaaactcattaattaaagtaataatgtaaaaaatttaaattttaaaagaattaatttctttcttagaatagtgaaactttaatctttgacttttaacaaatattaatagtcgaattattt

SEQ ID NO: 2510 - DNA, 467 bp, Lycopersicon esculentum
  Predicted polypeptide sequence is orthologous to G1539
gctatagctaataatagggatcataaatttcaagttacataaacagtcaacatctaaatgactcatgtctagatatttttcagttcttgagtggaaggaactcaaaaaactgataatgactgccattaaaattattattcaagttcgcggcagctcctatttcatccttgtctgaaaaattattttcatcattgttgtcattgctgctacggaggggaaataattcaagagtctgtgcttcatgaccattgccttcgccttcttcttcttcgtctccgatgatgttttggtgtttttgatcacatctaaaaggtgttataaagatgttgagatgatctttgggcttgaaaagttgttttgtctgatggtcgattgttgttggcgttgatggacaactccttataattggagtacaagttgcagtagttatagtattactacaaattgttgcacaattggtgttgttg

SEQ ID NO: 2511 - DNA, 1063 bp, Lycopersicon esculentum
  Predicted polypeptide sequence is orthologous to G1560
ctctgttccatattatatgacaataattgactagatatttgattttgtataacacatatcatgacattcgtaaaattgccatatcaaaattgatacatagttatattctatgtttaataggtcaattttgacctgattagtgcaatattacatcgtcagtgcacataacataaacttttttatattttttttatctaatacttaatcaatgggaacaagaaagatgaagaattatattaaagcttttgaggatcaaatgatgaatatatagttttttttaagaacttttatttcttaaagatttgcatatatgttcctgaggttcaaaagtctagccagagtttgttaaatctaaatccctaagaaagggaggtgtatatcttcattgacttttcactacttaaaagaaagaaaaaaaattaagaattagcgacgacagaaataccatatatatagctaaaaaacaaaatccttcttaattctacttagtgacaaaatattaaacaattttggtagtgatttgtttcaacaaagactactactccacaattattgtttatgtacactagcactactaccagcaattataattgttgttgaatatgttcctttagccgcagttactagtgacaaatacattttaccactctttgtaaatattcctaaagcctatagtgcttttggatataacgacaattaactaatatcagtaaaggcttaattaagcactgtttgttaatgtacatatttaatttattgccgctaaaaagtatttttccatgagcttgtgtctttcttttgttatggagaagaggaatgtgtttaaaaaaatgcagggatttaggaaagtaaatccagaccattgggaatttgctaatgaaggttttctgagagggaaaaagcatctcttgagaacaataaggagaagaaaaccaagtaatttcatcaagtcttcgtcatcaattaataatcaagcatcaaaaggctactaaatcacaacttcaagctatggagcaaaagcttcaagggacagaaatcaaacaagagcaaataatgagttttt

SEQ ID NO: 2512 - DNA, 712 bp, Lycopersicon esculentum
  Predicted polypeptide sequence is orthologous to G1594
cttcccccaactaattactagtaacatagaagagtctggtctggtctttatcacctttttaaattttaaaagtaaaaatataattaaagtagctgtctagctagggcctttttccaggtgtcgatctatatatatatttttatttgggtttaaagaaacgtattccatatatatatatatatatatataccgctgagataacaactagagatttttaattgttcacatactgttttgatgatggatgaattgagcaaacttcattctgctattgtttgttcacacagtagacgacaacaagaggttgaggttgaggctgaggccgggccgacaattattaataacactactactagttttgctgctgttcatcatcattattgtcaattagaagcagcggttgctgctgatcataatcatcatcaaaataatactaaatccaccaccaatatgtcagatcttattaaagctcagattgctaatcatcctctttatcccaacttactttctgcttaccttcaatgtcgtaaggttggagcaccgcaagaaatgacatcaattctcgatgaaattagcaaagagaacaacttaatatccagctcacgtcacagtagtgaaattggagctgatccagaacttgatgagtttatggaatcatattgtgcggtactagtgaatacaaagaagagttttcaaaaccgtttgatgaagc

SEQ ID NO: 2513 - DNA, 2046 bp, Lycopersicon esculentum
  Predicted polypeptide sequence is orthologous to G1635
gctcttctcttcttcttcctcctttcttcaaaaaaaataaataaataatatttgtgtgttgtttcacacttgtttttagttttatctatcaagtgttttcttgggaattctagaactatttgtctatttattgaatttttggtttgatttaacaactttgatgttgtgttttggtgaggataaggatgaaagtttcgatctttaaaggggaaagattgtttttagtggttgtaaaagtgaacagggtgtgaagagctacagttctgtatgtgggggttgttagatcgtgtgattttttggaattaacggttgatatttctgggttttggaactgaagagaatttaattgggtaaaactgggtttcttctattttaggactcaacgagtactgattcagcagaaatgactataggggatcaaagcgagtcggactcgatacttccttgtaggaataggatgtcagttgatgttggagctccttctccaaggagtatccagatggatgagcaagttaatccaggagaagaatatgctcctaagataagaaaaccatacaccatttcaaagcaaagggagaggtggtctgaggaagagcacaaaaagttccttgaagcattaaagcttcatggtagggcatggcgacgaatagaagagcatgtgggaactaaaactgcagttcagattagaagccatgctcagaagttcttttcaaaggttgttcgtgaatcgagtaatggtgatgcaagctctgtgaaatccattgagatccctcctcctcggcctaaaagaaagccgatgcacccttatccaagaaaaatggcaactccacttaaaagtggaaccctggcttcagagaaattgaacagatctggttcacctgatctctgtctctctgagccagagaatcagtctcctacctctgtgttgtctacccttggttcagatgcatttggtacggtggattccactaagccaagtgagcagtcatcacctgtttcctcagctgtcgctgagaattctggtgatcttgtactttctgaaccattcgatttggttgtagaggagagcagatcgtcacctgcccgagcttatgctacttcaaatccggccaatcaggcttgtgtgaaactagagttgtttccggaagacaatgattttgtgaaagaaggctcggatgaggcatcatccacacagtgtctgaagttgtttggtaaaaccgtattagttactgatgctcatatgccaccgacagacgagacgttgactcgaagctccttccctgcaaaatatttgccctgggattcagaatgtcctcaaagtaccttttctatcgtccctcctacgccgtcatattactttaccacaccaaatggaagttcagggcctaaccaaagtggcgttgcaactactcatttgccgtggggatcatcatgtgcagttccttgcactcaggtgcatagcccaattccaatgaagggacgtccactctttaatgacagatatttggaaggaaaggaaactcaaaaggaagggtcttcgaccggctccaatgcagaatcagtagatgcagagttgagtggagaaaagaacatggaaattgaagctcagagtagtagaaatgtggtagaagagtcggttagagccagcgtaccctctttgtttgagcgaagagcaaattccacgaagcgtgtgaagggttttgttccatataagagatgtttagctgaaagaggcgtgagttcctcaacattaactggagaagaaagagaagagcaacgaacccgattatgtttgtagttttactttctttgtgcctgtttagtttttgtttgtaaaggttagcacatccctttttggttctacttataatatccgtatgccggataactggatgaagagaagcaacaccatggcagcaaaaggcgattcatccctctaatttttgctgaatggagaagcagtcttcgtaatttttttgaatgaattgttcaaatgtatgttgataaaaatcaagtcttgcaacttaaaaaaaaaaaaaaaaaaaa

SEQ ID NO: 2514 - DNA, 867 bp, Lycopersicon esculentum
  Predicted polypeptide sequence is orthologous to G1635
ccactgcatccataccctcgcaaaatggctgattcatctatagctaacaaggcagtttcaggtcagcctgaaaggtctccttccccaaatgcatcaggaagggagagttgttctccagattcggttttgccagcaattggtctagggattgctgaatattcagttgctgagcagcagaactctcgcttttcaccagtctcttgtactacggatgcacacactgcaaatataatttctacggagaatgatgatgagagtatgagctcaaactccaacaatgtggatgcaatccacgtcacgttaaaaccagtagctgctagtatcagtctgattaccaattcagagttcatggaatgtaatatagttcatatggagaattcttgtaatggtgaaaagctagctgttgaaccaccttctgcaagtatcaagctgtttggaaagactgttttcgtaccagatgccaataaccttgctccgccagctccatacaacacagaaaaggaaaaggagatcagctatgaagatgtacttcatggattccaagctaaccaagcaaattcaccatttgtacttgccatggttccaggcaatatgattccaccagcatcttggttgtcacaaaacatgcttgaaaacaatcgtgagagtactgcggccttccctgcagctacaatttcttggtggtcctggtaccaagatctcttatatcggtccatctcatcgtgtggccaaacaaccgtggaggctgcttctcattgtcagggactaaaagatgaagaacctcaaagagagggatcatcgactggttcaagcattggctcagctagtgaagttgacgatggaaacacgagttgtgaaacagttgag

SEQ ID NO: 2515 - DNA, 978 bp, Lycopersicon esculentum
  Predicted polypeptide sequence is orthologous to G1655
ctcgcctcttccccctctcatttccttcaaactcttctcccccatctcgctctctctctctacataatccttctctcctccgccacctaccgccgccgtctccgccgtcaaactcaaaactcagtttgcatctatttacagaagagaagcaaacgtacaattcgcgagaatcattccgaattttgcatcagaaaattgttccttctgatggcgtcatctcaaaccgtctcgaatcccgatgttaactccagtcactcgcgagaatccaagcgcaaaaagagaagaaaaattggagatgatggggaaattgagcaacaaacgagccttgatcaatccaggtggagaacggataccgagcaacagatctactcttcaaagcttctccaggctctccgtcacgttcgccggagtaatgacaatccatctccggttaatgccggacgcgccgtcagggagaccgccgacagagtcctcgccgttacagcgaagggaagaagtcgttggagcagagcgattctcactggccgtctcagcctcaggcttagccaaatcaataaaaagcataagaaagcaaaactgaatagcggcaatataaaatcaaagaaaccagcggcgaagaagcgattgcctgctttgcaacggaaagttcgtgttctcggccgtttagttcccggttgtcagaaactcccgtttacgaaccttctagaagaaactaacgactacatatcagctctacagatgcaaatcaaagccatgacttttctgaccggcctcctctccgccggtggagcaggatcagttgccgctcaccccgatcggctcggctaagtggcttgttacaacatgtcctcttttttctttttttttctaattcttttttaatttctaaaaccctttttttatttttgttaataattgagagtttttatattggtgtattttattgtatacattccttttcttccctgtttaaaaaaa

SEQ ID NO: 2516 - DNA, 676 bp, Lycopersicon esculentum
  Predicted polypeptide sequence is orthologous to G1662
gaggaatgcatcaataagtccatgtgacagaagcatggtggaagctcaaagttttgctgctgttttccctaatgacatggatgaacatgattctccgtttgcgggtgaattgctgcatctcacaagaaaaggtatgcaacgatggaaacgcgtttctgtttatataaacaaaaaatctcaggttgtgatcaagttgaagagtaaacatgttggtggagctttttctaagaataacaaatgtgtagtatatgaagtgtgtgatgaaagtgaaccatggctattcaacaaagagattgaaagcctagatttgtaccttagagtaaagacagctcagggtcttctagagttcaagtgcaagagcaaaagccataaacaaaaatggattgatggaattcagaagcttctagataaaaccagtttatatgaagatactgaaggatcaatgacaatgttgagaatcaacaaaagcttttagactaacttagtttttcactttttgtgttattttaatgtataaaaatgtttgagatagttcttggtttgtctgtcttatgatacttcagatgtaagttgtacttactaattggagttagtatctaatatattggcagtaagacagatcttgtttgtaagaattttgtaaattcacctaaagactcattattccaaacttaat

SEQ ID NO: 2517 - DNA, 430 bp, Lycopersicon esculentum
  Predicted polypeptide sequence is orthologous to G1662
gcaataactcagtcaagaagaaagaaaaggcacgcctagaaaacgcgcatatgcacactgtcctatccatagcaggactagctgcagcattggctgcagcagcagcagcagagaactcaaacggttcgagttcaaagatgagcacggctttagcatcagctactgaactcttggcctcacattgccttgaaatggctgaatcagccggggcggatcatgatcgtgtagcctcagttgttagatcagctgtagacatacatagtgctagtgatcttgtcacactaacagctgcagctgccacagctttgagaggagaagcagctcttaagtcaagattaccaaaagaagcaaagaggaatgcatcaataagtccatgtgacagaagcatggtggaagctcaaagttttgctgctggtttccctaatgacat

SEQ ID NO: 2518 - DNA, 542 bp, Lycopersicon esculentum
  Predicted polypeptide sequence is orthologous to G1755
ggctgctcttgcttatgatgaagctgcaagggcgatgtatggtccttgtgcaaggctgaatctcccggactattacgcctcgtcgaaagagtcttccaaggatgattcttcgttgcctactgtatctcgttccgactcaaatacagcatcaagtttctctgaggtgtgccctgctggtgacatgatgagaggaagagccaatgttcctgcggcaagacatgaagatagatcaatagaaattgacggtgctaggactggttctaatgaaattggaacgcctttgagctcattgagagaggaagcggaagacgagaccaaggaggtgtcagataaaagtgagacttttacacctctgagctcgttgagagagcaagcggaagatgaggctaagcaggtgttagataaaagtgagacctttgaaattaaagatgagcctgcggcttgtagttatgattcatgggatatcggacaagaggacctaggtaacttttgtttggatgatgagatgtttgatgtaaatgagctgttaggcatgatggact

SEQ ID NO: 2519 - DNA, 675 bp, Lycopersicon esculentum
  Predicted polypeptide sequence is orthologous to G1798
gattccttaactattttcttttccatcctctttcctttttcccggaaaatcggaatttaaatggtgagaggaaaagtagaaatgaaaagaatagaaaattcaacgagcaggcaagtgacgttttcgaaaagacgaaatggacttacgaagaaagcttatgaattatcagttctttgtgatgctgaagttgctttcattattttctcacataaaggaagactttatgaatttgctagctccaacatgcagaagataattgagagataccgaggacgtgcaagagaaacaacgacggtggacaaaagcactgaactcgagcactacatggagaacttgaagcatgaaacagctaatatggcgaagaagatagagatcctcgaaatttctaaacggaagctaatggggcaaggattagggtcatgttcaatggatgaactagaagacattgacagccaactggagaggaccctcaaaattatcagggctagaaagactcaattgttcaaagaggaaatagaaagtctaaaagcaaaggagagactattgctccaacaaaatgcaagtttacgtgaaaagtgcgggcttaggccaatgctatcagagtcagcatctgcacccgaacccataccagcaccaccatcaacaccaccagctcaatcaaaagaaaggggaaat

SEQ ID NO: 2520 - DNA, 538 bp, Lycopersicon esculentum
  Predicted polypeptide sequence is orthologous to G1798
ttacatttgtaagtgtattgtgtctttccattttagctccaaatagtccttttgcaaccaaaatcttgtctgagatttttctatatttgggattgatctaaagatatggttcgaggtaaaacccagatgaggcgtatagagaacgccacaagcagacaagttactttctcaaagagaagaaatggtttgctaaaaaaagcttttgagctttctgtcttatgtgatgctgaagtgggattgattatattttctccaagaggaaaactatatgaatttgctagttcaagcatacctgaggtaattgaacgatataagaggcatactaaagataaagttaaatctgatgaaaatcaatctgtggatattcagcatactaagcaagagacagcaagtttgatgaagaagatagaactccttgaatcatctaaaaggaaactcttgggagaaggtttaggatcatgcagccttgaagaagttcaacaattagagaagcaattggagcagagtgtcattactattacggctcgaaagatgcaag

SEQ ID NO: 2521 - DNA, 518 bp, Lycopersicon esculentum
  Predicted polypeptide sequence is orthologous to G1798
ttttttttttttttttttcggcgtaatttttataattacagagtaaaaaggacaaattattgtatacaagatcttaccctcaccttttgtgaggtaaatatgctatttctgatagaccttctcctctaactaatgattcaagacattaaaaaaaaactatatttaagtaatgtagtttatattattacaactctataaattataattacagtgttaatataaaacttgaaaccccaacaattttgacaattaaagtaatgtaggtagtgtgtttaaattaggacaatatgaactttttctagtctctggaagtcctataaagagctctgtctcaacttccattatttgtctttcaacatctttctctactagaggaactggtgttaaagtcaatggtagcacctgacacttttttttcaagtctacattttccttcaatagaattttttcctcttccttcagttgagcaatctgttccttgaataacagattctttcttgccctaatgttgcttaaac

SEQ ID NO: 2522 - DNA, 604 bp, Lycopersicon esculentum
  Predicted polypeptide sequence is orthologous to G1798
tttcgaggaaggaaagtagtattagaaaagtcggggagaaatcaatgctcttcatttttttccccctttttctaaactagggtttctataacaacaactatttgtgtcttcactctattataatttaacttataaagttttttctaatttctttttctcttcatctttcagatctaagaaaccataaagtttttatttttaggggttattatccacttcaagatttagaatctttctatttttggaaacttctcatgaattggtggaaagaggatatttctgaaggacgtctaatacgttaagggcattttttcgcgaagaagaaaatggtgaggggaataactgagatgaaaaggattgaaaatacaacaagtagacaagtgacattctcaaaaagaagaggtggactacttaagaaggcatttgaactctcagttctttgtgatgctgaagttagtctcatcatattttctcaaaaaggaaaactttttgagttttcaagttcaagtactaacaagacaatagaacgttatcaaaagaatgacaagaatttgggtcatgaaaatatattacttgaacaaactacaaagcatttgaaggggga

SEQ ID NO: 2523 - DNA, 413 bp, Lycopersicon esculentum
  Predicted polypeptide sequence is orthologous to G1798
aattaaggggattgatctaaagatatggttcgaggtaaaacccagatgaggcgtatagagaacgccacaagcagacaagttactttctcaaagagaagaaatggtttgctaaaaaaagcttttgagctttctgtcttatgtgatgctgaagtgggattgattatattttctccaagaggaaaactatatgaatttgctagttcaagcacgcaggagataatagagcgatataagaggcatactaaagacagagttcaacctgaaaaccaagctgggccacagtatctacagtatatgcagcatgaggcagcaaatttaatgaagaagatagagctccttgaaacagcgaaaaggaagttcttgggagaaggtctgcagtcctgtacccttcaagaagtaccacagatagaaaa

SEQ ID NO: 2524 - DNA, 875 bp, Lycopersicon esculentum
  Predicted polypeptide sequence is orthologous to G1844
gagagaactagtctctattttttttttttttttttttttcacaaaaaaatcataacaataatgtgtagggtaatcaatttcaagtactccattatacaacttaaaaagagggaaaaataggcatataagtcaccctctagtaaatatgtcaaagtagagaagttaactttaatcatcatccattagaaacaagaacaaggatgaataattattagttttattgaaactaattttgcaggttcctctggtgcagaagcaaggcttttcgacgaatacgacgataatcactagaagaaattcagggtaactttttgttgtccacaaatcatgtggggtgctggaaggtcagacatttcattcacttttgtgtttttcttgatactagctatattgtcctccagatgtttcttttcctctagcagcagtttttccttctcatgaagaaccttagcagattcaagcatcaaatgtgtctttctagctctgagatgtattagagcagtttgaagttcgttttccaaatggataaggtcagtcaaagtgagaccatcagcatttgtttcctcgagttgcctttctgttgtttgtagcagttctcccattgttgtgaaccccgacacctctgcgacctggatttctgcattgatctctttttctgctccaacatggctttcatatcgtcgaagcatcgctgtcatactgttattgctggagaattcatggagtctaccacgatttgagatgataacaacagcaacatcgacatcgcagagaatagaaatttctttagctttcttcaataaacccttcctccgtttacagaacgcaacttgcctgcaatttttatcttgaattcgcttaatttctaccttccc

SEQ ID NO: 2525 - DNA, 1238 bp, Lycopersicon esculentum
  Predicted polypeptide sequence is orthologous to G1844
gtttaataaccatgggttatcctatttctgattcaatcctttacctagtaactgacttcaaaacatacagctccatctcctaatttctgaaaggaacttgtggtgtgttctttcgtaagcatttattaccctgttatcactgtttggcacaaaggcaagacttcttatttccccaaaagaaccaactcttccaacgacacttcaagatagaaaaccaacttttgggttattatgctcaaatagccaactaaaatttcagtggctttaataacctgtattttgtttatgactgggtttacagtgtaaaatgttgagttgtgttatttcttcatgcaatctgacaggagttattcaccgatataacaaccacatgaaagcagaagataaggcctctgcagaagtcgatgacaccgaggaatcaaaatatgcaagtttcatgacaatggaagaactgctacagacggcagaaaagcaactcgaggagcctgatgttgatgatctcagcattactgatcttgtccatctggaaaaccaagttgagactgctctgacacaaaccagatttagaaagacacacttgttgattgaatcaattaagaatcttcatgacaaggaaaagcagctgattgatgaaaacaaagttctggaggatgagataggtaccataaagaacagcgaagaaaatgagatggcaatgaatctaaataacatcgcaccaacccatatggattgtggacaacagagggagaccctgaattttctctagagtctagacacactaatggcatcacatatcagatagaagctcaatatataaataacagccttccaaaatatagcagagcagccactcctcgcgccatgggatatgtcctgccgaggttatatctggtgcatctaactagggagtgctactatgtagtcttctcttgtatgttgtcttggtatggttgaaacactgaagaactgtataaagggtaaataaataaagagatactgctgcagcgtctcgataacatgtgtgtaatgctatcatctaaatgactgtaaattagaggttattataatagtaagagggtgtagtccataagaatgacttgtccaagctgttcatgtttgatagtccgcatcggtctaattcatttcagcccattagaaaatgagacaaatgtggctatacgcagaggactattgcatcaacgaatgactttctagttaaaaaaaaaaaaaaaaaaaaa

SEQ ID NO: 2526 - DNA, 626 bp, Lycopersicon esculentum
  Predicted polypeptide sequence is orthologous to G1844
gtatgaaattcgtgaaagtgatggagatggaggtacaaatcttcttatattcggtcattttcatttgtgagaattagttagggtttgggagattgaagaaatggggaggaagaaagtggaaataaagcgaattgaagataagagcagtaggcaagcaactttctccaaacggagaaatggactcatgaagaaagctaaacagctctctgttctctgcgatgttgatgtcgccgtcctcgtcttctccagtcgcggacgcctctttgaattctccagtaccaacagtctgacaggagttattcaccgatataacaaccacatgaaagcagaagataaggcctctgcagaagtcgatgacaccgaggaatcaaaatatgcaagtttcatgacaatggaagaactgctacagacggcagaaaagcaactcgaggagcctgatgttgatgatctcagcattactgatcttgtccatctggaaaaccaagttgagactgctctgacacaaaccagatttagaaagacacacttgttgattgaatcaattaagaatcttcatgacaaggaaaagcagctgattgatgaaaacaaagttctggaggatgagataggtaccataaagaacagcg

SEQ ID NO: 2527 - DNA, 489 bp, Lycopersicon esculentum
  Predicted polypeptide sequence is orthologous to G1844
gacacacaaaagagaagagctgggtaggtgtaacgccgatgatagaagaatcttctagacatctgaaatttgtggattagggcttttcatcggcgaaaaaaaaaatggggcgaaggaaggtagaaattaagcgaattcaagataaaaattgcaggcaagttgcgttctgtaaacggaggaaaggtttattgaagaaagctaaagaaatttccgttctctgcgatgtcgatgttgctgttgttatcatctcaaatcgaggcaggctccatgaattctccagcaataacagtctgacagaaatgcttcaacgatacaaaagccacgtcgaagcagaaaaagagatctctacagaaatccaggtggcagagcactctaaatactcagggttcataacaatgggaaaactgctacaaacaacagaaaggcaactcgaggaaactaatgatgatgttctcactgtgactgaccttatccatttggagaacgaac

SEQ ID NO: 2528 - DNA, 367 bp, Lycopersicon esculentum
  Predicted polypeptide sequence is orthologous to G1895
atcatcgccaacccgtccatctgtcattgtcatcatcgccaacccttccttctgtcatcatcatcgtccccaactcctccttccttcatcgtcatcgtcccaacccctccttccgtcatcaacatcatctccaacccctcctttcgtcatcgttatcatccccaacccctctttccatcatcgtccccaaaactctagctgttgtcactttcttaagccctagtccgtcccgaatccatggtgaaagttgacattgatgttgcgattgatagccaaggaagagaacgattaagaagttcaactatagaggagcagatctggattgatagccaaattcattgcgaaagtggatactaaatttgtattg

SEQ ID NO: 2529 - DNA, 1251 bp, Lycopersicon esculentum
  Predicted polypeptide sequence is orthologous to G1902
agagaagaaactctacttctctctgagtttagtatatttggtgacgactctcacgcgtaattctgcagatcaatacacatcattcattcaaacttcaaaatctacttataccctctctcctcttttttctcaattttctgaaagatttcaattcagaatttggttactgaagtcactaatttggtgcaaaattggaggtatacaaatctggttttcataatattcagaaaattttaatagccatctatctttgtggcttataaagttgttttggtttgattaatatctattccttttggtcctcttttaagttttcctttcgccacttctcagaacaacaaatttgatttcaattctactatttttaagctgaaaattatgcaagacccatcaatttattcacaaattaagcctcaatttccagagcaggaacacctgaaatgccctagatgtgattcaccaaacacaaaattctgctactacaacaattataacctttctcagccacgccactattgcaaaagctgtagaaggtattggactaaaggcggtactcttcgtaacatacctgttggtggaggttctcgtaaaagcacaaaacgatcttcatcttcatcatcatcgagtaagaaaagttcatcaacttcaactacatcccctgcaactcctccattaacatcatcttcttcatccacaaatccaaaaccagagccattcggtatacctgcaattccatcttttgatgtgatgactactagtactggtccattcagctcactgttagcgtcaaccgagccgcaatttgggaattttctcgaagctttgaatccgaataataataatgggtccactttacagttgggtaacccagtttcgagttcgggccatcaaaatgggaatacttcatatttgggtgttcaaaatggtggagaatctaataattgttggaatggtggtaacaatggttggcccgatcttgcaattttcactccaggttcaaatttccaataaagtagtatttaatagaaggtattttaactactttactaagtatttaactttttaaacttttttttttttttaacattcttttgagagtgacgttgttgattgcactcgtagcaatacaacagaaatcacatatctagtataattctacgagtgagtttgagtactaggtaattaatgtattagtacataatttacttctgaaaaaaatgtggtgtctgagcaatgttttcaaatgcacat

SEQ ID NO: 2530 - DNA, 996 bp, Lycopersicon esculentum
  Predicted polypeptide sequence is orthologous to G1902
gtaacactctgttctctcaataagcctaaaaaacagagcaaacagaagctcacaatatgcaagatccatcatcaatatattcacagatcaatcctcagttcccagatcaacaagtcctgaaatgccctagatgtgattcaatcaacacgaagttttgttactacaacaattacaatctttctcagccacgccatttttgtaagaattgtaaaaggtattggactaaaggaggtattttgaggaatattccagttggtggaagctctcgtaagaacacaaaacgatcttcttcgaatagctgtaaacgctcctcaacgatgacgatttcatcttcaacttcatcagaacaaaattcaaaaacagagcattttgatacccctgttgttcggaacagcccgattgttgacgccaatgggcctttcggctcgctactagcatcaaacgggccggagatagggaattttttaaatgttttgaatcctaacgggcccgattcgggctcagacgctgctgccgctcaaagtgggaatagtaataataatcatgaatttttgggtgaagattctaattgttggaatggtactaatggttgggctgatcttgctatttacaccccaggttcaacctttcagtaattaattaattaattaattacaatagattattagaactttgtattagtactactaatacttatgaaaatgcacttatctttttctaagcatgaatgttggaagtgttgtttgcggattgtatactattactagtagttttcgtatcagcttgtcgtgcatctcagttttttattaatacatgtactgagtgactcagttcatgtttacgaaaacttaatatttttactttgcatcaaactagttttgtttgggtaatgcttagtgtacgtacataattgtgtgtgatttgagatttcatgtatgttattccaagggaaatgataaattatgaaatttattaaaaaaaaaaaaaaaaaactcg

SEQ ID NO: 2531 - DNA, 1074 bp, Lycopersicon esculentum
  Predicted polypeptide sequence is orthologous to G1902
gatttattactctctttcacattttcattctatcatcaaaagagtaaaactaagagcaatctcatttgcttttctcttcttttcttttttttaaaaaatgattcaagagctgtttgcaggaaacactacacttatcggagatgataatatttctaatattactccttcctcctctcctatttcttgtactacttctaattccaatattgcccctgcaagtgcaaatgcaaactctgaaaatcttagatgtccgcgttgtgattccccaaacaccaagttttgttactacaacaactacaatttaactcagcctcgtcatttctgcaagacttgtcgacgttattggactaaaggaggcgcgttacgcaacgttcctataggtggtggttgcagaaaaaacaagtccatcgctacatcaaaatcaactgctgcaaaattcaaaaattcacttccgtttgagtttattggaaaatcaagcatttttggagggttcgagcaggaaataataccttcaaattatgataataataacccttttctcttttcctcacctcatcagaatcataatcctattctttccttacttaaaggaaatcttcataaatcaattggagtgaatcaatttccttccaacaacggtatatggaaaaataattatgaagaaaacgttggtgaagtccagaatagtcgaggatttcaagagctatatcaaaggctaaaagcgtcaacaaatcgatgttatacagataatatgcatggaccatcatcatcgtcaatgattttggattcggctccggtaactggaggagagttgggttgctggaacccgaccctttcaacatggttggatctgccaacagcaaatggggcatatctttaattaataagtaatttactattttactattagggtgaagggtgcatgagatgtttgtggtatactggggatacttggacatgggtgtggcttacattttatttgcttttattctgtttttctctttgctttttgtgtgtgtttcatctataaaaatcaatgtactaaatttatttttcaaaaaaaaaaaaaaaaaa

SEQ ID NO: 2532 - DNA, 808 bp, Lycopersicon esculentum
  Predicted polypeptide sequence is orthologous to G1930
ttgaaatgttacgtaaacacacgtataatgacgaacttcaacatgccaagaaagtatataacaacaatactttcgagatgaatggaaggagcacatgccatactaatactaatatcgcgactttttcattagatactaatgaaaaagtcgcgaatatagctagtgaactgctttttgaaaaagtagttacaccgagcgacgttggaaaacttaataggcttgttattccaaaacaacacgcagagagatatttccctttggttgccaaagtaaataaaaatgataatacttctaaaggggtattattaaatttcgaagatatgaatgggaaaatgtggcgatttcgatattcgtattggaatagtagtcaaagttacgtattaactaaaggatggagtcgttacgttaaggaaaaaaagttgaaggccggagatatagtgagtttcaaacgatgttctggagttgaaatcgaagataaacttcttattgattcgaagaacagaataatacgaggcgaacaagtaaaaatggttagattatttggagtgaatatatgtaaggttcaagatgttagtaataatgttgttgttgagaaaaatatgagtgttggcaaaagaatgagggagatggagttgttggcatttgagtgtagcaagaaacaaagggtaataattgatgccttgtgaatttttcttttgtttgtaattttttttttttgtactttggtttttttagatgttttaatttatataacttccaattgtatattagtgttattaggaaaaaaaaaagggctcaaaaagagagc

SEQ ID NO: 2533 - DNA, 681 bp, Lycopersicon esculentum
  Predicted polypeptide sequence is orthologous to G1930
cttcctaattttccttttctcatcaaaaaagacaaaacaacacacacaccaaaaaaaaaatggaaggaagtattagtagcatagatcaagagagtactactagtgactctctctccattgctccggccgcgtcgtcatcgacgatgattaaatcgtcgacgacgataaaactgccgccggagagtggtctttgccggatggggagtggaacaagtgtgataattgatgctgaaaatggtgttgaagctgaatcaagaaaactcccatcttcaaggtacaaaggtgtggtcccacaaccaaatggtcgttggggcgcacaaatctatgaaaagcatcagagggtatggttaggcacattcaacgaggaaaatgaagccgctagggcttatgacatcgcggcccagagattcaggggccgcgacgctgtaactaatttcaaacccttgcttgagaatcaagaaagcgatgacatggaaatcgctttcttgaattcacattccaaggcggagatcgttgacatgttacgtaaacatacgtatatcgatgagttggaacaaagcaagagattgtttggatttactaaagacggtatgataaaaaggaaagatggactagtaattagttcgttctttggtagtaaaaatgataaagtcaattgcaaagcgcgtgaacagctatttg

SEQ ID NO: 2534 - DNA, 246 bp, Lycopersicon esculentum
  misc_feature (240)..(240): n is a, c, g, or t
  Predicted polypeptide sequence is orthologous to G1930
cagagacgctgactccacaaacggtgtagaagcagagtcgaaaaatactactattactaataataacaacaataagcttccttcttcaaagttcaaaggtgttgtccctcaaccaaatggtcgatggggtgcacaaatctacgaaaaacatcaaaggatttggcttggtacgttcaatggcgaagaagaagcagcaagagcttatgatatcgcggcacagagattccgtggtagagatgnccggtt

SEQ ID NO: 2535 - DNA, 748 bp, Lycopersicon esculentum
  Predicted polypeptide sequence is orthologous to G1935
ttgcgagtgtccaagtccacaatatgtagagtgtcctcttccttttatggagttatggtctaatagccaaagaggaaaaagaacatcaagaaggaaaagctctatgtggtattgaggattctcatcaaattaaaatggatactctctcctaatagaaaagttaacgaacaattaatcatgagggaacttcatggcatttgtagcctaacttgaataagtttcttggattggcttgacctaaatagaaggaagctcgagctacattgcaaaagcttttatcagcttgtgatgaagaaaattgaggatccaacatcccgtcaacagttctattcaaagcgcaaggataccatccttaagaagtccaatgagttggctgttttatgtgatgtggatgttggtcttctaatgttttctccagccggcgaagtgactagctattctagcaaagaacgtcttgaggatgtcatgctccttgctatgaacaaggctggtgaactgaacaagctatctcctgaaaatccaaatgaacaggctttgatggactctctcacacaatcaaaacatgaagccgaaatggtggagaagatagcgattgttgaggctcatgaggagaagcttaatggggtcaaagaaagactaagtgaagcacaacagaaaataaggtattacgaaccacaagtggagagtatcaactctgtccaagaagctgatgcatatgagaagttcattttgagtgctctggaactga

SEQ ID NO: 2536 - DNA, 543 bp, Lycopersicon esculentum
  Predicted polypeptide sequence is orthologous to G1935
aaattcattttgcttcactctaatacactaaactagaagcttctctctaaaactcacatgcagtggatcggaaaaagttccactgctgttttcatctccaaagctaaggcgaaaatattagaatttttcatctaaaagctcccaagctaacttcatgcttctctccaagcgatttttttcgaagtagagtactacggatccaaaagatttcatttcaatctaccaaaatcaagttctagtttgcatcttctcatgggtcgcaataagattgtgatgaagaaaattgaggattcaacatcccgtaaacagttctattcaaatcgcaaggatagcattgtgaagaagtcaaatgagctggcggttgtatgtggtacagatgtggggttgttgatgttttctccatctggtcagctgactacctattctagcaaagaaagtattgaggacatcatgatcgaagctatgaacaagtctgtgaatccgcgacccataccaaatctaaatgaacagcttttgatgcagagtctcaaacagtcaaaatct

SEQ ID NO: 2537 - DNA, 642 bp, Lycopersicon esculentum
  Predicted polypeptide sequence is orthologous to G1935
gcaaagttcattttctctatccctaaaatcctcctttgatatttttctttatattccattgttcatatacatatatacatatatatatattaaagagtggattttctaacgttacatttttaatgggatgaaatcgattgtttctagcaacaacatgaacgcgatatacgttcaaattatgttgctagatcatatcaatacgaaaaaaatgaaacttttatttttttaattgattgtatattattacattcatatatatatattgttcatatatgtatatatatctttctaaattatagaaagatttttttttttataaaaaaaaaaacatgggaagaagtaaattgccattgttgaagattgagagtttgaccaatagacaagtcacttttagcaagagaagaaatggaattctcaaaaaagtttatgaattatctgttttatgtgatgtagatgttggtattataatgttctctccttctggtcgtctcacacattattcgcgtaaaagaagaattgaagatattctttctgagctcattagtctcccagatagtgaaagaggattctacatcaacaataaagagtctgtactttggaacttaaggaagattgaaattgaagataaattttgcgatattg

SEQ ID NO: 2538 - DNA, 653 bp, Lycopersicon esculentum
  Predicted polypeptide sequence is orthologous to G1944
ggagcagtttgcaaagcattaatatctgctgaaaaaaatggagtcaagggaagctatagctccagaagctccatcaaactatcatatggtatctagaacagaatctactcctataccacctggtacattggcggtgattccccctccggtggctaccgcctttccaattagctcagagaagaagaaaaggggacgtcctaggaagtatgggcctgatggagcagttgcaaggacaatttcacctacgcctatttcagcagacttcttgtcgaagaaagtgagtgttgcccgtcctgaatcggagaaaaaggctcgaaacaaagtgggagctgaaaatttaggtgaatggatttcatgttccacaggtggcaactttttgcctcacatgatcacagttgaagctggtgaggatgttaccatgaagataatctcattttctcagcaagggcctcgagctatttgcattatttctgctgttggtttgatatcaaatgtcactctacgccagccaaattcatcagggggaactctaacttatgagggtcgatttgaaatcctttctttgtctggatcctttactccaacagagtttggggggttctcgtactactagcagaaccggaggaatgagcatttctttggcaagtccggat

SEQ ID NO: 2539 - DNA, 684 bp, Lycopersicon esculentum
  Predicted polypeptide sequence is orthologous to G1944
gcggacatactgaggaaagttagcaacccctaaattagtttttatttttattcttttaataacttatcaaaaactccatatttcacattttctcaagaatctcattacaataaagcctaaaaattcaatgttttccccataatttcatcttttaattctgaaaaaaatcttaaaattttcaacaaaaaattctgataatttccatcttcatttctgtttaactttcttgttttcttataagctctgtttttctgctaaactctggttagacttcaaaattaccactaattaagctttttttgagaatttttttttcttggtttcttcattgaaggaaaattatggggttttgaagaaaaaaagagggaaattttttaattttttttggtgattttttttttttttgggctatggaggggagtaacagtggagttacagtagtgggatcagatgctccatcagattaccatgtggcagcaaggaccactgagaatccgacaacacagactgtgacatcccagattgttgttgtttcaccaacgccggcaatagctgtgtctgtcggcgccggcgccggcttaacagctctgagtgtgaaaaagaagagagggagaccaagaaagtatgcaccagatgggtctgtaaatgttctttctccaaagccaatttcattatctgttccgt

SEQ ID NO: 2540 - DNA, 503 bp, Lycopersicon esculentum
  Predicted polypeptide sequence is orthologous to G1944
aagcttagcagaattttgtaaaatttgatggttgccgttagttgcgcatgcttagctgtagagttaacaatggcggcttcagatgcttcatcagactatcacatgactggatctgctcaaccaggagcagcaacccagtcgggtgcagcacggcagtgaccactcccaaagaagaagcgaggtagacccagaaataatggaccaaaagggtcagtggccacgccaatttcatccgtcgcaccttttctcaggtgattgatttttaggcgaaagtccagccagttgggtcagctattacagttgtatcagcccaagttgatgttgagaaatgagaagtcagcatgaaggttttatcattttttcaacaagggtctcggtcaatgtgtattctctcagcaactggtgtaatctctagtgtcacatttcatcaaacagatacttttggtggtaaagtgacatttgagggccggtatgatttacttacttccgctggatcatatgct

SEQ ID NO: 2541 - DNA, 620 bp, Lycopersicon esculentum
  Predicted polypeptide sequence is orthologous to G1944
cagatttcaccaactctctcaagaaattttgaaagcacaataaaaattagcaatacatattttctttccattttcataaaattattttgtttttttaaagctctgttctttcttttgcagtaacagagtatcagttagtcattagttttccagtgcacatggtcagatgatctttctgtagatacaattaagtctagcatttgcagatttctgagtttgtacttttcttggtatttttttgcttgtattagcatttgaaaaaagattgtatttttattatatttgttattatggggttttgagttcttgaaaaacaaatatatttttgctgttttgggagcttatgttatttggagttgtcttcagggtttaaggggttttgagttcttgaaaaaaaaaccattttttgctgttttgggggattaagtgatttggagttgtcttcagggtttaagggggcttgagttatttggggtttaaggggttttggttgttttattattgtgtatatgcatggaggagaaagaaggagttaatggttcaggggttacagttaaaggtgatgaagctccagagagctacagagtggctcccaggagtgaaagtaataatattgagtt

SEQ ID NO: 2542 - DNA, 541 bp, Lycopersicon esculentum
  Predicted polypeptide sequence is orthologous to G1944
aaatctaaattgaaaatcacaataaaatggtccaaagtacaaaatgtagcatttaattaagaggatgaatatgcctgttaaaactagacataaacccttaaaacactaagaacctagaacatggtaaccttcgtaaccaaagcgttatgacaacatcatacatctaaaactagtttggatttactgaacagacctcaaacaaacatcaaataggaggtgagaaggatcaatatgaacttcgttaaagacgcgtagtccttatggtctagtaaaatcacattcaaatttcaccctatgctggaagagatacatttatttcagctggcttattcctagaatcaggagctgaccaattatctacgcggaaagaagaggaagttggtgtagtttgttttactgaggactgataagggtcttccgtctcgggtagaggaacagcagcaataatgggctctggtttgtttttcttggttctctgctcatgttgatctccagcaagaaagctacctataacaatctgcacaggactggcagctactaa

SEQ ID NO: 2543 - DNA, 618 bp, Lycopersicon esculentum
  Predicted polypeptide sequence is orthologous to G2052
ctataaacctaaaaatatctctaattctggttatctcgttcgtacacatctttctcttgaatactagtaaaaatcaaatatttttgaacattttttttttcaaaggaagatgatcttgttgttacaagaatacattttgtggaaatttattgtaaatcttgaaacaaagttcagtgttgcaaaaagtttttatttttggattttccaaattttcaacagatatagctgtggtacttaactaatattgtgttgaaaatcttgtttttgctctgttgttgtatagctagttgtttgttttgttttgtttttttgggagaaaattctgttacttcatcatggcaggaacatcattgcctccgggatttcgatttcatcctactgatgaggaattagttggatattacctgaaaaggaaaactgatggacttgaaattgaattggaagttattccagtgattgatttgtacaaatttgatccatgggaacttccagagaaatctttcttgcctaaacgtgacctcgagtggtttttcttctgtcctcgggacaagaagtatccgaatgggtcaagaactaatcgagcaactaaatctggatactggaaagccacagggaaag

SEQ ID NO: 2544 - DNA, 763 bp, Lycopersicon esculentum
  Predicted polypeptide sequence is orthologous to G2052
gcttcgtatggactctttagctggcctctatttttagactctgatcactcaaatttagcaacttctcaactatttagaattgatagtactagaaaaaaaaaacaacctttttttcatgttttgacaaaccatatagtgacattttgtgccttgtgggataaggcagttttgaacctttattttttttcctggaagatgattgaattgttccagggatattgcatcttatgtgaacttacaaaattcagtgtagctaaaagtttttatttttggatatttcaaattttcaataggtacagtttgaacatttagctaaatttcatattgtaatttgtgtgtagttatagcagttggaaaaatatttacttatatggcaggaatatcgttacctcccggatttcgtttccatccaactgatcaggaattggttggatattacctgaaaagaaaaactgatgaacttgaaattgagttggaagttattccagtaatagatctgtacaaatttgacccatgggaccttccagagaaatctttcttgccaaaacgtgatatggaatggtacttcttctgctctcgggacaagaagtacccgaatggctcgcgaacaaatcgagccactaattctggatactggaaagccacagggaaagacaagaaagttgtatgtaagtctgcagttgtaagatacaggaagacactaattttttaccgcggaagaactcctctaagggataaaactgattggggaatgcatgaatat

SEQ ID NO: 2545 - DNA, 869 bp, Lycopersicon esculentum
  Predicted polypeptide sequence is orthologous to G2141
ggtttctcctataatcttccttatactaactactatacattgcactttgaaaaattcaaaaagttaaaaataacaacaaaaaagacattgtataacatttaaaaaaaaagaaaaaaagtgtgtactgtgtacagactacagagtaacagcaaaataaggcacaaaactataatcttgttccttcaatttctctacctgtatggatgtgtaatgaagtggaggcatttcaccagctgaacaatcgatccctctcgtcggatctttgaaagtggccaattgtttgatgtgtatcttatagattgttaatcttgaggcaaggggatttttttttttttagtttaagtttgattcatttcccaaataatggatatgggtagcaagaatgatactcaaggacaaaagaggaacaaggatgctactaattttcagtcaccaaacatatcgttggactggcaattaagtggaagcaacttgacaaatgcatcaatggggatgatccctaatagcaatcctttagtagattcagtttttcccactatttgggatcggcctcccaattcgtcacacttaggtttctatggtaataataatgctaatgctcaaatcagtccttgcattatgaatcagcacgagactgcagcaattggctcggtccctacgagaggtagtatgagttggaatccactgaattcgatgctgaaaggggctatgtttgtaccacctattcctggaatgattcctcaaagcttagctcagcttccagctgatttgggtttcattgagagagctgcaaggttttcgtgcttcagtggaggaaactcaatgatatgatgaaccggcctttaagcgtccctgagtctactaagcct

SEQ ID NO: 2546 - DNA, 863 bp, Lycopersicon esculentum
  Predicted polypeptide sequence is orthologous to G2226
gtttatctttgcaaaaatcttggccttttgcttttctctttctcttttttggttataggaaacaaaagttcgcttcttttttatggggtcttgataaaaaatccagtgcattgagttcttccaaaagtttggcttgaagagaaattcctcacatctacactaggttcctattcataatgggactctcaccatatacgactccagcagatgcaggagtgttctgtgtgattctggttaatacagccatatccatctctattgtcaagggaatggttcgatctatccttcatgtgattggcatcaactttgcatcatgggaagaatattctattgaaggccctttggacccatttgagtgtcgtgggagcccctcggtatcatacatggaggagttccgaagcagaacccctgctgttcgttacgattcattgtgttctaatcaccctacacaagaatgcgtggtatgtctggcagagttcaaacatgacgaggagataaactgcctctcatgtggccacgtttttcataagctgtgtctcgagaaatggctaaagaattggaatgtcacctgccctctctgcaggaattacattatgcctaaagaaggtgaggaagatacttgtccaatgtgaattttgtagtttgtcaggcctgtttgatatgttctgatgtacagcttagttgggtaaaaatttattgatgactgcctgatctttgacactgcataattctgtaaccttttatactgtaatactttgcgtcctatcacagtgacgggtctctttgttgcgaccaacaattcatatattgttgtacatatgttacaaaattgccagttaaaaaaaaaaaaaaaaaaaaaaaaa

SEQ ID NO: 2547 - DNA, 669 bp, Lycopersicon esculentum
  Predicted polypeptide sequence is orthologous to G2226
cataatgtaattcctgcagagagggcaggtgacattccaattctttagccatttctcgagacacagcttatgaaaaacgtgcccacatgagaggcagtttatctcctggtcatgtttgaactctgccagacataccacgcattcttgtgtagggtcattagaacacaatgaatcgtatcgaacagcaggggttctgcttcggaactcctccatgtatgatcccgaggggctcccacgacactcaaatgggtcaaaagggccttcaatagaatattcttcccatgatgcaaagttgatgccatcctcatcaaggatagaagtgcccctccccgaagaatcttataattttaaagtacaaacaaccttaccaaaccttagtgtcatgcacctgatggaagggctaagataatgagtctctgaatcagtaacagaaaatgtaacaacttaaataatggaacagaaggataggtttcattcacccaacgaattaacccagctggctactacgtcctatagaagaaaatggaacaacataaagtgctatctcatcaaacccatcctagcacaagggactgcttctcaggagaaaggaagcagcaggcttaacgtaagtataatccctgaaaagggtccgaattatcctttggactcgaaattggagaatcaacc

SEQ ID NO: 2548 - DNA, 996 bp, Lycopersicon esculentum
  Predicted polypeptide sequence is orthologous to G2226
gttaacaaaaaagtctcaagttttcatatttttagatccagtatattgagctctttcaaaagtttttttgaagaaataatcatcattttaacataaggttccaatccattatgggcctctcacaatatccaactccagcagatgcaggagtactcggtgtaattctagtaaacacagccatatccatctccattatcaaggagatactccgttcgatccttcgtgtgattggcatccgtatcgcatcatgggaagactattctattgaaggacccttggactcacttgaatgccgtggaagcccaccagaatcatacatggaggagttcagaagccgaacgcctgcatttcgttatgactcgctacgtatctctaaccaccctgaacaagaatgctctgtgtgcctgacaaaatttgagcctgatgcaggggtaaacagcctctcatgtggtcatgttttccataagctgtgtctagagaagtggctcaggtattggcatgtaacttgtcctctttgtagaaattacttgatgcctcaacaagaagaggacgatacatgtccaatgtgagattaaacgttttacggtgccacttcatccatttgctgatgttattatgtacagcttagtagtgtacaggctgagtatgtgtatgcttgatctttgatgtgatatagtctgttagcttgtcatatttgtgatggtttgcgtcctctcagagtgacgggtctctttcgtgtgaccaaaaaacttatactatgttgtacatgatttagtcctgtagcttcttgtgtttgtaatgctttgcgtcctctcagagtgacgggtctctttcgtgtgaccaaaaacttgtacattatagtacatggtgtagtcgtgtagcttattaatgcttttcgtcctctccaagtgacgagtctcctttggcatcaccaagaacttctacattgttgtacattgttgtacatataacctaaaactttctcttatgttactt

SEQ ID NO: 2549 - DNA, 582 bp, Lycopersicon esculentum
  Predicted polypeptide sequence is orthologous to G2226
ctctctctggtatcctatgaatctaacaaccctacccttaagtctctaaaaacaataaatttctctcccaattttcttaatatttcaaatttcaaagaattttctaacatcttctagctcctactacacctataggcaataatataaagtccagttcagtcagctgttccagaagttgttgctagtagaaatctctaagtttcagcctagattccaatccagtatgggactctcacagtatccaactccagcagatgcaggagtgctctgtgttattctagtgaacacagccatatccatctccattgtcaaggagatggtccgatcgatccttcatgtgattggcatccacattgcatcatgggacgattattccatcgaaggctccttggactcgtttgaatgtcgcagaagcccatcagagtcatatatggaggaattcagaagccatacccctgcaattcgttatgattccatctgtatctctaaccacgctgagaaagagtgctcagtctgcctgacggattttgagcctgacgcacagataaaccatctgtcatgtggccatgttttccacaagca

SEQ ID NO: 2550 - DNA, 628 bp, Lycopersicon esculentum
  Predicted polypeptide sequence is orthologous to G2226
actcatattttagtctttcttgatgatggatgatgatttaccttggatcttcacattttattcaatattgaaaagttctggttttgggtgttttattacatgatttgtaatttgtggtctgagatttccttgttatcttgaaaagggttttttttttctcctttgtctatttacatttggtatcaggaaaatgaaattattacagttttttagcagaagtttttctggttcttggatccatgttcataaagatttgttttttcaaaggaataaaactgaacttttaaaggaagatgaggactttctaatcaatggggtttccatttcttgtttgagatgtgtaacatagctccaattttcatttcttgatgcttttcttggaggactgtgttccatttataattgtcttactgctgtgggttgtttaacttttcctcataattgacttatagattcttgtttctatgcaggtccagttcagtcagctgttccagaagttgttgctagtagaaatctctaagtttcagcctagattccatccagtatgggactctcacagtatccaactccagcagatgcaggagtgctctgtgttattctagtgaacacagccatatccatctccatt

SEQ ID NO: 2551 - DNA, 1482 bp, Lycopersicon esculentum
  Predicted polypeptide sequence is orthologous to G2520
ttttcaactgcacaaagagtctccctcttcttcttcttctctctctctaatggtggtggtcgctattatacgccagtaggtacagtacgcaccatcaacttccatttttgtacacacagagcttctatatatatcttctctcattcacatttcctacgtgaatgcctaataattcaccattcgcttcggatttggatcgggtattgaaatggatccacaagcttccatgatgaaccacgccggaggatttcagtctccgccgtttaatttatctgagatctggcagtttccgatcaatgcaggtgaaggtgagacgccgtatagttttccgttgtctacggcggctgcgccgcagaatgtgagtgatgatgttcggaataatgatcctatggttctagaccggagaactaataattacagcggtggcggcggtggtggtgcagctaggaagcgaaacgaggatgatgaatcagctaaaggagtttccactagcggcaatggcttgactgaatctgctagtaagcggatgaaggttacaagatcaaatgagaattgcgaagctagaggtgacggggaagggaattcagtgaaatctgcagaacaacctgcaaagcctgctgaaccgccaaaagattacattcacgtgcgggcaaggaggggtcaagctactgatagtcacagtctagcagaaagagctaggagagagaagataagtgagaggatgaaagtcctccaagatatagtccctggttgtaataaggttattggcaaagctcttgttcttgatgagataataaattatattcaatcattacaacaccaggttgagttcttatcaatgaagcttgaagcagttaattcaaaaatgccaagcatagagggatatccatctaaagatttcggacagcagccatttgatacaaatgctatggcattcagttcacaagctacaagggaatataccaggggaacatcaccagattggttgcatatgcagcttggtggaggctttgaaagaacaacataaatttgcatcagaaggttaataataagttcattggaaggttccctcttttggtgattgccagaacacaagaccagtccaggtttctttgaaagcttatatccagtatctttatcaagcacaaaattgttgaatgtctagtacagctgataaacagacaaccacgttttccacttcgttcgtctatcgtgttatacttgtggcaggcaccatataagtattcttgtgaaagtgcttgtttaataataggtaaagaattgggtgtattagtatgctgaagttgtagctaaataaagtggtctgtcccgtccttaaaaccattggtagatagcatcaagtcttgtaaatagggaaaatcagtgtttctgtgtttcgattgttcaacaagttaagacaatatactttataccaaatgaatgatgcctgcaagtttttggaaaaaaaaaaaaaaaaaaaaa

SEQ ID NO: 2552 - DNA, 1056 bp, Lycopersicon esculentum
  Predicted polypeptide sequence is orthologous to G2574
tagaactcaaagaaaatagagaagaaagaaaaagataaaagcttgtgtatgcatatggagactgttttcagaaaatcaactcatggaggtgtagtcaaacaggacataaagattaaagctagtgaagaaggttttgttgaagatataaatgatcttaaggttgaaaaggagagaaaatcaatacataacgaggacgataattcgaagtcctctcagcaaaaggatctcactggggacaaaaaggacgatcagctggaatcagccaaagccgatatggaagaagtaatggaagaaaatcaaaggctaaagaaacacttagataaaatcatgaaggattatcggaatcttcaaatgcaattccatgaagttgcacaaagagatgctgaaaaaactaatactgatgttaaacatgacgaagctgaacttgtttcccttagcctaggaaggacttcaagtgacacaaaaaaggagttatccaaattaattttgagcaaaaaagagaatgatgagaaggaagaagataacctaaccctagcattagattgcaagtttcaatcatcgaccaaatcttcaccatcaaatctcagtccagagaatagtttaggagaagtgaaggacgacgaaaaaggaactgatcaaacatggccacctcacaaagttctcaagacgatgaggaatgaagaagatgatgtgacacaacaaaaccctactaaaagagcaaaggtttccgtcagagttagatgtgacaccccaacgatgaacgatggatgtcaatggagaaaatatggacaaaaaattgcaaaagggaacccatgtcctagagcttactaccgttgcacggtagcaccaaattgccccgtaagaaaacaggtacaaagatgcattcaagacatgtctatattgatcacaacatacgaaggaacacataaccatccacttcctcattcagccacatcaatggctttcaccacttcagcagccgcttccatgctattatccggttcatccagctccggatcgggacccacaagtagtacagcctctgccacaacctct

SEQ ID NO: 2553 - DNA, 794 bp, Lycopersicon esculentum
  Predicted polypeptide sequence is orthologous to G2574
aagccttgatttaggattggattgcaagttcgaaacaacgccaactgaatgttcaccagtgaattatagtccggagaatagcttagatgatattcaagctaataaggatgaaaatgaagagacgtcgaataaaaatctcaagacgatgagaaataatggagatggagatgatgtttcgcaacaaaaccctactaaaagagctagggtttctgttagagtcagatgtgatgcccctacgatgaatgatggatgccaatggagaaaatatggtcaaaaaatagcaaaaggaaatccatgccctagagcttactatcgttgcaccgtagcaccaaattgcccagttagaaagcaggttcaaagatgtgccgaagacatgtcaatattgatcaccacatatgaaggaacacacaaccatacccttcctctttcagccaccgcaatggcttctaccacctcagcggccgctagcatgctgttatccggttcatctaattcatcagacccaaacccacaagtaactgccaccaccaccactacccctactaccactacttctgccaatatcaacggactcaacttctatctctctgatacctcaaaacatcataaatcgccatattactttcctaattcatccatctcagcatccgcacctaattccctccctacaattacactcgatttgacttccacctcgtcctcgtccccgtcctccttatctcatctaaacagaatgactcagaattttcctcctagatataattacaataacaataattccaccacaaacctca

SEQ ID NO: 2554 - DNA, 513 bp, Lycopersicon esculentum
  Predicted polypeptide sequence is orthologous to G2574
ctatacatggagaacaagaacaaagctgaatattatagtcctgatgatgaagatcgcgatatcgataatcaagaaaatattatccatcaaggaggtgctgttaatgttatggtaaagagagaaagatccccaccggaacacaactcaatggcttcttcatctactcacaaagaacaggacgatcagctagcatcagccaaagatgaaatgcgagaagtaatggaagaaaatcagaggcttcgaatgcacttagatcgaatgatgaaggaatatcgaaatctccagaaccaatttcacgatatcgttcaaaaagaaactgatcaaaaatcaagcagtactactgtcaacactagtacaacacatcatgatcatgaatctgatcaagaagctgatcaacttgtgtccctcagcttaagaagaactactagcgatatgaagaaagatgatttatctaaaatcttaaagaaagataaagttcatgacgatgaaggagttagtaataataataaaagc

SEQ ID NO: 2555 - DNA, 532 bp, Lycopersicon esculentum
  Predicted polypeptide sequence is orthologous to G2574
gagagttcgattttccacattgtaatccccttttccacaccccaaaattgtatatgaccttagatagaaggatatgaaggttgcggataaagaatatagggttagtaggtagttgagatttgtgttattattagcctattcacgtctttggttgggtggaaatgtagagctccgtgttggtcgtagtattagtatattcatgtagtctatttttttgtggaactaaaatatgtagattattgcgtgtaggtaatctcaccttgttgttgttgttatggtcgcactactttgctattagctatcattcttttattttaattacggcattgacttgcttggtggatctttcgaaaaacaacctctgtaactcggagaggtagtgataaggtctgtgtacactgtaccctccccacaccccactttgtggaatttcactgggtttgttgttgttgggagaggttgaattaagaagtccttatttggcatcgttagttttatagtatcactttgtggttatgaatctacttatgct

SEQ ID NO: 2556 - DNA, 538 bp, Lycopersicon esculentum
  Predicted polypeptide sequence is orthologous to G2574
caatggattctactaagaaggatgaagataagcctaaattcaaccaaaatgtgagatatatgaagcccaaagaagaaaatgaaaggctaaaaaggatgttatctaaaatgatgaatgattataaatctttggaaatgtattttcaaggcatattaactcaaaaaaataccaaagaatattattgcaaccaagtaataatattcatgaagaaaaagaacaagtggaacttgtttctttgagccttagggagaaatagtagtccttcaagagagttgatcaagaaggagttattatatgatgatcaaaataaaagtaataaaaaccatagtaaattattatttgatgggccttgaccttggattaggttgtaaattcactcaagaaaatagtttcgaggggccaaagaaggagaatataaataatgaacgacgagtattgataccaaaattaccttccatcggattactgtggcgaagaatttttgcagcaaattcctcaaaagaaggctagagtatctatccgggctgtgtgtgacact

SEQ ID NO: 2557 - DNA, 522 bp, Lycopersicon esculentum
  Predicted polypeptide sequence is orthologous to G2574
aacacataatcatccacttccagtaggtgcaacagcaatggcatcaacagcatgagcagcagcttcattcatgttagtggattcaagtattagtcctcttcttaatcacaattccaatttaaaccaaccacttaatttccctaattaccaccataatctagcacctaattaccatcactcttcttcttcttcaccttataataatttctccaatttaagaaccaatattcttaattctagtgatcctaataattcttcacaagggaacttagttcttgatctcaccaaaaatatgtcaaataataatcatcaattcccctttgcaagttcttcttcaaataatcatgaaattggacattctaattggatgtctaaattatctaattatgaagggaataaccttttttctggtcctaaattacaaggtgaacataataataataataataataataataatattcctcctatgttggctcatgaaaatatgagtgcaattgcttctgatcctaaatttagggt

SEQ ID NO: 2558 - DNA, 598 bp, Lycopersicon esculentum
  Predicted polypeptide sequence is orthologous to G2719
agatgaatgaaaaggcggagcaaaacggttacgccgccgccggcgaaggccatggcggcgacggaggatgtagtttggttgatgccggtgatgcgatgttgaacggaggaagaggaagtagagttagtagtggaagagtgaaagagccttggtcgccggaggaagatgcagtactgactgaacttgttaataagttcggtgcaaggaattggagtatgatagctcaagggatcgcaggtcgttctgggaaatcgtgccgacttcggtggtgtaatcagcttgatccggtgcttaaacgcaagccttttactgatgaagaagaccacattataattaatgcgcatgccgtccatggaaataaatgggccgcaattgcaaaattgctccctggtagaacagacaatgcaattaagaaccactggaactctacactaaggcgtcgatttgcaggggtatggagggttaaaccaatacgcagcatgatgttagatgatagtagcatttacaaagccagggcattatctgaagaaactatgtcatgtgaaggtgttaaccaaattaagcccctggaaatgctggaagttagtcgtacagagtg

SEQ ID NO: 2559 - DNA, 608 bp, Lycopersicon esculentum
  Predicted polypeptide sequence is orthologous to G2741
ggccttctccatttttcttcattcaacggcatctctctcaaattcgccggaatatactccaccagcggaagaagattttagtacttgcaaatactgttaccatgggtgaagaagtgagcctgaccgactatgaatcaagcggtggtaacgatgacagacttctctgggaaattggacttcccgatgtcgatgatctcacaccgttgaatatgcagttgattccgtcggaacttgctgctgcgttcagaatttcgccggaattgtcaaagacgatgaccgatgtaaatcgtgcttcgcagaatacgttttcttctctccagagatggcactcacaggatatggcttcgatgaataactctaatttcaagacgtttagctatgagaggagtagagaagagactgttactgaaagagatgaaacggatctgataagagagggatccgactcgaggaagctccggcgggttgaatccggaggcactgaggaggctgattcatctctgtgtaacgagaattttgcggatgattcgtctgctaagactctgaaacggcccagacttgtttggacgccgcagttacacaagcgctttattgaagtagtggcgcac

SEQ ID NO: 2560 - DNA, 508 bp, Lycopersicon esculentum
  Predicted polypeptide sequence is orthologous to G2741
caattatgcagcttatgaatgtggaaggattgacgagagagaacgtagcaggtcatttacagaaatacagattgtatacgaagagaatgcagccgaacgagggtccttcttcgtctgatcatttgttgacttccacaccggctacagagattatgcgtgagtccagtgagagtggtcacctccgcaatactaatggccacatggcaatgccaactctgatgccgtaccaacaacaaatggtggcgatgccaatgatggggatgccaaatggaggacatgtaggcatgcctgttggttacgggggtggaccgccacttgggtttcatcatcactataatgtggtgcaacagcgggattggtctggaaataattttggttactatcatcctgttgcttctaatgataagtagctccacaagctgggacctggatgatgtcatttgatcgtggaggaatcatggcaggttcatgaagtgttgttctctggtaaaatgtgggacaaatatga

SEQ ID NO: 2561 - DNA, 640 bp, Lycopersicon esculentum
  Predicted polypeptide sequence is orthologous to G2747
catgaatttcttctcagatggacgtggcttcaacgatcaaggcccattttctcatcctgatttctcccatcagcaaagaagcaccactaatagtagtgatatggcagatgaagtgggtgaaagtaacacgattgaacgagaacacatgttcgacaaggtagtcactcccagtgacgtcggcaagctcaatcggttagtcatccccaaacagcacgcagaaaagtattttcctctggattcctctaccaacgagaaaggcctccttctcaatttcgaagacacgaacggaaagccttggcgcttcaggtattcctattggaatagcagtcaaagctatgtaatgaccaaaggttggagccgcttcgtcaaggagaagaagctcgatgctggggatattgtctcatttcagcgtggagtcggtgaattgggcaaggatcgtctcttcatcgactggaagcgccgtccaaacgcccccgatcatctccacttcatgactaatcatcatctccataataacttgtaccgctctaatattcagtacccagctgctgcttgggatcgtcctctctttttgcagcctcctgaccaatcacatttacaatattccctgggacctgcacctggcagcatgtctcagcaa

SEQ ID NO: 2562 - DNA, 755 bp, Lycopersicon esculentum
  Predicted polypeptide sequence is orthologous to G2859
tttgattattcggttttgttgggggcagtagctcttgtgataagagtggttaattatcagtttaagctgtagttcatttagcatatgaatttggttgttttcaacttctacaatcagtatagctgcacaactcttgcgagtcttaaacttggatgaacttgctttgttgttttccactgtttaagggaagagcttgccatatatgttttagactgagcttaacctacaattttcctcattgttgtttcttgtttgattgaatcataagagttttgaatagattaattcattatgcttcgaatgtctgttctctcactctatttcttaatgcatcgatttttacttctatttcacattaaagtcgatgagttcttagctttgttctgagaaatattaaaatttgttaaagaatgactaaagtcccacatcgatggttaatgagatgggtggacggactccttataaaacttggacaactaaattcttgtcccttccctatatctgtgccttgtcttctcatatcatttattcccatgattttcttatcagtgttccatgttgctagtttctatcggaatttggaactaattcttatctgtttttgttttgttttcttaccaaatcccttttttgagtccaaatagattctgtctcgatatcttgcacctcccaatggttcatatttctcgagtcagccccatggcaaattgtgaaagtcggtgacaggtctttggaagctgatacagggtttcgca

SEQ ID NO: 2563 - DNA, 542 bp, Lycopersicon esculentum
  Predicted polypeptide sequence is orthologous to G2885
ggggattcctgcatctttggagcttgatcaactgcagcagagcaagtgtgccacacacataggagagttgaatcctttggatgagtcaggactgcatacagtggccagtacattcacgaactctagattggttggtagcgcaaacagctctatgcccaatgtatcaaataatcctattttgcttcaagtaaattcccagcaaccactgacggggatgggatttggaaatcagacttctctcaacgtagcctcttttagctctgaggccttcaatactggtgtaagtggttcttccaattttctggaccatgatagatattctaacgagaattggcaaacttctctccagcctctgaagttccagtcaacctcctttccgttaaatgaacctttcagcaacagccatttgcctcaagacagagtacgagacaatgatacttcaactggccctcatttgcagaacaatcctgttgatttttcaacctccaccatagtttccgtacctttcgaagcttcaagaggagaaacacaatgccgtgaaa

SEQ ID NO: 2564 - DNA, 561 bp, Lycopersicon esculentum
  Predicted polypeptide sequence is orthologous to G2990
gcataaacaaaaacctaaaaaacatccttcatttctttttcatccttttgtcttctcacttactaaagtccccctttcattttttttttcttccttcttattaacctttttttcctatgaataaagataattctttttatttttttttggtatgaaatcatcttgaccttaaatttaatcatctactaactcttttaactcaaaaacaaaaaaaaagaagataaaaaagagtgttagatgtttcagccatggagttaaccaacaacaacaacacaactattagtactattactactactactacagtgaaaaccccagaagctgaaattgaaaccccaactcagatccagaaactgaaaccttttccttttagtaatggtgttctgaaaaggaaaagttcatttaaccataacaatcatcatcaccctgttgtggttatttacagagagtgtttgaaaaaccatgctgctagtttagggggtcatgctgttgatgggtgtggagaatttttgccgtctcctgcagcgaacccatctgacccaacttcactgaaatgtgctg

SEQ ID NO: 2565 - DNA, 639 bp, Lycopersicon esculentum
  misc_feature (591)..(591): n is a, c, g, or t
  Predicted polypeptide sequence is orthologous to G2990
caaaaaccaagatttttgttatctatagtcataaactctcatcatcatcaaaactcaaaatcccaaagaaaaacaaacccactttttttttttcttctctttcttaacatgctttttcttttcattttcttaatcatctaagttctaagagtgaggggaaaaaaagaaaaaagataagtagtagatgtgtttcaggtatggagttaaacataaacacaaacacaacagctgctattactaccgtgaaaacaccagaattagctgaaactgaaactccgagtcggatccagcaaccgaagcctttttcgttcagtaatggggttttgaaacggaaaaatcatcatcatcctgttgtggtggtgtacaaagaatgccttaaaaatcatgcggctaatttagggactcatgccgtggatggatgtggagaatttttgcctattccagctgcgaacccagctgatccaacttcactaaaatgtgctgcttgtggttgtcaccgcaattttcaccgccgtgaaccggaagaaccgccgcctatcgctaccgcggctattgagtaccaaccacatcaccgccatcatcctccgccgnctcgtggggaccacggtagcccgaattcaccatctccaccgccgattt

SEQ ID NO: 2566 - DNA, 724 bp, Lycopersicon esculentum
  Predicted polypeptide sequence is orthologous to G3032
gctcctctctctcttccctcccgtctctcctcttcccgttcctctcctctctctcttcccctcccatctctcctcttcccgttcctatcctcttccctttccttttctctttgcaggtagcagcaaccggcgacagccaccacgcagcagcagccggcgacagccaccagcagctgcaacaaacagcgcacgcagcagcgaccaccggcgaaaccaggagcagcaacagcttcttcagcagcccagcgccacccgtctctcctctcttccccgtctctgcctccctcccccttcttttaccttttctctcttctattttttttaaaggaccagcagcagcttacatcggccagcagcagcagcgacaaaaactataaagcagcgacctcctatgtcgcgatatctccggtcaacgagcaaggcgaactccggatgaacccattgaaggctccaagttggtcgaaagacggatcttttaacagattcgtcaggtacattcttacagtttgttattttatctcttgaccaattcattatttaagttgtggtataacctttggtttaacaattatttgcaccgtttagtacatataaaaatcattttagtcttcaatttgaattgctagttagaatgacaaggttttttttttcatgtttgatttttttttgatactttgattgaatatagtcattctgttggctcagtggtttagttgatgcaaaa

SEQ ID NO: 2567 - DNA, 664 bp, Lycopersicon esculentum
  Predicted polypeptide sequence is orthologous to G3044
gggaagagagagtgacattcccgcgcaagaagaagaaggagagtggcaatggcttctccttcaacttgtcaaactcaaagggttgaagagaagaaggaacccaaaagcagcaattcatcgaaatcttgttttcagccaacagtcagtttgaaagattggtggcttattagggctgaaagagattctcaaggaagaacccttgccgttgctgggcgcacttctcgagagtgaactttctcttcctattttttttttaattgctttcaaagttttgttgcaactttgaagctcccatttggccatagattttgtagttgaagcattgagaattttagtttttcaagttgtggttttttttttcctagaccccatttgtgggattttattgggtatgttcttgttgttgtaaagttgtgtttttgaatattttaagttgtgtttggatatacattttacttggaaaaatctgatgtttttggtatttaaaaagatttgaagaatttgatgaaattttgcggttacatagatatttgaagataaattttcaaaatgtactcccgaaatgtactgtcaaacgctagcttatagttgtttttacgtatttggggttctgtgatttcggatttactatgttgtcatgcaagtttcttggtcaccttggacc

SEQ ID NO: 2568 - DNA, 656 bp, Lycopersicon esculentum
  Predicted polypeptide sequence is orthologous to G3044
tttgagaaatcttgagggggggttctgttctttactgtgacttagggttttttactttaaatgagccatttatggttgctgcaagttaatgacttgttcaatttactgctcttttgagctctttgttgaaatgggtttgtgttttctgggacattaaggaggtggggtggggactttttttgtgaatttgaaagcattgattgttatttcttgttctgtatggactttttatatttggggcttttctagttttgagtgaatcttctggtagacatagtttgttcacctgaaaagtcttgcttttttggatagtttgaacacatgtttggttgtatggtctttcttgaggatagttaaatgcataaagatgaaaactttaagttcccagcatgttgaatttcaatgttttaggttgttttcttgatactcaagtgctgtggtaaaagaagtttggttaagttttttctatacttggaaaaatatggatatagaaatcaagaatgacagtgaaccagaaaagaggagtcctgtggaaagaatattggctcaaagaaaaggaaaagaagtggtcaggatactgaacctgatcaaatgaagggagcacagcagccaccatcccgaaattcagaaaaggggaacagaaacttgaatcaatt

SEQ ID NO: 2569 - DNA, 1660 bp, Lycopersicon esculentum
  Predicted polypeptide sequence is orthologous to G3061
ccgactatagggagaaaagccgtgtgagataaggaataaaatggagagagaaaattattgtatggtagtagttttttaggtgctaaacattgaagcagaaaacctctgtaagaaagatgaagaagaaatagtctgtggatggaatcttgtagttgtaaccattgtttttgtctagtttcctgggaaataaaaccttatactgtgtaaacttgggatttagctgttttcagcaaaatctttggtttcttctgaaagctgagctgttctatttttgtttttttggtaccttattctcacttatactcatcatctaccttcttctccaaatctcacctatcaaaaatgatgtcggatgatggactttcttcattagctttcattcaagatccaaactcaaaccctactaataataatccaaaccctaactcaaatccatctgctaaacgaaaaagaaatctccccggaaagccagatccagatgcagaagtgatagcactatcaccaaagtcactgatggcgacgaatcgattcatatgtgaaatctgcaacaagggttttcagagggaccagaatttacagctccacagaagaggtcacaacttgccatggaagctaaagcaaaggaacaaaaatgaagtgatcaagaagaaagtttatatttgtcctgaaaagacgtgtatccaccatgatccatcgcgagctctgggagatttaacaggtattaaaaaacacttctcgagaaaacatggcgagaagaagtggaagtgtgagaaatgttccaagaaatatgctgttcaatctgattggaaagctcatactaagatttgtggcacaagggaatataaatgtgactgtggaactctattctccagaaaggacagctttataacacatcgagcattttgtgatgcgttagcagaagaaagtgcaagatttacatcagttccaagtacagcaaatctgaatttcataaatgaaattttgctgaatgggggatttggcaatactaatcttcagcaaagtactggaaatccccaatttggttctaatttgtttaggcctgaatttatgggacttggattggaccctgcaattagtcatcatcatcaaccacagctcaataatgtggatggacaaaaaccaaggataccactttggttggacaataatatgaacccgaatccaggtaatgatttcttagtagcatcgtcaagctctactactagcaatttgcctcatcatgaattggtccaaatcgccgcacataacaatactcaacaatggttcattaatggtactggtgttggtgatgattctggaattggctcatcctcgtctcaacttccttcacgagtattgctaaaggaggaggaagagaacaaaagaaatatgtcggagacaataagttcaatgtactacaacaatcatcacaacgaaacaacagcaccagctactcatatgtcggctactgcacttttacaaaaagcagcccaaatgggatcaacgaggagcaattcagccctctttggtactggattcgggctaatgggctcgtctttttctaaaagcaatggacaaggacaatttgctactcatgatcagaattttaacggtttaatgatgcactctccgaataataataatagtaatcaaggaaata

SEQ ID NO: 2570 - DNA, 366 bp, Lycopersicon esculentum
  Predicted polypeptide sequence is orthologous to G3061
tttttttttttttttttttaaaattaatctgattttcagataactacaacaaaaaagttactaactttatgaatgaaccttaaaaaacttcccttctccatcaaacttggaacatttttttttataaaagattcagttgcagaaaaaaaaacaagaaaactccactaaagggaacacaaattaaaatactttaacccaatgtataatataccttggaaactcaaaaataaaaccaaaaattgtgcaaatcccacaatttacatcaagaactcataaccccaattcttgttttttgctctttaatctgaaaaaaaacatctaaaaattagagggataagagatttttgttacatagttttcaatctg

SEQ ID NO: 2571 - DNA, 633 bp, Vitis vinifera
  Predicted polypeptide sequence is orthologous to G2
ggtcatttgaagctgattggcggagtcggggcttcagacctaagttcaacctgcagcaggaggcgtgtaaaagcgatggggatgccctccggagaaatggatataatgaaatggaaaccatgcagcttctgagccacacccacctacaatcgccagcggcattaaagccaggtgaaatgtacagatatgggcaattcagaagagctggagaaacccagatgcttcatatacttccgccacagctcagctcaccaaattatcagattcagtttccaagcagcagtaacggaggccgaattgctgtcaacggaggagatctctctctggccacaaaccatcaacaatggcaatccggtcccccacaattgtttgcaactgctgcagcatcatcaggattcccaccgcagatgattagacccaaccaacaatggccgcagaaaaatgggttccactctctcatcagaccctcctgacccatacaaacaattcttcttttttttttttctttccaatcttttttctcttttctgcctcagccatcacctcccattttccattctttttcaagccccaccataccatgtaaaaagaaaggaaatcagtgttgtgtacgtggctgtctgtcttctacct

SEQ ID NO: 2572 - DNA, 619 bp, Vitis vinifera
  Predicted polypeptide sequence is orthologous to G2
ggttgattgctattttcatttttctgcctgggtttattacagtatttccaatgcacatatcggtaaggaatagataagagttcagtgggatttgaatgatgtattgttaatttttgtagggcctatgacaaagctgcaattaaatgtaatggcaaagaggctgtcaccaacttcgatcccagtatttatgaaaatgagctcaactcatccggtgagtaatggaaagatgaatcgtttcacttctctagtgatcaacagtctctttatgcattggtgtgtattcaattagatcatgtctggcacaattctcaggtaatgctgcagatcacaatctcgatttgagcttgggtggctccgcatccaagcagaacaatctggaattgggggatgacagccaagttgttacaatggatcagcattcggtggggatgtcatttgaagctgattggcggagtcggggcttcagacctaaggtactaaacagatttgattctttcagctggataattaggtgttataagctgtgcatattcagtcctagatggtgatgttctctacttgtccatgaaacctagttcaacctgcagcaggaggcgtgtaaaagcgatggggatgccct

SEQ ID NO: 2573 - DNA, 822 bp, Vitis vinifera
  Predicted polypeptide sequence is orthologous to G8
tttttttttttttttttttttttttttggaatgaaacgaaatggagtgcttcaagtagaagtaccaggtacactgttatgatcagtttacatggcttcatattaaacagaaaacaagcacagaaacgactctctaattggttttgctttccagcagggtcacttcctaagcagaaagaggggaaaaaaattatcaaaactgcatctgttgacttgagctcccaaaattgtagaagcaacttgtactgttggtggtggatgtggttggtggggagatttgtggaggaggctgcagggcaggattaatgttcctgggatttaatagtggaagagttgcagagggaccaatggtggagcaagaagggaatcctgatgatgctgcagtagacaacagtgggattgggatattgacaccatggccatacacttgccttgcccagtttgagaatcttggtgaagaaaccccttccaaccttttctccagggctgtttcctcgtgaattggtaagaaactagtgcatatgccggatatcatgggaaggtgcttggatactgtggttagactatggcggggttgtccaccaactagtgtgtaagtggagccctcaaccatggatctcctcccaactgcgtcatttcccctaggaccatcgggagggaaagaaagcccaaggttcaaatcaagattgtgcccactgcttctgtcattggcctctaagattgccccttctccataggaacttgatacaaagatcgggaccgcttcccttccatcgtatcgatcagcagctttgtcatatgcccttgcggcttctatttcgct

SEQ ID NO: 2574 - DNA, 745 bp, Vitis vinifera
  Predicted polypeptide sequence is orthologous to G8
ttttttttttttttttttgaagttcaaacaaggcaaaaatatctaaattggctcatcccactcaggctaaagcaccctggtttaacaggcttcataaaagagaaggatcaatctaatgtctcatatctacaaccacacttcaaaattagaatatatgaattcatttaccaatcttagtttgctttgcttgcctacccacctgctttcaatgcaaatgagaagatattgaattgtggctgtttctgctggtagcttgtttcagctcctgcagtagtagtaaggggatatactggtggtgttggggagtgatggagagtaatagtgctggagaactgttgtactctgtaagctgccttgagtgggattagctggtgaagcagttgtaaccgaagacaagaatcctgatgatgctgcagtagagaagagaggtggagtagccccaccataagggccatgaatttgccatgcccagtttggcaagtgatcaacttcaatcctcttctctattgctctttccttatagataggaaagacacgagaattttcaccactccagataggagggtgatcagatgccattaccaggccatatgatggatgaacccccagtgttgctgaagtagagttctcaatcctttctcccctgtcatcaggcatggcatcgtggccctgctgggaaggagaaccatttgctttgctgttcctcactggatcatcagacattggttcatcagaaaaatatgga

SEQ ID NO: 2575 - DNA, 846 bp, Vitis vinifera
  Predicted polypeptide sequence is orthologous to G12
acatgttttttttttttttttttttttttttctaacataaaaaaaaaccaagtccatcatcaaataactaactatagccgttaaacatccctttgttgggttgggttgttacatctgacaaagtgatgaaaaccaaagagtaagcagctttgcccgtttgacataatcctttggattatagttccagtttcggattacccagcaacaattcctttgtttttctcttcttccatggttgcagaagaaagagatgggtaatagaggggaacacaagatcataagttcatgatctgtgggtttgagatagctgtcaatcatcatctgaactttctgggctagggtactcgttcaagtcgggtttgtcggagactctgctagaattgggttctgatgcgtggagggcggtctccatggcgtcaaccctagctccgacttcggtggctttctttcgtatggatgcggcggataagtcctgaacctcatcttcttccgctatatactccgggaagttgaggcgagcagagcggccccggagacagaagacggcggtgtcataggcacgggcagcggctttcggtgtggagtatgaaccaagccatatcctggacctcttgttgggttctctaatctcagccacccacttaccccacttcctcatccttatacctctgtaaggcttctcttgttgctgcctctgcttccgcttctctgtggtcgcacaacacttgccttccatcatcacaaccgacctttgttctgtgccccaaacagccccaagctaaaaaccaaaaccagaaaaaattctatctcccccggccgtatggccgaattcccggtaccacacat

SEQ ID NO: 2576 - DNA, 790 bp, Vitis vinifera
  Predicted polypeptide sequence is orthologous to G15
ttccgtggggtaaatgccgtaaccaactttgatataacaaggtacgatgtggagcggatcatggcgagcaggaaccttcttgctggagaacttgctaagcgaaacaaggacatggaatccaccagtgaggctaagaatctcaacccttctgttcataccagcagtggggaagccattctctcccaggataacaatcaaagtgaatcaggatggaaaatggtgctctatcagtcttctcaacaatcgaactcctgtttgaaacagcttgatcagaagccactgagttttgatcattacagagccccatcttttccggtggccccacacaatctgatggggacggacgctatgggtccagctcagcaagaggctgaagactcggccaagatggggacccacttgtcaaatgcttcctcattggtgactagcttgagcagctcaagagaaggtagccctgataaaaccagccttcctatgctctttgcaattcccccatcagcacccaagttcttcgccactccagcaaatactgtgaattcctggatcccatcagcccagctgaggcctgcaatccccatgcctcacatgcctgtctttgcggcttggactgatggctaagaaacttgtgttttggcaaaactggtaaaagtttttgcattaacaaaacatgggtggaaagggaaagggaaagagaatggtttcatgttggttttttctgaattactggtggaaattggggggttaatgggggtcaagggtgggacctattgtgaacatggttcaaaatttt

SEQ ID NO: 2577 - DNA, 648 bp, Vitis vinifera
  Predicted polypeptide sequence is orthologous to G15
ttttttttttttttttttttttttttttgcaaaatcttcattccaatatgagccaaaaggttgagtctgaaaaagttgccaacactttggttacagacagattactggcccctacccttgtctttttcattcactaataccataggaaaagagaaaactaaagtaaatttctttttaccaatcccccccttccacccctcaacaccacgattttctttcccccttgtccatgcaaaactttacatgtttattacaatgaagctttaggtgtcattccaagcagcaaaaaggggcaagtgagccatggaaactgcagcagtcctcagctgggatgttgggatccatgaactgagtgcgcttgcaggccccatcaattttgatgctaatggaggctttgcaaacagcattgcagggccagttttatctgggctagcttctcttgagctgctcaagctggtcaccaaggacgatggattggaaaagtgcgtccctagtttggtcgattcatccccaatgggctggcttgtgttcactgaatcaatcccaataagatcttgcaatgccattgaaaaagaggtggtcctgtaccctccaatgctcattggtttctgttcaagtgattccacacaactacttggctgctgcccc

SEQ ID NO: 2578 - DNA, 774 bp, Vitis vinifera
  Predicted polypeptide sequence is orthologous to G15
tttttttttttttttttttttttttttttggtaattttctaacgggaagttgatatgagtagaaggtccccagtatttgagggccgccagatcgtaagctcttgcagctttctcttccatatcatacccccccagataaacttgtcttcctttcctagtctgcccctccttcttgcaactattatcccaaagatgggcttcatatctaccagtccatctatgccttgtaactcctctatattgtgaagtcctctgcccaaatgtgtcaatggacttcctatgaactggttgcttttgtgcaacctttccggacccccttttctttgtttccatggccacacactcagctccggtaggcgagatctgtcttggagctgtcacacagcttgactgagaaccggggctcatggacaagctgagagactgtaaatccccacaacccatagctccaatagacccaggagctcctccgtcatcaacgatgctgttgttcatctgctgctctagtgcatggtgagtcgagtagtgccttgcaacccagtttttcaggcaaggcattccatcctcccccataggagggatctgggtatggcaatctgcaagttgggtttcctttgtttcttcttctaatgggttctggtaaatcccattgcaggcaagtccagtgaaatatgggtggtgttgaactggaatttgttgctgaccttgttgcctaaaggattcctgaagaaggtttagagaatgttgcctactggtttcaggttccgcattttg

SEQ ID NO: 2579 - DNA, 757 bp, Vitis vinifera
  Predicted polypeptide sequence is orthologous to G201, G202
gcatataattttgtgggagttggggttgggcctggggaatggaagggtttgttggtagtggctacaactccagtgaacaaaacaagcggtggaactttgaaaatgcatcagattgaattgggaaatgtaaaggatgggaggctccacgaatgaagttttgcgagatactgtaagtccatacctacaaagcaattgagccaaactaagacaaatctgctagaaccaccagtccaagtcaaccctaaatcctttaggaggacgagacttctatatagtacgcccattgcttatgggattccctctcttcctcctgctctctctctctctccccctctccctctctctccctctctatctctctcagtcatatctctggagttggatgtttgtatttatatagagaatttcaatgaggaaaccttgctgtgagaagaaagatacaaataaaggagcttggtcgaaggaggaagaccagaagcttattgattacatccaaaagcatggtgaaggtagctggcgctcacttccacaagcggcagatggtccctgatagcgggtagattgccaggaaggactgacaatgaggtgaagaattactggaattctcatctaaagagaaagctcataaggatgggtatcaatcctgataagcatcatgtaagacagtccatttctcgtcaacacccggaaacacctcatggcaaaaaggatcagttatccaacgatgcaactttcctagtcaagaaaacaaaaagaa

SEQ ID NO: 2580 - DNA, 652 bp, Vitis vinifera
  Predicted polypeptide sequence is orthologous to G201, G202
tttttttttttttttgtttcctggttgtatatttcatggaagtagctttatttcatttcttccatctttgcagggaaacccgtaatggcaagaccacggccgaagagattggtatggacccaagaagaagacaaaaaactcaaacacttgaagacagaataccccaatctatcttggagaaagatcgtacagctagggaagctggacagggatgaaaaaagttgctcacataggtggaggaactacctgcaccctgatatcaacaaaggggaattctcccaagaggaagatgagctcatcatctttctaaagggcgctgatgtgaggtaattaataatgatatgatatgatatttgtgtggtgatcagcttgaatctgaggtaggagttcctgtggtaatttgcagatgggcatctatgccgaaatatgttcctaggcgatctgctaacgctatcaagaaccgctggaacaatcacttgaagaagaagaatgcaactatagatgaccttgcttatttgattcccaaccttgatccaaatgcaattcgtttgattgctggacccaacagctgaagaaatcgccaagttaagggtaatgagagtcctaagtacatgtctttgaagctagggaaacaagagtccaactacaacct

SEQ ID NO: 2581 - DNA, 802 bp, Vitis vinifera
  Predicted polypeptide sequence is orthologous to G214, G680
tttttttttttttttttttttttttttgcagattagaatgaacctcattttgttttattatatagaaatattaccaagcaataagaaacaaagatatatttatacaataagcataaagttagaaggtatcgattgacctttgaaaagaatttttgtgcgtgacttctgatttgcacagcagtctttgttcctatatgttcttctatacgttgccaagctcgcccataaagcttcaaggcctccagaaacctattatgctcctcctctgtccatcgctcccgctgcttggtaatagtatacggtttccttgtctgatgttgaccaagattcataactcacattttcatcgtcaaaacaatagtttcaagtcattgtacagactgattcaagaattcagcataaaagaaaaataaataaaaaaatttcctatgtaaaatcaccttgataatcaagtcctctccagaggaatatatgtccattaccgaacctaggcagcttccgctgcttcagattaccgaacctaggcagcttccgctgcttcagattatggagcctgacgaacgaggaatatgacaacctcctttcatctcttgatgtcttgaatactacaaatagcctagccgtctttgtcaatgaaacctgataaagtaatgctacaaaacgaatcgtaggacgccaaaaccttctataaaacccggtatcctccgtttggttgccgagaaaacttccgcaaaaggcatggcggacgaaaattctgtctggtcggatctcttccccgatcctgcatggactcaattcatcg

SEQ ID NO: 2582 - DNA, 874 bp, Vitis vinifera
  Predicted polypeptide sequence is orthologous to G214, G680
atcacaactggacctagaatgctctgaagctttgcaagcacaacattcagcatctaaatcaccagccatatcatcttcagactctgaggagagtggaggtgcaaagccaaatactgagtcaactgctcctgataatgagaaaaacactacagcagtaactgagctcaatgatccgaccaagatgaagagtagaaaacaggtggaccgttcctcgtgtggttccaacactccttctagcagtgaagtagagacagatgcattagagaagcatgagaatggcgaggaagagtgcaaagaagctgatgtaaatcaggcagctggtgaggctaacaatcgccgttgtagaagcaccagcatccttaatgaatcctggaaggaggtctctgaagagggtcggctggccttccgagcactcttcagccgagaagtattgccacagagcttttctcctccacatgatttgaagaataaggggctccagaataaggatttcatagagaatgagcagggtggagatgagaaacatgaaaatgccttgcagttagacctcaacagcaaggcatggggaccttgttccagtcaccaagatgtggagaaaaatggattgatggaaaatgacaacagagaagaagggctgctcacaatagggcttgggtatggaaagattaaaggtcgtagaacaggatttaaaccctacaaaaggtgttcagtagaggccattgatagcagggtcacaaactgctgcagccaaggtgaggaaaaaggccccaagaggatacgcctggaaggggacgtttcaacctgatatttcataatgcatgcaaatttaaacggaggaaaccttcgtagctgcattcaatttctaatttttccc

SEQ ID NO: 2583 - DNA, 581 bp, Vitis vinifera
  Predicted polypeptide sequence is orthologous to G261
acatgttttttttttttttttttttttttttttttcgttgaaatcatgaaagagccaaaaagttgataaatgatggagacaccatcctacataagatcatgtgtacagaaaagataactcaaataatatgtctattcactgccagatcaaaaatcaaacgtgcctaaatttattacaccaaactattgatgcatcaaaacttgaaaaagaattgactaacatcaagttctctctgctggagtaagctgtcccatttgatctgcaagcttatttgcactccttgcattccaccaaaacctgccatgatcaccaggcttcccttcattcttcctgctttcatcatcctttctttctaactgaacttcctctgctgatgaaccaggattctcagtgaagaactgttcccagaatacgtcgttgaccccagttggaacaggagatgcagctccaactacttgttcttttaaggtagtaacctcaggagcagtagcagcgggcttgcaattcatgtcaatcccagtagatttagacctagtatcaatattaagttgaatgtaagatatacctggactttctgcccc

SEQ ID NO: 2584 - DNA, 372 bp, Vitis vinifera
  Predicted polypeptide sequence is orthologous to G261
ggcgacatgtttttttttttttttttttttttttttttcgtcaagaacctggcatgcaccacaacagtgagggctaaaacttgtagtctgtaactataggaccaaggtaatcatacctcttagttaagttaatatacaaccagccactgagacctagtgttaaatgaatggaccaacattaagttctttcagatgaagtaagatgacccatttttttagtaagatgatctagattatttgtatcccaccaatatttcctgtggtcatctggcttactgtcacccttgccgccatatgcttccctccgttctgactggacctcctgtgcatccgatgaaccaggtgtctctgttaggaattgtgcgcggaaga

SEQ ID NO: 2585 - DNA, 614 bp, Vitis vinifera
  Predicted polypeptide sequence is orthologous to G280
ttttttttttttttttctttttttttttcccatccaaagctacttcattttttctaggggtgaaacagggaaggaaaaaagcaaaagcacaaagcgattagcaaggaaaatgtaatcagaatcagtctctttaaatcctttttaaagagaagggggtggaggagagagagggacagagagagagagataggccaaagccttaaacagccgctgcacaatttacatgcaattacagacacccactagcttacaacactcaacactgaaacaaagaaaaaaaaagattgaaaagctaatgaagagaaaccataaattagagctaatatacctaaaaaccctactctcagtttcaaatcaacacccaacaggaaccaccgccggcttcacctttggcggccgtcccctgggcctcggtgccccagtcgccggcgctggggctgacgaagttcccaccttgggcttctttggagggcgtccgcgtggctttccacttcctgaggaagccttcttcggcggagagaccggagcaaatggatctctgggctttggcggacggcccctgggcctcggcggcgcgagaacggttcctggaggaagaggaaccttgggcttgg

SEQ ID NO: 2586 - DNA, 888 bp, Vitis vinifera
  Predicted polypeptide sequence is orthologous to G481
tttttttttttttttttaatcctccaaaacaaaacataataacaagtcctcttctgacatacatggcaccagatgacaatctgaggtataatattagctgttgcttaatcatccaaaacgagcaaaatataattccaggcgtcacccgccttacatggcagaagatgaaagtctaaggtatcatatgcaaacccttctccagatattgcagtctgccctcaaatatgcctagataattaaacggcaaagatccagttctacaatatcgggctatcccagctgttctgcagtcaaaattctgaatcattgaattggtaaaagagaagctagagtctcctactcgctactctgcacgggagatacaattagatgctgcccctgtgcctgggaattcatatagttcattgcttgcgtaaaggacccctgatgagcaaactgtgcatttggaccaggttgacttcctattgcatcccttctagcagatccatctccacctctagcagatcccctggtatcaccctccagctctctatatctctgcaggtacacctttagtggttcaatataatcttcaaatcctagggtcgccatcgcccaaagcagatcatcaccattaatcgtctttcgcttctctttctgacacttatcactagcctcgctggtgatgaaactgatgaactcggagacgcactcttggacagtgtccttcgcatccttggcgatcttaccattagccggcaacgccttcttcatgatgcggctgatgttggcgatcggaaggtaccggtcctgctcacgaacgttgtggcgggggctctggtccccgccgctttcgtggctgcctccggggggactcgccggacatctgcatggtcgccggaacctctc

SEQ ID NO: 2587 - DNA, 589 bp, Vitis vinifera
  Predicted polypeptide sequence is orthologous to G481
ggttgaaggtgtacctccagaagttccgggaggtggagggcgagaagaccgctgtgggcagacaggtcgagaaggacggcggcggctccagcggggacggaggtaatggcggcgtagtaaacactggaaacttcggaagtgggtacggtgcgatgcagcagacaatgatgatgatgggccaccaccagcatcatcaaggacacgtctacggatcagggtcgtatcatcagatgggtagcggcagtagacctacctccggtggttctagcagtggtggcggagccgccaccggaagacccaggtagatttatctgttgtaacttctaagtgatatatatgagtttttctttaccagattgatgtggattatgaagatgaagatgaagaagtagatgaagacgatgatgggttctgtatgtgaggatcacaggctatgttcgaatacattcttttctggagctactgcagctagctggagaaggggatggatgaagaaaacactagctacagcccttgctcttggtttttcttcttctttttgtttttttctttcctttccagtttatttcatatataaattgtaaatccc

SEQ ID NO: 2588 - DNA, 821 bp, Vitis vinifera
  Predicted polypeptide sequence is orthologous to G504
gtttttttttttttttttttttttttttttttgcgaatactgctaaccagactatatatccaaggatgtctatggcctcacccgaaaatattagcagctaactgttacagtactgagaagaaacttgaggccatttatggagtccctagcgctcttccctgacaatcaaaaactcaaaatacacaaaccaactacactctatatctaaccaactgtatcgatgacaatcggagtatatatatatagaacattggctagctggtgatagtctacctgggataatctctgattttgattcaaatattatgtatagttatgctcacaatccgtaaccgcaaccgagctaagcataccaattcatgccagggagttgaaagggttgccggaaaacgccttcgccaagagaccccagcattgactgttggtgcaatgaaggagtctgcggaagctggctgagcagagtggcgatggaattgttcccatcagttgttctaccaatgtttccatctgtgttttcggcttggaacctctttgtcgtggaaggaccggcagtatcatcgtcgttccagtatagagaagggagcgttcgcttcagagggaggatgcttgatgttgtggctgcaaccaaggagaggtgatccggctttgagcttgagcaggccagctgagaaatagtgccggaactgttgataccatcgctgtttatcatcccttcaaacaggctctgctcattttctagcaatgcactgtagtttgggacctttgggaaactgcagtttcaggctttgttgccccatcgagatcgaggtcggcaccggccc

SEQ ID NO: 2589 - DNA, 672 bp, Vitis vinifera
  Predicted polypeptide sequence is orthologous to G559
tttttttttttttttttttttaacgagccatataactatatatcatatataatatataacccacagttcaatattcaactaaaattaaatataaatgaaattaaatacctaagaaagaaggtcatatagatgtctagaagggataaacaaaaaaccaaagatgtcctatctgacaacagactgaaacaaggattttgaacccatactgaccctttaatacctagctgctgactggcacgttcctcatctttcgtttgaagcggggctatgatgacacatgcactttcctttgttctcagagaaagatcaaaaaaggacaaacaaaaaaccaaaggtgtccaatctccggagagattgaaacaaaattttgaacaaacactgacccttgagtgcccagccagctggtgcattcctcttctcatcattctttcacagcagaagagttggtgtctgatgcattttccttctggctcggagaagccatagatcctcggattttcagatctccagcttgttgaggctgttcctgctgcatttgttgctgctgaatctgctgttgaatctgctgctgctgctgctgcagctggtgcagttgatgctgctgaagctgatgctgcttatgagatgaatctggagctgctgaactgctgtgcagttaaagagtggcatggc

SEQ ID NO: 2590 - DNA, 1106 bp, Vitis vinifera
  Predicted polypeptide sequence is orthologous to G663
ctcgatgaagagcttaggagttagaaagggtgcatggacccaagaagaggatgttctcctgaggaaatgcattgagaaatatggagaaggaaagtggcatctggttcccctccgagcagggttgaatagatgcctaaagagctgcagattgagatggctcaattatttgaagccagatatcaagagaggagagtttgcattagacgaggttgatctcatgattaggcttcacaatttgttggggaacagatggtccttgattgcgggtaggcttccagggaggactgctaatgatgtcaagaactattggcatggtcaccacctgaaaaagaaggttcagttccaggaagaagggagaaaaaaaccccaaacacattctaaaaccaaagctataaagcctcaccctcacaagttctccaaagccttgccaaggtttgaactaaaaactacagctgtggatacttttgacacacaagtaagtacttccagtaagccatcatccacgtcaccacaaccgaatgatgacatcatatggtgggaaagcctgttagctgagcatgctcaaatggatcaagaaactgacttttcggcttctggagagatgcttatcgcaagcctctggacagaagaaactgcaacacagaaaaagggaacacattctaaaaccaaagctataaaacctcaccctcacaagttctccaaagccttgccaaggtttgaactaaaaactacagctgtggatacttttgacacacaagtaagtacttccagtaagctgatccacgtcaccacaaccgaatgatgacatcatatggtgggaaagcctgttagctgagcatgctcaaatggatcaagaaactgacttttcggcttctggagagatgcttatcgcaagcctcaggacagaagaaactgcagcacagaaaaagggacccatggatggtatgattgaacaaatccagggaggtgagggtgattttccatttgatgtgggcttctgggatacacccaacacacaagtaaatcatttgatctgatttagaccattgttatcttaatgtttaagttcaaaagttgttcttgcattcaaaaaaaaaaaaaaaaaa

SEQ ID NO: 2591 - DNA, 850 bp, Vitis vinifera
  misc_feature (799)..(799): n is a, c, g, or t
  Predicted polypeptide sequence is orthologous to G668
ggacgcttgtctcccattaccaaagttgaaacgctaaggaaaagacctttgtctggaaacccttccacaactcagagagaaagaccgaagagccatggggaggccaccttgctgtgacaagatcggggtgaagaaagggccatggactcctgaagaggacatcatcttggtctcttacattcaagaacatggtccagggaattggagagcagttcctactagcacaggtctgcttagatgcagtaagagttgcaggcttagatggactaattatctccgcccgggtatcaaacgcggtaactttactgatcaggaggagaagacgataatccacctccaggctcttttgggcaatagatgggctgccatagcttcttatcttcctcaaagaacggacaatgatataaaaaattattggaacacccatttgaaaaagaagctgaagaagtttcccacaggtgtagatgaccataatcaagatgggttttcaatctccaaaggtcagtgggagagaaggcttcaaacagacatccacatggctaaacaagcgctatgtgaggctttgtccatagatacgtcaagctcgctgcctgacttgaagagctctaacggctacaaccctaacaccagacctgtccaagcatctacatatgcatccagtgctgaaaacatagccaaattgctggaaggttggatgagaaattcaccaaaatcaactcgaacgaattctgaagctactcagaactccaaaaaactccagtgaaggggcaactacaccagatgctcttgactcggattntagcttcaactcttccaactctgatctttctctgtctaatgatgggacagc

SEQ ID NO: 2592 - DNA, 719 bp, Vitis vinifera
  misc_feature (13)..(13): n is a, c, g, or t
  Predicted polypeptide sequence is orthologous to G904
agctggttgaagnatatgtagacaggttgtcttcgacggcgtcgttgtcaatctcctcacgtgcgctatcgttccggagctccggcaggtttttcaccggaagcagtcgccgcaatgaaactgccagcgtcggcgagtgggatttggaggcgaatcgggttggagaagagataagcgaaatgtttcggtggttttcggggatataatggtaatttcggtccatagctagggtattttctgattcattttcagccaattttcctcctacctctgtagataaaaaaaacaaaaagcagggataatttggtaaaaagaattagctccagttgcatcctgaccgttcatcagagcagaggtggacggcacagattgaattgaggtagcatttgtcagaaaattcataaaaatgctgccatcctccaccaccagtgaggataaaattgtagaaaattgcatttttgagatgaaaaaaagtatattattaaatttggatggagctgtaacgggaaagaagaaagacggtgggtgtgttcactgttcatttgggacctgtgatttggtaggccacgacagacggaattaaatggcctctcttcatttatggaaatcaacaaccttcttctacggttctacctcgcttttcatcgcattctccaggtcgcgtcttctttcttcttcttcttctcctcctctgtgatcaattccgttacgttttcact

SEQ ID NO: 2593 - DNA, 687 bp, Vitis vinifera
  Predicted polypeptide sequence is orthologous to G913, G1753, G2514
ctcgaatatggctcggcacgtacccgacgcctgaaatggcggctaccgcctatgatgtagcagcgctggccttaaaaggcactgatgccaccttgaattttcccaactccgttctgtcataccctatcccaaagtccacctccgctagcgatatacgcgcggcggcagcgagggccgctgaggctcagcaagcaaagcccgagagttcggagagcccaaaccccacccaacctaaaaaggaggagacaacagaatccagtagcttggcagcgggggaggatcaattcattgacgaagaggagcttctgaacatgcctaatctattggtggacatggccgagggaatgctggttagcccgcctagactcaagtcccaaccctccgacgattccccggagaattcagacagtgatagtctatggagctacacataatcaaagccagaaaggtggagaagcagaaccatcatcaccatcatcatcatcttcaggtaaaagaattaatatggtaaattttccactttgtttgtgagatttgtttttggatttccttttctttttccaacattgatgttgggttccgaagctgatcgggttgcagagatcccagttactaacctgtaagaaagcgtgtactgtacagctaccattaatgtgactagtgcttatatatctcaatgtcataact

SEQ ID NO: 2594 - DNA, 631 bp, Vitis vinifera
  Predicted polypeptide sequence is orthologous to G913, G1753, G2514
gccgggagagtaatagtgataaatacttctatccctcataaaccccacactctataatatatggctcatagtcatgccacatgacatgcgccaagtagactaaccttgtccagcctatcttctccaatctccatccacacgtgccaaaaccaaaaacccaaaaaagaaaagaaaaaaaaattccaactccggataccaccacgatatggcgtccgcctccgccgggggctcagccaaacagccctcccctgggagacacccaatgtataggggaatcaggagtcggagtggcaaatgggtgtctgagatcagggagccacgtaagactacgcggatatggcttgggacgtttccgaccgctgagatggctgctgctgcctatgatgttgccgccttagccttaaaagggacagaggcggttctcaacttcccggactttgttcactcgtacccggttccggcatcagggtcaccatcagatattcgtagtgcagcagctgctgctgctgcgttgaagaaagcgcagacagacgatggctctgcagcacacagcaggcgtgaagatgatgggaggttcgatgttcatactaatactaatactacgtccgagggaggaattgtggacgaggag

SEQ ID NO: 2595 - DNA, 654 bp, Vitis vinifera
  Predicted polypeptide sequence is orthologous to G977
ttttttttttttttttttttttttttttttaggaaatagttccattgggatttgcaggtgcaccattatacaaaactaattaagctcgacagacccagaatgaagcaactcctcgatcatctgctcaatatgatcatcttcaagaaccttgaattcctcgtcttccccaccaacccttttgccctgcacttgtcgccgtctcttcgctggtgacccgacatccacttggcggctatttccggcattgccgtctgtggcgaaatttggagagtagtgaggttgttggaggtgtgtagctaaaggctctttggccgcttgaagtgatgccatgtagcatctatgcaatttagcagttaaagtcgccgagagaagcctagacgaagatgattgtgagtcgttgggattgtaactgaagttggtgcgagctcttggcccacacatgagcctggctgcttcatcatatgctcgtgccgcgtcctcagccgtttcgaacgtgcctagccatattctagtcttcagtaaaggatggcgaatttcagagacccaagagccccaatgcctctggcggacgccccggtatcgctgttgttgttttccagccatggtgtctctgaggtcgagatggaagaagatgagaagaaagaaggattcccc

SEQ ID NO: 2596 - DNA, 702 bp, Vitis vinifera
  Predicted polypeptide sequence is orthologous to G1020
gctctttctctctttttctctctctgtctccctctgttttcgttttcattcactgttttcacaaacacttgtaccaaaacacaaaacaaatggcgccgagagacaaacctaccggcgtaaccgccggcgctaccggaaacaaggagatccgctacagaggcgtgcgcaagaggccgtggggcaggtacgccgctgaaatacgcgatcccggcaagaagagccgcgtctggctaggcacctttgatacggccgaggaggccgcgcgtgcctacgatgcagcggctagggagtttcgtggagccaaggcaaagactaacttcccttcgcctaccgaccttgcggcagctgccgcgactactgctaaccggagccctagccagagcagcaccgtggagtcctccagccgcgaggcgctgtctccgggtgcgatcgctggtcctccggctctagatctcaatctgtcacaccccgccgccgccggccaattttccgcagttcgttaccctgcggttggtgtttttcctattgcgcagccgttgttcttcttcgagccattttcccgtccagagaagccgaagacccaccgcgatatgttcgatttagatcgagcggttgccgattttcaccctgcgattgccggtagcgttcacagcgactccgactcatcctccgtggttgatttcaattaccatgaccgcagta

SEQ ID NO: 2597 - DNA, 762 bp, Vitis vinifera
  Predicted polypeptide sequence is orthologous to G1020
gcacgtttcaatcacctaacaaatggctctcaaggagaaagtgaaggaaggagttaaggccaaagagccgcatttccggggagtgaggaagaggccatggggtcgctacgccgccgagattagggatcccaccaagaagagccgtgtctggctgggaaccttcgacacggcggaggaggccgccaaagcctacgacgccgccgcccgggagttccggggctccaaggccaaaaccaacttccctctccccaacgaagtcctccccttccccaacaccgacaaccacacccgcagccccagccccagcagcaccgtcgagtcctccagcccccacgcgcctctcgagctcgacctcacgcgccgcctaggaagcagcgacggtggctttccgttccattaccagccgcacgttgtgaattccgctgctgtggcaggcgtttggcctcacgcgcggccagttttgtttttggatgcgtttgtcggggcggaggggttccgagtcaacccggttacagtcgcctacgatggcgggtttgggagcccggttcagagcgagtcggactcgtcttctgtggtggactcggtccagcatgagagcagtggggcaacgagggttctgggtctggatcttaacttccctccacccctggaggcttgattttacctggagtctccgagtttctaaccgctagcggctaagcttatattaatattttttatttttcaatttctaggacaatatgagaatgtttgatggtctaa

SEQ ID NO: 2598 - DNA, 646 bp, Vitis vinifera
  Predicted polypeptide sequence is orthologous to G1020
ttttttttttttttccctattttcttcctatggtagaatagataaggaaagagaaaatttttcaagggaaaaaaaaaacgaattgaaacgttatccagtgaggacgcaaagatcagagaagtattcaggcgatttcaggcgggggagggcggttcagatcgagatcgatgagaacgcgtgcgcgaggcttgagatcgttgtggttcaaatcaaccacagatgatgagtcggaatcgctctggaccccaccggtaagcgcggcgcggaaatcagacgccgcacggtcgaacctcagtctctgaaaatcttgattcactctcccagtccgtaacatcgcgtcaaagtagaaaaggtgattcgccgcaggcaagcctccggtcggaacaattccggcagccggcgaaggggaggaaacttgaaactgatgatgctgaaacggaaatctcaaggcagtggcatatccagcagcagcaccaacgccaacgccgacgccacctccgtgcagcagattaagatccgatggagaggaatcaaccattagagccggcgaaaatccctcccggctggaagactccacggtgctgctctggctcggactctgattattgttgttcagattctcagaaccaaggaaagttggtcttcg

SEQ ID NO: 2599 - DNA, 397 bp, Vitis vinifera
  Predicted polypeptide sequence is orthologous to G1082
ctttgggaacggggtagactagaaatgcgccagagggcgctggttgataaggatttagagcggaaagttaaggacttggatagggaggaccagaagattcagaaggagattcaagccttggacaaaaagatggttccaattgcagggcacagtgacggcctcgcattagctggacatcttgtgtaccaaagtgaaaccagcagtaataatagtatacatgcgaatttgcaacatatttttgaatccatggagaggttcacagctaactccttgagagcctatgaggagcttttacaacgaattgaagaagataagcttgctgaggcatgagagtttttaatagtggcaagtgaaatgaaatcctcttgccgaattcctgcagcccgggggatccact

SEQ ID NO: 2600 - DNA, 631 bp, Vitis vinifera
  Predicted polypeptide sequence is orthologous to G1082
ggatgatcaatgttggtagtttacagtctggtctgcggcagatttttgaggccatggagaggttcacagccaacctgatgcaatcttatgaggagcttcttgtaagcattgaagatgcaaagtgtgctcaagagaacccataaacaccatggatttttgcccaagtgttatcccacctgcttatctggttctttgttggtccccaagcatgattatctctgaatggcctcctagaaattgttcaattatgcaatacttctttccagggaaattttacaaatgctggcccaattccttgttgaagtcaatgagggcaaagtgattttatagattttatcttcattggagccaagcatcctggttgccttatcggctgaaggtcattgctgaggacgagaccagtaactttcaatccccgcaaccaacttcctttccaacccatgctttaggatgttaagttctgacagaactgaagaaaagcaggactacacaaggtcgtcaactggagtgtggcttttgagtagtgatatacaagctgcgtcatcagctgtctctcttcttgtcatgtcaaaaacaaaatgctcgtgccataacaatcagctaagctgaactcatcaggacaatgctgact

SEQ ID NO: 2601 - DNA, 783 bp, Vitis vinifera
  Predicted polypeptide sequence is orthologous to G1082
tttttttttttttttttttttttttttcgccacaaactagaagcactgtttcacattaaacatggaacaggattcatttatgggaagaaaaaattcgaaaagaaagaagcaaagaaagcaaaattaaaagggaagaagagaacactcttgaatgactgcgaaagttatcattttaattggcccaaaggcaatgagccacacaaaggggttgcagtcttcacaacccccagcaggacccatgaaatttttccccttccccagctgctcacatgaccaaatgaaggtagggttccatctcagacctcttcacaaaactatatcctttgccaccattcatcataagaagttttgggctgacaaaatctgccattaagcattctgctgagattcaagaaatataaatcttactgtgcatcttaaaccctgacttgcttcttcccaaatcattgttgcaagtcaactccactagttcctccatttgctccaccaaaacctataatcacctcttgagaatctttactctcaggttcaacaccatcttctttagcaggcaccgtgcaatccagctctccagtgttcacatccgtgacatccaaaactcccttatcaagatctcccaacttagtgtccttgccctcctccaaagaatcctgcaattcacaaaaataaaaaaacacaacacctatatgacatgtcatcgttgagatacacaaagcccaaacaaacctgatacacacaaaccttcaattcaaccccattagcatttgaatcctcaaccacccc

SEQ ID NO: 2602 - DNA, 789 bp, Vitis vinifera
  Predicted polypeptide sequence is orthologous to G1108
ctttttttttttttttttttgatgtgcaccacctgatggggtgtgttattgaacaatttttggtatataacagactgtcaaaaggcacttgcctggtataacaagtatcttacaacctttcttaacctagaaacatcaaccaccaaaaaaaaaaatccatgaatgaattttaagtggtcattcattcatccaccatcagaagaacgaaacctaaaagtaccagaagcaccaattcatacataccatatgtgatgcacatatacttgaaaaaaaaaggggggtgacatatacttgtcaagtaaacatatttgctccacctgagcctttcaaccacaccaccattctcaccctctttcactagttgatacttaaccctgagagtgaacctaaaaagctctcaccgacctcacgcttgcagaggggacatagagcattgatcttcagccatttatccacacactccttgtggaagaagtgagaacatggcagctcccgaagctcgtcgttgtttgcatactttgccaagcaaatacagcatactgcatcttctccagagatcacccgctccctttctgttccagctgctacaaccccaccttcgcccgcacctgaattgccttctctatcatcgccatttctattttttttcagcttgaacttgtaggttggaagagcatttattgattctgatgtggctcctctagtctgtgtcagatcctctctaagccaaggatggaaattatacaagggaggcagcagcagattgtagcacatagaatcggacgcgtg

SEQ ID NO: 2603 - DNA, 947 bp, Vitis vinifera
  Predicted polypeptide sequence is orthologous to G1108
gggggttatggatatccattgagatatttttcactacaagcccgattgttgcatccatagtagtattgtccttgtctagagatgagaaaccacaaactccgttgtttgcttgggttgtgggttatgcagctggatgtgcagcaagccttcctattcttttctggcgttatcttcgccgcaaccatgatggtgagcaaggtttaaatcatatgcttcagggttcatcacaaggaagtactacattggaatctaattcgtacataactatctcattgacccggtctgcagcagaggaaaatctcccagatgcgtctacaaacacttggaatggtcatactatgggtgcttcaaatgctaggctcagtatattagcagactactataagatggccctggattgcttctttgctgtgtggtttgtggttggtaatgtatggatttttggaggacactcctcttttaccgcagctccaaatttgtacaggttatgtattgtgtttcttacctttagctgtattggatacgctatgcctttcattctatgtgcaatgatatgctgctgcttgccttgtataatttcaattcttggccatggggatctgagccaagttagaggagccagtgcagaatctattaatgctttaccaacctacaacttcaagttgaagaaaaatggaagtgccaacagtggagaaattagttctggagttgaaggtggggttgtgggagcgggaacagaaaaggagcgtgctatctcaggggaagatgctgtttgttgcatttgcttgacaagatatgcagatgatgatgagctgagggagctgccttgctctcatttcttccatagtgagtgtgtggataaatggctgaagatcaatgcatcctgtcccctctgcaaatgcgaggttggtgagaatactggggagtttgccttgatcatcaaactc

SEQ ID NO: 2604 - DNA, 714 bp, Vitis vinifera
  misc_feature (560)..(560): n is a, c, g, or t
  misc_feature (619)..(619): n is a, c, g, or t
  misc_feature (647)..(647): n is a, c, g, or t
  misc_feature (690)..(690): n is a, c, g, or t
  Predicted polypeptide sequence is orthologous to G1146
gattttagtcgatagtagataatctggattttagtggcaactttttatcatcttcctagttttctatcaatgagagtgaatgagagagatggcttggagcgttgctacacaaaccttagaacgccaaacctcacagccaaacctcgccttcataaataaaaaataaaaaaatagaagaaggagaagaggaagaggtggtagaaaatatgatcaaagcaatgtttccatgcgctccagttcaaggctctacacttcagcagataagctagttcgtgcacatctggaccctttgttattgatattcctcatgggtatgttgaaaatgggggcaacatgtgtgaaatgaaggctcatagagccattaatggtttttcttacttgggaatattttatggcagtaaagtcaatggaggacttttggtggggcatccatggggcacatatgcccatatacctttttaaagcctttatctcacgttttcacaattttttttttataaaaaaattaactttcaaaaattctggattttcagtcacttcaatcttcaaattaatttttncaaaattaaaattttcaaattaatttttttttaaggattccattttcaaataaattccncaaatttcattttttaatttaatttttncaaacctcaatttttaagtttaattttgaaaactccaattctncaataatttccaaaatccaatttt

SEQ ID NO: 2605 - DNA, 800 bp, Vitis vinifera
  Predicted polypeptide sequence is orthologous to G1146
tgtgtgctcaggcccatcgacaggagctcatccaagatctttataagacttggcaggatcctgtaagaggaactgtgtctggtggaatgatcaaagaactgcttatatctttccggagagcaactgggcagaaacctcagcgcataatattctatagggatggggtcagtgaagggcagttctatcaagtcttactatatgaacttgatgctattcgtaaggcatgggcatctttggagccaaactatcagcctcctgtgacatttgttgtggttcagaaacgccatcatactagattgtttgccaacaaccataatgaccggaatgcagttgacaagagtgggaatatattacctggtactgttgtagattctaagatctgccatcctactgagtttgacttttacctgtgcagccatgctggcattcagggcacaagccgacctgcccattaccatgtgttgtgggatgaaaacaagttcacagctgatgggctgcaggccctcacgaacaacctctgctacacatatgctaggtgcacacgctctgtttccatcgtgccccctgcatactatgctcatctggctgctttccgagcacgcttctatatggagccagagacatcagatagtgggtcaatgacaagcggtgctgctgctggtcgtgggggcatgggtgttggaggaccaggtcctcgaagcacacgggtatcaggtgctagtgcagccgttagacccctcccggccctcaaggagaatgtcaagagggtcatgttttactgtgatcttcttctacattca

SEQ ID NO: 2606 - DNA, 777 bp, Vitis vinifera
  Predicted polypeptide sequence is orthologous to G1146
ttttttttttttttttttttttttttttgaaacaaagaaccttcttcacaatattaaatatactagatttcaaaatccttccattacatattccacactgtgacaaaacttgttggataagcttgctttcaaaaaaatcggtggttcaccactcacatataaacacaacactcatgtacagatatgtctttgcatttcttctttggtcccttcccagtgcctattttctttttctctaacagtagaacatcacattcttcaccttctcattcaatgctggcaggggccggacgcgtgattcatttgacgtgcgcatgcaatttggtattgcattctcaggcttatcaggttccatgtagaatcgagctctgtaggctgccagatgagcataatacgcaggaggaactagagaaacagaccgagtgcaccttgcatacgtgtaacagaggttgttcgtcaaagattggatctcatctgctgtaaagttgttctcatcccagagaacatgataatgagcgggtcggctggtcccctggattcctgcatgactgcatagataaaagtcaaactcactgggatggcagatcttagaatcgaccacagtaccaggtaagatgttcccactcctatcagtgctgcttttgtcattgtggttgcttgcaaagagtctagtgtggtgccgtttttggacgacaacaaatgtcactggaggttggtaactaggttccaatgatgcgcaggccttacgaatggcatcaagttcatatagtagaacct

SEQ ID NO: 2607 - DNA, 841 bp, Vitis vinifera
  Predicted polypeptide sequence is orthologous to G1198
tgagcatccattgggtttcatttagaggatgctgtggacctgagtggaagcactgcattcaattcgacaaaaccaagtggtcgagcagttacttctgatcccctccatactgtcacttttgataagtcacaaaattcatttgatataaatccaactgctgcccgggtggagtctcagaggttgccattgcaaaagggtcaacaatcaaatctggtttctatatctagtggtagtgtagagaactggggagagtctgcaatggcagatgccagtcctaggactgatatctcgacagacgtggatacagatgataaagttcagaggtttgaaaggggtcaacctgcttccaatatggcttctgattccagcgacggatcaaaggataaaatgatcagaagactcttcgtaggcttgctcaaaatcgtgaagctgcacgaaaaaaccgattgagaaagaaagcatatgtccaacagctagaaagtagccggatgaagctgacccaactagagcaggagctccagcgagcgcgacagcagggtatttttatttcaagctcaggagatcaagcccattcaatgagtggaaatggggccatggcatttgatgtagaatatgctaggtggctggaagagcagaaccgacaaatcaacgaactgagatcagcagtcaattctcatgcaagcgatgctgaacttcgtgttattgttgataatatcatggcacactatgatgacatattcaggctgaagggcgttgcagccaaggctgatgttttccatttattatcaggcatgtggaaaacacctgcagatcgatgttttttgtggcttggtggtttccg

SEQ ID NO: 2608 - DNA, 819 bp, Vitis vinifera
  Predicted polypeptide sequence is orthologous to G1198
aacttcggatattgtggacaatgttacagcacattttgacgacattttcaggttgaaaggcattgcagccaaggctgatgtcttccacatcccgtcaggaatgtggaagacacctgcagaacggtgttttatgtggattggcggtttccgttcatctgaagtcctcaagcttcttgtaaaccaattggagcctctaacggagcaacagttgatgagcatctacaacttgcagcagtcatcccaacaggcggaggatgctctctcccaagggatggaggccttgcaacaatctctggctgagacgttaaccagtggctcacctggcccatctggatcatcagggaatgtggcaaactatatgggccagatggccatggcaatgggtaagctagggactcttgagggatttcttcgtcaggctgataatctgcgccagcagacgctacagcagatgcaccgtatattgacaacccggcagtctgcacgtgctcttcttgcaataaatgactacttctcccgacttcgagccctcagctctctgtggcttgcgcggccacgggaatgatgttgtatgagtatcaggatcgtctttagaaatatggtctcctgctagggaatcaaaaggctcacttccaacttcggagtacttttgggacctatacatggtgcagggaggctgtagtggtggtttcagctccatctacacatgtaacatgagatatgttcactgggtagttgtatgcttgtttcatatgttcagttaggtgatgtatttttatttcttatgtctcagacaacagtgccaataatgtgatcatg

SEQ ID NO: 2609 - DNA, 833 bp, Vitis vinifera
  Predicted polypeptide sequence is orthologous to G1276
gaggcagtcaccaacgattgagcctagtacttatgaaggggagatgatccctgaggccagcaatgaaggtagtgatcacaatcttgatctgaacttggggatttctcctcctttaagcaatggcccaaaggaaattgacggcttggggcatctccaatttcactctggctctcatgatgctcacaatggaaggagatcaatgatggagaaccctaatatagaaacagcgggtgacccgtctttcaaagggctagcaatgacatcggagcaccctcctctgtggactggtgtatatcccagcttctttcctggctatgaggaaagggcaacagagagaagaattgaagcaagttcttcacaaggactcccaaactgggggtggcaaatgcatggtcaggtcactgctactccaatgccattgttctctactgcagcatcatcaggattctcatcttcggctaccactgctccctccgccgccattctttcatctaaaccgcccaacacaacatcccactctatctgttttgcttcatccgcctcagccgtcaccacccctctcaatactatttccagatgaagcccccaccaccttaatccacccatcacacctccacctccccctttatcaaaggcggataggcaaccacaacaaaaacagagtggtcttcaaattcatttgtatgtttcaaatagtcgattgatatgcgccatgtctaggcgcccaactagtttggtaaaccattactctacaggatttattagtatcaagaaaatgctaatcccttttgcctttgttatgcaaaaaaaaaaaaaaaaaaaaaaaaaaaaaa

SEQ ID NO: 2610 - DNA, 823 bp, Vitis vinifera
  Predicted polypeptide sequence is orthologous to G1290
acatgttttttttttttttttttttttttttttttcaagtttcaaaatgaccatgaaatagcaggcaaaagtagtaatgggaaaaatgaatttttttttatagataattattcaggaaaaaaaatgttaatattctgttctttttcgagtttaaggtcatcttgaaccccattatgatgattcactttatttctcatccccttctgggttaggaaagagaataaaaatattgggccttctcccctccatttcaagtttcaacattataaggatattaacaacatgaagattctatagcatattatcaattcatcaaagaaaactgaaaaacagagggaaacatgctaaatacattcaggtaaaaacacttcaaaatggaggaaaaggtgcttgctagtgtataaagaaagcctcaacaagcattccattgggaaccaatgatgacaatttttatgtcacaaaatcatcaacatcatccagctgacataacagcaagcacaacgtcaggaaccttcctctccctctttctctgaaagaataatcaaaatttcaatagatgggaaaaggaggatggagatgacacttatagaaaagttcaaatccagttttacataatgtccccaatccaaagtgaactcaaagctcatttatgataatgaatatgtgcctaacctgcacaaaaatctctcaatatgaattaaaataaaaaagaacaggtttgctcatgtaatgctttgatcccaaatataatacttctactaccattaaaaacacagaatcgcaagaatttaatctattactatccagtttccacatctgaggt

SEQ ID NO: 2611 - DNA, 803 bp, Vitis vinifera
  Predicted polypeptide sequence is orthologous to G1290
ttagctcctgcaatcgataagcctgggcaaatatcatgtttttccaactctgtgccagcctgttgggtaaaactggcaaaagctgctccatgactaatttcaatgagcccctgtggcttatagccgctttctccactcttctgacactcgtggaatgattctgcttgataccacgttgtcaattctttataggcgccaggagggagtttctccgtgtaaaaagctctaactgattcaaaataagctctgtcaccatgtagatatagttcaacaagtgcagtattggcattgtccaatagcttctgtaacatgtcagaaccatcacttctaatgtaggccaaagagctcattattgacaatttttctaagggagcatttatcaaaccccccgagcctttcacaaatccacgtttcaaaaattctaattccagcagtggacgagctggaatagtggaaagagacttgtctttcccatcagtaatagtcactcccaatttggccatttgcaacttcaaagcatcgccagtaaaatgttgcatgacagactgtgccacggtgaaaacattgtcatcaccataagtgataagtacaacacatctgtcaaaacattccctgtatattgggggaactatctttttgaagcaatatctcatcagtagttcattgaaaatagaattaagcactaccgtgagagcacatccagaaggtatgcctgcttcagtgacatacacttggtttccacaaatagaaggcgtccgcttattgccagaagcaatttttcctctgcctattgcctacagggt

SEQ ID NO: 2612 - DNA, 959 bp, Vitis vinifera
  misc_feature (887)..(887): n is a, c, g, or t
  Predicted polypeptide sequence is orthologous to G1361
tcatcgatgcaaaggctgatgacatacttccgacactaacatgcccttcatgtggccaccaaatagaattccaagatcaggctgggattcatgatttaccgggactgcctgcgggagtgaagttcgatccgacagaccaagagattcttgaacacttagaggcaaaggtgctgtctgatacacataaaacacatcccctaattgatgaatttatccctacactggagggagagaatggaatttgctacactcacccggagaaactaccaggagtaagcaaagatggtttaattcgtcacttctttcatcgaccttcaaaggcatacacaactgggacgaggaaaagaagaaaggtgcataccaatgaagacggaggcgagacaagatggcacaaaacaggcaagactagaccagtttttgttggtggggcagtgaagggattcaaaaagatactggtgctctataccaactatggaaggcaaaggaagccggagaagacaaactgggtaatgcaccagtaccatcttggcaataatgaagaagagaaagatggagaattagtggtttcaaaggttttctaccaaacacagcctagacaatgtggtctgagcattaaggattcacttgataacaaatcaaatagtcgaagtgcgcatgatggtccgataataaaaagtgctgcattggtagaatattatcatccatcttttatctcttatgaccaagtaagccataatacagaaagcccacctcagctgattcccaacttggtagtccaaggcgacgggtcttccttcattcgactagctgctgatgcaagcaaaggaaacttgagaggaaatagagatggaagagctgatatatagcaacgacaatgactcctgggnggtgggattagtttgttgttgctgtgtaacactcgaaaataattaatagcatcagattttattaatgaggag

SEQ ID NO: 2613 - DNA, 652 bp, Vitis vinifera
  misc_feature (627)..(627): n is a, c, g, or t
  Predicted polypeptide sequence is orthologous to G1421
gctgatttcagccgcccatttcccccaaggacgttgccgaacgccgcgaaactttttacccgtcgacggcttcgccagctgccggacagcctgagcttcaccttttccggtgggcttcttccggccatttctcgccgatctgcttctccaaacagtggtgccgtcgctgttatctcctgaacatgactgaatagtgatctcgttaacgaacttcttcacacgctgacgcgcgaaaagctcaccctcttcgtcgctggaagagtccgtcgcgtcaccgtcagtgacggaaatccgtacaattctgggcccatcagcattcatactcctgccggtgaatttctccgacgaggttgtcagcagcttagtacgcttgcggtgctcactgtacttgattggggacaacatgtttcgggagatttctcagattccctccgttagcattgaaagcagaggatgaaagggaaagggagagagaaggagggtgtaaaaatagagaacggagaaaaagcagagattcctctgagaatagagaggcacggagaataaagagataaagaaagctgaggaaagaacacacgttaaagggaagcttgaaacgcagataaacctgccattaatggattgaanacccacaaaaagccattaaagcacc

SEQ ID NO: 2614 - DNA, 696 bp, Vitis vinifera
  Predicted polypeptide sequence is orthologous to G1476
ttttttttttttttttttttttttttttttgagctaagcatcgctgcatcttaatagtttctctcgctatgaccgaatccccatgacccccaagttttcgaggcatactcttcttacccagctccgatacaatctccttcacttaaattctctaagaaacctcaaatgatccccagaaattttcagttttctattctgttgaaatcgggagcttgggttctcgatgctattgagccaaaccttataggcaattgggcttttggcaatgcccagaacttgttagctcagcttcaggatgggttccaaaaaacacataataaagtttataacatgaacctgtatgtaaattaattccccacatgacaatatcatgcacaagattccattagagaaaacacgatgaggaaagggagaagacacaatggggttacataattaataattaaataataatatcacaccttaatttccacttttccagtttgcaggcttgtagctattgcaagagaggttacagcagcagagaggggggagggggggggttacaattgactagagaggatttgatgctaggattctagtggcttggcggcttgcaacggcacgacgggaaaaacgcgactcaggcaacggtgatcttgcaatgcctgacggggggagcctatcacggcacgttagggacgggctaagaggtgg

SEQ ID NO: 2615 - DNA, 516 bp, Vitis vinifera
  Predicted polypeptide sequence is orthologous to G1543
ttttttttttttttttactaccatttaaaatattgaaagctatatatatcgagaatattcaacatgcataactatacttgtgtcgagttccaagcagcttaatttcaaacatatagtgccaaatttcttttagaagcaactgggcattattgatggcaccccttagggacatatatactaatagggaattctgaaagacaacaactgattcgatacaaacacataggatggggtattaatattgagactggactggtactgccgagtgaatgtcgtgtaaaagctccatcttctatagattacaaggccagtccatgaaactctgtaaagaagtaacttcaaagataatctcagttttgatgtttccgaagatagatctttcttatagttgcatttgcacaaagtataggcatcttcatgtcttggtgagaataccttgaaagtgtagatgcagggtacgatccttctatgcctcacccaggggatgttcaaattgagttacagaaacagcatgta

SEQ ID NO: 2616 - DNA, 662 bp, Vitis vinifera
  Predicted polypeptide sequence is orthologous to G1560
tttttttttttttttggtgaggatacactgcttggtaatcctcgtatcctgtcaatagagagaaacccagatgaaagttatggtctaatgacacttgcagggttacaaaatgagacagggattaaccaaacaactagagaaaacctcctaccaaaagaaacagccattgaagtgaagtaaaaaggcaactgatgcagaaaactgggggtggaagactattgatgcagaatgggttcctacggtgggctggagcccaggtaaccaaatctgccagccaggacattcacatcttcttcttcctctccttcagcaccaggtaggcttgatggacagccaaatctctcattcaatagttcttcccagaactcctcatcaagttctttatcttcactttcaggagggtctagctcttcatgatcctctagctcctttcttggtctacccaacccttgcatttcaaaagcaagtgcctctagctctgaaacttcaaagccatttccttctgtgaaatgtacaggctcaatcttaatggggttcctcaatccgttgccatggctggatttagtgcctccagctccactagtcccttgatcaataggccttcttctcttctactaatggcttcacaagctctttctctctcttctgctggatactgctga

SEQ ID NO: 2617 - DNA, 673 bp, Vitis vinifera
  Predicted polypeptide sequence is orthologous to G1594
ttttttttttttttttcacttcggctacacaaccaatattttcagctctaagtttagcagtgggagcccattagtttcatccctaccataaaatatgccagcaactagaacttacgaaataaattaggacattgtcagaaaaataaggtgggtaaacatttcatttggtatcagcaaattaaagaccaaattgaagaatatacaccggaaatacgggagagagagaagagagggttgtcactgcatcactcattcatgaaaaatggtccataaatactgtccataacagcaaattgcatgttctccgatggcttccagtgccgtttacgttggtttatgaaccagttgtttatctgcttctggtccaggcctgttgattcagccagtgcgatcttgtcttcctccgttggatatggccatttatagtgaatattccaccaatcaagaagggcttgtcttgcttcctttggtagctttcccttcttctttgtctttgaaaattcatgcttcagggtactgatatagccactatatttccgcaatagcttatccttaagctcctgattttcagtagtttgaagacattcttgtacctccacctctcctccacttaagtcctcctctgatgacccagctgcttcgtcggaaacgtagcttctggaagcaccattgc

SEQ ID NO: 2618 - DNA, 725 bp, Vitis vinifera
  Predicted polypeptide sequence is orthologous to G1635
tgaaactcatgacaaagagattcacaatgaaggatcttggaccgggtcaaatactggatcagtgaacgaggggggcaattgtgatacaaattgggatgttgaaacccagagccaccaaccttatttagacacgatggaaaaagaatcagactcagctttcgagttaaagttgagcgagagatcagccttctctagaggaagaacaaacacggacaagtgtgtgaaggggtttatgccatataaaagatgtttggcagagagagacacccagtcatcaataataattgggaacgagagggaggagcagaggaaccgcctttgcttgtagcgtctctcactggaaagaaatcccctagagcgcagtttcccttttagtgcatagatttttttttgacagattcagaaactgattcaggtaccgttaaagaagaaaatggggcagtaaaacggcagccatttctgaagctttgcaaagtctcttctacttctctactagtactaccttttcccctcatctgttcaaatccataaccctactcctttacttgcaatctcttttgtcctttcggaattagcttttatattcctttttaattctttttgcctttgttgaaatgtgaatccttgatcacactctaattctggtaatgtcctggacacctatgattggaggataaatttacataaagtgcagcattttcgaccaaaaaaaaaaaaaaaaaaaa

SEQ ID NO: 2619 - DNA, 790 bp, Vitis vinifera
  Predicted polypeptide sequence is orthologous to G1760
ttttttttttttttttgcatagtattgcctgacattatgtttcaaatttctgtatgaaatgcccaaaaacagtttacagaacatatttgagatctcacacaatttcattctgctattccagcattaaatcaataactgagcgctacatcaaagcaaaagaggaacaccaacaactggttaacccaacttcagaagtcaaggtatcttcagtaaccaccactccatcttcttctgtaaatttatccatgtttaaagaagcatatatagttgattttgtatgcaagcacagcattgcagcattatatatagaatgctttatctaattgtttgtgtatgtatttatcaacctatccataaggtataaaaaaatttaagacatgttcaaacaacaatgcagttaatagacaataggcaaaccttctctgtacttgcactggtgtcgctcatgttggcataggaattaattgggaaggaggaattacagttcaaattcctgaaaatttttactttcttgcaagctttcccaacacgaattataccttccacaaatccttagcttcctggcaacgaaacctccatccacctagattgcacacaaaaaatccccaagaagtgatgcagtaatggttttgttggtttacttaaacattacaaccccttctgatgacccacagccatagtcatggaatccagttgttccatccacttccaggtttaaatatatatatttctcacaggcctacgcgtctccagattgaatcaaatctgttctttatccaactcatatcta

SEQ ID NO: 2620 - DNA, 937 bp, Vitis vinifera
  Predicted polypeptide sequence is orthologous to G1798
acatgttttttttttttttttttttttttttttttgcaggagaaaagcacattgtgaaatttaatgcagggcaatttacatcataatacaattttctgagaaagtattcttctgatcataccgaccattgagtgtattcaatagacaaaacattactcttactatacgactgatactagaatcattgctcgcgctggtgcaactcatagtatatagcagtgttgctgagcatggaccccttcatcagtttcccaataggaggcgcttggctctcccctcaggcagtccaatgaacaagtcagtggagacatctgaattttggcttctctctgcactaggcaaagtttcattctcttgattcggagcttgatacggttgcaccccacacttttcacacagcattgcattttcagctgctagggctttctccttttctttcagttgctcgatttgttccttgaaaacctgattctttcttgctcggatgctgcttacgctgcgctccaactgttgttctatctgttgtagttcttcaatggagcatgaccccaaaccttctcctaagagtttccgtttggaaatttcaagaagctctatcttctttgccatatttgctgcttcatgcttcaaatgctgcatgttatgttcggtagtcttgtagttgttggtatgaacatcttttgtgtgccgttgatatcgttctattgtctcctgcatactggaactggaaaattcatagagcttccctcttggagagaaaatgatgagcgcaacctcagcatcacagagcacggagagctcgaaggccttcttgaagaggcccattcctccgcttaaaaaaggtgacttgccgacttgtggcgttttctatacgcctcatttgagtctttcctctcaccatcctccagaaaaccccgttgaaaactctccaaaaaaa

SEQ ID NO: 2621 - DNA, 851 bp, Vitis vinifera
  Predicted polypeptide sequence is orthologous to G1798
ttttttttttttttttttttttttttttttggtgctaaatttagattagatcgattataatttgttgcctaatctaacattaggcaccaactccctgtagtgaaaacaaaaactagagcaaggaaaactaattaagagtacaattaatggcgatgaaaccgggtttccacaaaccagcaacttcacactacattttttttttctttcaggcaggcataaactcacactacattaactttaatgctatatatatttgaaatttattctataggcacaatcttaacactacattattcttgtttattgaatgctgccactcagatgattagcgagtgcaattatttgatgttgaaattgaaaatagacactgcaaatcacgatctggaaatgtggccaagaacatcagcaagtccccacttggtcatgagcagcgcatttctggcaggccgatgaacaactcggtctccacttcagaacttggactgctttggctgtaggttacaccttcacttggttgtgctgagagttgccactgccttgtgtccttttgacttaaccttgcattttcttctagcagttgtttctccctttcttttagctcctcaatctgctcctggaatatctgagcctttcttgccctgatgctctttaagctcttctccagttggctgtcaatctctaggatttcgtccagagaacatgagctcaagccttgtcccaaaagcttccgttgagaaacttcaaggagctctatcttctttgccatgctttctgcatcctgcttcaaattctgcatatattgctccaattctggattgttggtttcaacttgttttgcatgttcacggtat

SEQ ID NO: 2622 - DNA, 503 bp, Vitis vinifera
  Predicted polypeptide sequence is orthologous to G1809
gcaggagcccaagatgtctcttcccaatcccaccccctcggcttccaggagttacgagcaggagggatcatcttcttcttcgccttggaggaggcacactgccgattccttccctcctctcaatattcattctgacaacaagcacaaaaagacagcgatgaagatttgttcagagttcccgacgtggaagcgcagcccccttcggattcaacgcgaaccaccaccaccaccacaacaacaaatactagtaataatccagaggttcaacaacaaactagcagcggcaagcgccggaggggacgcaatcctgtggatagggagtatagaagactcaagaggtacacattatttacacatcacccccctcctaatttttatgtttacaggtgagttcatcacatattgatttgagcctgttggccaatgtataaagatgggcacattcatataccattgactcgatgtgatctaatataagtatcaagtatcaaactttaacaatc

SEQ ID NO: 2623 - DNA, 609 bp, Vitis vinifera
  Predicted polypeptide sequence is orthologous to G1809
gaatttataattgaatatgtacttactaaggaaataatagtcatatagattggttcagtggtagtaattaataggttacacaattacatttagtgtggcccccaaccttaatgaaggcagcatgcaggctgaggttgccttaatttggaacacaatttgtagatacacttttagtaaatcaaaatgattacagtcaggtgatagtggctccatggcactggacatgacccagacagtgataatcatgtagcacagctaagtgcatatctgcaaggctaatttttcaggtgtttggcaaatgggtttggcgcagattcaaaaataaattgatctgatgacaggcagaaggatgtggtagaagttcttcagctcttgcccaactgatcatgctttgactcagtactactgtcatccatcttaggcctagtgttcatgaggaccttacggagcatggtgttttcgttaacaagagttgagattttctcttctagttttgagttcctgtcctgcaactcctgggctcttgactccagatcattcacatacaccttctttctttctcgagcttgttggggagaaaccctgtttctcagcagtctcctcgtgccg

SEQ ID NO: 2624 - DNA, 851 bp, Vitis vinifera
  Predicted polypeptide sequence is orthologous to G1844
ggggggcttgaagtagagatatgggtaggaagaaggtcgaactgaagcgaatcgaagacaagagcagtcgccaggtgaccttctcaaagaggcgaaatggcttgatcaagaaagctcgcgagctctctgttctctgcgatgtcgatgttgccgtcctcgtcttctccagccgtggaaagctctacgagtacgctaatggaaacagtttggctaggatccttgaacgttatcagagtcattttgaagcagaaggcaatgcctctacaggtgctaatgaatcagagaattgtcactacgagtatacaagagactggactgagctactgcagacagtgcaaagccaacttgaagggcaaaatgatgagcagatgagcgtgactgaccttgtgcaactagagagagaacttgatgctgccctgcttcaaaccaaatctagaaagaatcaactaatgatggagtccataaggcatctccatgaaaaggaaaggatgctgaggcaagaaaaggagcttctagagaaagagatggaagcaatgaggaaggagaaggaagaaggctggaaggagtgtgcgattgggaacaacctcgatccctttaacccggaagagccctgtcctcatcaaaggacaaccctttccttgcttagagggtaggcaccgctcatacccaccgccattgccaccgcttaaaaaggtgtgctaggcttcagtggaaggccaagtgtttggtgtctcaacggctgattgcaatgacgttttattacgtgtgtatgaactatagctgccaagtggccgttcttgtatccgctcagtctctttattagtaataagtttagtttcaaaaaacctatt

SEQ ID NO: 2625 - DNA, 924 bp, Vitis vinifera
  Predicted polypeptide sequence is orthologous to G1902
tgctgtcgttgaagtcaaagaccaaggaagttgcggtaagttatagtccttattcgtttctgaactttatttatttgcatgtatttttgttggatttgattcaattattattgccttttttctttgattacaaatactactgttgttcccttttcattatccttttcttggagatgaaggaaattggattatgtattactcgaccataataccatcagatcagtcacagctttactgatatctgtgacaccatacccttttattgcaaatttctctgacgataatcgtaagtttagaatctccgatgttgaagggcccttatcagatgccaaggattagaagctgtaagccaggagatcatcaatcatggagaaccaatggcatagtttatagaagagcagacccctgttttagaaaaatattatttcccttggtttcagggattgggaagaatcttgtgcggtgtcagggtcagaggattcttccctcacccgtttctccattaatgcggatgatgtgtttcacatagcccttttctttgaacagattcgtcgaacatatctatctataagaatattcatttcggtggaggaccccaccagtcaatatcgatggacccataaaacctggcagctttcgcaaccatgggttggctgggttagctccttccccggatttcgctatcctttcaattaaatatattttagagatttgccctttaaatctaatttgattttttccttcaattaaatatattttatggatttaccctttaaatatgatgtatcaccatatttgctctggtcatatgatgtcatggctgatgtatgttggaatccttgaataaaactagaataattgtttgaccggatccttctagcaagtatcagcttctaggagtaactttgtaaggatatgaaattg

SEQ ID NO: 2626 - DNA, 810 bp, Vitis vinifera
  Predicted polypeptide sequence is orthologous to G1902
tttttttttttttgtttctctctcttgttttagataaaacccagtggagaatttgagttggtttcatgagaattgaagtgaaaagtctgggagaaaatctgggtgattatggaaatggaaatccactttgagggatggaaagggcctttttgattgattttgttcttgggtagtggggagtgtttttggtgattttcttgttctttttcttttctatgaagaatccatttttgggtcttgaaatatctttcactttttgtcctttcgcttgcattttggtcacttcaaatcttgtgaagtcaagaagtttctgaaagacccagttcagatctctaaaaacccatctgattttctttccaaatctttgttcaaagacaaacccattttccagagcaagagcacctcaaatgccctcgctgtgaatccaccaacactaaattctgctactacaacaactacaatctctcccagccccgccacttctgcaagaactgccgccgctactggaccaagggcggcgctctccgcaacattcctgtgggtggcggcagccgcaagaacaccaagcgctcctccaaccccaaacgcccttcttcttcttcctctacgtcgtcggtgtcttctccgccggtgtcgtccacttcaaacgctgctgctcagaagtccgagccctccggaatctacgttacggcggcggaccaggaccgaagaatgctcgacatcagcggaagtttcagctctctcctggcctcgaacggccaattcggaagcttgttggagagtctgaatccgaccgggtcggttcgtggg

SEQ ID NO: 2627 - DNA, 673 bp, Vitis vinifera
  misc_feature (156)..(156): n is a, c, g, or t
  misc_feature (204)..(204): n is a, c, g, or t
  misc_feature (257)..(257): n is a, c, g, or t
  misc_feature (281)..(281): n is a, c, g, or t
  misc_feature (395)..(395): n is a, c, g, or t
  misc_feature (489)..(489): n is a, c, g, or t
  Predicted polypeptide sequence is orthologous to G1911
ttttttttttttttttttttttttttttttgcgcttgatgatagatattccattaaaataggggtgggaccgggattacgtgcatacaagagcggacagagagagtcagacttttttttttttttttttccgtttttttttccttaaatgaaaagnccgcttctattttttcctaaaatataatttaataggagccaggccttnggatttcttgcaggtttaggatacttcaaaagccaacaggggcttttcgtctntttgtagttggggatcggagatcngcccgactcgatatgcttgggggcccgaataaggatctcggaggggggcttgatcgacgatcgatcgatgccccccccagcgtgggccacattctgccagcgggggggggtggnccgtgacatataagggatgagccttttctaacagtttgttttgttttggggcccatgagccagacctctggagaaaaggagatgccatggatcntttcaaaggagataacaaaccaagggggttttaaaaaggactaggggggattagaaataatcgggagataggggttcaatcttctaacttaaaaaaaggcctaaaggaagggtacttgaaagaagagagggagctgagttggaaggatgttgtgtccccggccgtgatggccgaattcccgggc

SEQ ID NO: 2628 - DNA, 439 bp, Vitis vinifera
  Predicted polypeptide sequence is orthologous to G1911
ttttttttttttttttttttttttttttttctgatcaatagagatccccttaaaaaaaggggggtacagggattacatgcatacaagagcagacagagagagtcaaactttttttttttttttttcggtttttttttccttaaaggaaaaggccgcttttactttttccaaaaatataatttaaaaggagccaagcctgggactttattgcagctttaggagacttcaaaagccaacgggggcttttcgctacttgtagttgggaataggaacacggcccgactcaatatgttgggggccccgaataaggatctcatagggttgtttcacctccccgggagattggccacccacagggtgggccactttctgccaggggtcgggggggtcccggccatataaggatagggcctttccaaacagtttgttttgttttggg

SEQ ID NO: 2629 - DNA, 763 bp, Vitis vinifera
  Predicted polypeptide sequence is orthologous to G1911
tttttttttttttttttttttttttttttcaacgtacaatctattataacaagtaaatacatttgtttctgcaaaattccattacaatatggtaggaggataaagggatgaaggacttgcaaaacaaggggcgaggacaaatcctacaggaaaaaaaaaaaaatttatactttacactgtatgggggaaaaaaggaaagggaaggaaataaacttcttgttattctagtactccattacttgctttgtagcatgaagcaaaaaaaaggaaagggaaggaaattaacttcttgttattctagtactccattacttgctttgtagcatgaagcataatggatccttattgctgctaattcgtcatattatctgcttaaagcttcaaatacttcaacctaggagaggaaaaaaaacagaatcaaaaggaagccctctgttcttcatcgttgaagttgtatcctttgttggaggctccagcttttctgtagttaggcaatgggacttggccaaactcaatatgcttgacatcctccacaagcatctcatagtgcctcttcacctcctccacagtcttcccacccacagccctggccatgttctgccagcggtccggggtgtccttgtcatacatcaccaaagcattctcgaacagtttgttttgcttggtagtccagttatttgaactcaatcccatttctgaatctgcacacaaattgtaggtggggggcgcagtaccaaggataggaagattgaattgtatcccc

SEQ ID NO: 2630 - DNA, 484 bp, Vitis vinifera
  Predicted polypeptide sequence is orthologous to G1911
tttttttttttttttttttttttttttttctgataatagatactccattaaagcaagcgtgctaggtgaattgaattacaggcattagagggggatacaaggcaaagagagagagagaaagagaaaatttcttctggataagtctgcatctgcttttctcaaagatataactatataacttggtcatgcctagtcttggacctttattgcagctttatacacttcagcagcctctgttcttgatcaccaatgctgttgcttccagtggacttgtaattaggaatcggaacatggcccgattcgatatgtttgaggtcctcaatgaggatctcatagtgtctcttcacttcctcggcagacttcccacccacagccttggctacattctgccaacggtctggggtgtccttgtcatacaaggctagagccttttcaaacagtttgttttgcgctttgaagtccataagccagagcccatgcgaga

SEQ ID NO: 2631 - DNA, 611 bp, Vitis vinifera
  Predicted polypeptide sequence is orthologous to G1911
ttttttttttttttttgataatacttcattcatatatagaaccattacattaatttagcagcacaatggaagacaaaacaagaaaagacatggacacaatatttttcagtaattctgcttctgcttctgtgtcttggatagatacctcagagggctctgttcatcatttcatggccatgcccacttcacctgtaattgggaaatggaactttgccggactcgatgtgcttgacatcctctatgaggatttcatagtgccttttcacttcctccgcagatttcccacccacggccttggcaatattctgccagcggtcaggggtgtccttgtcatactttgccagtgccttttcaaatagtttgttttgcttgggtgtccaagaggagccagaggtacgtgaagaagtcatagagttggatgccattagttgatttttgaagtatgggcttttggatttgcaagaggaaaggaaaaaaaaaaaaaaaaactcagggaatgcagttggaaaccaaagtgaaaatgcaggagtggctggtatgaatcccacgaaatggaaaagaaggaaaaaaacagctcagttgcttcagtcaaggaagaggagttggaagtc

SEQ ID NO: 2632 - DNA, 641 bp, Vitis vinifera
  Predicted polypeptide sequence is orthologous to G2052
tttttttttttttttttgtgtttctcagaattgttttggatttcttagagaattgttctggtcataaccttcataaggtacatcttcatttccataaaatcccatgtaattgggatcccctgagtaaggcgacatgcagccaatgcgactgaagtcatcggcaaattcaacttccccaggaaaatttgagtatgatgaacagggtgagatttcactgtatggattccatgaactcattgagtttgcaaaatcatactgtggaacaaattcagatacagtctcttgtccttgctgatagtcctttgaagaatctagaattagatcaggtgagacccagaagtctgtaggattggtcccctttgaagaaagctcaaaatccacaggccgtgcggcttcataaggggaagccataggactcgaataattactctcattgtatgcatgactagcttgagatggaatgttgtctgagatgctcaagatctcattcgagattgctgcggaggtgaaatcaccattgcttgaactgcttcccacctgctttcctttcgcttctccatggaaatcacttgacttttgtgtcggatcattcttcttaacaacacgacacaaagcaaaagccccctgaaaacctgatcctt

SEQ ID NO: 2633 - DNA, 853 bp, Vitis vinifera
  misc_feature (853)..(853): n is a, c, g, or t
  Predicted polypeptide sequence is orthologous to G2226
agctcattaatcgacttctgctgtcaattccacatcttgggatcccatgaatttctctgctgctgctgcttcttctccttcctgatcactccaacgcccccatcatcttctcaagctcaaccctatcagaccctccttctccgcaaatctaaatcccaaaactccaatttggagcagcatgggactatcgagtctcccagccccatctgaaggagtactgtgtgtgcttctggtgaacacagctctctccatctccatcttcaagggcatagtccgggccatcctccatgtcattggaattcacctctccgcaaccccatcctcctccgactcccctgaacccacctcagagccctttgagtttaggcggaacccatctgagacctgcatggaggaattcaggagcaggaacccagcaatcaggtttgacacagtgtgctcctgcaagcgccctgaacatgactgtgcggtttgcttgactcgatttgaaccagactctgagataaatcacctgccttgtggccattttttttcacaaggtttgcttggagaagtggctggactattggaacatcacctgccctctgtgcaggactcccttaatgccggaagaggaaacatcttgcttttggtaagcaatatctgggagaatgacaagttgaggaaatattcaaatatcactgtacagcttatgtataggtgttttacatgaatatcatcagctaggtgtatcttttattcatatgttagttatatgctccagttttatgcctttatgtgaagaatctatatgatatcagggtcacatatcccatgtctatatatgtatatatatatatattgtacatgatcn

SEQ ID NO: 2634 - DNA, 832 bp, Vitis vinifera
  Predicted polypeptide sequence is orthologous to G2291
ttggagtctaattaggattaactagttgagttataatataattagaacttgagtcatgataggttattagagtcctagtagactttggatgttataattagaattagaatcataataggttattaaagtcctagtagactttggatttcttagagaagcctataaataggttaatcaatgtaaatcaaaggaatgaatttgatgaataatattatactttcttttattgcaaggttgcaaccctcaatggtgagactccattgatttttcttctaggtgagactcctagaaggccttagtgagactctaaggttttccatcttttcttcattatttcttctttctctctatttcttatcttataattttctctaccataaagattattccttgttcctctccttacaccctaaaaataaaaccctagcccacctacccttgagtgtaggcaaccatcctagggttgtcctacatcatgtctcctttattgctttgtcttaaggggcggcagtttgggattcatactgaaaggagaagagatagaaaaaaggagggatccaatttcaaacaacgattagtgagtagcccttgaggcctggctaaagtggttagggtttgggttggggttgtaggaggttcccaagtttgcggtccattgcaaaaaaaggtttacccatgaaaatgattagtgagcagatagattacctatattaataaaaatgatcaaacatctaaagaatacttcctacaaaaaccttttgtatgttggggggattccatttagtacaaattggatacatgtgacttcatttgtcctttagcttcttatttg

SEQ ID NO: 2635 - DNA, 668 bp, Vitis vinifera
  Predicted polypeptide sequence is orthologous to G2291
gctagctccacatttacttttcccttaacctcagtggtggaagggatagaactagaactgaagagatgagcaacagaagtgacaactgagcactttcttctattctgcgccttaggcttactactcatattcctcttcatttcagatgatgacgacgaagaagatggggatgagagaggcaacaccgaggggatctcgaagttggtcctagctttcgaccctctgagccgcctcgccgccgcgtcgtatgcacgcgctgcctcctccgccgtgtcgaacgtgcccagccagtgcctgcatcgcccgattctgtcgcgaatctccgccgaccacctcccccacggccgctttctcactcctctatagctcttctgcacggaaacgtcaccgatatttttcttatccaccactgtcttttcggcaccgaagcgctgtgaaaccggcacgaaccccgaaatcccgccaccatcacagctgctcccactctttttccctccaaagagaacgtgttggccaacaaccgcagctattccgtcaagaaccggaggaatttcggcttccttctgggtaccatcccccaaattccccgataaatcggccaaaacagcaccattactgggcaggttgacgagctccgggacagaaacagaagaaagtgagaagtgagc

SEQ ID NO: 2636 - DNA, 757 bp, Vitis vinifera
  Predicted polypeptide sequence is orthologous to G2520
acatttgatgctgctggtgtggcatatagttcacaagcaacaagagaatatggccgggcctcatcgccagaatggttgcatatgcaggttggtggtggttttgaccgaacataatttacataatcctagtaatttggtaataagagcattaagaagctgttcttcctccttcagtgactgtcaaatactatcatgttgtttttaagttaaagagatatctatttccattttcgacattgggcatggaggtgtaatttctgtctataagacttctttgatttaaaatctggacatctccatttctgtgtgttagaaaatgatttcttttatctcaaaatatgttgcagcagcttgatgttcttctttgtactaatatccaaacagaaccccccagagtaggtattgttcttgtaaaagattactgcttgttcagagtttgtaattcttaaagagtttaatccagccggtgttaaccttgtttagcgttggttactacgaacctgaaggtctgttcagtgaaatcgatgccagtttagccctatggttagttaaaagcccttaattagtcgataaaaggcatttgcttggtgggattgaagcatctagtctcttgccaaaagaacgacaccaagggttcattctgaagcatttttttcttttttttgtccaagtcttgataggtttaaaatgttcatgtatccttcgattttaaattaaattttatttttggatatagatgtgcatttaaaatgtaaaa

SEQ ID NO: 2637 - DNA, 816 bp, Vitis vinifera
  misc_feature (802)..(802): n is a, c, g, or t
  Predicted polypeptide sequence is orthologous to G2520
ctgtgacggagcagagtgggagtcgtggcggtggaaggaagaggagggatgtgagttcggaggatgagtcttccaagattgtttctactagtagtggcagtggcatgaatgcatcgaatggtaaacgtatgaaaatatcaagaactcctgatgaaaatggtggttcaaaagcagaattagaagctagttcagtggctggtgaaaagcccgctgaagaatctaaacctgctgagcagtctaagcaagactatatccatgtgagagcaagaaggggtcaagctactgatagccatagtctagcagagcgagctaggagagaaaagatcagtgagaggatgaagattcttcaagatttggttcctggatgtaataaggttattggaaaagcacttgtccttgatgagataatcaactacatccagtcactacagcgtcaagttgagttcctgtcaatgaagcttgaagcagttaattcaaggatgaaccatactgttgaaggatttcctttgaaagatcttggggtacagacatttgatgctgctgcaatgatatatggatcacaagcaaccagggaatatgctcaaggatcgcaacctgaatggctacatatgcaggttggtggcagtattgaaagagcatcctagtgttatagagaactgtcatcaatgggcaataggggaaccgagcagcaaaattaattcttcaacatgtttcctgaagtctaggaccactttgttgttggcttctacatgttatccagagccatgcttcctaaatatgtgtcagtccttgcatttgtaancagaaacctaaatc

SEQ ID NO: 2638 - DNA, 714 bp, Vitis vinifera
  Predicted polypeptide sequence is orthologous to G2741
taaagtgaggtgactccagaagccctacaccatactatggttgtgacagctttctgatacctgccatgcggtcttcctcatgccaagactgataaaagatcagcggcaagtgagagcacactcgcacgaacgcgctacgttatctaccgcgaatggctggtatggcagtatcacttcagacatcgctaacgatctcgcagttccagcgcgtaatctcatccaagcacaatcgtctacgatatcagtttgcctctggactcggtccacgcaacgctagctcatccaatcatatcgcacacggcatgtacgctgacttccaggaagaggaaggcaccactgatggcgactttggtggctgaaccgatcccgaaaccggcaacagcgtagaagatgatgacagcacatgcgagaatgcttcctaaatcgtcatgggccctggtaatacggtgaatcaggaagttccacattggaagaagatgtatcttcggtgcttatacagtatgcacggtcgcagcacgcatgtatcaagcttttacgggaaccgatatacctcccttaccgatgaggacattatgcgcatgctcagcccgagagtgtggagcgtcatgagcggacctctacgttgttgctcttattcttgcagtgtgcgaatatcctcactattcactactttttacgccaaaaaaaaaaaaaaaaaaaaaaaaaaaaacatgt

SEQ ID NO: 2639 - DNA, 723 bp, Vitis vinifera
  Predicted polypeptide sequence is orthologous to G2763
ggttgagatttgagaattacggaagaatatctttgaggcgagggattggatggcgtcatcggtgatctcgaatcccgtaacaaactccgacagatcacgcgagtcgtccaaaaggaaaaagaagaagaaaaatcaaatccagagccaagtcagagatcagcaaaatcagaaccacacaaaatggaagagccaagtccagcaacagctttactcctccaagcttctccaagctctgcgacaagttcgcctcggttcttccaacgagacgccgcgccgcggccgagccgtccgcgaagccgccgatcgagctcttgccgtcgccgctaagggcagaaccaggtggagccgcgccatcctgacaaaccggctgaagctcaagttcatgaaacacaagaggcagagagtgacggtgaccggacagaatcggtcgaagaagcccaaagtgagtattctacgtctgaaagggaagaatttgccggctgtgcaacggaaagttcgcgttcttggccgtttagtgcccggatgccggaaacttccattgccggatattctggaagaagccactgattacatagctgccttggagatgcaggtcagagccatgaccgctctcactgaactcctctccggcgccggcgccggcgccggcaccacctccagtaattcgccggccgacactctcggcccgagccggcctccgacgagctaaatgtcatatattgc

SEQ ID NO: 2640 - DNA, 858 bp, Vitis vinifera
  Predicted polypeptide sequence is orthologous to G2859
cttcttccttagaaatgaactcaaacatggaactgatgaacaaccggagtgcaccagagaattcccacatgaatggtcacggattcatggctttctccaatgtgggattctctatacatcaccaacaagagttccctgtgaacttcagggataatactcaaagccctgttcattctggaggtctaagtgctgtccaagttcttcagttctcatcgcagcccggagattttggccaggaaacaaagactggaaaagtgaattttgtatcatctcctccagcttctgggtctgagttccttggagataataagaacttgggtggaagaaagaggaagagaagcaatgagagagaaaacaataaaccaagagaagttatccatgtgagagcaaagagaggccaagctactgatagtcacagtttggcagaaagggtaagaagagagaaaataaacgagaaactgagatgcttgcaggacctggttccaggatgctataagactatgggaatggctgtgatgttggatgtgataatcaattatgtccagtcactgcagaaccagattgaatttctctctatgaagctttcagcagcaagcaccttctatgacttcaactcatcagaggcagaagctttggaaaccatgcaggggacaaatgcatatgaggtacatgaggtggagaggtcggtgaaagaagggtatggagggccttctcatctccactcaacatggcctttttgactgcaattaggcttccaatactttgcataaccatgaagccacatgaatataatcttttacttaaatgcagagcaaatgcgatagtgcacagagccacagtattgcccacgcacatggg

SEQ ID NO: 2641 - DNA, 743 bp, Vitis vinifera
  Predicted polypeptide sequence is orthologous to G2990
atcctttatttcgcatgacctcctcattccttactccttacctcaaaattttttatcatcatgttcaccgccaccatcatcattaatgcctaatcttagatgcttcagcccacccatggatgtcaccgccaccgccacagccacccgacccactgatattgagactgaaacaaccaccaccaccaccaccatctccacgccttggacggttgcggggagttcatgccgtcgccgacttccactcctgccgaccccacctccctcaagtgcgccgcctgcggctgccaccgcaatttccaccgccgcgaccctgatgaacccaccactcatgtcatcgaaatccaccgccacccactggggccgccccgccggagctcaccctcaccgtccccatctccaccgccaccgccccatcactcgtcatactactcatccgcaccccagatgctcctagctctcagcagcggcggtgcggggccgtccgatgagcatcagattcatcccataacggtgacgaggcaggacaacccaaatggaagaaagcggtttcgcaccaagttcagtcaagagcagaaggagaagatgttctcgttctctgaaaaattggggtggaagatgcagaagagcgatgagggtttggttgaagagttctgcaatgaagttggtgttggcaaaggggggtgctcaaggtttggatgcacaacaacaagcacacttttggtaagagagatattagcagcaat

SEQ ID NO: 2642 - DNA, 757 bp, Vitis vinifera
  misc_feature (672)..(672): n is a, c, g, or t
  misc_feature (674)..(674): n is a, c, g, or t
  Predicted polypeptide sequence is orthologous to G3044
ttttttttttttttttttttttttttttttcgctaaatatattttattagcagaagaaagtgcgggcaatgaccaaagtcaacacaaagaagcaaaaaaagaaacaaaagacaaactaaataccacaaacaagctgacaagataacaaagaaggcctaccaaccaacaagcaacccataagtgatcaccgaagaccacaaccaaactcattcgggaaaacaatcccctgcaaactcaaccagtgaggaagcgcccttttagccaaggcatcagtttcctggtttgttgatatgggaccccacacaaagcaacaagctaagtctttggacaagttgacaatccttaaaaaggaatataccagacaaggaaacaatccgggtcatatacttttcatacttccagggccttctcctccccttggcggctcatgaaatgataatagcagaatctctccagtataaattccctaacccacatggcttcacttggcattctttcgcattggtgcactggtgtatatgtgcttaaatactgtctttgatattaactcgtgtgttgtgcactattagacatcatgcatcttagctactgatctctctagttcttggtcttatttataaagaactgagggtagaaaactcaaacaatgtgttgcagtttcttctccatttngntcccaagtctggttttcttttggtttttatattgcatgattatttggggttttgtagtgatttctgaacactgtaaatacccc

SEQ ID NO: 2643 - DNA, 795 bp, Pinus taeda
  Predicted polypeptide sequence is orthologous to G2
acgaactttgatccttacttatatgaaaaagaaattcttgaagaaagaagagagagtcagacttctacaggttgtgaccagaatttggaccttagccttgggattggtcatgttccaacgcaattaaagaaaagcccttcatacaaatctagggcagaagaagacagtcaaccgaatcacattggaggttcaacctattcgaaccatacacaggattcgaaggttttgtcatgtctcacatctaaaggggacgagaacgctgtaccggagtttcaggtgttgcctcgtggtcatgccctatattggaattctcaggtgctgcaagttccagaggccatgaaatacaaggaatctgaagctcacaggagtgaggataatgcttatgagcaaactgcaacatcagggagccaattatatcctgaccatctcgggaactgcaagaaattgaatatgatggaggatttgaaagagcaaagctttggagtccctgcatcaactgtacccttttggcctatgagacaacaacaattaggatggacttggcaactgcatgctaagggaccaactagtccagtattcaccaccaacagatcctcctcatcaggattctcaccgcaaatccataccgcattcgttccttcaacacacgggtctcacaacatgggattacaatgggcagcgcaatcgactgatccctgcatggttcaaaccccaagcccacatctgtcaactcgtctgaccaatggaactgattccagcgaccatatggtgggttcaaatcttgattttccagcc

SEQ ID NO: 2644 - DNA, 598 bp, Pinus taeda
  Predicted polypeptide sequence is orthologous to G2
gggcaaggccctcacctgttgttatcatagaagggtaaattatttagaaatcgatgctgacgatttccctactgccatttgcgtgatggatctcagccgaacgtgttaatttctataccaggtggcctttctgtgattagttcatcttggtataattcaggctcgaagtttgttactgctcctgccccattgcatctgatggcagccctatcataggctcttgcatcttcgatctcactatgactcccatcacacttgtagaatgttacactgttgtactgagagctcctagaccgcgggtcatgcctgcttttcttactcggttgagtgccttccatcatgccttttgatgctcaacaaggtcgggtgaatcacagaacgttacattcgtccagcgagatcaggttagggtatcaagcggtggtttttccgggtcttcgaccgggaaaaattgttgggtaacgccgtcgtttccacccgggttctcattggcatgcaatatcagattcttcggcatgattttctattcttcttgtgatgcctctggtggtggttgaacttgacatgtgccgtggaaattttcttgtgagggtccctg

SEQ ID NO: 2645 - DNA, 921 bp, Pinus taeda
  Predicted polypeptide sequence is orthologous to G12
aggagatccggagcatcacgtactcatcactcttatgtggccaaaaccgccgacaaattagagccagccaaatatgggtatatatctctactccttttatccttaattttcatccatccgtctttagagatttttcttgtgtctggcgaaaccctcgtcagagagcgagagatctttaatggagcacgaatgttcgacttctgaacctcatggcagcggtggaggtgggggcatgaagaggtccagtacaggagcagggggaggagggggagtaggaggcggcggcggaggcaagggaagcccgtacagaggcgtcaggatgagaaaatggggaaaatgggtttctgaagtgagggagccgaacaagcggtctcgcatatggctcggttcctattccactcccgaggccgctgccagggcctatgatactgccgttttctacctcagaggaccctccgcgactctcaatttccccgaggaagcacgtaaggagcagcagagcgacctcaggctttcgcagctcggggagctctcaccgtcctctattcagcggagagcggccgaggtcggcgcggccgtcgaccatgccatgcaggcgggcccggttcctgctcagaccctgagggaaataaaccaagaaaatgatatgaagaacgccttgagttcaaaattgagcgagggcaataatttcaagatcgaagcaaaaaataatatgaggcagcagggcttgagttcgaaatcgagtgacaatattttcaagtttgacgaaaaaaataatacgatgctgcagggcttgagttcgaaaccgagcgacaatattttcaagtttgaggaaaaaataatacaaggctgcacgggttgaatttgaaacccaagcgagtgcgatattttcccgttcgaagaaaagagtaataagaagct

SEQ ID NO: 2646 - DNA, 911 bp, Pinus taeda
  Predicted polypeptide sequence is orthologous to G481
acattgcggcggactgcgggaagtattgttttcagtaattcccttaattgggtcccagaatacgttctcagatccgaaaacggttcagtccatcggaggttatagcgattcgaaggcctgaaaaccctaaaaatccttatccccctttgtctttgaatggcagagaactatggcagcccggatagcagcccccggtcggagaacgaatccggcggcggtcacatgggcggcagcgatttctctgtgaaagagcaggatcggttcctgcccatagccaacgtggggcgcataatgaagaaggccctgcccgccaatggcaaggtttcgaaggacgccaaagaaactgtgcaggagtgcgtctctgagtttatcagtttcatcaccggcgaggcctccgacaagtgccaacgggaaaagagaaagacgatcaacggcgacgatctgctgtgggcgatgacaaccctggggtttgaggactatgttgagcccctcaagatctatctccacaagtacagagaaatggagggcgagaaggtctctatggccaaacaaggagacccgactccttccaaggaaggtaacaacgccattaatggctcctcaattgaaaaccctaatgctaatgcctacagtggtttgaaccccggcggttataatagggtacagtcgcagtctctgccacatatgcagcaggctgcctatgggcaaccgccaggtggaatggtctatggccaccacggccacattatgggggcttacaatatgaccgccccaaatagcagtggtggaaatagcagtggtcagcaacagcagcaagcccccagaggccaatggtagaaatatttactttttcttttctgtttttctaatttttatgggttcatgtggggacagctgggtgccttagttaa

SEQ ID NO: 2647 - DNA, 958 bp, Pinus taeda
  Predicted polypeptide sequence is orthologous to G481
aataaaggcagcgagagggtgggaggtgattggcaaaagcgaaaaattaaaaaaggggatttgagcgaacgaacgaacggtgaagatacacagaggatctctcaacggcttcatctccgtcgtcgtctctcctccttccatctccagcgtccgatctgatcttatcaaaggaagcccttaaatccctccagctttccaagcgcgggttctgttgctgtatcccaggtccctggtcatatggcggaagctggcagcccgggcagccaggaaagtcctcgttccggggaacaaagcccccagtccagcgtgcgggagcaggacaggttcctacccatcgccaacattagccgcatcatgaagaaggcgctgccggccaacggcaagatcgctaaagacgccaaggagaccgtgcaggagtgtgtctcggagtttatcagcttcatcaccagcgaggccagtgacaaatgccagcgagaaaagaggaagacaatcaacggcgatgacttgctctgggccatgagcacgctagggtttgaagattatatcgagcccttgaaggtttacttgctcatgtacagagaggcggagggtgacaataagggatcttcaaaatctggagtagaccaatatggaaagaaagagtcaaatgtacatcaagggattccaaatatgcagcagtctcagatgcagcatcatcatatggttacaatgcaggggcaatgatctgtcatgatacatgagaggtcatgaattgctggttagtatgtagccgatcaaatttagatggctagttttgtgaggatcaaatgaaaacaattcatttaacttaattttatgttactgggcaaagcttttagcttgacctaaatgataggtagtcgtgatagctagctttattgtacatggaagttgtgatttgtatgttgctgtacatgtgaattgttgtcactgtaagcat

SEQ ID NO: 2648 - DNA, 908 bp, Pinus taeda
  Predicted polypeptide sequence is orthologous to G481
accaaatcggaaaaagaactaaattatttgacactttatcctaatccaacgggaatctatttggtcgctggtctccggcgtataacgtcttctgtgacgccacctggcgcctgctctcgattccagaattctatccggttgggtattaaattaaggtgattgttggttacagacgttctgtggacaccgagtgagtctcctagccttggaatttggcaccatctcgtcccgcagccatttcagttcgatctcccgccgtcagaaaaaataatccccaattctccagctgtccctgccgtgtctgcacgcgacaggtctgcccgggctttggtctgtggaatttcatgccaatttatcacctataaactccacccgcatctgcccacaaaccccacaagtcacacccctcttcgtcttctttgaaatctcagatgggttctgccaattagctcggatccttgcctcttcagttggttttgtgagcacacacgaggccaggacccgggtatcaacgattcccctcaactgacgtaacccatggcgaccactcggcatcagcgcagtcccgatagcagcccgcgctcggaggatgaatcaggagcgcacacgtacagcaaccaggatggttccgtgaaggaacaggatcgatttctgcccattgctaatgtgagcagaatcatgaagaaagcccttccagctaatgccaagatatcgaaagatgccaaggagacggtgcaggaatgcgtttcagagttcatcagtttcatcactggggaagcctctgacaagtgtcagagggagaagaggaagaccatcaatggggacgacctgctgtgggcaatgggaactctagggtttgaaaactatgtggagcccctcaaggtctacctgcagagtacagagaattg

SEQ ID NO: 2649 - DNA, 767 bp, Pinus taeda
  Predicted polypeptide sequence is orthologous to G481
cggccgggggtggaacaagcatgacgttgtgaatggtccacttttttttctcccctcccatgcccggtatttctctaaatgccgacgcaatggaaatatgtagtctgtaaaccctaaaacttgtaatgcccatagcaaatcatcagcgttcatagtcttacgcttgtttttcatgcacctgtcacacgccaccctggagagcagaggagttgcagctggtgtggtttgttcggttgtaataatgtgttttcaggaatgcagaggagatccgctggagaaggctttgggttattttctttttgtccttacatacagcaggttgctgtgattttgcgataaatggaaagtcaagagatgggggcacacttgcaactctgtcaagaatgaccgctttctctatgtttttggcggatatggcaaggacaattgccagacattcgggacagctggtctctccacgcacctccactgatacggttcttggagattgagtcagggcagctgatggtgttaaatgccataacttagcccataacccctcgggatcctatcctggatagacgctcaggattttatctcggaaatcgacggtgataaaccacaggtcttggttcaaaaggaattgggctagggtttcatcgggcatttgcatagtcattgcgaggcaatgcctctcgacgctggttacttctgcatttgtagtatggcatcttccattcggctcttcattcggtgaacccataccttcagcttctctggtttgcagt

SEQ ID NO: 2650 - DNA, 843 bp, Pinus taeda
  Predicted polypeptide sequence is orthologous to G481
cggccggggggacggtttggatgggttgttttgcaggtttctcacctgcggcgcgcgtttggttcgttggatgacaaaaaacacattctaattgtatttattcatctcccctccaagagagcagcggcagccatggcagacttagcgagctccgtcaccagtcaagaaagccctcactcagaagatacgaacaataacagccaaaaccagggttccaatgcccgggagcaggatcgattcctccccattgcgaacataagccgaattatgaagaaggcagttcctgccaacgccaagatcgcaaaggacgccaaggacactgtccaagaatgcgtttccgagttcatcagtttcattaccagcgaggcgagcgacaagtgccagcgtgaaaagcggaagacaatcaacggagacgacttgttatgggccatgggtactctagggtttgaggactacgtggagcctctcaagatttacttgcacaaatatagagaggcggagggtgacagcaaaggagctgctactagcagatctggtgtgggagatcctactaagaaagattcgagtaattttggagcattaccaaatattaggtgaataaattatgttcgataaaccagggattgaaccatattcaacaggtcagattttgcaggaagtggtcattagagaatctgtataagatgcttggaaggatgaaattgtgggattggaagctcctagtaataaaatacatgtttaatttttttgaaataataaaataacttgtgattaaagttttgccgagtaaccaatatgatcattgtacataagataagtgcatgactgtagctctctcatttt

SEQ ID NO: 2651 - DNA, 903 bp, Pinus taeda
  Predicted polypeptide sequence is orthologous to G504
ggatttttatcagaaaaatgtcaaaaatatttatacgacgaccagatgtttcctgtaggctgtgcatagaccaattcattgacgagtcgctgccgctctccgatgaatttagcgggtgggggactacctgcggcgaggatgtggactccgcagaggacacggctgcgttgttggcatctgacgtggcatggctcggtaagttctccacagatggaccctcgttcagaggcaccctagaaaaggaacccaattttggaatcgctggtttttgtcggctacgctgcacgtcagtagctgatggcgacgggacctccagctgtgagcacgagagcatcccgggcgaatgattgagtctctgaaacaatcggcacagcacccaatcgtccaagggggcagatccgtttttctgggttggcagagtttcggcgaggtagtattcgtgcatgatccagttggtcatcacgccctcagcaggctttcctttgtaaaacaccagcgatttcttcacgcccacttttctcggtgacgagcttcccgacatactaacaatgggtatgtctgatcccgtggctttccagtagccagagccggcggctctgtttggccgcgctccgctgggatattcatggtccctccgactgaagaaataccattcgttctccccgaaaaatgctttcgcgggcaaatcccaggggtcgtgttggtatggatcaatgtctgcaataattggggcaggcagaggggaggaggataccttcttctccaggtaatgggtgatgagttcctcatcggtgggatgaaatctgaagcctacaagcagctctggcactgcctgctgctggaatgccactccctccatcgtcaacgattgattgcttgctgagagagcaagcaagcgatcgg

SEQ ID NO: 2652 - DNA, 1023 bp, Pinus taeda
  Predicted polypeptide sequence is orthologous to G504
ggcattccagcagcaggcggtgccagagctgcttgtaggcttcagatttcatcccaccgatgaggaactcatcacccattacctggagaagaaggtatcctcctccgctctgcctgcctcaattattgcagacgttgatccctaccaacacgacccctgggatttgcccgctaaagcacttttcggggagaatgaatggtatttcttcagtcggagggaccgggaatatccaagcggagcgaggccaaacagagccgccggctctggctactggaaagccacgggatcggacatacccattgttagtatgtcgggaagcacatcgccgagaaaagtgggcgtgaagaaatcggtagtattttacaaaggaaagggcggtgagggcgtgatgaccaactggatcatgcacgaatactgcctcgcccaaactctgccaacccagaaagagggatctgtccccttggatggttgtgtgctgtgccgattgtttcagagactcaatcattctcccgagatgctctcgtcctcacagctggaggtcccgtcgccatcagctactgatgtgcagcgcacccgacaaaaaccagcgatgccaaaattcagttccttttcgagggtgcttctgaacgaggttccatcaatggagaacttaccgagccatgccacgtcagatgccaacaacgcagccgtatcttctgcggagtctgcatcctcgccgcagttggacgattgggtgctgtgccgattgcttcaaactgactcattctccggggatggtctcgtgctcacagctggaggtcccgtcaccgtcagctactgacgtgcagcgcacctgacaaaaaccagcaatgccaaaattcggttcctttacgaggctgcttctgaacgaacgagagaccgtcttgggagaacttaccgatccatgccacgtcagatgccaacaacgcagccgtgtcttctgcggagtccgcatcctcgctccagctagttccccaccccgctaaattcatcggagagcagcag

SEQ ID NO: 2653 - DNA, 850 bp, Pinus taeda
  Predicted polypeptide sequence is orthologous to G504
cggccggggaacacctcttctccatttgcttcaatcatgaagcaatcgatgggcacgatgaaaatggagggatcggaatcgcagcaggaggtgctgccaccgttgcccccgggcttcagatttcatcccacagatgaggagctgctcatccattacctgaagaacaaggtctcctgttcgcctctccccgcttcaattatcgcagagattgacctgtacaagtacgatccctgggatctgcccgcgaaggcgtgtttcggggagcatgaatggtatttcttcagcccgagggaccggaaatatcccaacggagagtggccaaacagagccgccgggtccgggtactggaaagctaccggaacagataaacccatcgttattacgtccggaagcacgtcgtcgcagagggcgggcgtgaagaaatcgctggtgttttacaaaggaaggccgcttaagggcgtgaagacgaactggattatgcatgaataccgcctagctgaaaccctacctattaagaaaaagagatctttgcggttggacgattgggtgctgtgccgaatctacaagaaactgagtcattctccgagggtggcctcgtgcccagagctggagaccccgtcaccgtcagctgctgacgtgcagcgtgcccgacaaaagtcagcaatgcccaaattcggttccttctctaggctgcttctgggcgagggtacctctatggagacctttctcacccatgccacgtcagattccaatgcgtcccggtcttacgtggagccttcatctaatctccatctagtgcccagaagctaaattcctcggagacagaagccacctgtcaatgacgattggt

SEQ ID NO: 2654 - DNA, 875 bp, Pinus taeda
  Predicted polypeptide sequence is orthologous to G559
tagtgattacaacatacgaagggcagcacactcatcatagtcctgcactgttgcgtgggtcatcgtctggaacttcagatcaattaacccactttggaggagcagcagaccatcatcgcaccgcatccccttttaacactgctcagtcacccagcttcaatatacagagcctgagaatggcggtgcaggtccctcagcgcactaattattatggtatgggcagtttacaggcacatgatccaatacaccggggcagcagcaccttacagcaccaacaacaaattataagatcaattcagcagcagcagcaacaacaacagcatgatcattctcagcaccagcagcagcatcagctaattcattcccagcaaatgcaacccccatcggtcgaccagggtttgctggaggacattgttccaccaggcatgcgcaaaaatccctagcagcttatttctaaacatatatacatagttatatatacatacttatcctgtttcgaagaacatcgccattactgactgccacagttcatgttggacgtgccatatgatctgcaactccacgtgaggtacgcccagaaattttatccttaatgcccatgatgtttcttgaaaacaattttatggccagcagctggatcttcccctctccatgcatatattgcaaccagatcccgtggaatgtttgcagacttcttaacagctaggccaattctcggttcggtgaaacgatgataattccggtcttagttctttgttgcttatcgctcttaattaaattccttttagaaagttgcagcaccatggattcatagtctattgacattatctaaacttttgactaggatcacaccagcacaaatttaattttatgaa

SEQ ID NO: 2655 - DNA, 851 bp, Pinus taeda
  Predicted polypeptide sequence is orthologous to G559
cggccggggtcatagcaattccatggatggttcatcttcctcgcaattaaatcaactgtcgtcagagtctttagagtccaagaaggcgatggcagcaaaaaaactccaagaacttgcacttattgatccaaaacgagccaagaggatattggcgaatcgacaatcagctgtacgatcaaaagaaagaaagatgcgttatatatcagagttagaacgaagagttcaaacactgcagacggaagcaactactctttcagctcagcttacattgttgcagagaggtacaacaggactaaccaccgagaacaatgaactgaaactgcgactgcaggctatggagcaacaagcacaacttcgggatgctttgaatgaggctttgagagaaaaagtacaaaggctgaagattgctactggccaactttcatcaaacaatacaaatgccttcaacatgtctgcaactgcacaacaattgccattgaatcgatcttttttccctccaacccaacattcacatcgtttgaatcaacaatttcagccatttcagcattctgcatctccaatgaataatcagccattgatggggcagtctcaggtgcatcagaactttccccagtatggtcctgcaggccaattgcaagtgcttgtgggcagtcaaggcgggcctgctgtagaatcagaagtgtcctctagttctgttaaccatcctggtagttctgcgttttagatggagagaatttgtggaagtgacacagtattaatcagtaagtgggagttctggctttatcagtggccaagattgctgttctcatgaaaatccttgtgcgtttacggtctttgttttgattgttaca

SEQ ID NO: 2656 - DNA, 809 bp, Pinus taeda
  Predicted polypeptide sequence is orthologous to G567
gatttgcggctgggagattcacatttttctctgaaagcctttgctcatgattttcaataaactttgataatatgtaaattgttatgacctgtggtatatttaaggctataaacatcatctcgaatcctctttactggtgaggttccacctgcagttttttttgatagatgtgcacatctgctgatttaaatttgtcacaaagatttgcggctgggagattcacatttttctctgaaagcctttgctcatgattttcaatgaactttgataatatgtaaattgttatgacctgtggtatattcaaggctataaaacatcttctcgaatcctctttactggtgaggttcgtttttttaatagatgtgcacatctgctgatttaaatttgtcgcaagatttgcggctggggggttcacatttttctctgaaagcctttgctcatgattttcaataaactttgataatatgtaaattgttatgacctgtggtatatttaaggctgtaaccatcatctcgaatcctctttactggtgaggttccacttgcagtttttttgatagatgtgcacatctgctgatttaaatttgtcacaaagatttgtggctttttctgtccagatgccagagctttatacgttggagctgcgagcagcactgcttcgggaccaattggtattccagcacttcctccgcagcctaaaagcggaaatactcaagtgagaacaactagtggatcctcaagagagcagtcagatgatgatgaccaagaagtgggacccagtgaacaaagcatggatcccagtcatgtgaa

SEQ ID NO: 2657 - DNA, 480 bp, Pinus taeda
  Predicted polypeptide sequence is orthologous to G779
acttgcaatttcctgcaagccaataacggcatgctttatcctttttctgaatctgtcctctcctgcacctgctattattccttttgtccatgatttcttcatatctctttggagctacaacccttttggagttgtggctgcttttcttacttcctcttgctggttctggtttgtctgatgagatgatacccatgtcgatgtccatggctacggattcggatttttctgagatgatgtccatgtcgatctccatcgctacgggtttgatttccatggctctgccagtgaggaaaaaaaagaagatgaaacaaacaaattacgtgctctgctctgcttacttgaaccgccaaattatttagctcattcaattccccacagtcctccatcaaattcaaatttataaccttcaattcctccatcgttcagttcctcgaactatacctttcgaccacttcaactaatatttttagttacacaggt

SEQ ID NO: 2658 - DNA, 677 bp, Pinus taeda
  Predicted polypeptide sequence is orthologous to G860, G1760
ccgcgtgccgaattcggcacgaggtctacatggaaataccattcccgcggaggacgaagggtcaacattgactcctgagcgtgccctcactgggggacagggcaagcagcctgctcacaaagaaaaggagaaagtttcaagtaattttttccaggaggctaaacggactgatgaaggacgcgtcggagctgccaatcctatgtgatgcgcgagcggcctccatcgttttctccaacagaggcagactctgtaacttctcctgtatcaggtcccgcatgtttattgaacgtcagctttggatccaacaatggaggatatgctcaattaaaacgtatgtgttgcgagttgtggatggattccctattaatcatttttatttttattttagctattacaattttcccagaaaagagaagtaaacaatttaaattgtttttttaactgacggttataggcttttgaggattatttttggatacattgagcgctcccaacttgtaaataaagactttattttgcgtagtgatgtttggggggcttatgaatatcaatatcagaaaaggttgcaggggtcacatgaggaaaggatattttaaaggaaaatatcagtaatcttactatgactgtggatatatatatatatactggtaagctttagactttatttggttttattc

SEQ ID NO: 2659 - DNA, 702 bp, Pinus taeda
  Predicted polypeptide sequence is orthologous to G977
gaatcaaattgggttatgaagttggagttggatcatgatcagcatggaaacagtacgctgaaacgggagacagatgatgatattgctcaaatgattgaggaattacttgactgtggatccttggagatctgctctcccatggcttctgctgattctagtatcagtaatgcagagtcgatgcttaattagcctttccagtgaatgttaagtctaatggccagcatgaaattttgcatgaatcctattagattctggatgtgcaggagaaattcttactcatgatctgcaaatttgctcagtcaaagacttgcaaggtgcaatttatgtgaggccatggaagttggaagggttgatctatcagagaagttttataatctcaatcgtgatcttccacacctatattatagtagcctagcccgattttgttaaagggttgtagagatataggatatcatctctctgatctctttgtgcgctcctgggagacatttataatcaagtttctatataaatagccctttggcgtagtcttgtagctgttggcttcttttgttgaagcttgtggctaatatacttcacttaatgtatatctacaaaaattacagtcagtccgcgctccagtgatgatggtgagtgaccatggctcctgatggtagaacagatgtttgtggggaaaatataaggaataaaatattttactat

SEQ ID NO: 2660 - DNA, 678 bp, Pinus taeda
  Predicted polypeptide sequence is orthologous to G977
gattcttgtcttcccccagctgaggctttctgagaccaaggtgagattcagccagtagtaagctatagattgatagttcagagaaaagactgaaaggcaaaacttatatagacataacaacggagagagcagcaaaggaaccaggttgcataatggctaggcctcaaagatacagaggagtccgtcagaggcactggggatcatgggtctctgaaatccgccatcccttattgaagaccagaatatggctaggaacatttgaaacagcagaggatgcagcacgagcatatgatgaagctgcaaggatgatgtgtgggccgagctagaaccaacttcccattcaatcccaatgcacctccatctccatcttcaaaggttttgtcctccacgctcactgccaaactacaccgctgttatctggcctcgatacaaggaccgagatcgggctcatcgaagaagtatgccatgacaagagctgataaaaataacaatatacatagcagcaatcagtccctcacttgcttaagattggataacgaaagatccaacaacattggtatttggcagaagaaagctgggtctaagcaatctgaatcaaattgggttatgaagttggagttggatcatgatcagcatggaaacagtacgctgaaacgggagacagatgatgatattgct

SEQ ID NO: 2661 - DNA, 576 bp, Pinus taeda
  Predicted polypeptide sequence is orthologous to G1075
cagtcatcggcacagacgcccccagacagctataagatatcgaaccgtggaaccgtccatccaaggacacgactgcgctagccgtgggcggccgtcgcggggaaaccttgctcacagttccgcttccgccgaaaatgcagattcctcgctgccgctgacgagcgaatatcgccatgctttcccctacgctgcaccagtgggcgatctgatacttgctacgccaaaatctctcaacccttcgccgatcctaacatttactttcaaaatctttgccgcctcaagttacgccttactagttctatctccgagcctgatcgagccgcccaatcgaatcggtttcgtattcgattctggcatagcataaaggtggtcaaaattaccttcccggtcgctgcagatctttctcagaaacagaaaagaagatccccaagagctagaaatcaaccctagttaaaaagaacggacgggacaaaaccagtgcgtcgatggccatgtgggtggatgagaaagccacattctatggcggcttttcaaaggcagtctctgtttgtgagagtgggtttggaaaccaactaa

SEQ ID NO: 2662 - DNA, 926 bp, Pinus taeda
  Predicted polypeptide sequence is orthologous to G1075
tggacggcgagatgagtcggaggcctcgcgggaggccgccggggtccaagaacaagccgaaaccccccacaattgtccaccaggagagccccaacgccctcagagctcacgttctggagatcgccaacggctgcgacgtcgcggagagcttggcgaatttcgcgcgcaggcggcagcggggaatctgcattctcagcggaagtgggactgtgaacaacgttaccctgcgtcaaccgggcgcggctaacgcagtcgcgacgttgcacggaaggttcgaaatcttgtcactgtgtgggtcgtttctgcccaccactgagctctccggggctacggttcttacgatttatgttgcggttggacagggacaagtggtgggagggagcgtcgtgggcgccctggtggcctccggccctatcgtggtcatcgctgccacattccgtaactgcccttacgagcgactgcccctagatgaggacgaggaaccgttgcctatgccgctccaccctcccggagggccactttcccagccatcaaccctaacggcggcgcagcagcagcagttaccagatccgccaagcatgcccatcttcaacattcccccaaatctgctccctaacggtcagctccctcctgatctctacccctggccacagcatacccgtacccaatattaacaaaagtaaacctttcttccgctttgtgccagggccacttgctcactgcccctccagcagatcagctcattcataaatttcgtacaatatcatgtgtacaaatgatacacagacttgtaaagtgttttattctgtttagggagagttagatcccatttgtgggattgcttctgctcatcttcgttcactttcatcatcaaggagaagaaaaacaatggagcatttcaggtctgctgtaatagacttgtaaag

SEQ ID NO: 2663 - DNA, 917 bp, Pinus taeda
  Predicted polypeptide sequence is orthologous to G1075
gttattaaatagttgtaaaggagttcgctgctggagctctaatggagatttgagagatttgaggatacggatatatatatagatgggtccagccagttattttgagagataaaataccatttgttgagtgtcgcttgacagggagagacaggggttttgttttgttttttatttatataattttataaggctgatgctgtgatggctgaatttgaagcagcagggggaggagttacaggaggaatttcttctcatgcacactttcagcgagaatgccagacttctgaagaagaggaaagccgcagcagtgatttaggcggtggaggagtgggccgagggagatcacagacacagatcattcagtcctcctctggtggtggcggtggtggaggagccgagggaggttccgggactgtggaggttgcccggaagccgaggggtcgcccgcctggttcaaagaataagccgaagcctcccattatcataacccgggacaacgaaaatgctatgagacctcacgtcctggagatcaccgcgggctgcgatgtggcggagagtgttctgcagtttgtgcggcggaagcagatcgggctctgcgtcatgagcggaagcggcacggtcgcctccgtgacccttcggcaacccaccgtgcccggcgcgccgctaactttccgcggccggttggagatattgtccctctccggcatgtatgtgccggctcccgcggcttcttcttcgtccccgagctctctgtccgggggactgactataagcctcgccggggcacaggggcaggtcgtcggaggaagtgtggccggcgagcttaccgcggccggaccggttaccatcattgcctcttcttttacgaatccctcatatcaccgcctgcccgcagaactggacgaagaaaacgccgg

SEQ ID NO: 2664 - DNA, 827 bp, Pinus taeda
  Predicted polypeptide sequence is orthologous to G1075
caggccgccgggatcaaagaacaaagtgaaacaccccatgattgtccacaaggagagtgccagctgcctcaaagctcacatactggagattgccaacgggtgcgatgtagcggagagcttggcaacattcgcacgcaggcgacaaagggcagtctgcattctcagcgggagcggaacggtgcacaacgtcacgctgcggcaaccgggcacggcgggcacgatcgtgaatttggagggacgcttcgagatgttatccctgtcggggtcattcctgccaacggtcgagccctccggttctacggggcttacaatttatctcgtgggcggacagggacaagtggtgggagggagtgtcgtgggcgccctgatggcctccggccctatcgtggtaattgctgccatattctgtgacgccccttttgagcagctgcccctagacaacgacgaggagctgatgtcgctgcagctccaccctccccaaggactttcccaatcatcaactctggcgccggcgggggcgcagcagatgcccgatccatctaccatggccctcttcagcattcccccaaatctgctctccaacggtcaactgcctcatgacctctacgcctgggcgcaggatacccgtatgccatattaaagaaagtaccctttcttcttgtttgtcccaaggtcactgtcctcagctttatccataattttgtgtacaaattgtattgatcagagtttcaggtatacaaattatactcggagatgtaagcgaataattttttcactttaagttagacctgatattggcctcgagccgaattcggcacgaggcctcg

SEQ ID NO: 2665 - DNA, 774 bp, Pinus taeda
  Predicted polypeptide sequence is orthologous to G1100
agttgccattagtggacaacgccaaccgcaaccctcccaagcacgaggggctctcggaggctgaccttaaccggctacctatcatcgaatgttctaaagaaaaagaagggactccgggactcggcaacacggagtgcgcggtgtgcctcgaggctttcaagggcggggagcggtgccgcgttatcccggtgtgcagccacgtctttcatgtgcagtgcgcggatgcgtggctctcaaggcgctccgtctgtccgatgtgcaggaggagcgctcgcgagaacgaggaagagaaaggcgttaatggtggcgctgcggtggtgtcgcaggaagccgaggggcgtgaggaagagcccgggcgtggtcggcctccggctgatagtgtcgtggtcgagatgtccattgccttaacgccaagaggttaaagtggccactgccgctgcgtgtactgaacgagattcggcctgtcggaaccgttaaaagttgccacggccgctgcgtgtattgaacgggattctgccagtcggaaccgttttcgccacgatacgcgggatttatttttcacatctgcatacttttacaaaatacagtcgtaatcatcattggtcattctgtatgtagatattatataatttggtgaatttctgtggagattaaagttgcgagagaatttcctggttctcacctttgaccagagtgtggaaaatggacgatcgccatatactatgagaagccattcacatttattaaaagtgggagtgagtttaatggctaaaa

SEQ ID NO: 2666 - DNA, 493 bp, Pinus taeda
  misc_feature (430)..(430): n is a, c, g, or t
  misc_feature (442)..(442): n is a, c, g, or t
  Predicted polypeptide sequence is orthologous to G1108
tgcctcacaagatacaaagacaatgagcttctgaaggagcttccttgtacacacctattccatgtgggttgtgttgatcagtggttgaagatcaattcttcctgccctctatgcaaacgccaacttaatggatcaatgattatggctgatcatacttcttctgcatcaagatatgagatttttttctgatcataatttggggaaactacaaaatatttcttttttaatacctgaggctaattaattccaatacaaaactagcccattcatcggcatttatatgaagatgatcgatctcataaactgtactgccactgcaatctgtggacctaatcatctgtatggacaatgaaaaaactctggtaaatagttgaggtatggtccgccattaatactgcaggcatattccagctttgggcgtgtttcctcntttgcaaagcanaagctcaagtcagtttatactctatctatctgcaagatgattccgggatca

SEQ ID NO: 2667 - DNA, 581 bp, Pinus taeda
  misc_feature (447)..(448): n is a, c, g, or t
  misc_feature (459)..(460): n is a, c, g, or t
  misc_feature (518)..(521): n is a, c, g, or t
  misc_feature (523)..(525): n is a, c, g, or t
  misc_feature (536)..(539): n is a, c, g, or t
  misc_feature (544)..(544): n is a, c, g, or t
  misc_feature (552)..(553): n is a, c, g, or t
  misc_feature (557)..(557): n is a, c, g, or t
  misc_feature (559)..(561): n is a, c, g, or t
  Predicted polypeptide sequence is orthologous to G1108
cccaggcaaaggaaagaggagcttccacttatgacattgcatctctacccactcatagattcaagtccatgtcggatgttaagagaaagaaagaacaaattacagactcagatcaggagaatgatccaaattatgttggtggtggatatataatattggacacagtaggaaggaagagatctgtttcagccgaggatgcagaatgctgcatttgcctcacaagatacaaagacaatgagcttctgaaggagcttccttgtacacacctattccatgtgggttgtgttgatcagtggttgaagatcaattcttcctgccctctatgcaaacgccaacttaatggatcaatgattatggctgatcatacttcttctgcatcaagatatgagatttttttctgatcataatttggggaaactacaaaatatttcttttttaatacctgannctaattaattnnaatacaaaactagcccattcatcggcatttatatgaagatgatcgatctcataaactnnnntnnnactgcaatctnnnnacctnatcatctnnatgnannntgaaaaaactctggcaaata

SEQ ID NO: 2668 - DNA, 693 bp, Pinus taeda
  Predicted polypeptide sequence is orthologous to G1108
gtgtatacggaggtggggatggcatggataaacaacacagagggcctcaaagacgtgctgaaacgtcaccatccagagttggtagagaaatggatcctcgtgccgaattcggcacgaggtttttttttttttttttttttttttttaagagatctgatttaattataatgttagtcaatacaactcatgtacagtatgcaacacacaaagttcatgtgctttagctaaaggtcacaaagattccagcagtggaatttcctgattcacactccctcattacgagaacctctctctctctgttcttctgtttcatgaacagattcagcttctacttcactagaatcaccaatctcaagcttgcagagaggacaagatgcattaattttcagccatttgtcaacacactctacatggaaatggtgcgtgcaaggaagctccctcagctctacatcatctttgtatttaccaaggcaaatgcaacaaatcgcatcttcagcagaaacagatctttcattctctgtaccagctgctacaaagccaccctcgcatggactgtctgagtcagattcattgtcatctttaggatcaatactttcacgttcaacttttcccttgaacttgtatgttggcagggaattaatgacttctgatgaagcaccttttgtctgcgtctggtcttctcgaaaaccaaga

SEQ ID NO: 2669 - DNA, 862 bp, Pinus taeda
  Predicted polypeptide sequence is orthologous to G1137
gagatttatgtgactgtctgcatctaagtgcactattctttgtacttccctcagtcagcatgctaacagcactcaatgcacggatattcttgttattacattcattctcctcggtatttttgcaattcttggtttggatgtccacttcctgggtcagagtgaccagaagagagtcatcaaacaaaaaacagttgtcatttatgctagactcgccaactgattcttcaataatagcaggtccaaagtctgctacctcttctttatgtccctgttgattgctacctgttttcttggctgatatcccagcaatagtatcatccctaacttttgtacatgcctttttatttccactatattcacctggtgagtgaccagtgctactctcctgaccattgctgctctcctcttcatcagaactcaacagagcatctaaatctgcagtgttttcatgtagctgagtctgagaatctccagagtttcctttgcttaatacatcacagctcacacgaattgcaccttcattttcaacgacaggacaatcaataaactcacccccatagctgtccagggctgtcatgcacaattgactcattcccatatttggcatagttgtaaaagatgagggaatactgtccctgtaccatggcaaattaacatcccagaggcctgatgttcctgcagccagtacttcagaaattgtgtttttctccatggccatgttttcagggttagtctctttatttaccttgccattgccgggcaacatctccgaaaagctctgtactagtgcagggtgaaaagtaaacccacatctgttcatattatagtcacacatgaacatatttttgtaataatcaggtgc

SEQ ID NO: 2670 - DNA, 685 bp, Pinus taeda
  Predicted polypeptide sequence is orthologous to G1145
ggcaagaaagcaggcatacacaaatgagctagagaatgaagtgatgcagcttaaagaggagaatgagaggctaaaaaaacagcagttcttggagaaattgctgccttctgtacctccaccaccaaccaaagcacacccttcgaaggactggttcagctcctttttgaagtggagttgtagacaatcatgcttctaattttgaagaggttttgtggcacagtttcgctaatctatctgtaattttgtatctctattccaaactgataagctagatagtttagtgtattggaagatgaggtttttaacttatgatgacttaggaggggcgtagctgcttctatattgaagacaattgtggagacatacagtttaggatagcacatccaaagaaagctatacgttgtcagttttcatcaagtaagaggagcctttggttttgaagccatgaagtatatagctacgaaggccttgcgtgacactgtaaatttgttttcgggtctgctgtggtccagaatgacctacattggggtaattcagcgtgacgtttcaggaaattttgtggccacaaattgatcagtcatggctctttttatgtttttatgaaaactaaataaagtcgtttgtaagcacacattattgtgtgtactttgtagcattttgaatggttcgacttccgtttgttgtg

SEQ ID NO: 2671 - DNA, 849 bp, Pinus taeda
  Predicted polypeptide sequence is orthologous to G1145
tttaacccgtttctgctttcattagggaagagagagaggcaccgcaaggtgtttcagttacaggtttaggaagaagttggatttagtccaacaatcagacatatggggtcccaggcagtgctcgctccttctgaattcaggttcttgcaacccctggaaaggcgggtagagaagcttcacggtgatggcgatgcaggaaatagtaacatggaggatggccttctcagctccccaccttgtgccatgcagcgccaggtaagcgttgcaggcgggggaagtcttgatcaagtctggagagacattcacaggcctaattttcagactactcaggccgcggcggtggagaattttcttgcacagacgggccttggacagcgggaagatgaagaggaagaagaggaggaggatggcctgaaccggggcaacaatggcagcttgaccatatttgcaatggattctgttcttgcaggtcaaaacctgcagcaaccggaatggctgcaatttcaacaccaacaccaacaatttggggaattatcggctcaggcgaacagtaatattgatatccctgtcgtagccgcatcgtcgggctctgaacaccctgtctggaagaaacgaggttgtgagtctataacagatcacaccgtggagcggcgccagaagcgtatgatcaaaaatcgagaatctgctgctcgttcaagagcaaggaggcaggcttacacaaatgagctggagattgaagtgaataagctcatagaggaaaacgccaggctgaggaaggagcaggaagctgcaaacctgctgcattcaatacaacctggacaaacaaaacatccacttcgaaggactacg

SEQ ID NO: 2672 - DNA, 844 bp, Pinus taeda
  Predicted polypeptide sequence is orthologous to G1146
tgttaacacccaaaaacgaggttcagagatttttgacgatctgtattgggaaaaagatgatgaacagggccgcaaacaaacaggaggcattttcaaggagttattgtcttcatttcaagagcgatgtaacacaaagccagagcgaattttatattacagggatggtgtcagtgatggccaatttgaaatggttttgaacaatgaattgggagcattgaaaaaggccattgaagctcttggctggactgatcaatcccaaacatcacaagctgaggaaccctcgcagaagagggttagaataggcaagtcaccgaaggttacattcattgtggtgcaaaagcgtcaccacacacgcttttttccaaatactgagaagagatgtccaactcttaaaaatggaaaccttctaccgggaactgttgtagactcggtcatatgccaacctaaaatatttgacttttatctctgtagccatgctggaataaagggcactagtaagccagctcactacaatgtactccaggatgagaatggcttcaccccaaatgatattcaacgattgactaatgacctgtgcttcacgtatgcaaggtgcacccggtctgtatcaattgtgcctgcatgttattacgcccacttagctgcaaaacgtgctcgtgtgtggcttgattcggggattagttctgagagtgggtctttccatggtagaagcgtatctggcatgagtactggctcaggaactcaaattctgtcagggacatttacgaagccattgcctcctgtacatggccgcattaagaactctatgtttttatataatcgggcattatttctatgactaggg

SEQ ID NO: 2673 - DNA, 900 bp, Pinus taeda
  Predicted polypeptide sequence is orthologous to G1146
tttacagagatggagtaagcgagggccagttttatcaagttctgttgtatgagttagatgctattcgaaaggcctgtgcatctctagaaccaaattatcaacctccagttacttttgtggtggttcaaaaacgtcaccatactagactctttgcaaacaaccatcaagatcgaaatgcgacagacaggagtggaaacatattgccaggcactgtagtggattccaaaatttgccatccaacagaatttgacttttacctctgcagccatgctggtattcagggaactagtaggcctgcccattatcatgttctttgggatgaaaacaaattcacagctgatggattgcagtccttaactaacaatctctgttacacatatgcgaggtgcacacggtcagtttctatagtacccccagcgtattatgcccatctggctgcatttcgggctcggttttatatggagccagaaacatcagatagtggttccttatctagtggtgttcctggtagtcgcatgactgcagctagttcaggttctcggagcactcgtgtacctgcaggaacgagtgttcggcccttgccagctttgaaagaaaatgtcaagagagttatgttttactgttagatttgatacatagatgtttgacatttttaagttctatatatgccatccctttgttgggtaggcattgagtgacgggccaggtgcatcactacgatgctttcaaattgcaaagttctagatttccaaaacttaagatcacactcaatcattacgatgctttcaaattgcaaagttctagatttccaaaacttaagaacacactcaatcacttccttttcacctcttgtactgtttgacattttttaattggctgcgggcatttagatgaagagac

SEQ ID NO: 2674 - DNA, 894 bp, Pinus taeda
  Predicted polypeptide sequence is orthologous to G1146
attagcaatgtaatcaggcctgcattttttgacatggtctgccaagcaacactgggtccaaacaccaaactccaactcgcataacctctttacagtagcataaaggtgcttgttctcttgttggggcattatgcagaggataagctcaagagggttaccattccgctccgctgagtctatcacatgttttacaactccctcaacattcccattgatctctgttgccggtggtgctgccaaatcagggttcatacgcacaccatatgtattgcacaattctggaagtttgctagaaaaagtttgaactgcttgaggtggaacatatttagaaaaatttatcactgcccaggaacttattttggcacccctccatatgacctttcctctcatattccatgaaccttctcttggattttcttcataagccttgtacattatctttggtggaggtaagaccctcccggggacttctgtcatcaacgtgttgatttgaatgccaaattcggcagcatctttggcagttgaatctctcaattgtcctccaatcactttagttctctcccttcggtcttggggatgtaaacaagttagatttaataaaccacttcgttgttgttcggttagaactttgatataaggctgatccatttgaatccgacaaagctcgatgggaatatatttctttttctctttagtaccggcttcgatcgccggaaagccccgcaatcggagagtcagcttgtactgttgttggaaatagtcgacaatagagagttgctctccattgctatcaaaacttaaaacctccaaaggcctatcagtcaaacctttaattcgataactatgcctgatatgaatagtttcgacacgaagacctttaagcaacctttcaac

SEQ ID NO: 2675 - DNA, 717 bp, Pinus taeda
  Predicted polypeptide sequence is orthologous to G1146
gcacgaggcggagaaatcgcttgttcattggattggacttgtctcactctcatgctggaccatcggctcaaagcggcaaaccaattccgtcagttattggcatgtcttacactgtcgatgagaaattgtctatgaccggtcactacttcttccgcactccaaacaagacgatcattactgatttggctgaagagtttgagactcccattttggagtacaaagagcgctcaaagtcgaagcaatggccatctcacatcttcatctatcgatctggcgtttctgaaggcgagtactcccaagttgctcgtgttgaaaaaactgctttgttgaagtgttttgatggacttgcaagcaaacattctgatttcaagaaacctggtttcacttttgtcatcgctcaacgtaacagtggcttcaagttgactcctactcaagctccagcaccgaatccacgtggcaagatcaatgatgccgaccgcaatttgaaacccggaactcttgtcagcaaaggtgttgttaatccgtctttggaacagttcatcttgatcgctcatcgtacaattcagggaactgctcgtccgattctttacactgttgttgctgatgaagacagtcaaggaagtggaaagcgaattccggctgatgagttgaaatacttgacttttgccctctgccacttgcacaacaatgtcttgggaactgtcaatgttccatccg

SEQ ID NO: 2676 - DNA, 797 bp, Pinus taeda
  Predicted polypeptide sequence is orthologous to G1198
agcaaagaaagtagactgagaaagaaggcttatgtccagcagttagagtccagccgcatgaagctcagtcagcttgagcaagatcttcaacgagcaagaacacagggtgttttccttggggcgggattcgttgctgatcaaggtcacccaggtttgagtccaggtgctgctatgttcgacatggaatattcacggtggctggaggaaaaccatggccgaatgtgtgagctgagggcagcattgcaggcccacataccggacaacgatctacgcccgctgctagacaactgcctgcgcctctatgacgaaatattccggttgaagagcattgcagccaagacagatgtgttccacctggtttcagggatgtggaaaacgcctgcagagcggtgtttcatgtggatgggaggattccgtccctcagaacttctcaagatcctggttccacagctggagcccttgaccgagccgcagtttgtgggcatttgtaacttacagcagtcttcacagcaagctgaggaggctcttctacaaggaatggagactctccaacagtctctgtctgaaaccataatatctggaactctgacctcaccttcaaacgccggtaattacatggaacaaatggccattgccatgggcaaactcgccaacctagagggctttgtgcgccaggcagacaatttgagactgcagacattgcaccaacttcaccgaatactcactattcgccaagctgcgagatgctttatcgccattggggaatactttagtcgacttcgagcattgagctccct

SEQ ID NO: 2677 - DNA, 895 bp, Pinus taeda
  Predicted polypeptide sequence is orthologous to G1198
tctggtttcgggatgtggaagaccccagcagaacgctgtttcatgtggatgggaggcttccggccatcagaaattctcaagatcctcattccacagatagaaccattgacagaacaacagtaccaatgcatttatagtctgcagcagtcgtcactccaagccgaagaagccttttctcagggcatggaagagcttcaacacactatttccgagaccatagctgcaggatccctcagctcaccttcaaacatggccaactacatggggcaaatggctgtggccatgggaaaacttgccaatttagaaattttggtaagccaggctgatagtctgagacaccagacattgcaacaactacacagaatcctcaccacgcgccagtcagccaaatgcttgctttcaataggagaatacaactctcgacttcgtgcactaagctctctttggtcagccagacccagagaatgagtattaatcactttgcagatcatcatttggataattaattaggttgggtccatagttttttcatcataatttgtactgcatggctaatttcctaccatggaatcagctccaattttagaattagaattcatacaacattgtgcattattaattcgatttatgctctgagatcagagtctcctgctcatcacgttaactttcaccattgatgatcatgatctgtgacttttagacacctgcatgctactaatcaggcttgcagatagtgaattcttagtgatagttttagacacctgcatgctactaatcaggcttgcagatagtgaattcttagtgatggtttacacaaaaatagtttttgaaattactggttgaaacttgactactgcaaaaagcttgaaacaccgagatacttttgtacatattt

SEQ ID NO: 2678 - DNA, 844 bp, Pinus taeda
  Predicted polypeptide sequence is orthologous to G1198
gaggcctcgtgccgaattcggtacgaggttttttttttccatgataaattatattatagctgcaatgcatagaattctgaagaaattacactcatataattcatataatgatcaacttactgttacaacctagagaagagtgtcaatctatccacagctctctatcaattccgaccaccagcacctcctttgtaaactgaatcagccacctaaattttacatgtaaagtccagatggtcatgtgtacaataaattactgaatgaagcagagttgcaactcttcaaaattcagagcagcaagtcactttctgcacatttctgctgaatatgttactataaagatatctgtcgcatcttctttcttcctcactcttacaggtcaatctcttcatgtcttaactgcaagtactttggaaaatataccatcggcttttgccaagcatgtccttcaaaccaagttcagcaggttcaaatcccttgctgaatcagctgaagattaacaataaaagataatcataactttacgctggttcacgaggacgtgctgcccagagagaactgagcgctcgaaggcggctaaaataatcccccatagcaagaagaccccttgcagcttgacgagttgtaagaatgcgagacatctgctgcagcgtctgctggcgtagattgtctgcctgatgcacaaagttctcgagcattcctagcttgcccatcgccattgccatatgccccatataattagccacattcgatgcacccagtgaacctgctgccaaagtctctgcaagtgactgctgaagcgcctccatgccttgtgacatgcatcctctgcctgctgtgatga

SEQ ID NO: 2679 - DNA, 803 bp, Pinus taeda
  Predicted polypeptide sequence is orthologous to G1198
cggccggggattccctgtcgcgaaaatcggaaatctgaaatctctgttaaggcacagaagaaacacagaggcagggcaggatcaagatttcaagtgagggtagagggcgcatggcaattggcagaatatctgtacgctcttcttcacgcgcttattcagacgccttttccccgtctccagtattcatatttatgtacatgcatagccatcttgggttagcttctcatctgcaacacatatgaattcacagtacgcacagtatattgcttaaagtagcaaccagccagctcaccatctattcatcaactggatacctcgggtgattccttcaggacacaaaatagtccacaaactggaacctccaaaagtatggaagcagatgtgaaggtggataatatgtcagaagatgtaaatcagctaacgcttgcaagatcaaaaaggtctgaccaagaagcaaaccaacctaacaacaaggtcttgagacgacttgctcaaaaccgtgaagcagcaaggaaaagtcgtttgcgaaagaaggcttatgtacaacagcttgaatctagtcgaataaagctgaaacaaattgaacaagagcttgagcgagtgaagcaacagggaatttccatcaatggacatttgggcgatcataatggatcaggggctgctgcatttggtatggaatatgggcgttgggttgaagaacaaaacagacaagcccgtgagctcaggggcttctttacaagcacacctgacagatagcgaacttcgtgttctggtggataatgctatagctcattatgatgaac

SEQ ID NO: 2680 - DNA, 865 bp, Pinus taeda
  Predicted polypeptide sequence is orthologous to G1276
ggttgctcggtggatgcctgattcaactgaccctgccaatgaatggtcccatgacaacactggattctttggttttaaatcagttcctcatgattttggtaaattgccccgatggacagatatggaagttgagggaagaaaggctgcaactcctggggagtttatgtcaaggaatggacggagattcaaatatgaagaaggctctactggtccaatgccttatcgaatgggtacctgggaatcccctataagaactctaggcttcggagattgggaaattgactctggcagtggtggacagtattcaaagccattgcatacaccaaatagttcacataattctcgtggacaccacaataaatattctgcctcaaagtccaggaaaagagatagttggaggaagtcgaattatgattgaagtttctggaaatgtgaggttcattatttggaacttttgtatcaaattttgaagactgaaatcctgtcatgtatacagcataatgtggcatttcacaactcacctagtgcgaggagcaactcttaaaatcttgaagttggggcaagcatattaatgtggaatggctgctttcagctttgacaatttctgtcaactcaacgttcctgatagcagatcaagctttgaatggtgtcgtggcagcttgtatgtgtctgtttgtttgcttctccatgattgtgctgcaaatgcacatacctgagttttgaggtaagaaagctagatctgttgaatacacgagttcctgttgatgttcgatattgtaaacattgagattgttggcaatttgcaatcaacccaagaaccaaattggtcaacccacattgattgcaaattaagctggcaaattat

SEQ ID NO: 2681 - DNA, 864 bp, Pinus taeda
  Predicted polypeptide sequence is orthologous to G1482
cggccggggaactccactcctaccatattttcattggtattcacgtgggttttgcaatcccatcacgcggccacagccctcgttagcgctctccccgcccctcttctagctctttgaccatgatttaataccagtggctagtggcttctgcagatatgcaggagattcagcgcccctagaaagataatactgaaatatacaatatactgttgtgggaaggctggatcagtaatcctgaatttgttgtggattcggaaaaaagatgaaggttcagtgcgacgcgtgccagagcgcggaggcatctgtgttttgctgcgcagacgaagctgccctttgtatgaaatgtgattccaaagtccatgatgccaacaagctcgccagcaagcaccgcagactctctctcctcgagcccagttcatcatcctcctcggattctcttatatgtgatatatgtcaggaacgaagggcgttcttcttctgtcaagcagatcgggccgtcttatgcagagattgcgacttgtctatccattctgccaacgaattgactgcaaaacacaacagatttctggttcccggcaccagagtttctctgaaaccaatagagactttggctgcccctgagaaagctgtggccacggccgctgtcaccaaggcacttatcccgcctgtccaaaagatgccggatcatgcccagccatcaatggatctgcctgtagaaaccgtgactgcaagtaccagtaacagcgagttctcacagtacttgagcgaggttgagcaattcctaacctcggcttcccctgagcgtctagactggggtgatcagctgagctcacgctattggaaagtatatggagtcggcttggg

SEQ ID NO: 2682 - DNA, 814 bp, Pinus taeda
  Predicted polypeptide sequence is orthologous to G1655
gaaattttcttttatgcttgccatggaagggaagtgcagcaacatgtcccgagttcgaatctacttgacccattttctccctgagctgcagaagatcaagcggagacgctcaagcctaccgcagcgccagcgagccattcgtttcgcagctgatatgtgcttggctcgcactgccaacaagggctctgcctggactcgagctctgaacctccgtctcatgcgcaaaaaaaagaccatcaccatgatgaagaagaagaaatcctccatcataacgctggggagaaaaacgaaatcggcatctttccatcgaaaatgttgtaataatgttgatgttgaaacaggcggccatgatcatggcgccattgacagaagactgcggactctggagaagattgttcccggcggcaagaaaatggaagttcatacgcttttccaggagaccgccgactatattttgaatcttcaaatgcaagttcaaggtttggaagctcttgcagatttctacactgcgaattctgcaggtcgtgtggtcgagtgcgccccgctacaggaccgatcagcatcctgcgctgcacaggtctgatatggtatatacgcgagcttgcttgctctgtataattttaactatgcagtgtatatatgaaggcagcgaggatgtagctggttgttacctcggaatgtttctcactgtatggtatggctgtataaggccgataaatttactctctgtaaaggtactgctcctcccttaacgaggcttggcgtagtatcctgatttgtgtaaagttttcgagaaatatatcaaaatctttcc

SEQ ID NO: 2683 - DNA, 571 bp, Pinus taeda
  misc_feature (544)..(544): n is a, c, g, or t
  Predicted polypeptide sequence is orthologous to G1798
ggagagagagatgttgggggaggatctggaatcatgttcaatgaaggaattaaatcagctggagagccaagctgaccgaggattgaagcatatacgagctcgactgactaaaatgctagtggatgaaattgatcaacttaaatggaaggaacggatcttaaccgaagagaacctttttcttcgtaaaatgtgtggtgatgaacatgtggatggttcggcttttagaacacctcccgcacaacttagaagcatccagaacattgatgtggagactcaactggttataagacctccaactgtacaacagcaccctgacgtcgatagtcctcgataactgttgcatatgcaaattttctactttcatgaaataaacaaacagtacaactgcagcctcattttgttcgccttttgtaaacgtataattactattgcatatgttagctttcctctcatgtttttgtgatatggaaataaacacgttgtggatcaagcttgaaattgatatcaaacctttagcatgctaaatgaaaatttgcacattatnaataaataagaaatattttagatattt

SEQ ID NO: 2684 - DNA, 450 bp, Pinus taeda
  misc_feature (388)..(388): n is a, c, g, or t
  misc_feature (399)..(401): n is a, c, g, or t
  misc_feature (423)..(423): n is a, c, g, or t
  misc_feature (425)..(427): n is a, c, g, or t
  misc_feature (432)..(437): n is a, c, g, or t
  misc_feature (444)..(444): n is a, c, g, or t
  misc_feature (446)..(446): n is a, c, g, or t
  Predicted polypeptide sequence is orthologous to G1798
gatggcaaggggaaagacacagatgagaaagatcgagagcgcgaccagcaggcaggttacgttttctaagcgcagaaatggattgatgaagaaagcttacgagctgtcggtgctctgcgatgcccaactgggactgattgttttctcccccagagggaaggtctatgaattctccagtacctgcatgcagaaaatgttggcacgatacgaaaaatgttcagaaggaagtgacacgagtacatcaaaagagcaagatgtccagtgtttaaaacgagaaagtgcgaatatggaagaaaggattgaaattcttgaatccatgcaaagaaagatgttgggcgaggagctggcatcatgtgcattgaaggatttgaatcagttggagagccangttgaacgagnnntgagaaatgtacgagcgcgaangnnncggannnnnngcgaagngnatgc

SEQ ID NO: 2685 - DNA, 779 bp, Pinus taeda
  Predicted polypeptide sequence is orthologous to G1798
caattcgatcttgattttccagagacgatgtgattgaccattctgtgggcaaaagagagagaggagaatggtgaggggaaagacccagatgaaaaggatcgagaacgatacgagcaggcaggttacgttttctaagcgcaggaatgggttactgaagaaagcttatgagctctctgtgctctgcgatgccgaagtgggacttataattttctcaccaagagggaaactatatgaattcgccagtcccagcatggaggagattttggaaaagtataaaaaacgttcgaaggaaaatggcatggctcagacaacgaaagagcaagatactcagtattccaaacattccaaagaaaagcttgcaaatatggaagaacagattaggattcttgaatcaacccaaagaaagatgttgggggaagggttggaatcgtgttcaatgacagaattaaataagttagagagccaagctgaacgaggattgagccatatacgggctcgaaagacggaaatattggttgaccaaatagaatgtcttaaaaggaaggaacgtctcttaagcgaggagaatgccttactcagtagaaagtgggttgatcgtcaatccgtggacggttccggttcaacatcatcttcaattggattgggaagcatcgagcagatcgaagttgagacacaattggttataagacctccaaatgcacaggatcactgttctgtaaatagtggccattgaaattattatttaaactgatccatgttatcaaaattttctatgtgat

SEQ ID NO: 2686 - DNA, 753 bp, Pinus taeda
  Predicted polypeptide sequence is orthologous to G1798
gaggcaatacgagtctcgacggtatagagacagttttgtgttgagagacttgaagaatactcgtgtaattactaattactaattttattggcctatctatcctcggattccaaacagagttcaaaaagctggttcggctatcgttagcagtcatgaggtcgcaattttagcgcctctttaatatctgctgggtgcttgttctcattgcctggaaccagatctacaggagactgtaattcactgttttgcactgtagaatggagaggacaagaatggtgaggggtaaaactcagatgaggagaatcgagaacgccaccagcaggcaggttacattttctaagcgtaggaacggactgctgaagaaagcttacgaactgtcggtgctctgcgatgccgaagtagcgctgattgttttctctcccagagggaaggtccatgagttcgccagtcccagcatgcaaagggtgttggataagtaccaaaagtattcacaagaaagcggaataagtgataggacgaaagagaaaaatactcagcatttaaaaggagaaattgcgcaaatggaagaaagggttaatattcttgaatcagcacaaaggaagatgttgggggaggatctagcatcgtgctcaatgaaggaattaaatcagttagaaagccaagctgaacgaggattaaaccgtatacgggcaagaaagacagaaatactaatggatcaaagagaacaacttaagagcaaggaacggatgctca

SEQ ID NO: 2687 - DNA, 852 bp, Pinus taeda
  Predicted polypeptide sequence is orthologous to G1798
cgagctggttgggctatttcaggaagccattattgggtttagatttttgcagccggcattttctgctggtgtttgttgcggttctccgttccgcgggtctgattgattaattaaagagcaagagtgacgaaaggagtctggagaatggcgagaggaaagacccagatgaagaagattgagaacgtgaccagcagacaggtcacgttttctaagcgaagaaatgggttgctgaagaaggctttcgagctctcggtgctgtgcgatgcagaagtgggacttattgtattctccccaagagggaagctctatgaattttcgcgtccctgtatgggaaaattgttgcagaagtatgaaaagaattcacgagaaagtggtataaataatgcggctaaagagaaagatactcagcattcaaaacgcgaaattgcaaatatggaagagaaaattaggatcctcgaatcaacagaaagaaagatgttggggcaaaatctagcatcatgttcagatgaggaattaagtcagctacaaagccaagttgaacgtggattgaaccgtatacaaagacgaaagaatgaactattaatggatcgaattgaacaacttaaaaggaagtgtgctgatctcgaaggaggttcggttttgacatcatctgtgctccagcctggaagcacccagtgcattgattttgagactcaattagttatgggacttccaaatgtataagatcaccttcctaaactcatcttgttttcattatacaaataagctactgcatccttcctgttattttgtaaaccaattctcaacagtgtgaatcaagattagaatgtgagtgtaatcctttttgtattt

SEQ ID NO: 2688 - DNA, 871 bp, Pinus taeda
  misc_feature (108)..(108): n is a, c, g, or t
  Predicted polypeptide sequence is orthologous to G1798
gagaatgggaagggggaggactcggttgagaaagatagagagcgcgaccagcaggcaggttacgttttctaagcgcagaaatgggttgctgaagaaagcttacgagcngtcggtgctctgcgatgtggaactgggacttattgttttgtcccccagagggaaggtccatgaattctctagtacctgcatgcagaaaatgttggaacgatacgagaagtgttcggaaggaagtaaaacaacaagtatagcaaaagaggaagatcccaaggctttaaaacgagaaattgcgaatatggaagaaaggattgagattcttgaacgcacgcaaagaaagatgttgggcgaggaactggcatcatgtgcattgaaggatttaaatcagttggagagccaggttgaacgaggcttgagaaatatacgagcgcgaaagagcgaaatattggtgactcaaatagagcaacttcaaagaaaggaacggatgtttagcgaagagaataattttctccgaaagcggattgtcgatccccattccgttttgacaactcctgcaagtggatctggaagcctccaaagaagtgaagtcgagactcaactggttatgagaccgcccagttaaaatgctgattttcttgttaatagttctcattgataatcactgtattcatatctgtgttattaatttattatgaaatgtttatgttaataaaaagtaaaggtgcttgccaaatagcatctcactgctcaacccttaaaaaaggtctcccatgcaggtaactcattgttttttaaacaaagcgcgtgttcaaaaaatagtcagtatgcaggcttactatcaatacatatttaaaagttttatttttatatatttttt

SEQ ID NO: 2689 - DNA, 859 bp, Pinus taeda
  Predicted polypeptide sequence is orthologous to G1798
tagcagacaggttactttttctaagcgcaggaacggtttgctcaagaaagcttacgagctgtcggtgctctgcgatgccgaagtgggactcattgttttctccccgagagggaagctctatgaattcggtagttccagcatgcagaaaatagtagaaagatatcaaaaatattcggatgaaaatagtatgaataaaacagttagagaagaaaatactcagtctttaaagcgggagattgcaaatatggaagaaaccatcaggcttcttgaatcaacacaaagaaagatgttgggggagggtctggcatcatgttcagtgaaggaattaaataatttggaaagccaagctgaacggggattaagccatattcggtcacgaaggacggaaattttaaagaatcaaatcgatcaacttaaaaaaaaggaacgcgtgttaagtgaggagaatgcttttctccgtaaaaaatgtgctgaggctagatatacggatggttcggtttcggcaagccccacaaatggagttggaggcgtagaacagattgaagtcgagacacaattggttataaggcctccaaatgtacaataccgctttcctgttaaaaatcttcattgtaattccttgctagtctgatggatgttattttcaaattcaaacatgatcttgatttattatgagtattcttatcttgttaagtttcaaaagagtaaaggatgaaaactcattttaagttcaacctcattgtttaacaaaactaaaaaatacatatatattagccttactctgaaaagactaaattagggcttccagaggatgactgctgtaattagtaatttttttatataaatctgctttccatgc

SEQ ID NO: 2690 - DNA, 824 bp, Pinus taeda
  Predicted polypeptide sequence is orthologous to G1944
gtcctcccgcggtggtggacggttcgagcccccgcggcggctctcagtattcgaaacgttacaaatccggtggccgcagcagctaagatcaagatcagcttcttttcacactaaaatttactcttattcagatctggaatctctgctgctttcagtaatgctctagaaaacacacaagaaattccatataactacactgagatttataaagaaattcaagcctataagctgaattaagcagagtacagtagagtatttatgaatgaaaggagagatttccccggccttcatacttcagggccgacttcattcttacacccaggattccaacagcatcaccacctccacggctccacgaatctcaatgctgctgctgctaataacaatgctatttctaatgtcaatccattctacatcccacagggaggcattgccagtaacgctacactgcgcttcatgtccagtcctccttcatctttagcaattggcaatgccaatccaaataattctcctccagaagggcctgctgcttcaccgggtcctcataatccattacctcctagaatgggaatgaatatggggtttcgttcagagcctttgaagagaaagagaggaagacccaggaaatacagtagtgatggagtaggtttgggattatctccattgactcccagctctcagtcattatccgaaaaacgagcccgcggctccggctccggcgccgggtccaacaagaaagttcagttggctgcacttgggagttcgggtcatgggatttactccacacatcatcacaattgaagacggggagggatgtgtcgaag

SEQ ID NO: 2691 - DNA, 839 bp, Pinus taeda
  Predicted polypeptide sequence is orthologous to G2052
cattatcggccaccagcacagaaagacagcagataaattatcaaccgggaaagagaagggaaaaggaaagacaggtggaagggggcttcgataccccttccttccccatgggaagattagctttacctccaggtttcaggttccatcccacggacgaagaacttatctcctgctatctcaagggcaaactcaatcatgcccttagaggagcagagctcgaagttattcccgaggtcgacctttacagaaacgagccctgggatttgcctgcttatcaagtttcctggaacagttatgttcagtttttcagtaacaatagttaatgggatgatctggattttctcagttgggtttgcagaagtgtaaaaattctgaaaaatccttcctgcccagccgtgatatggagtggtatttctttagtcctcgtgataggaagtatccaaatggttcacgcactaatagggctactgaagctgggtactggaaagccacaggaagggatcgtgaagtttactctcgagaaaatacagtaggaaaaaaaaagactctagttttctatagaggccgggctccagaaggtgaacgaactgattgggtaatgcatgaatatcgtcttgagaaaaatgaatgtgagccaggaccttgtttgcaggtattatttatgaattattcattctttgggatgctgtttttaagtgaaatgcatttgtttggataccatcatatcgaaaacatcatcaatattcatatgcatagatagagacatatgcacattcatacacctcttttgttttgaagatatttacttcaaggctaaaatataatgaatgagctagaaa

SEQ ID NO: 2692 - DNA, 889 bp, Pinus taeda
  Predicted polypeptide sequence is orthologous to G2226
aggggtggccagacgcttgcagaagaggagaaattagaacttagaacttatgggtttcccgagcttccccggtgtatcagcatggcttctactgatcatctctacggtcctctcagtccaatgcatcaaggacattgctaattcaatttttcatattttccacatgatcttctccattagaacttctgctaataacaatgatacccaattcatgagagactcggctcggctcccttttgaagaagagaccccagtattgggctcagggctggcgcaattgcccccgatagctgaagaaatcaggggaagcctgcctgttactcattatcaatcatcacccacaaatgcccatgtggtggaatgtgctgtttgtctgtcaagttttgaggaaggggatgatataaggcagcttccatgctgccatttctttcacagagtttgtgttgataagtggctggatcaccaacagacaacttgccctctctgcagagcatctcttgtgccagaggagacagccaataagctgaggagaagggaacaagaactcacagaggagctcatgttttggttctcttctttccatggccatggattcaacagcatgtggtggttaaggtagctttttgttgttgtatgctgttcaagttttttaaatttattctcagtgcagatagattatctaagatacccatccaagggtttcctctgttttttctttatatataatttagctttgtccttactttcagaaagtaaggacacccaatctgtcaattgttgtgggatggcccatcagtcaaacagttaggcatttcgcctggatcttgtatatgaagtactgtacatatatataaattttttcgttctctatatgcaaacatgcttgtct

SEQ ID NO: 2693 - DNA, 809 bp, Pinus taeda
  Predicted polypeptide sequence is orthologous to G2226
cggccgggggggtggggtgggtttatttattaggaatctgaatggatggatctatattacgcgtgtcaagaatttgtatgaaaaccagagggtgcaggaattagaccaaatacggtgagacaggttgcctagaaggtgagcacagccgagggtgcaggaattttgagcaaatacagtgaagaaacaggagcggtgggaaggtatttgctgctgagcagagaaagatggggctttcaagattcccagacgcgtttgaaggaggagtgataccacttttgatcatccgcacagctttgtctatagccatggtgagggacgttctcatctcgtttcttcaaaaaatgggtctcaaagtgattacagagcaaccagaattagcccaatcatctaggtcatttgtatatgctgaagaagaagctgctgaattgggctctgggcttgcagagctggccatgaccactgaagaaattggagataagcttcctgtatcactgtttcaagtgtcgtcgtcgtcgtcatcttgttcttgttctggttctgatggtgatggtgtcactgagtgtgtggtgtgcttgaggaaatttcttggaggagaggagattcgaagcctgccctgccgtcatgtgttccacaagatttgtgtcgacaaatggattctggattatcagaatatgacatgccctctttgcagagtatgccttgttttttctgtagaggacgagttgagaagataagggaactggtaatgcagttttagtcctagttttcctgtagaggatgagtagagataaggaactggtaatgcggtc

SEQ ID NO: 2694 - DNA, 864 bp, Pinus taeda
  misc_feature (837)..(837): n is a, c, g, or t
  Predicted polypeptide sequence is orthologous to G2346
gactggataaatccaatccagttaccctgcaatagaagtagtctgaagcaaatctgatgtgctttcttttcaagagtggatacccaaagtaaaactgatgtgctttcttttcaataatggatacccaaagtaggttatactgctaaagaattaccaccatgaagttcaaacattggaacactgtccaacctacaaccatggtacaatgctgttgttgacatttccttcaaaaatgaaaagaacattcaacaaatatagtgcgtctgagtcctccaatggcagaaattgcctcgggctagcacccactacatgcagggatgatcctaattaaacatgaaataggtgaactagattttaaaagaacaatggacattgaccttctcgaatgaagatcaggattgctatttctacagaatcaaatctatcaaatatattcggcatgtctctcatgatctccgtggggagatcctgacattctttgggatttttctctgttaatggctaagaaaggcaagcatctttttggctgccctttgtaatacctgtctacatgggactgatcactgcagttattacgacacttttgcccctctgccgtatcttcagtatgcaccttgttacaatttttacagtaggctttcccacatccctggcaagtagtcttggagaagaaagtgtacccgcaacaaaatgagcatcgactcatgctcaatttccaaaggccaaagttataaccagtatgtttggcagaagctgggagaacctgataagactgaccatcctgggcagaaaatggtttaggagacaccttggagaagccaattgaagaaccagtangagaataagacgcctttatcttataca

SEQ ID NO: 2695 - DNA, 324 bp, Pinus taeda
  Predicted polypeptide sequence is orthologous to G2574
gctgaagtccaatccaaattccatggtctccttgagcagtaatagcaataataatagtaatagtttctattctgtatttggggcttcgggcctcaaattggagctcccttcaagccaatcagcggggtctgctggaagcgcagacacgccaaagtccaatctatcttttacaaatttttcctcctcttcttcttcttttcagcaaaccaactgcctgatttcagaggcggacagttttaatgacaacaactcgggactcctggaagcactactcatacaggaaacacagtgtcgtaataataataataataaagatttggattc

SEQ ID NO: 2696 - DNA, 704 bp, Pinus taeda
  misc_feature (24)..(25): n is a, c, g, or t
  misc_feature (484)..(485): n is a, c, g, or t
  misc_feature (514)..(515): n is a, c, g, or t
  misc_feature (539)..(541): n is a, c, g, or t
  misc_feature (616)..(621): n is a, c, g, or t
  misc_feature (631)..(632): n is a, c, g, or t
  misc_feature (634)..(636): n is a, c, g, or t
  misc_feature (693)..(699): n is a, c, g, or t
  Predicted polypeptide sequence is orthologous to G2747
gaaggccaccaataatatggcagnnctcatggccatggagcatttcctagaaatcttgagggactcaaatttacacaacaccataattgacgctaattccgaattgataattaattcggtcaagataattggcaatggctcagtaccagagaaagtgtcgagacactggaggctactgcaattttatcaacatattcaatcccacttgcagaccatgaaaacccttagttttatccatgtgcgcaaaacaaccaatagattatcggatattttggcaaatgaaggtgtgctctgttccaaaagcaatataagatatgactggataaggactccccaaggacgtctatgggaagaatgctccaaacaggcggccttgaatagagagttctatcaaagcaaggaaaataggcaggatgaagactaatggagacagaggatttttggtccacagggggaaacaatatatggcaaagtgcgagcaggnngtcagatacccctctaaattctacgtaannttttcaggggggaaaatgctcctnnnactatgcacactcatggttctcgggtgagaaactataaacaggcctagtcttcacatggaccctaataacattannnnnngccttttaanntnnntggggtcgttgactcatttaaaatggtggcaagttgatgccatcgcaacaatcccannnnnnntgcga

SEQ ID NO: 2697 - DNA, 867 bp, Pinus taeda
  Predicted polypeptide sequence is orthologous to G2763
gcctgtggacgatctttctccctatctctgtgcaggaacttcacaatcgacagcagctgttttcctagtattttaggcttgttatttttctcggccattatggaagagcgttacggagatgggaaagtggtggtatggcgggccattttgcaacgaaattatttgagtcgcctggtgctcgcgctgcgccataggagaattggaagatcaattagagcctcggctcgaattcgatccgttaaattggctgcagatctgtcactggccatgaagtcagaagatcgaactgcgtggaaccgagcaatccatggaaaacacctttcaaggctccagagatctcactacaaactgcgagtagtaaaagccagaaggaatctatatgtaataaagagatcggcctctgccaaaagcgggacgaataaaaggacctctgtttggaagaagtttgccaggccgttcttccgaagggcgttgaggaggggatacaattgcagggaagcaggaggaggtgccgtggcttctcgtctgcaaaccctaaggttgctcgtcccgggaagccgtgcactagacacgcccgaccttttaaagcagaccactgactacatcgcggtccttaagaagagggttcaggtcatgcaggcactcgtagaatgctgctcaaattaaagcgccgattcgaattgccagatctaggtctaatgtatgcctgccaggtataacaagaaggtcgcaaggtccaatcttgcgctgcatgaacacgcaggtggttgtatatcgcgggaataacagaaaatattatatcgtgttgaggtggggcgtttctaaagatatgcggcaggtgatctgaataatgctggaggctggtct

SEQ ID NO: 2698 - DNA, 802 bp, Pinus taeda
  Predicted polypeptide sequence is orthologous to G3032
atctggacgagaaattattattagctgtacgctaaataaagaggctgaagatgaaatcgatcaactgacggcaaagttcaggagttgcctcatgaaaaccatatatggtgaagctggtgcttcagatgatagaaaccctcatgtggagaagggtccgaacttgatgataacaacgatcgtagttcaccgcagctccatctcttctgacaattactgccaccactcatcctgtgacaggaaaaactctcttattttgaagcgcgagagttccctttctgaatggggaaaagctgatgctacaaagaagattgaaactccccgagatgatgttggacgggcaaagctaccgcttcctcctcgccccagggaagcttcttacagaaatccactccagatgagctcgtcccgcggggattcgattgagttgcaaccaccaagtcctttcgtacaatttttcagtccccaagaatcgttggcccgaaataacgtgcagtcaacgctctccaaaatcgcgaaaaaacagaaggagatttcggtaccatttactctttctgcaataaagttcattgtttatgcatctgatcggggacattttactgctagatttttttatttgatattttagaattccaaaactcgttcttgctgccactggattttaggttaagttatggaggaacactctaactctggtacgccaatgcggaaaacctgaggtctgtgctatattcggctgttacctatataattgtttcctccctttctttaattgtgaaaactactttacatacattttcttcat

SEQ ID NO: 2699 - DNA, 793 bp, Helianthus annuus
  misc_feature (677)..(677): n is a, c, g, or t
  Predicted polypeptide sequence is orthologous to G12
ttttttttttttaatgctaaaacagagagatttattaattaaaacaaaatacaccacaattatttacattactgcccttgtaccttaaaacaactactccaaatcatcatcaagttaggtataaaaactaccggaccatccaccacccatcatcaacaatctccatccgggtcttcggattcgggtttcttattcaaatcaggcttttcttgaaaccaacaagccttcttcaactcagaactagaaggacaattatgatgatgctcaaacgtaccactcttatgcaccaacgtacaacacgtctctgcatctactctagccccaacttcaatagcttttttcctaatagaagccgtgctcagctcatccaagccgccatcagaagccatcaactccgggaagttaagccgagccgacggcccccgtaggtagtacacggccgtgtcatacgcccgtgcggcggctaagggagtcgaatacgagccgagccatatcctcgaccgcttattcggctcccgaatttcggctacccactttccccactttctcatccggatccctttgtacggtcgttgatcggactttctttttccagccgccggagaatagtttaagtcaccggagacgctgccggagaagggttttctggcttccatcgatttagtgacggatccagnaaattttttctatataaaaaagatatataaattctcgtaaggttttttggaacccgaaactatgggtagatccacccctgattggattgggatatttgtgttagagggtttttggg

SEQ ID NO: 2700 - DNA, 566 bp, Helianthus annuus
  Predicted polypeptide sequence is orthologous to G15
ggaattcggccattatggccgcttgaccggaacaaggatctttacttggggacattcagcacccaagaagaagccgctgaggcttatgatgtagcggccataaaatttcgtggagttaacgcggttacaaatttcgacatatcgcgttacaatgtcaaaaagatcattgcaagtagtacccttttagctggtgagctagctaggcgaaccaaagacgtagacactacaacggagctcttgtcagaccaaccaccggctcaaaatggcgagcccaagaccatatcaaccgagcacactaccaacaggaacatgttggactggaaaatgacactctatgatcaaaaccagactggaccagggctcgatgtggacgagacaactaaacttggagcacatttatcaaacgcttcttcattggtgactagtttgagcagctcgcgagaagatagccccgagagaaattcttctcgcgatgcatggttcccgacagcagcagcagcagcacaaatgagagctcatatcccagtctttgctgcatgggcagatgcatgatcatgaaactgaaa

SEQ ID NO: 2701 - DNA, 741 bp, Helianthus annuus
  misc_feature (584)..(584): n is a, c, g, or t
  Predicted polypeptide sequence is orthologous to G280
tttacaacacaacacacacttgcattcttcattaaaacctaaaaattacaataaccacctactaacataaaactaacaagacaacctcacggagccttttttttttgttaaaagtaactctatttccagatacgaaattcccaaatccagagcaacaacactctacccacttgtacatcacacatcaacacttgtactcaactctaaacttaagaatcccacatccagtaacacatctaacaccgtttcttttttccatcttctcagttatctcatgaactcccaaaactcaattagcttcaacaccggcaggctccggctgcaccttacgcggccgtcccctcggccggccggttttcgacggcggcgttggcaccgtcgcagccttaactttcttcgccgacggtggagcattcggatccttcttcgggcgtcctctgcctctcttaacttcagaacctgccgttgccggtgacgtcaccgccgccggagtctcggtctccgccgcggatggatccttagccttcggaggacggccgcgaccgcgtttcgctggtgtggcggagtccggaccatgtagttgntatttgaaaccactagctcaccgttttcaacgagtttgttcaactgatccgccaggatatttgtgtgttcttccggtaagcttccgcaagttgattcgatgtagtttgagatcgacgatgtgcttgaaccgtccttctctttcagagcatcaatcgc

SEQ ID NO: 2702 - DNA, 1062 bp, Helianthus annuus
  Predicted polypeptide sequence is orthologous to G1145
atttggatgagcttttgaagagtgtttatagtgctgagactaatcaaggaacgagtagtaacgcggttaattatacggagctcaattcgggtgtgacgaagaagacggttgatgaagtgtggcaggatatacaacaaggtcagaggaagaaaaagaacgatagcgatgacgatgggagtaatgtaagtaagggcggtagttttaagagcggggacgggaagcgacagcgtactctcggtgagatgacacttgaggatttcttggtcaaagcgggggtcgtggccgaatcttctcccgggaaggtgaacgaagaagggaatcttgaaccgcaagaaacgcagtggataggctatcaaagtcatgcagttcagcagcagaatatgattatggcgggtcattatcaagttcaaccatcggttacggttcctggtaactctttgatggatgtgggttatatgtccccaacctctttaatgggtagtttatcggacagacatatgtctggaaggaaaaggtttgcttctggagatgtgatggagaagacggttgaaagaaggcaaaagcgaatgataaagaatagggagtctgctgcgcgctcacgagcaagaaaacaggcatatacccatgagctggagaacaaagtttcacgtttggaagaggagaatgaaagactcaggagggagaaggaggtggagaaggtaataccgtgggtcccaccacccaagccaaagtatcagctccgaagaacttcctctgctcctttctgacggctagctaatctggtcagcggtcctgaatttgtgatcttggtcatgggctctgagtcatgaaaaatgttctgcagcaatgaaagtgaaaggcttgtagaccttcctttttatagcagggaagctttggtgtaccttggtcaactctttttcatttccatctaaatctttatcagatgcattatggatgatgtacgccttgtgttttttgctacttttcggttttagtttgttttatacctagtttcacgcagtttcttgtttaatgtattgtccaagggtgatcttattatgt

SEQ ID NO: 2703 - DNA, 913 bp, Helianthus annuus
  Predicted polypeptide sequence is orthologous to G1145
caacatgttcccggtccctctttggctcgccagtcgagcatcaatcttgctcaagatctgcgcaaaaagacggtggatgaggtgtggcaaggtatccaacaaggtaaaaacaaaggtagtaataatagtagtggtagtggtaataatgatggtgataaaaggggtaatcgagagcgacaaccgacgctaggtgagatgactttggaggatttcttgctcaaagccggggttgttaccggatccggaaagaaaaatgtggatgtgaatcaagagaacgcgaatcatcaacaagcgcagtggatgcagtatcaggttgcaccgataccgcagcaacatgtatatatgtcagggcatcatccggttcaacagtctttgtcgattggggcgaacccgatgatggatatggtttatccggagacccaaatggcaatgtctccgtcgcatttgatgcataatttatctgatacgcagacgcctgggaggaaacgcgttgcgtctggtgacgtgatagagaagactgtcgaaaggaggcaaaagagaatgataaagaatagagaatcggctgcgcgttcgcgtgcaagaaaacaggcttacacacatgaactggagaacaaaatctcacgtttggaagaggaaaacgaactacttaagagacagaaggaggtagggatggtattgccgagcgcaccaccacccaaacccaagtaccagctcagaagaacaagctcggcttctttctaacagtttgttttcatcttaataagaatattagtatgttatgtagagccaattttttcccttttctcagtttttgttaggagacatggtttttatgcattaagtttgctgattttcttaggtttctacaaacagtgtatcgggtcaatattatggtcgacgaatgtgctgtccc

SEQ ID NO: 2704 - DNA, 538 bp, Helianthus annuus
  Predicted polypeptide sequence is orthologous to G1911
gatatttcctcatcttaattacctggggtgttcaacttctctgcattgaagaaatggcttcaagttctaactggacgtgggagcaaaacaagctgttcgagaactcgttagttacgtacaatgacgaccctgatcgattccaaaagatcgctaaaatcgtaggtaagagtgtggaggaggtgaaggttcactaccaaaaccttgtccatgatgtgaatgctattgaggctggcaaaattccgctgccaaactacaaaaccgatgaagccaaaggacaacaaaacaaaaagaaatgaatttggaatatggttattcaagataaatttaagtagtgggtaaaagaatagtaatttaataaagtccccaccccctgtgtgttttctcttgtattttctatggaaatatgtatgtttagtgttcttaatccaattaagaactgcaagatatatagttatctaatggtaatatcatatgttgttgggccaaaaaataaaaatgattgtataaattaaacatgtcggccgccttggcccaatcg

SEQ ID NO: 2705 - DNA, 675 bp, Helianthus annuus
  Predicted polypeptide sequence is orthologous to G1930
ttttttttttttagaaaaacaaaaagtttctatttttcttgggattttactagaattaaacttgatccctacattgagctttctttagctcaattatctttaaatttctaaaaatcaatatacaaacttttgcaacttgcaacttgcttcctcctctattccattcccaccactttccagcttcattccccatcatcatcatctctagaggaaaaaagtagaccaaaatgttaccacacaaaccctccaaacatgagagattgttacaaagggtcaataatcttttgcttcttacaattctccattcccaacaacaccatttctatgttatttctctttccattgcaagtgctgctatcaagagcaagagtattattattagcactaaatatgttgactccaaacaacctaaacatttggactggttgtactggttggaccggttggaccggttggattggtcttgaactcgtgttaccagatccggttttcgtcttccagtcgatgtaaagttgcttgtctggaccggtagatctttgaaaactaacaatgtcaccggcttttaagttcttttcctttacaaaccggctccaacctttggtcaacacgtagctttgactactgttccagtaagagtaacgaaatctccatactttcataccaatatcttcgaaa

SEQ ID NO: 2706 - DNA, 934 bp, Lactuca sativa
  misc_feature (872)..(872): n is a, c, g, or t
  Predicted polypeptide sequence is orthologous to G2
cttggcggggattcgcatttcatcatcaaatggctagatagaaattataagactcgaagaaggacgttgtttcagcgttgcaagtgttttggttattgggtattgactttgaaaaagagaagtaatgtgggatctaaacgggtctcccgatcggagaaggagagacgaagacgaaggtgaggggtgttcttcagcgccggtggtaggggaggaggaatataataatatcaagggtaaaagggttggaggatccgtgtctaattccagctcatcgatcatagttgtcgatcaggacgacgggtccgacgtcgatgaggattccgacgccggtggtttacagaaactcacaaccaccggcgatagcaggttattcgggttctctatggccgacaactcatcctgggactacaatccgccggtcactcatcagttcttccctttggacgactctgaagttgggtctaccaccttcgtcggagcaggtagagagacgacgtcgttgcccactacttaccctacgtctaactggtttggggttaaattctcccacccgtcatcggagccttcatgtttcagtggtggtgttgccggtgggaacaatggattttccgggaaggtcaccgatgttcctcagccactcaagaaaagccgccgtggaccccggtctagaagttctcaataccgtggtgtcaccttttaccggcgaaccggccgatgggaatcacacatatgggattgtgggaaacaggtgtatcttggtggatttgatacagcacatgcagctgcacgtgcttatgatagggcagcccatcagtttcggggtgtggaggctgacataaacttcattcttcaagattatgaagacgacctanaacagacgagcaatttaacaaaggagagtttgtgcatgtacttcgaagacaaagtactggtt

SEQ ID NO: 2707 - DNA, 876 bp, Lactuca sativa
  Predicted polypeptide sequence is orthologous to G3
tctatcgaatcggaggagaggtcatgtagatcactgtcgtctccgattgaatcagggatattaagacgtgtcgatgggccacggaggtagaaaacgtcggtgtcgtaggcacgaccggcgtcgacgggggaggagtaagaaccaaaccaaatacgagaacgtttatcgagttctcgaatctcggtgacccacttcccccacttcctcatcctgattcctctgtagtagggtttgtttgtttcaattgactgaatctcctttctcttagatgttgaacagccgccgtctgcctctatgtgtggcggttgtgattgtcgtatggttcatcttctgttgctgttcctgtaactggccggcgtaggtgccgccgttttgaagccttttctgttcttccccagtatgttgattgtggtgactgtacctgggtttgtgagttctgtggtgcttttttctggtatgtcgagagggccgttaatctatctacatctgcacatctgaggtataatcattgttgtaggggtgggagtgtagttcttccttatccttctaggtttcccccttattttgttgccctatatggctggaaacgggagagcttccacagtaccaccacacttctcttgccattgccgatgacaaacacaaagccttggttgccgttggaaccttgactttgcactaaacagacttctacaataacgaaaaaagagaaagaagaagccaaataaggatgaaataaagtttcctggcgtgaagagatcaaatttagagatgttaaactcccactaaacttggtcgatgttcccaagggacctgttgtccagatttttttaaagatccgcaagttacttaccccttgctgcccacattaaacga

SEQ ID NO: 2708 - DNA, 852 bp, Lactuca sativa
  misc_feature (809)..(809): n is a, c, g, or t
  Predicted polypeptide sequence is orthologous to G15
gcgggcagatacgttgctcacttgagaagagaagcagcggtttctctaggggagcttcaatttatagaggagtaacaagacaccatcaacatggcagatggcaagctcggattggtcgtgtggcagggaacaaagatctttacctaggcacatttagcactcaggaggacgctgcggaggcttatgatgttgctgctatcaaatttcgtggtgtaaatgcggttacaaactttgatgtgtcaaggtataatgtggaaaggatcatggagagcaatacccttctatctggggaactagcaaggcgaactaaagcacgagagcccatgaccgaggttgtggctaacgaagctcataatggtgaacacaaaaccctctcgaatgatgtcaccagtgatggtagcatgttggaatggaaaacggaagtatatgagcaaaacagtggtggtggagttgagggagatgagtcgtcgactatcaagaacaatggggactccggtgaagaatgcatgaaaaggaacaagaatcttccgatggttcttgggatgccgccggcgatgaatacatggatcccgactgtagctgcgacaacgacccaactgaggtctcatatgccgatttttgctgcatgggcagatgcgtagttgacgatggagacgagaaagaagtcttaggtcctgtaggatgtgacgaacccctaacaagctgacatggcgatgaactacggtgtttgtgttattttacttgctttatgtatgtgttagttttggttctttttgtgttttgggaaaatgcatggaatgataatttgnggactatgtaggatttttgtagacgatgggggtttgaactttc

SEQ ID NO: 2709 - DNA, 860 bp, Lactuca sativa
  Predicted polypeptide sequence is orthologous to G280
gcggggacactttgtactgtgcttcttcgaagctgacatctcctttctctcttctctgtacaatctcctgcacttccttccaatggccgccgcaaaacatacccaatccccatcactgccaccatattcagagatgattttcgctgcaattgattcgctgaaagtcaaggaaggtgcaagcgaatcctcgatttcagactacatcgaatcaacctgtgataatttgccagatgaacacgccaatatactgactgataacttgaacaaattggttgaaagcggcgagctagtggtgttgaatgacaactacatgcgaccggagcccaccgaaactccgaagcgcggccgtggtcgcccaccgaaggccaaggacccttctgtttcagaggctgtgactcaggcggagcctgggtccgaagttaagaggggaagaggacgacccaagaaagatcctaacgcgccatcttcagccaagaaagttaaggttggatctacctcgccgccgtcgtccaaaaccggccggccaagaggtcggccacgcaaggtgcagccggagttgacaagcgttgaagccaattaacctttaacttgatgcaaagaagagaacagatgttgcagactgatttccaaatcagaaatttctatgtttagagtaatgtacaattctcactgtatgatgtacaaggaactataactagcattctctggatttagaagttttatctctgcaaatttcaattacctaacaaaaagcctttttataaagggtttcttattagtttaaggtgtttttaatgtctttagggtttcttgtaatataacttctatgttaaatgcatttgtgtgttgtattttgccta

SEQ ID NO: 2710 - DNA, 641 bp, Lactuca sativa
  Predicted polypeptide sequence is orthologous to G481
tactcgtttccgcagctctcaaattctccaccactttcgcctgcaccctcagcatccccggagctccggcagtctctgtctcttctagagccggagatcttcttcgcgccaaattaattcgaataattcaacggatatggcggactcggataacgaatctggaggacacaacgcgggcggtgatttgtcggcgagagagcaagacaggtttcttccgattgctaacgtgagtcggatcatgaagaaggcgctgccggcgaacgcaaagatctccaaggatgcgaaggagacggtgcaggagtgcgtgtcggagttcatcagctttataaccggcgaggcttcggataagtgccaaagggagaagaggaagacgattaacggtgacgatttgctatgggcgatgacgacgttagggtttgaggagtacgttgagcctctgaaggtgtacttagcgaagtacaggggattggaacgggagaagacgacgatgggaacgccaggggagaaggacggttcatctggaggaggtgttgatgctgcagtaggcggcggaagtactgccggagagttaatccggtggatataacgggatgtacggagggacaggatatcatcaaatgtataatttcgggtcagtatca

SEQ ID NO: 2711 - DNA, 708 bp, Lactuca sativa
  Predicted polypeptide sequence is orthologous to G729
tgttggacccgggattcggactgatggcccgaatgcgggccgtttaaattctatccttctcaagatatagtttgtttccttcggaatctctatgttctccatgcaaccaagcctcccttgaagaattgctccatagaccatactgacaatctttctcttgatgaacactagaccttcctccatgttccgttgataactgatctgtcggccttgggttacgaatatcaaacatgatatcgtccagaattatccccagatgacccattctcgtaaatatcagattgccctgaagacacaggagctcgatcagtctgtctttactgttcggtacatctgcaagtgagatttaacatgtgacaaagctaaatctttcacatccattaactcaagaactgacttgggtgttgctctttcatggccgcctaaaagctcaacagcatggacaaagcgagcatgaagggtagtcgtccagcgcatcctcggagccctcatactgcgtttggaggggaacctcgatgataaaaatcttgatcggacaatattgataatattattgctatgaattatagaactggtggtcgtataattagtgcaagaatctaacgaaggctggttcttatgatgcggattgcgcattatcgcgaaattgggaggggtattctggtaatcaactcgaattcctcttataggactccagaaacctaattt

SEQ ID NO: 2712 - DNA, 987 bp, Lactuca sativa
  Predicted polypeptide sequence is orthologous to G729
gcggggcttccgtttcatctctccctatcaaaaaaaaaccctctttcttttctcactacattttcccttccttcctattctgcaaaaccaatcctactcctactttatactctctcagtccagaataccatgcaaagattaatgcaatcataagtcactcaaccagcatataatcagaactacatcccctttcactgacacccactctttatccatcgaaatgtttctgagctcaaatttttctccaatgacaaataacgaagctacaactttcccagatctatccttacagatcagtcctccatttgcagcggatgagtataacatgacaggttgtatcatcaaaaggccaccctccacctcaagcagcagcagcgatttaagccaagaaaacaccttcaaccatcaccactaccaacagcttatagcagcagatatggatggttttgttaaccatggtttgcagtttgatcagcagcagcctcagctgaccttggggcctgagatgggagctttgaatgattgtcatcccaaccaccattatcatccgcgtggaccacgtcaaatctactcctacgatttcaagagaagctcgaggatggttaacagtgtcagaaggggcgctagagctcctcgtatgagatggacctcgtccttacacgcccacttcatacatgccgttcagctccttggtggtcatgaaagagcaaccccaaaatcagtgcaagagttgatgaatgtgaaggatctaaccctagctcatgtgaagagtcacttgcagatgtacaggacagtgaagagcactgacagaggaggagcagttgcactgacagatactcaagtaattaatcccagggctccaatctcatttgttgaagtagagggagatatatcaccatctactacactgcatatatctcaaaggagatcctttgaatcgtctttggaaacgaatgatttgagtttacacatgaaaaaaaatgtatc

SEQ ID NO: 2713 - DNA, 772 bp, Lactuca sativa
  misc_feature (634)..(634): n is a, c, g, or t
  Predicted polypeptide sequence is orthologous to G1020
acttggtgttagtgttggtgcgaaagagccgcattttagaggagttaggaagcggccatggggggggtacgccgctgagatccgtgatccggggaagaaaagccgtgtgtggttgggaacttttgatacggcggaggaggctgctagggcttacgacgcggcggcgcgtgcgtttcgtggtgctaaagccaagactaattttccgacacatgatgatcttggtttgttgaagctacaaacttgtccgaatcagcggagcccgagtcagaccagtacggttgagtcgtcgagtcgtgaccctgaaccggtggttccgcttttggatctcaacctgtcgtacggtagccctcctcccttcgtagtccagtttccctacaacccccaccataatcataaccaaccccggttctccaccgtccccggtgccggcttttattcgccgccggcgaatcagatgttttatttcgacggaggatccaaaccatctgctcgccacatcaccaattgcgacagatcgtcgatcattttccggcagtctgctagtgttgcgaagagcgacgactctgcgtcatcatcagttgttgacttgaagccgtcgcctccaactcgacgcgtcggcgtcacaatcgatctncacttcccgccgccagtggaatcttgaaattcatattcatcttgaattcgtaaatctgaaaccgtaattaggaatattacgtttttacataaccgggtaggaatacggcaacgtcgtttagcggtggtgatcatgtat

SEQ ID NO: 2714 - DNA, 745 bp, Lactuca sativa
  misc_feature (565)..(565): n is a, c, g, or t
  misc_feature (624)..(624): n is a, c, g, or t
  misc_feature (695)..(695): n is a, c, g, or t
  Predicted polypeptide sequence is orthologous to G1020
aaacctgacggcaacaccggcggcggcaatggcggctccgagactcgctaccgcggtgtcagaaagaggccatggggacgttacgcagctgagatcagagatcctggaaagaagagccgtgtttggctaggcacatttgatactgcggaggaggcggcgcgtgcttacgattccgccgcacgggagttccgtggcgataaggcgaagaccaactttcctacctccaccgaattgtcgctcccgatggtcgccgttggtgggaagcctaaggctgtgactaaaagccctagcggtgagagcagcaccgttgagtcgggtaactccgccgttccgatcgccgccgctcctcttccaccgtcggctctcgatctcaccctgtcgcactttcctgttggtttcccgatggctcattccttgttcctctaccattctcagatcaacaacaccgtcaaacacaacaaccgtttggacatgttcagattggacggatccgttcttcctgcacccaacctgactatcgccgccggcaacaacgcacaaagcgactccgactcctcttccgtcngtcatttcagtcatcctaccgatcgtccacaaccaagaaaaaaccttcgctcttgattntgatcttaatttccccccgtcggaagttgcctgatgtaattttctttttttagcaatctccggtcctccgncaccctccgcccctggtttccctttttttttttcatcgcagagcagatca

SEQ ID NO: 2715 - DNA, 895 bp, Lactuca sativa
  Predicted polypeptide sequence is orthologous to G1047
gcgggggtcttaatccgccttccactcatcgtttcttccctttcctcctcctaccttcctccaccgtctaaaacgcttttccgatcatgttgtcttctgttttccccaccgacggcgaccatattccgtccgacgactttcttggaactgggtttaccccttgggacactgacactcatgaaagtccctttctttatccacctcaagagcctgtcttttcgttttccggctccgacgactccacgccaaaaaccaacagctccaactccggctccgacgagggagacgctgaccggaatcctattgaagtcaccctgattgatgaacgtaagaggagacgcatgatatcaaaccgggagtctgcacggagatctcgcatgagaaaacaaaagcacttggagaacctgaggaaccaggtgaaccggcataagactgtgaaccgagaaataatgaaccggttacggtttgtaagccatcatgcacaagttataaggcaagaaaacgagaggctccgatcggaatcagtgatgctccggcaaaaactatgggacatgcgtcaagtactgctcgtccggcagcttcagaaccagttattatcgtctgcatggccatgcaataataacgtgacaaccatcaatgaacaaaacccacaatcgttaattacataaagctttatatatatatttcatatgaaattaaatcgtaactaagtgcatgagaacaatagcaactcaccctatatatatatttgtaaaggaatcgatcaagtagttggaggaaggtaattatcaagtaatggtaattttaagtcgttatttttgtcttggttttcgtttcttttttagttggtttttggaaaatgaaggttttggtagaacggatggttgtttttgtc

SEQ ID NO: 2716 - DNA, 735 bp, Lactuca sativa
  Predicted polypeptide sequence is orthologous to G1108
ggaacgattgatcttcacaacttcgccgcaaatccctccgattctttgctagtttaatcgcatactcactggttagtctttcctctttgttcgcgtatgattcttcccataaaatcagctcaaatacgcaagaagttgatgttttgcactactagggtttttcaattgtgagttctgatgacaccagttgtttcattgatccgttgtttacttacttggacgttttctctgaatacgtattagaaagatcagaattccgaagctaggttttgcgtgttgattagggtttacattaggagaatgttcatctgaaaatttctctgctaagttgtagttggtagatgggcgtttgtgtgttgggactacattgtaaagttgaaacaaagaaggaacaagacgtaatggagcgagcagaaaccagggaggacaatgggcatgtgattgatataacaactgaaccttcttcttcctctacctcaacacaagatagacaagtgaacaggtcaaacgcacagcagaatgaaaacctcccttcaaccagtgtaagcgatcctgtttttcagcattctttctctactaccaatgtgacaaatccaagaaatacaccatttgctaggagggcaaatgggacaaatggtcgtcgtaggagttcattgaattctggatattggatatgttttgaaatggttataacaatgagccaaataatagcagccattgtggttctgtccatgt

SEQ ID NO: 2717 - DNA, 915 bp, Lactuca sativa
  Predicted polypeptide sequence is orthologous to G1108
cggggacgatttcctgtatcctaacaaaattgatgcgatattgaagatttcgatgatggataagtatagttttagttcgatttttctagcttcgttgctgaatatgattaaattgatggcttaaaatcgaagccgtgatgtttgttcagctgaattcaagttgcgtgtgtctgtgttttaccctttcatgaaatttatcatcgaaggagaaggtataacattctatccagcttacatattgcaggaatcgtgaaggagactaaagcatctgttcttgataacgccaattatgcgattgtttcctccctaactttcaccaaactagaatggctgtaactgtaacccccgaagaacagaacatagaccatgcaacagacagtttccccttgctcatcgagagccgagtacaccatgaaaatgaacatataatcgatttggaaagaggtgatgatgatgatgatgatgatgcttcttcctcatcaaacgcatcaactaattctctttctcatggcttatcaaacagccctagagcttccacttctcaactgattcgatcatcatccagtggttcaacttcaaatggagttggaaggagaggagaagggtttgggaggcgaagatggagcccattcgacacactgctatggatttcaatcgaattagtgttcactttggggcaaatcattgcatccattgttgtcttatgtatatcacaaaaggagaacccacagactccattgtttgcttggattgtggggtatgcagctggatgttttgcaagtcttccatttttatactggcgatatctccatagaaatcaatctactgaaccagggtcaagtcaagctagacaaccaccttctgaagctaaccatacaccagaaacaaattcttatatcacaatctcctttgctc

SEQ ID NO: 2718 - DNA, 697 bp, Lactuca sativa
  Predicted polypeptide sequence is orthologous to G1146
gatggagtgagcgaggggcagttctatcaagttttactttatgagcttgatgcgattcgaaaggcatgtgcatcgttggagccagattatcagcctccagtgacatttgtggtggttcaaaaacgtcatcacacgcgattgtttgctaacaaccatcgtgaccgcaatgctaccgacaggagtgggaatatactgccaggcaccgttgtcgactccaagatatgtcatccaaccgagtttgatttctatctatgcagccatgctgggattcaagggacaagccgtccggcccattaccatgtgctgcgggatgagaacaagttcgcagctgatgctttgcaatcactcacaaacaatctctgttacacgtatgcaaggtgcactcgttctgtgtccattgtgccacctgcatactatgctcatctggctgccttccgtgcacggttctatatggagccagacacatctgacagtggctccatgacaagcggccgtggtgcagggacaaggagcacccgtgtgccaggggcaaatgttgctgcggtcagacccctacctgctctcaaggagaatgtcaagcgggttatgttctactgctagaataccctaccctacccttccatttcatgtatgtttttgtgtctactactactactactacctttgtgctggataaattacaacacactatgtgtgt

SEQ ID NO: 2719 - DNA, 905 bp, Lactuca sativa
  Predicted polypeptide sequence is orthologous to G1146
cgggggacatgatgaacaaaaaaatggttaatggtggaacagtcgccagctggatttgcataaatttcgcacgaaatgttcaagataatattgctaaagctttctgtcaagagcttgcacagatgtgcaatacctctggcatggcatttaatcctgaacccgtgcttcctgcatttactggtcgtcctgatcaggttgaaagagtcctgaaagctcgtttccatgatgcaatgactaaacttcaaccccacaaaaaagaacttgatttgcttgttgtcattctcccagataacaatggctcactttatggtgatttgaagaggatctgcgagactgatcttgggattgtttcacaatgctgtctaacaaagcatgtgttcaggatgagtaaacagtaccttgcaaatgtagccttaaagatcaatgtgaaagttggaggaaggaatactgttcttgctgatgcattgtcaagaagaatccctaatgtcagtgatgtcccaacaatcatatttggtgctgatgtcactcaccctcaccctggagaagattccagcccctcaattgctgctgttgttgcttctcaagattggcctgagattacaaagtatgcgggattagtctgtgctcaagctcatcgccaagaactgattcaagatctgttcaaggaatggcaggatcctaatagaggcaaagtctctggtggcatgatcaaggagcttctcatatccttcagaagagcaactggccaaaaaccacagcgcatcatcttctatagagatggtgtgagtgaagggcagttttatcaagtgcttctttatgagcttgatgcaatccgaaaagcgtgtgcatcattggagccaaactatcagcctccagtgacattttgtgtggttcaaaaacgtcat

SEQ ID NO: 2720 - DNA, 780 bp, Lactuca sativa
  misc_feature (661)..(661): n is a, c, g, or t
  Predicted polypeptide sequence is orthologous to G1198
attgctacattcgaaatggagtatgaattgtggattggggaacaaaggaagaaggacgatgatcttcggaaagtgttgttgactcatactagtgatgtcgagcttcgtatgttcgtcgacactggattgaaccattactacgatcttttccgaatgaaggcggacgccgcgaaggccgacgtgttttatttgttgaacgggttgtggagaactccggtagagcggttcttccagtggatcggcggattccggccatctgagctcttatacgtaagcttccgccttccgctttcaatttcaattaaacaaataacattttagggtttgcattggtggcagatactgataccacaaatcgagctaacggatacgcaactggtgaaggcggggggtctccggcaatcatgcgagcaagcggaggaggcactgagtcaaggaatggaaaagcttcaacagacattagctcagagcatcacaatcgacataaccggagccggaagttacaccacacagatgaattgtgcactcgaaaggctcgaagcgcttgaaattttcttgaatcaggcggatcacctccggcaacagactctgcaacaaatgtatcagattttaacacttcgtcaagcagcaaaagcattgcttgcacttggtgaatactttncacgtcttcgtgtactgagttcaatctggtctggtcgtcctcatgatcgtggaactttactttcatgaatcaatctacttttttcgagttttcattagccgccattagctaatctagag

SEQ ID NO: 2721 - DNA, 825 bp, Lactuca sativa
  Predicted polypeptide sequence is orthologous to G1198
cggcggggtatcgtgaggcctggttagaatctaatattatgggagatggaagcccacacacagatacttccactgaaatggaccctgatgacaacaatcaaagctttgatattgttccatctaatccgtttatggcttctggttctagtgacaaacaaaaagaaaaatttccagaacaaaagacattaaggcgattagctcagaatcgtgaggcagccagaaagagcaggttgaggaaaaaggcatatgtgcaacaattggaaaatagtcgattgaagctaactcaactagagcaagaggtccaacgagctcgaaagcagggtgttgtgatttctaattcaagtgatcaaacgcaaccaaatgggtcattggcatttgtagcagaatattctcggtggttggaagagcaaagcaaacacataagtgagctaaggacagctgtcacttcacatagaagtgacaatgagcttcgttctttagtggaaaatgccacctcacatttcaatggtatttttaggctcaaaagaactgcagcaaaagccgatgtttttcatatcatttatggaatgtggacatcgcctgcagaacgttgttttctatggattggtggcttccgttcttccgaattactcaagctacttgtgagtcacttagagccactaacagaacaacaattggcaagcattgatcatttacaacaaacatcacttcaagcagaagaagctctatcacaaggaatggatgcattgcagcaatctctagcccaaacattggctagtgatgcacccgttgtgccagctggatcttcgggtatggctaactaca

SEQ ID NO: 2722 - DNA, 730 bp, Lactuca sativa
  Predicted polypeptide sequence is orthologous to G1275
gcggggatccaaatgaattattatgatcatcaaatgtctaaagcctacagttacagatcagtagactcacctgacatggactatgatgttccaaaccagcaaacttatgagtttgttgagagctttctcagctttgatgattggataactgaagataaagcatccactgttcctgagtatcaagatcatactcctgtttacccttctgccaccattgaagatggtggtctgtcgatcggaagtagcagcagcaacagccatcttcatgatggaagtagaagcagggccacaggatttgggcaggctcaaaatggcaaaaaagagaaagtcgccttcaaaacaaaatcccaagttgagatcctagatgacggttttaagtggaggaaatatggcaaaaagatggttaaaaacagtccaaacccaaggaattattatcgttgttcagcagcaggatgttcggtgaaaaagagagttgaaagggatgtagaggatgcacgatatgtaatcacaacctacgagggtattcacaaccaccaacgcccttctaactactgatagcttgtactacgatttgttaatgtatgctaaagaatagtagtttttctaagcttactccatcactagcttattgaaaagaaagttgtagttcggttacttattttcttcaaccgaccaaggttatgaatcgttttagaatataattgtttttaactgctatgaagcagtcttt

SEQ ID NO: 2723 - DNA, 740 bp, Lactuca sativa
  Predicted polypeptide sequence is orthologous to G1361
attcggccattatggccgcttgacgggggcgaaacaaggtggcacaaaacaggaaagactaggccagtcttaatttcgggttcagttgaagggtacaaaaagatactcgtgctttatacaaattatggagggggaaagaaaccagagaaaacgaattgggtgatgcaccaataccaccttggtaacaatgaggaagagaaagatggtgagatagttctctcaaaagtgttctatcaaacacaaccaaggaattgtgcgtcgaacctcaaggagtccacgttacttgatgagaaaactgaaagaaaccctaacgttaggaacatgagcttcattgaaaactatagcatttcacctttcataccatatgacattaatcgaaggcaactcagtagggaaattccttctcacgtcatccctagttttgttctacaagatgatacatcaccttttattcatctaccaagtggatcaagcaaagaataagatattataggtaaaaaaaaaaaagatatattgattctttcctagtatccgaaaggttaacttttgaaattctcataaggacctcatttattttgggggttcaaatttcaagttcagaagaatgtgtaaattttactacatgagttataatattgtagtcattttggattacgagagagacaataatatggttcccttaataatagggtttatataactttggttttacgagtttatataatttaaattaatattgg

SEQ ID NO: 2724 - DNA, 859 bp, Lactuca sativa
  misc_feature (793)..(793): n is a, c, g, or t
  Predicted polypeptide sequence is orthologous to G1798
tatctttcttgaacaaaatcttgttgtaagagttgatagttttagctaaggattgcacctttttcgatctttttctattatggtacttgtgaaaaccttgtcttgattcaagaattgatatgggtatttgaggttggtgttttgttgatggatcttgatcgcatataaagattcatggttccatcaaacaaacctgtattttctgtaacttgaacatgcgaccataccactttcaaccacattaagaagacttgacatttgattggttatcagttctgaccttttttataacttcttttttgaatagagtgaaaccttaaattttttggaagatggtgagagggaagactcaaatgcggaggattgaaaatgctacaagtagacaagtgaccttctccaaaagaagaaatggtttgttgaagaaagcgtttgaactttctgtgctttgtgatgctgaggttgctttgatcatcttctctccaagaggcaaactttatgaatttgcaagctcaagcatgcaggagacaattgaacgatatagaagtcacgtaaaagatgttcaaacagaaaattcttcgagtatagaagatgttcagcatttgaagcatgaaacagctactatggcaaagaaggtagaactcctagaagttgcaaaaaggaaacttttgggagaagggttaggatcaagcaccattgaagagatagttcagattgagcaacagctggagaggagcgtacgcattgttcgagcaagaaagatgcaagtctacaatgaacagattgagcaactacnagcaaaggagaaactgctagcagctgaaaatgcatcacttactgagaagtgcttaatccaaacaga

SEQ ID NO: 2725 - DNA, 815 bp, Lactuca sativa
  misc_feature (734)..(734): n is a, c, g, or t
  Predicted polypeptide sequence is orthologous to G1844
gcgggggattttgtgagagagccggtgatcagaagttagaacttagggttagaagattgattcatccatcggccgggagagagaaaatggggcggaggaaactcgaaattaagcggatccaagataagagtagcaggttagtgacattttcaaagcggagaacaggattatttaagaaagcacgacacctgtccgtgatctgtgatgttgatgtcgccgcttttgtaatctccgatagcggcaagctctatgagttctgcagcggtggctataatagtaacagtgtggagcttatcctttccaggtatcaggcagaagagagaaccacccaagaaggagcttttgaagatatggcatttaacaagtccacaagattccgaacatgcaaagagcttctaaagtcagtgagaagggttgacgaacaaccaaatgaggtctctgtgagtgacatgacaaagttagaggaggaacttcatgctgctcttttgcatacaagatctaaaaagactcaattgatggtggagcgtatgtcgacctttcatgaacaggtaaggaaattaactgaggaaaaggaagaactgaaacagcagttacaggtggcatcagcaaagaagaaccagaaagatgatgttgatgacgatggtggtgaaggtcttgaccactctgcaaatagccatagttattaccagaccaatctatatccaccacaaccacttttaacactccctctcttncaggagtagatgatgttatgttatattaatcaactaattcaaggaatatatagatcgatgatgtctttagaaagccacgtg

SEQ ID NO: 2726 - DNA, 942 bp, Lactuca sativa
  misc_feature (845)..(845): n is a, c, g, or t
  Predicted polypeptide sequence is orthologous to G1930
catcatatttctctctccataattcataaaacctcattcatcctcctgtttctctctctttcaagaagactaattagtaatggatggaagttcaactgatgatcaaagcacaacaacagagacaacttcaacagttgcagcacctgtgactacgcctccactgatcggcagcggcggcagcatggttgtcgacatggaaggtggtttggaagccgagtcaaggaagctgccttcgtcaaggttcaaaggggtagtccctcagccaaacggccgttggggagctcagatttacgagaaacaccaacgcgtgtggcttgggacctttaacgaagaacatgaagctgctaaagcctatgatacagccgttcagcgcttccgtggtcgcgatgctgtcaccaacttcaagccgcttccagccgacacagaagaagccgggttagaagccagtttcttgaattcccattcaaaagctgagatcgtcgatatgttgaggaaacacacatacaatgatgagctacaacaaagcaaaagaagctgcaacttaaacaaaaccccttgtacaaacgggtttagatcgggtcaacagttggtcaacgcccgggaacaactctttgagaagacagtcaccccaagcgacgtcggaaaacttaaccgattagtgataccaaagcagcacgctgagaaacacttcccgttgcaaagcgaaagcacttccaaaggtgttcttttacatttcgaagacatcgggatgaaagtatggagatttcgttactcatactggaatagtagtcagagctacgttttgaccaaagggtggagccgattcgtgaaggaaaagaacttanaagccggtgacattgtgagctttcaagatccacgggttcagacaagcaactttacatcgactggaagacaaaaaacgggtcgggtagctccaatatt

SEQ ID NO: 2727 - DNA, 714 bp, Lactuca sativa
  misc_feature (617)..(617): n is a, c, g, or t
  Predicted polypeptide sequence is orthologous to G2226
ggctggaaattcttaaaatcccatctcaattcaacaattccaaccacaatccgcttcaaagttaagcaacgaaatggggctctcgccatactcaaacccatcggatgcaggagtgttgtgcgtaattctggttaacacagctatgtcgatatcaatcatgaaggaaatagtttgttcgattcttcatgtggtggggttacgtgtagcgtcatcaccgtcatcatccaatcaaggctcgccggaagcttctgagcgccggggaagtccgtcggagacgtacatggaggagttcagaagccggacgccgtcgctccgttacatctccctccgtcgtcccaccaaacaagaatgctccgtttgcttaacggagtttaaaccagattcagagataaataagctttcgtgtgggcatgtttttcataaatcctgccttgaaaaatggctaaaatgctggaacattacttgccctctctgtagaaaccacatgatgatttctaaagaaatggaagaaaacaacacttgcccgatgtgaagaattgaaatcaaaacttacactttttgtagatatcatcaattgtgtaaggtttccggtggtttattcatctgagaaactgatnaactttggttatttttttctcgtttatcgagttttctttgacgaaacagatatattctgtttctttcatcatttatgccacaatattgaatgatcat

SEQ ID NO: 2728 - DNA, 598 bp, Lactuca sativa
  Predicted polypeptide sequence is orthologous to G2251
gcggggatttgataactccactgtttctcttttctcaatcaaatcaaaaaccttcaaaaacatgggagcactttctcgattcatagctcatgtctacacccttttcttagtattcttcactgtcctcttcctggagctcgtaatcttggttcgctcagtcgccggaagtattggttacacgacggcagccgacgaccacccaatgaccaccgcccagtacctcaaattgattgacgaaaaaaacccagcgagtcggtacaaaaccgccggattagaacgtaaagagtgttcggtttgcctttctgtattcgacgacggcgatgaaatcaggagattgaaatgcaagcacacgtttcacaagggttgcgttgataagtggctggagcaagatagagccacatgtccgatttgccggagtttggtgttgccggaggcgatcgtggttaaatacagtcaacgacatcagattcctctgcatcgccgccgcagggagttttacggtggtagcgatgaggagctcatactcttgttgacttctttacatggtaattatatgcgtagattcatgtaattagtttgtatttctaactttagtgat

SEQ ID NO: 2729 - DNA, 864 bp, Lactuca sativa
  misc_feature (681)..(681): n is a, c, g, or t
  Predicted polypeptide sequence is orthologous to G2719
gacgtcccccaaaacactttgcctcgcaactcatttcacctgttcgtcaatcttcccctgtcacacactccagcagttgaaaccagtcaacttcgctgcgaatggacaaagatcaagatcaagaccaagacgccgccaaaattgaggatttcacagcaccccaagacgatggcgcccacataactaccgctgccactgaaaaccatgacgccgatgactctgacccagttactgtcggagatggagttggggccagcggtgctagtggcggtggtggtcgcgccggcaagaggaccggcgatagagtgaagggtccttggtcgcctgaagaggacgccatactgagtcgattagtgagcaatttcggtgcgaggaattggagtttgattgcccgaggaattcccggcagatcggggaaatcatgtcgtttgaggtggtgtaatcagcttgatcctgctgtcaagcgcaaaccctttactgatgaagaagaccgaattatactctcggctcacgcaattcacggaaacaaatgggcatcaattgcaagactcttaccaggaagaaccgacaacgcaataaaaaaccattggaattcaaccctaagaagacgaggtcacgaactcggtaaattcaacatcgggtcgggtaacaccattgaagacccgagcttagaaagatcanaagcatcatcagaagaaaccttatcatgtggggacatcaattccttcaaaccccacgaaggacccgacatcacaagtgaccctaacaatgaccaaactacccttttccgtccgaaaccccgcgtaagcgcgttcaacgtttacaactcacaaaccggttctgaaacatacgggcccaaactgt

SEQ ID NO: 2730 - DNA, 666 bp, Lactuca sativa
  Predicted polypeptide sequence is orthologous to G2990
gaggtggacatcgtgaagaaagaaaaggaagccaaggggaagattgtatagatcgattcggtggcggtgcctcctccgacggaagatgatgtggatgaattttttgctattctgcgacggatgcgagaggcggtgaaatacttcgagaaaggtaacggtgggaataaattatcggatccatcacgagaacctgatgatggtttagcttctgtgaacaaaggaacgaacgttgcactcttggatctgaatactgttcctgacgagagagaatagcatcttctacggtggcgcgtggggtttgtctttgttaactgcgctcgtggcgcgtcttaggttaagccttgctgcctggcatcgttggctatcttgcgctcatgtaactcacctggtcgggtcatccggctgggttttgacccagaatgttaaaaaatatgaaatattttggtttctttgctaatttttctacacatggctgatgtatgtgtaatttgattgaaaaaaaaggtacccatcaacgggcccggaaggcaaattattttgctttggaagatgataattgaacgatgattatagctgagtctttatgtatgtatttttatatttgaaatggtacaacgagatagcaaggaaaagatgatcggagcttcttttctttcttccgatgtc

SEQ ID NO: 2731 - DNA, 652 bp, Populus tremula x Populus tremuloides
  Predicted polypeptide sequence is orthologous to G2
gcttaacctttgtacaagtgacaatgatggacatggaagagatgggtatggagagactgaaacgactcagcttcttagcaaaatccacattcaatctccagcatcactcaagtccagtgaaatgccaagatatgagcagttcaggagatcactcggagatagtcagatgcatccttttcttcccccacagtttaactcaccaaattatcaagtgagcttccatataattaaagctcgtgcaaacaaaaaaagtacaggtctttttactagttgaattgttgtgtttcaattcttctttagactcagcatccaagcagcagcaatggaggccgaattggaagtgatctttctctctctccatctgagcttcattatcaccatcattatcagcaatggcaagcaggtcctccccggtttgcaaatgctgcagcatcatcaggattccaacagcagattaggactccacaaaactggctgcagaacaatgggttcaactctctcatgagaccttcttaacccatacataaagtagccgttccatcttcctcgctatgcaatctcaatcctcaccttgtttgctagctgggtaaacatgtaaagagcaaggcttttaactacgaggcaggttgtttttctatccactgtccaccca

SEQ ID NO: 2732 - DNA, 573 bp, Populus tremula x Populus tremuloides
  Predicted polypeptide sequence is orthologous to G214, G680
ggagaaaagaaagatgcagaggagaaagatggagatgcatcactgataaatctcaacagcaaaacgtgggagtgctgctctggtcatcaagaaggggagaaaaatgctttgtctagatgtgaaaactatggggaggaggggctgctgacgattgggcttggaaatggaaagcttaaggttcgtcgaaccggatttaaaccttacaaaaggtgttcactggaggccaaagaaagcaggaccggaaccggcagctgccagggcgaggagaaaggccccaagaggttacgtttggaaggagaagcttcagtttgatacttgatattgcttgcttgaacaagggaaaacctttgtttttgcatgtaatttataatttcctcgcttgcctatcattccttttatgtttaaattagagtatctgcaacccacaagacttgtcgtgtaagtgtgtgtactatatgtcgacagtggcttatttactttcttgaacccattaccgctgttaagaactcccgttaaatagacgtagataagaacttaagaaccattaagtattgaataggccttccttggccc

SEQ ID NO: 2733 - DNA, 888 bp, Populus tremula x Populus tremuloides
  Predicted polypeptide sequence is orthologous to G261
gtttaataactgtatggttactactgttaacaaggaggcaaagctacacaggagtctgcgactctgtaaccatgcaagctataatacaacttaatattgacaagggaaacgtgatatgaaacaagagatcacaaatataatgcaacctcattgaaccaatcattcctaatttattacatgtgtgtccctgaggcatcagaagttgagaaaattatcaaccaaagtcaagttctttcagcaggagtaagatgccccatctgctctgtaagattatttacattcctcatatcccaccaaaattttctgggatcaccaggttttatttcattttttctaccatcagaatcctttctttcagattgaacttcctgtgtgtcagttgaaccaggattctcagttaaaaaccgttcccagaatacatcgttgactccagttgccacggcgggagcagtcccagcaggttgttctttcggtgaaacaggctctggcacaacagctatagaaggttcagaattcatgtcaataccaggtgttttagggcgaaaatcaaaaatgagttgtgcacaagatatagctggactctctgcaccacttgtagactcatccatctctatcgttttagtgttatgactgtgggtttgaacaacatcatttaccatattctcccagagtgtcaggggatgtttccaactgctcaaactgctccatgtttaacagggcaaaagaattaccatctgcattttctctaaacagagcttgggaagtcaccgtctgattatcctcattactactggcttcaatgtgtagacaaccaattctcggcagccttctctttctatcatgaccttccaactgcggcattagatttaaggcaggacctggcttagg

SEQ ID NO: 2734 - DNA, 603 bp, Populus tremula x Populus tremuloides
  Predicted polypeptide sequence is orthologous to G481
ttttttttttttttttttgattggaatcggcttggattttgggattttacaaaataatcttagaatcaggctctacatcagttattaatcttgtaactcaagaaactgatagggcttatgctggttctattatcatcgcttgagttaaaagaactactggcaagagaatgggtgggtggtccaagctcatcatatttattaggaagctaatgcagcagcatagcaaactagttggtaagctatgatttgatcaatacaagtccttgtgacttgattaggtcgacttttccacgcttagtttaattctctggggcggtcgttggcccttgaattaccttgatgatgaaacccgccagcaccgtacacgtgtccttgatggtgatgacccatcatcatcatcccgccatacatcccttggcccccaccaccattaaaccctccacctccaccgccggtggaattagccccgcctccacctcccgcagcaccactcccaccagacccacctccaggaccttccttctcccctgctggtcttcccatggaactcttctctccttccatctccctatacttctgcaagtaaatcttcaggggctccac

SEQ ID NO: 2735 - DNA, 357 bp, Populus tremula x Populus tremuloides
  Predicted polypeptide sequence is orthologous to G517
cgggtctcgttgggattggatatagatggggaatctatagatcgtagtagttcgccaacctctctaactaacatacgatacaatttcacttcacggcccaaaacaaaaaaaaaaagaaagagcttcgcctatcgtatgtatcggcctggcttcgtccagaaccaaggaggcattctggcgggcgcgtgcgtgtaggaaggccgaccactacataagctaaaactaaaagactacgactacaagccggaagcgactcgcttctattctcgttgggattggatatagatggggaatctatagatcgtagtagttcgccaacctctctaactaacatacgatacaatttcacttcacggc

SEQ ID NO: 2736 - DNA, 607 bp, Populus tremula x Populus tremuloides
  Predicted polypeptide sequence is orthologous to G559
gcccgaggacagcttagaattttgaatcacaaatcgccatcaaaggcccatgattgcatcaaggttctacataaactataacatattaaatgcttaaactataaactcaatcttcaaggaaactagaatatagaacccgcctaaatgaggtatgaatgtaatgtatctaaaagactggagataaaaggtaaatgtcctatgtgataactaggatgtaaacaacagtagacagaacattctgtagctggtctgatgatcatgctattctcagtcctttgatgaggaggaattatcctcagatgaattatctttctggattgaagaagccattgatcctctcatttgcaaatccccaccttgctgctgctgctgctgttgaagttgttgctgttgaagctgatgcagctggagctgctgctgctgctgcttctgagaatgaatttggagttgttgaaactgttgtgcagctaaaaaagtatgcattgcttgattattgggatataattgctggcctcctccaaaagatgcatagtttggcacttgaccagtcagtaccttcagatgctgaatttcttctttcagtgcgtcattcaaggcatcttgcaag

SEQ ID NO: 2737 - DNA, 621 bp, Populus tremula x Populus tremuloides
  Predicted polypeptide sequence is orthologous to G729
gggagttttattggctgtctattagatggctctggtgatgaagatttcatgtctggaacagcgtgctttaatcaaaatgcaaactatttactcaaccagaaaggaggttcaaatgtgcctaatttacagcatgataatggtttctctcactctcccaccactctatggagcaactcttctagcaaaggaggaggatggcataacagctcaagagatctagatggactgaagggagaagctctatcttctcaacaagtatcgggaaataaactggacggagttggttttgctcaatcaagaagctttacaggatccaatcaagaactcaagaatccaatcctggagatttccttagggagaccagagtactggcaaaacgaagaacatgaatgatttaagatagagttgtgctggctaacaatggcatggtatttagaattccctttttcttaaacaaaaagaaaaggatcatagatgatataaatagatatagggctttgcaaggggagaagaagaaagtcttgttctgtcagttcagtgcatgtctgtctgtatattcttttttagaccattgttggactatgttatgagttgatgttagtcattacatggtgtattcaa

SEQ ID NO: 2738 - DNA, 789 bp, Populus tremula x Populus tremuloides
  Predicted polypeptide sequence is orthologous to G1020
gatcaaacctcgcacctaaccagcgaacaaaccccccgaaaaataacagtaggaaacccccaacgctaaaatggctccgagagaaagatctaacaacagaaacagcccgaatagccctagatcggagatccgttttagaggcgtcaggaagagaccatggggacgttatgcggctgagatcagagacccaggcaagaaaacgagggtttggctcggcacttttgatactgctgaaggggccgcccgtgcatacgatgcggctgctcgtgaattccgcggagccaaagccaaaactaatttccctacaattggcgagcttaatccagaccccacgcgcagtcctagccaaagcagcactgtcgagtcctcctccccgccgcctccacgcgccgtctctcctccgccaccactcgacctcactcttaacatttcccgccataaacccgacagccagccgttccccaatggagttagttttccaggaggcgcgtggtttccattccatgctgttgcgcgtcccgttttcttctttgacgcgtttgctcacgcgaagaatgatactcctaacaataatagtgtagtgaataatattaacgggtgcaggtttgatcgaacggtgatggtgaatggaggtggggcccagagtgattcggattcgtcatcagtcgtcgattacgatcatcatcgtgatagtaagggattgtcacttgatcttgatcttaacctggccccaccaccggaagtctcatgatcttgttgtttttcatggagagatctgattttggaagt

SEQ ID NO: 2739 - DNA, 728 bp, Populus tremula x Populus tremuloides
  Predicted polypeptide sequence is orthologous to G1020
ttttttttttttttttttaataaaaagggggattgaaaattatcagcaattgaaataatttgtgagcttacaacacaaaacaactaggaagagaattatgattgtatctctgtagttgcaaaatcatgatcctagtaatttacttacattagattacgatgacccattaaacgagatcatcacttctctctttaagatgtaaaattagctggaaaaaaaaattattcccctgaataatctcaaaaaaattaaataattatcaatcaagcatcggctggtggaggcaggttaagatcaaaatcaagaattgaactccttggcttaaaatcaatcacagatgatgaatccgagtcactgtgggccccgccctcgagacccaccgggtcaaaccgtacagggaaacgctgagccacaaactgaggcttaacaccatcaagaaaccagacaggaccaacagcgtttacaatcggctgctgctgctggaacacgaagggaaacctccccatccccatccccacaaccccaccaacctggcgagttacatcacgcgccaccgcagaaaccaccggggagcttgacgactcaacggtgctgctctggctagagctctgcttctcatcgtcataatcaaccaccttctccgctaatggaaagttggtcttcgccttggcaccacgatactcacgcgccgccttatcataggcccttgcagcctccactgccgtgta

SEQ ID NO: 2740 - DNA, 610 bp, Populus tremula x Populus tremuloides
  Predicted polypeptide sequence is orthologous to G1145
tttttttttttttttgccagaggtgaagcaaagcagccttgtgataaattcccacagcattttacacataaacccaagaggctagcactaacacttgacgagctacaaaactctcacacagagagatgtgatgtcagaaagaagtagaacttgttcttctaagctgatatttttgttcagctgatggttcaattggaaacttcttctcaaattccttctctttcttgagctttatattctcctcccctaaatgtgaaatcttgttcaccagctcgttatgataggcctgttttctagctcgtgaacgggcagcagattccctgttcttgatttttctcttgagcttcctctcaatactcgtctcaaatgcatctgatgtatcccttttccgtcctgatgtcgtagtatcaagataatgtgcttgttgacggtgatgaggaaacgaccattttctgtgaaaaactttgtggggtcactgcatcaacagtaactaaatccaaagaagggcttatagttgcttcggcaaaaagtcctgcttgtaccaagaaatcctccaaagtcatttcaccaagagtctgctctctttcctgaactttcatctcctcaccaa

SEQ ID NO: 2741 - DNA, 657 bp, Populus tremula x Populus tremuloides
  Predicted polypeptide sequence is orthologous to G1145
gggggaatggatagtgaaagtgccgcaacatcttctcttcaacgtcaggctagtttcacattggctagggcattgagtgggaatgacagtggatcaagtctggaaagagattcaagaagggcagaagaagaggtttggtctggaaatgaacgttcatgaaagagagcagacacttggcgaaacaactttggaggattttctggtacaagcagggctttttgccgaagcaactataagcccttctttggatttggttaccgttgctgcagtgactccgcaatgttttccacagaatatggtcctctcctcatccccttcaactggcacgttatctgactctacgacatcgggatggaacagggatgctccagatgcacttgagaagagtattgagaggaggctcaagagaaagatcaagaacagggaatctgctgcccgttctcgagctagaaaacaggcctatcataatgagctgatgagcaaggtttcacgtttagaggatgagaatataaagctcaagaaagagaacgaatttgagaagaagttcccaattgaaccttcacctgaacaggaatatcagcttagaagaacgagttctgccgctttctgacaaatctctctatgtgaaagattgtagttgatcaagcgttattgcta

SEQ ID NO: 2742 - DNA, 323 bp, Populus tremula x Populus tremuloides
  Predicted polypeptide sequence is orthologous to G1146
ttttttttttttttttaaaagtcttagaattacaagacattcaatgtcatacaaattttgaagaaagcgataaaaagcagcagttttaaacacgtaatttaaataatacacacccaacgctgacacaaccagcttgatattgtatgtaagggtaagcagaggcctcccatagatttaaacaatccaaaagtggggatgtctcgaatcctaacagtagaacataacccgcttgacattctccttcaaggcaggcaggggcctcacagcagcattagcagcaggtccgcgtgtggctcgaccacctgctcctccacctcctcgcc

SEQ ID NO: 2743 - DNA, 613 bp, Populus tremula x Populus tremuloides
  Predicted polypeptide sequence is orthologous to G1146
ggtatcatgatacaggcagggagaaagatgtcttcctcaagttgggcagtggaacatgatgaataagaaaatggttaatggaggcagagtcaataattggatctgcatcaatttttcaaggaatgtccaggacagtgtggcccgaggattttgctatgagcttgcacagatgtgccacatttctggcatggactttgctcttgagccattacttcctcctgttggtgctcgtcctgagcaagtagaaagggttttgaaaactcggtaccatgatgcaatgacaaaactccagccacatagcaaggaacttgacttgctcattgtgattctcccagataacaatggttctctttacggtgatttgaagcgtatttgcgagacagatcttgggcttgtttctcagtgctgcttgacaaagcatgtattcaaaatgagcaagcaatatctggccaatgtggctctgaagataaatgtgaaggttggaggaaggaatactgttcttgttgatgcattatctagacgtattcctctagtcagtgaccggcccactattatttttggtgctgacgttactcatcctcgtcctggggaagactcaagcccatccattgca

SEQ ID NO: 2744 - DNA, 826 bp, Populus tremula x Populus tremuloides
  Predicted polypeptide sequence is orthologous to G1146
gaatatgatgaacaagaaaatggtcaatgggggaagagtgaataattggatctgcgtcaatttttcacgaaatgtgcaagacagtgtggcccgaggattttgctatgaacttgcacaaatgtgtcaaatttctggcatggactttgctcttgagccattgctggctcctgtcagtggtcgccctgagcatgtagaaagggttttgaaaaatcgataccatgaagccatgaccaagctccggccccatagcaaggaacttgacttgcttgttgtgattctccctgacaacaatggttctctttatggtgatttgaagcgtatttgtgagacagatcttgggcttgtttctcagtgctgtttgacaaagcatgtgttcaaaatgagcaagcaatatctcgctaatgtggctttgaagataaatgtgaaggttggaggaaggaatacagtacttgtggatgcaatatctagacgtatccctctagtcagtgaccgacctactattatttttggtgctgatgttactcatcctcatccgggggaggactcaagcccatctattgcagccgttgtggcttcgcaagattggccagaggttaccaaatatgctggcctggtttgtgctcaagctcatcgacaagagcttatccaagatttatataaaacatggcaggatcctgtacgagggacagtgtctggtggcatgatcaaggaacttctcatatccttccgtagggcaaccggacagaagccacagcgaataatattctacagagatggtgtcagtgaaggacagttttatcaagttttgttgtacgaactcgatgct

SEQ ID NO: 2745 - DNA, 557 bp, Populus tremula x Populus tremuloides
  Predicted polypeptide sequence is orthologous to G1198
catcctataggatgcggaaacccacagacgttgttatgtggataggtggctttcctatctgaactcctaacttttggaataactggacctctaactgacaacactatgggcatttacaacttgcaacaatcttctcagcaggcagaagatgctctctcacaagggatggaagcgctgcagcaatcactggcagaaaccttggctaatggcaaccctggctcatcaggttcgtctgcgaatgtggcaaactatatgggtcaaatggccatggccatgggaaagctaggaactctagagggattccttcgtcaggctgataatccgaggcagcaaacactagaacaaatgcaccgtatatcgacaactcggcaatcagcccgtgctcttctagctatacatgactatttctctaggctacgagcccttagttctctctggttggcccgaccacaggaatgagtagcagtatgttgcccctcaacaaaattaacatgaatatttaccacctcaccaccctcctacttggccttcagttctcattatgccattgggtggga

SEQ ID NO: 2746 - DNA, 710 bp, Populus tremula x Populus tremuloides
  Predicted polypeptide sequence is orthologous to G1198
ttttttttttttttttttttttttaaatcaactcaaaatgaaagtttctcaactttcaaaatcatttcgagattgtcaagtacaaggacagcatattctaaacttgccattacaactgtggataaaatgaaaacaggaagacgatcatcaggctacaaataattaacattgatgcatactgtacttgaaggactcaaattctatgctctaagatgattagtatgaaagaaagagcagtaccatgatacatctgagactacaacaagaggaatgcagaaaagagaagctattttgagcactagaaacaagaagcactgctggatgtggaatgagcctttgtgatttttgtgcagaactcgagttcagatgcaaagcagattcactctctcggtcgcgcaagccagagggaactaagagctcgtaaacgggagaagtaatcgtgtattgcgaggagagcacgagcagactgacgggtggttaatattcggtgcatttgctgtaatgtttgctgcctcaaattgtcagcctggcgaataaatccctcgagggtgcctagttttcccatggccatggccatctgacccatgtaatttgccacgtttccagatgaacctgaggagccaagaggtccgctggacaatgtctcagcaagggactgctgcaatgcctccatcccttgagataatgcatcttctgcctgttgggaggac

SEQ ID NO: 2747 - DNA, 475 bp, Populus tremula x Populus tremuloides
  Predicted polypeptide sequence is orthologous to G1198
gacggtaagacaggtggcgcggtgttttgtggtgatcggagagtattatgggaggctacgggcacttagttccctgtgggcatgtcgtcctagagagacaatgatgagtgaagaaaactcatgccaaaccaccactgatcttcaaatggtgcacccttcacagaatcatttcgccaacttttaatataaaaaaaacatgggatagcgatacaaaagagccagacagcttgccttcctcggtgactgagaacctgtattgcgacaaatgttatgggctgttagaattcggataagcactttagtagtgaagataggatcgttttcttttcttttctttctcctctgccttcttcattatctttatatcatcaatcactatgttatcttgtaaatgcaaatcaattttatatgcatgaggagctttctcgcttgctttaaaaaaaaaaaaaaaggggaaaaaaaaaaaagggggggg

SEQ ID NO: 2748 - DNA, 869 bp, Populus tremula x Populus tremuloides
  Predicted polypeptide sequence is orthologous to G1275
gactgaacattcggttgattgctttggtgatcagagaattatgatctgattttttttatactaagatgtccagtcctaagtttagcacacaggaggatacacccgagcaaagtgactacgctcacgaccagctgtccaattttgagctctcagagttcttgaccttcgatgaatggatagcgctagaagatgctccgtcgtccatagcttccagttatgcctgcaacccggtttatagagcacgtgtcgttggcgagtcaggtggaagtagcagccctcgtgaagagctaagtggtggagagggtgaagaagggcgagagaagaaggaagccaaagaaagggttgctttcaaaacaaaatcagagatcgaaatactagatgatgggtacaagtggaggaaatatgggaaaaagatggtgaagaatagtccaaacccgaggaattactacaggtgctcggttgaaggttgccctgtgaagaagagagtagaaagagacagggatgatccaagatatgtaataacaacctacgagggcattcactctcaccagagcttttcctagttctcaggcgaagttgcactggctcatggtttcagatcctcgggcacgcttgatattgatgaacttgttaaggataacgtattgcatcgatcttggtttcactttgctgcaatctttaagagttggaaagctcatggacgacttgcaagaatatcagacaaagtcagctttgccagctttttgactagctataatataggaccttgagtggttttttggtactaattagtcgggatcccctcaatatatgcaatattaattgtgtctgatacaatttcagctgtaattaattatggttcttataaa

SEQ ID NO: 2749 - DNA, 796 bp, Populus tremula x Populus tremuloides
  Predicted polypeptide sequence is orthologous to G1290
tggtcgttaattaggaaatagctgtttagtgtttctaccaagttcgaaagggagaaactaaaaactatttccctttctttctggataaccaacccctgatgtgtgtttacaattcggaagatacagaattcaaggtattattatcaaggtaaacattaaaaccatatcatacaggagaacaggattgggcctaatgaccaccacccttgtcactaagcttcccattagacctcgccgtgccaattgacttggtggatgatgaagatgatatgacagacctgtcgaactcttgtttatcttcatcgaatgccttgcttagagcttcctggagttcaaggtgtctctgtctcttcacaagtcgttcctctgaagtttcattccctaaataagctatctgtgataggtcatcagcatccatgatcttgttgagtacgtctgagcaacgcgggaaaaaccgtttcccaagttccactgttctagagagtgctctcatcctatttagatgctcctcgtgcattctgaaaggtgcctcgttcaagtccacagctcccctttgtgcaccagacaagatgctgggcctgatgccagctaatggtaactcagaagtaccatcaacttgagcaatatccatcgcaacttttgcttccatgggaaaaaggagttttgccagtccaactgaaagaacaataacatcaatcttcatattctgcgttttgctttcattcatcgtagtcattaagcaatggaaacaggatttaaaaccatttcaagatagataactgattaccccggccat

SEQ ID NO: 2750 - DNA, 824 bp, Populus tremula x Populus tremuloides
  Predicted polypeptide sequence is orthologous to G1421
atttgtcactagctacttatataatccctccaactctggagatccaattaagcttagtataaagtagcttccttcagtttttttcctccaagaaaccaataagaatcttcatcgttgatcaaccaaataaattaagctagctagaccctacctgagctggccagtacatggttctgccgctatgtcttgacccacttcttaattgaatacaaaaaccaacccttggtaccacccaccatgcatcttctattccccaatgaattacaacccatgtttacctccaacgccaccatgtccgttcaaccaaaagtcaaatttactgaacatgtattcatcactagtaagctcatcgagaaccagcagctgcatccttcttcaagaacccgccaaagacttgttagaatcatccataccgaccctgatgccactgattcctccagcgatgaagaagagggagaacaagagaggaagtttgtcaagagagtgaagagacaagtgagtgaaataagcttgttagagcaagaaacaacagcaccagcagctccttcttccacaacttcaaatgatgatcaagaaccaagaagaaagagaccttcttcaagattaccagtacctgacgtatctcttcagaaaaagttcaggggtgtccgtcagagaccctggggaaagtggtccgccgagatccgtgacccgactcgacggaaacgggtctggctcggcacttttgacactgcagaggaagctgctacggtatatgatcgagctgactgtaactaaaagacccgacgccgttacaacttcctactaactccgtatacggataa

SEQ ID NO: 2751 - DNA, 129 bp, Populus tremula x Populus tremuloides
  Predicted polypeptide sequence is orthologous to G1463
attttaagcttgtttagcttccttgtttcctcgtagcttttctttttccaagtgtactttaatgtgtaaatgaatggattgcttgtgggtaacaagtctttggctctcaaaaaaaaaaaaaaaaaaaaa

SEQ ID NO: 2752 - DNA, 849 bp, Populus tremula x Populus tremuloides
  Predicted polypeptide sequence is orthologous to G1594
ggcttctctagtcccagcaaattcaaacttaagagtcattaataatggaactccaactccaaaaacatagaaaaactacaaattaagaacaaaacgctaagaaaacaaagatagaaggccaagctgcctgtgccttcttccttctgctaatatggacggaacgtacggtctgcactcaacggtggcggactactcagacaaggcgttgatgtcgccggaggatttgattttacaatcggagtaccagagcttgctgtcttcagaaactcttcggctgcggattccgattcttggatccgaagagttgctttcagaggcggcttcgatcagaacagaagaagatatgtccgctttgatcaaagccaaaattgcctcgcatccttgctatcctcgtttactcgaggcttatatcgattgccagaaggtaggggtgcctccggggatagcgtgtttcttggatgaaatccggcgagaaaacgaccttttcaagcaaggcgctgtctccacgtactggggagctgatcccgagctagacgagttcatggaaacctactgtgatttgttggtgaagtataaatctgatcttgaaaggcctttagatgaagcaacaaccttcttgaacaagattgaaatgcagcttcgtaatctctgcaccggtgcctccatcagaagcctctctgatgaaggtgcgccatcatcagatgaggagtaagtggaggggagttggatatgcatgaagctcaaccagtggtgaagaccgagagcttaaagataacttctccgcaggtttggaagtatattggtcgctgaactggagtctccaaagaaaaaagaaaggaagctcccgaa

SEQ ID NO: 2753 - DNA, 625 bp, Populus tremula x Populus tremuloides
  Predicted polypeptide sequence is orthologous to G1655
gcggatctattcgtcgaagcttctagaggctctgcgtcgatcatgccggataacttctcctcggggtgagaagactcgagaagtccgggaaaccgctgacagagtcctcgcggtggccgcgcgaggaaaaacacggtggagccgcgcgattctagcgaaacgcgcgcggttgttgagagtgaggaaggtgaagaaacagaaggtggctcgtgatcgcaagtcaccggggagcgagaagaggagggagttaccaccggtggagaagaaggtgagggttttgagccggttagtccctggttgcaggaaagtctcgtttgtgaatcttttagaggaagcgagtgattatattgcggctttggagatgcaaattaaggttatgaccaatcttagtgaaattctcaccgtcgctggcggaggaggaggcggtggcggctcgtcaggttgagagcgaggagacagatatactagagattgttagttatgccaggtgtccattataattaatttctttttgctttttgtttttcttaaatattttaattttctttttttttcccttctattaatattaattcatgatgttattgtatataccaccttattattattattgttctagccttaa

SEQ ID NO: 2754 - DNA, 662 bp, Populus tremula x Populus tremuloides
  Predicted polypeptide sequence is orthologous to G1756
ggaacatcacgaacaactcaccttccttgtttgctcccttgagtttttatcaagatgagctcttaaatttccaagaaactccaacagattttgatggactagatggcctttacaagcccctttaccctttgttgcaccagacctttaattccccagaaagcaatatccttagtagcagtatcagcactggtactttagcatccatgtctgttccaaaagaagttagagagagacaaaaggtgcagaaaacgaagcctgtttctcctgaatctgctacttttgcgaacactgttgatgctacgagtggggccgaatcaaaaaggaggaagaatcagcaaaaaaaagtggttcaacacgtgagagaagatggtctctcatctgatatgtgggcttggcgcaaatatgggcagaaacctatcaagggatccccatatccaaggagctactacagatgcagcagtctaaagggatgtttggcaagaaagcaaatggaaagaagccgtacagatccatcaacgtttatcataacctacacagctgagcacagccatgcccatcctactcgaagaagctccctcgccggtagcacccgaaccaagccatcaatgcctaaagaagccacccaagatattgagcccaatatgccaacaataaaagacgaa

SEQ ID NO: 2755 - DNA, 753 bp, Populus tremula x Populus tremuloides
  misc_feature (694)..(694): n is a, c, g, or t
  Predicted polypeptide sequence is orthologous to G1798
gccggggagacaaaacggggagagggaaagtggagctaataagaatagagaattcagctagtaggcaagtaaccttctcaaagagaagaaatgggcttctaaagaaagctttcgagctttcaattctctgcgaagctgaagtttccctcattattttctctccaactggcaagttttaccagttttcaagtcatgacatggagaggagcgttgctcggtaccggagtgaagtcggcctgcctggaacaaatgaccaacgctctagatccttggagttttggagatgtgagattgaagagttaaggagaacaataaataaaacagaagcacaacttaggcactttattggagaagatatagcaccgctggggttgaaagagttgaagcaactggagcgacagttaaagacaggggttgaacgtatccgctgtaagaagaaacgagccatctcagagcacatcaaattgttgaagagcgagcaaagagcccttcaagaggagaatgctcgtcttcagaaaagattgcaagagctgcctgatgccaatgtaagctcgaggattccggaaccaaatgcatgcaatgcttttcatcagcaaaggatttttcttgatggatctcaccattaaacaggcggtgaatggtcctttacaagaagctataatcttcaaaaatgaacctcaagtgtggtggttgnggttcgtggtgacaataaattgcctctctttatttgcataaagctttggaggctgatga

SEQ ID NO: 2756 - DNA, 739 bp, Populus tremula x Populus tremuloides
  Predicted polypeptide sequence is orthologous to G1798
gggctttttacatatgtattattccctcttttcttatttgggaggcgtctgtgttttttcctgaatttaccaaaagaagaaagagatcagggtttgtgtgatcctttcaattctccgtattgggtctcttgagatttgaaagttcacaagcaatattttccttgtcttcctgcttcttaactgttgcccataaaggtataataatggtgagagggaagactcagatgaagagaatagagaatgcaacaagcaggcaagtgaccttttcaaagagaaggaacggactgcttaaaaaggcctttgagttatcagttctttgcgatgctgaagttgcactcattcttttctccactagagggaagctctatgagttttccagctctagtattaatagaacaatagaacggtatcagaagagagccaaggacgtaggaatcagcggcaagatggttcaagacaatatacagcctgtgaaggaagatgcatttactctggccaagaagatcgagcttcttgaagtctctaaaaggaagttcttaggagagggattggaaacatgttccactgatgatttacaacagttggagaaccagttggagcgaagcttaacaagaattagggcaagaaagaaccagttatttagggagcggattgagaagctaaaaggcgaggagaaaatcctgttggaagaaacacgaggttacgggagaagtgtgggatgcaacaacttgacctctca

SEQ ID NO: 2757 - DNA, 811 bp, Populus tremula x Populus tremuloides
  Predicted polypeptide sequence is orthologous to G1798
ttttttttttttttttttaagtctaatgatacgtcaaatatatacccaaattacagtatttaagtacccctgtttacagttgatctcaatcaataatgggtagcttttttaacagacagcatatatatttctcttaaaataatactattgccttaattattgcttgcgcagttgcaatatagcattagcaagagtctaagaatatgaaaaagtttggcctcacagtacgatgggcattcaccgctagtttcttggtgggatgcgctttgttcttgtttctggtggtccaatgaaacaattccgtctccacatccgaaattgaactgctttctctctgctcttcacggggtaaaatcatctctctgttcccatgagactgggccatgactggtgcaccacactcgtcagacagtcttgcattttcagctgccagtagcttctccttttgttttagtagctcaatctgttctttgaaaacctgattctttctcgcacggatgggtgcttacactcctctctaactgttgttcgatctgttgtagttcttcaatagtgcatgatcccaaacattctcccagtagctttcgtttcgaaacttcaagaagctctatcttctttatcatgcttgctgcttcttcctttattgcagcatggttctgttcaacaggctgcttggttggggttgttttcttttcacgtgccttcgataccgttcaagggtctcctggcatactgggagctttgcaaattcattagagctttcctctaggagagaagacaataggggcaaccctcagcatcacaaagaact

SEQ ID NO: 2758 - DNA, 467 bp, Populus tremula x Populus tremuloides
  Predicted polypeptide sequence is orthologous to G1911
atagcatttaatctcttcataggcttcagggttctagccaatatggacttcaaagcaaaacaaactgttcgaaaatgccttggccatctatggtcaagaatctcctgatcgctggcagaatcttgccagtgctgttggaaaaacagtggaggaagtgaagaagcattacgagatacttgttgaagacgtccagcagattgaagctggcgaaatccctctgcccaactacactaaaagatctggagctagcaacaaaagctgccattgcattgatggtcaagcacaaagggtgaagaatcttaatctcaactgaaggatacatgaactaagctagctatagaataaagatccattgcgctacaaatgacaataggcagaagtagcagcagcagtgttattagctagcaccgaaaatgggattacgatctccctttgtgttatctgtataattactttctcgtcaaaca

SEQ ID NO: 2759 - DNA, 574 bp, Populus tremula x Populus tremuloides
  Predicted polypeptide sequence is orthologous to G1930
cagatcttcagcaaagtgttgacagatgatgatgttcgttttcggttctcgttcccagctcattgcttgcagcatttagattttgctggaaataattctgttgatttgcatgttaaagatagctgtggtgagcttcgagttattcgttgcctgaagagagatggagattatgacaagcctgtgctttctaagggctggcgtcaatttgttaaatattatgaactgagagttggtgacatggttgttcttcatcgtgaggatgaccagaacctggggtcacagttcaggattgaagctaagaggagtatccagctgtttggtgaggaggattggggtgaagtgccaagagctaactagctattatatatttgcaggatgttcggccatatccagatatatatagaagaatgaatttatgtatgtgtttatgtttgagtgtttgtagtgatcataatcaatgttatctgcgtcagtctaattaaataaatatgttgctgttcttagtttcttgaatatgtattacgtgcatgtaattctcagcaataatggatttaattaattatatgtgatcaga

SEQ ID NO: 2760 - DNA, 710 bp, Populus tremula x Populus tremuloides
  misc_feature (523)..(523): n is a, c, g, or t
  Predicted polypeptide sequence is orthologous to G2226
gggcagccatcttcatctccatcttctatgaaacaatcccatatgacatgtataaaagttttgataatcccatgaatatgtcatgtttctaggctgctagcatgttcttgatgcttatatatttctttgcatagagaccaagacaggaacttcaaagcttccctagtgtcactgttgtcggctccttttacaggattttgctattcatcacttcatcatagtcaaaaaccctgtttatatgccccaagatcaagcaaagaaggaaacatccggttttctccatttgcttcaactgtgatttatacaagcatccctccattggtttccataacttccatttgagcacactgtgaatcaagaatcttttgttagcttgagctttgcggaatcactggaaaaaaaaaaaaaaaaacaagtcccacgaaacttcaatgggtctatcaagtctgccagctccatctgaaggagtactatgtgtgcttttagtaaacactgccttgtcaatttccattgtcaaaggaantagtccgttcaatccttcatattgttggtatccgtttgtcaccatctgcttccctcccatcgtcagataatgctgaagacaccagagagtcgtttgaatttcgtttaagtcccccagagaattacatcgaggagttccgaagcaggatgccgtcaatccgattcaacacggtgtgcagctgtaaaca

SEQ ID NO: 2761 - DNA, 714 bp, Populus tremula x Populus tremuloides
  Predicted polypeptide sequence is orthologous to G2520
tttttttttttttttttttggttctgaactagttctcacatatccattactgaattcagtcagatgatataatacaattaaagattagatgtattttctacaaatgagatgatagtacaacttcagtaatggtcacagatatcacaaacacctttctgcatctaagggggaagcaaataacaaatttcttctcaataaactgaagaaatctagtgccttgattacgttgctcttttaaaacttccaccaacctgcatatgtagccattcggattgggatccttgaacatagtctcttgttggttgtgggccaaatatcattccagtagcatcaaatggctgtgcaccaaggttatttggatgaaggccttcaatcgtggggctcgtgctcatccttgaatttactgcttctatcttcattgagaggaactcaacctgacactggagtgactggatgtaattaattatctcatcaagggcaagtgctttaccaatgaccttgttacacccagggaccaaatcttgaagtatcttcatcctctcactaatcctctctctccgagctctctctgctaaactgtggctatcagtcgcttggccccttcttgatctgacatgaatgtagtcttgcataggcggctcagatggtttactgcttggttcagccggcttgttattagcagcagaacttgcttctatttcagctcttgaacat

SEQ ID NO: 2762 - DNA, 754 bp, Populus tremula x Populus tremuloides
  Predicted polypeptide sequence is orthologous to G2520
aaataagtttatacaagatttgagcactagaaatatcagacatgcaactttatctaacaagattaataccaattctaggaggatctgtacgcgtattagtacagacaagaacatgatgcctgttaagatatatggagtaaaaggaacattttccaacacaaacaaatggagatgttcagagcagcttgaattggaaatgtgttcctcgttttaacctagcgcgtatattttgacagccgatgaaggaagaagaagcattgccacttgaaggttcttgctggtaattgagggggattttctatattatgacgttctttgaaagccaccaccaacctgcatatgcaaccattccggtgatgtacagtgattgtattccctcgtggcttgtgaaccaaatgccatgccagcagtatcaaaagtgtgttggccaaaatctttagaaggaaagatttcagttccagggttcatattcaaattaactgcttcaagcttcattgatagaaactcaacctgacgttgtaatgattggatgtaattgataatctcgtcaaggaccagggccttgccagtaaccttgttacaacctgggactatatcctgaagaattttcatcctttcgcttatcttttctctcctagctctttcagctagactgtggctatcagtagcttgaccctttcttgctcgtacgtggatataatcttgtttgggtggttctggtagttgaggtttgtgttccacatgcttgcctgaa

SEQ ID NO: 2763 - DNA, 863 bp, Populus tremula x Populus tremuloides
  Predicted polypeptide sequence is orthologous to G2763
gtttttttttttttttttttaattaacaactttattattaattaattaattaacattttttctagggattcataacagagaaaatagaataccttttttcttaaagaaaaaaaaaacagagacacgtatttaacagggagtcgaaagaaaaaaaaatgtgggaaaaaaaccagaaaaagacatctggcaacacaatcccattaggaggtcatcggctcagaagtagagctggcttcggaggtagagcgagaaagaagctcagctatagcagtcatggttttaacttgcatctccaaagcagcaatataatctgtagcttcttccaaaataacaggcaatggttgtttccggcaaccaggaactaaccgcccaagaacacgaactttcctttgaacagccggcaaacccttcgctttcaacctcaaaacactcactttatgcttcctcgacgaccggctgccactcccggtagtggatcctggagaagaagacgacgacgacgcaagtctctgtctcttatgttgtttccgaaatttgagtttgatgcggctagttaaaatggctcggctccacctggttttacctttagcagcgaaagctaaagctcgatcagcaacttctctaacggctcgacctttacgcggggctgatgaagttgaaggggttgagattgacttggcttaaggcttggatgatttggatgagtagacttgttggttgtgcttctgttttccatttggcgtggctctgtgagttttgggttctgtttgattggtgttgctgcacactgattcttcttcttttccttctggtccgatccgggttgatgttgggcgctagtgctcactattgctgctgctgct

SEQ ID NO: 2764 - DNA, 568 bp, Populus tremula x Populus tremuloides
  Predicted polypeptide sequence is orthologous to G3032
ggctgccccatttcttggtttcctcatccgatagtggtggtggttgaagcggcgacccctctgtgacagtggacgatgagggtggctgatgagattcggctcctgtagctttaggagctgataatgctgggactggtacttcatgttgctgtgcctgttgaggtgagcttgtcattttgaccgactagaactgaatggaaggtagatgtggcaagagcaaaaactatcggtgcgatattgaagaaagcagatttttttttgatggattgaagaaagtagatgaatcaaccttctagattgaaagcgtccttagcctgttagccagatgactattccgaggaggactatctaggtgaacaggtggcaatgccaaaaaactttttggcctactgaaattatcaggagaagaatcgaaaaggtttctagctagacaccattaataaatttaacagcctggctgtttttgtttatgatgtaatatctagagtgaataaaaattaggattttaaaattctaaggttatagctgagatttttgagaaatatagataaaactctagcgtaaaaaa

SEQ ID NO: 2765 - DNA, 496 bp, Lotus corniculatus
  Predicted polypeptide sequence is orthologous to G2
atataaatatttatatattatatgaaagattatttaacttgaatgtgattactggcgggggcagaaaaaattgtacattaggatggtctcttgagtgtgtggaacccatttttctgcagccaaccttgagaagaagagggtcttataatctgcggtgggaatcctgatgatgctgcagcagttgctaaataatgtggaggtccggattgccactgttgtaaatgttgatgatcgctcgatgataaggatagatcacttccaactcgacctccatagctgctgctgggaaaatgaaaatttggagggtgaatatgtgcaaaattgtggaacattggagactctccagaagatctgtaggggacatatctttgcatttcattagaggctgaggaatggaggtgagtttgactcagcatcctcagtgcttcactctccccatgcacttccttgttgcttctatgcaaaggcttcggtagtatactcatgagcttgggct

SEQ ID NO: 2766 - DNA, 502 bp, Lotus corniculatus
  Predicted polypeptide sequence is orthologous to G214
acctcaaatggacacaggagtaagataagattaataaattagtttcaacaaccaggaagagcacgtaaccttgggcagcacataaaagatcatatttacattcttttatttatgaacaataaatatatggatatattagcggtttgatattgaagaacacgtcataatcagcacatggtctacgcaacataggagaaaacaaacagcccaagaaccttgcatacttcgaacaagcttacattctgggaatcaatcttcatttggctgaaataaatgcaggaatatgtcccgtcgcgcgggatataagcagagagatgacatcatttcttaaccttgttctccaaatctgactcggtaagagggctatggtcctgagcaccagactctagttcgagttctctatcagttaccatcatttgctgatgaggcaaagatgtgcttggagcagccgactcagaactttctgactccatcggttcatgttcacctgttccagcagaac

SEQ ID NO: 2767 - DNA, 550 bp, Lotus corniculatus
  misc_feature (211)..(211): n is a, c, g, or t
  Predicted polypeptide sequence is orthologous to G214, G680
aatgcatcttatctaggtctatttagcggagtttttaacagcattaacatcagttcaaaatagtaaaagagcgtatgtagtaattaaatatggtacacacatcgacaggaaaagtttcttaagctgcaagattagaaataaacaatagagatacaccgttgtgggggattataaatgatatgcaaaaaccaaaggtttcctttatgtgatngcacgcatatatcaaacctcaagttgaagcctctctttccaaacgtattctcttacaacctttctcatcaccttggttgctggtcgtaccaacccggttttccttggcctccatggaacatcttttgtagggcttaaagcctgttcgacgagtattgagctttccttgttcaagcccaatggttacctgtccttcctcgttaatttcaaagaatggcaggtttttctgcattccttcataactagaactgcatttctggcggtcaacgtcgtctttatctttgtcatctgtgtttagcttgtcgtccatgatgttgtccaattgatgatccttattttt

SEQ ID NO: 2768 - DNA, 474 bp, Lotus corniculatus
  misc_feature (437)..(437): n is a, c, g, or t
  misc_feature (456)..(456): n is a, c, g, or t
  Predicted polypeptide sequence is orthologous to G280
aatcagctcaagtcatgtcctcttagacaattaaggaaaaaagtaaaaaataaacaaagactctcattctcataaactaagctaccactacataattttacaaagcaaaaattacattgacacaaagaccaaattccctacattgtctaagaccaccacaatcacaaggcacactctatgattcaacgctgacttcagtcaattgaggcttcaccttaggaggcctccccctgggcctcccactagaaacagcagcgcccggagacgccgccgcagccgaccgggcaaccttcttgggccggcctctaggcctgccacttgcaattgacaccaccttgggctttggctcagcattaggatcctttggtggacgacccctgggccttggtggggccaccacagtgtctagaggcagagcagccttgggcttgggtggnctgccacgtcccctcttangtggggcatttgggtcag

SEQ ID NO: 2769 - DNA, 545 bp, Lotus corniculatus
  Predicted polypeptide sequence is orthologous to G668
gaaaaaatcaattcaaaacgaaagatctcatcgtaggaaatttacataagcaagcttttcctgcagcaaggtactcagtatatatctctaatagtgtgataattatgttgattaatagtgaaaaatatacacacctatactagcaccaatacatttgaaaacttgtctatgaaccttttccttgaacttatgaaagaaaaattgcaaaagttccaatctaaaaaatcttatcatcatcaccaaagcctaagattttctctggattaacactgcactcatcaagaagccacttctctagcaaagacaagggcatttctggaccaataacattaacatctggctttctttcaggtgacaaattagatggagaaaactgatcagaatttggagactccaaagactcaaaaccaaacaaggactcaaatgtttcagacaattcagcactagtactgctaattccttttgctccactagaagaagcagtgtcagtccctgcagcattcaagttgtaattgaaggagttttgtgtggcaactgagttagtc

SEQ ID NO: 2770 - DNA, 541 bp, Lotus corniculatus
  misc_feature (87)..(87): n is a, c, g, or t
  misc_feature (102)..(102): n is a, c, g, or t
  misc_feature (479)..(479): n is a, c, g, or t
  misc_feature (522)..(522): n is a, c, g, or t
  Predicted polypeptide sequence is orthologous to G729
ttttttttttttttttttacagaagaaaagagaatgctataaccaaaataaaggttcaatttcttccccttctctctctcactttcntgttcttctacattntgctgctacatcagcttcctttcctccacctcaccaataaataaataaaattaaatacaagaaaatgctaaacaaaactgtccatgagctcagaaaacttccaaaaggaacttcattagtagaactatgcagagaatttcttcttctctttgacaccaacttatatatatctaattaacaccaccttggtggattataatcaaattaatgcaaaatagagacaattaggaaaccaatgaaaaattagctaggcttgtcctttgccattccaatctggtcttcctaatgtgaactccaagcttggattcttacactctaaattagatcctgacaaattgttcttgagttgggttgaatcacacttctgaatttgatgncctcctgaaattggttgtgattggaagattgttggtctaaaancttctacttcgttagaact

SEQ ID NO: 2771 - DNA, 487 bp, Lotus corniculatus
  Predicted polypeptide sequence is orthologous to G975
aaatagaagatcgatcttgccttctatgaatgtagcatggtaggatatcagatcaagctgcattacattaggaaaaagacaatagcatcattacatactaaagggtcatattgcataatgaggatatctatcaaacctaccactaccattacttctgcaagacacttgttccttcaattggataagcagcaaagtcaatcacttcgactcctccgcagccgaatcatcagaatcagaatcctctatatcatcttcagattcttcaaactcagatctgccagactcataggcatctgcagagggtttaaaacatgcataaggatcttctccttcatggctaacttcaatattagcaactcttcctaggaaagcaccaaagtccccatccccaagcttatgcaaataaatatcatatttcatcaacttccgacgaagttcttcgaacgacacaggccttttatatgatctcaacaatttcctaatcttc

SEQ ID NO: 2772 - DNA, 734 bp, Lotus corniculatus
  Predicted polypeptide sequence is orthologous to G1020
gcacacacgtacctgcattctctcatcaaatcaatcatcatgcgaaaggcaccctcatcgaccaccgttacgaaggcgagaaacaccgccgccgcaaccaccgccgtgagcgccaagagcaagatacacaagccttccaataatgcaaccgaggttcatttcagaggcgttcgtaagaggccatggggccgttacgccgccgagatcagagatcccggcaagaagagccgcgtctggctcggcaccttcgacaccgccgaggaagccgctagagcctacgacgccgccgcccgccagttccgcggccctaaagccaaaaccaacttcccccaatcaccctccccggacaacaacaccggacccaacgacgtcgtcgtcgctaacgtcaaggccaaccagagcccaagccagagcagcaccgtggaatcctcaaccccggagcgtgacatcacgcgcggcggtggtgtggtcgtcgaccgcttccccttcctcccgctgcatccacaacaactgatgcctttctccggcggcggtgacgttgtttacactgctccggtccgcccggtgatttttctagatccggcttctcaggccgagtttttcgcccagcggttccctgtccgattcgaatcaggaccggtcgattttaccggcatgtttggcggtggtatccagagcgattccgattcgtcctccgtcgtggattgccggccaaaacctacactcaatctcga

SEQ ID NO: 2773 - DNA, 458 bp, Lotus corniculatus
  misc_feature (379)..(379): n is a, c, g, or t
  Predicted polypeptide sequence is orthologous to G1075
aacacaaagggcaaacgttttacaatgttcctaaaaagagttcttacaacattcctagcaaaagaagacgaacttcagtaacaatcagtacttcttcacaaacaattcaaaggaaagaaggaaattcaccagaaaattaatatatatatatatatatatatatatatatatatatatatatatatagatgttaagattcaactactcacctttgtgccccgaagatcaactcaataagattgccttccaccggagtttccagcccaaccatcaactggtaattgaggcatgtttaggggtaaattgaagaacggaagccctgaagatgggtcagggaaagagttattaactcctccaccaccaccactgccactaccgncaccagcagatgattgaccttgttgcatctgaagagattcatcttcctccaagggcaacctctcatacgcaacattagt

SEQ ID NO: 2774 - DNA, 536 bp, Lotus corniculatus
  Predicted polypeptide sequence is orthologous to G1108
gttgttggtaatgtaacatacagatgagacaaacatagagtacatttaaaatagactccaacataaagggcatgacaaacccacataagcaaaaggaaaataaaatcttgaatctggtagcactgaccatagcccagatatcccaataattacttaacatgacaacaatagcacaacaaaattaacaccttacacaaagctgtgacaaaatcagaccaggtcccagtcattctggtataaatatacaaatactacctatctaacttaacactccttattttcagcctttttaaagtccttgagctgctgattgtttctccactgttaatactaccaatcgatgagaaaacagcggagcgttcatgtggtgaaatatcatctagggatggaacatgtgggctcatttcagaaaggttggcagaactttcacaatttaaatcagacatatcaccatccttggataaaattaagcttctatggagtctgaaccttggccttgtccttaaatgctccaatgatgctaaaatgatcacata

SEQ ID NO: 2775 - DNA, 495 bp, Lotus corniculatus
  Predicted polypeptide sequence is orthologous to G1145
ataaaacctcatgataactaaaagcaagcaaatggatgcaaattgcatcacatagctatgcctgtgatactagaaggaaggtgtcaacctcaaaaaacaccaaaatatgcattctctgatactcatatctacaaaccactaacttatagttacatatctcagagtggagctgatgctattcggcgaagttgatatttaggttcaggaggtggtgtacatggaagcatctgctcaagctcctttcgtttccttagcctttcattttcctcttcaagacgtgagactttattctacagttcgtttgtgtatgcatgtttccttgctcttgaacgggcagcagattcccgattcttgatcatccttttctgcctcctttcaacagtcttccccaccatgtcctcaggagcgctccttttccttccgggtatctgcatatccgacactgttcccatcagaggtggaggcagtgccacctggttatcagcataagaaaca

SEQ ID NO: 2776 - DNA, 544 bp, Lotus corniculatus
  misc_feature (237)..(237): n is a, c, g, or t
  Predicted polypeptide sequence is orthologous to G1146
ggcccccctcgagttttttttttttttttttaaacgtgaatgttggctaattatatgcaaaactaatgagatgaaacttcccctcattgaaaaatgaagtgggaaatttctatgttagaaagatcttcaggcaaaattttctacaatgaagactgatagaacattctttacaatgccaacttttacaatatctataaaacctaatacttctaggaactctaaactaagttggtgatnggtttccaaggttcttcaaaagctaagtcttgtaatttttaatttccaactataagtgattcttcaacatttcaccatgaaaccaaacctacgtgaatctatcacaggaaacctgaccgctatgcatgaaccgcgactaatgtacatgctaatctgaagtgagcactgcattcaatgattgttccagttttctactatttgatgctctatcatctaccaattccaagtctaacagtaaaacatcactctcttcacattttctttcaaggctggcaatggcttaacaccacactctccagctactcgt

SEQ ID NO: 2777 - DNA, 567 bp, Lotus corniculatus
  Predicted polypeptide sequence is orthologous to G1146
acagttcaaccaaatatgtctcaaaaaaaatgttcaaccactaacatgagaaggcaagccaacaaaagcaagtaacaagttcatccacgaacataatcacacgaagtttttaacaaaagtcaaacaccaatgacatcagtacttcaaacaaccatatgctatcctaacagtagaacatcaccctcttgacgttctccttaagtgcaggtaatggcctcactgcagcgttggcaccaggtgcccgagtagttcgtccacccattccgcgaccagcagcagcactggtcatggagccactgtcagaagtttcaggctccatatagaaccttgctcggaaggctgcgagatgggcatagtatgctggaggcacaatagatacagatcgtgtgcaccttgcataggtgtagcacaggttgtgggtaaggctttgtaaaccatcagcagtgaagttgttctcgtcccacaggacgtggtaatgcgcaggacggcttgtgccctggattccagcatgggaacaaagataaaaatcgaactccgttggatggcagatcttggagtccaccacag

SEQ ID NO: 2778 - DNA, 495 bp, Lotus corniculatus
  misc_feature (49)..(49): n is a, c, g, or t
  misc_feature (201)..(201): n is a, c, g, or t
  Predicted polypeptide sequence is orthologous to G1146
tctttcacggcgcattcctttaatcagtgacaggcctacaattattttnggggcagatgtcactcatccacatcctggggaggattctagtccatcaatagcagctgttgtggcttctcaagattatcctgaaatcaccaagtatgctggtttggtttgtgcccaagcacatcggcaggagctcattcaagatcttttcanaacaatggcaagatccagtcagaggaacattaactggtggaatgatcaaggaacttcttatatctttccggagggctacaggacaaaagccgcagcgcatcatattttacagggatggtgtaagtgaagggcagttttatcaagttttattgtttgagcttgatgctatccgaaaggcttgtgcatctctggagcccaactaccagcctcctgtaacttttgttgtggttcagaagcggcaccacacgaggctgtttggcagtaaccatcatgacaagagttctgttgaccgga

SEQ ID NO: 2779 - DNA, 603 bp, Lotus corniculatus
  Predicted polypeptide sequence is orthologous to G1146
atgaaggaaattaacatttcatgcagatttttatacaaaaaatattgattgatagcactttgtttacaatgcctgattcgatttcatcttggccgactagagggttagcatctctaaagtctacacctatggtttgtctcccatgttctaggatcctaaactaggcctctaaaagtacaatgagaaaccttgctgctatgcttcaaagccactaatatacaagctacagggttgaggggaaaggaaggtgcattgcatgattgtgttttgcagcatttcactgtttgatgcacatgtcccccatcggccattgccaaacggccagacaatcttaacaataaaacatcactctcttcacattttctttcaaggctggcaatggcttcacaccacactctccagctgctcttgttaccttggaaccatgtccagtacctgtggagccattctcctgcagctcttccggtcccgcatagaaacgagctcgaaatgcggccaagtgtgcataatatgctggaggaacaacagagacagagcgtgtacacctcgcatatgtataacagagattgtttgtcaaagactgaatcccatcagcagtgaaat

SEQ ID NO: 2780 - DNA, 604 bp, Lotus corniculatus
  Predicted polypeptide sequence is orthologous to G1146
ctcatccagatgcaggcacaggccgcggccgtggccgtgcacgggcgccaccttctcaacaacctccatcatcgtcctctcattctcccgctcctgtcatcggcgctccgatttctccagcgcctgttgtttccgcgccgatttccgcgccatcgcccccgccgccttctccggttccggtcgacgctctgagttccgaggtcgagcagaaactcgcattgcgaccggcagcgccgtcgtcgacgaaggctattaggttcccggaccggccagggttcggtcgattagggaagaagatacaagtccgagcgaatcactttcagttgcaagtcgctgaacgcgatcttcaccattacgatgttgctatcactcctgagattacttcgaagaaggtgaccagagaggtggtgagtcagttgataaagatgtacaaggagtcggtgttggggaatcgcttaccggtttttgatggacggaagaatctcttcacggcgggtccgttgccgttttcatcgaaggaatttgtggtgaagttggaagatgataggccgaaagcctcgtcctcttctggttctaaaaaagagaaacgggagcggcaatttaa

SEQ ID NO: 2781 - DNA, 604 bp, Lotus corniculatus
  misc_feature (586)..(586): n is a, c, g, or t
  Predicted polypeptide sequence is orthologous to G1146
atttagtcaatatatcattatatctgatttaagcaggagcaccattcacctttagcattgcaaaatccgtctctctacatcgtcaacttaaattaaagccatatatagtagctgctagcataataatgaacacccaaccaaacaaagaaacggccatgtcgaagagagaaaattgcggttggtatatatgttcaataggcagctattctataattcctaattagttaatgttatgtccaacttcagcagtagaacataacatctttcacattatccttgatggcaggcaattctatctcaacattgctcctggttgcaccaccagcacccgcactagcagaacccatttccgattcgccttcgatatagctgcgagctcgaaaagcagctaagtgtgcataatatgccggaggaactatggaaactgatcgagtgcaccttgcatacgtgtagcataatttattggccagcccctgtagctcatcagctgtaaagttattctcatcatacagaacatgataatgggtaggtctgctagttccttgaattccagcgtgactgttgagataaaaatcacactcgcttnagtggcaatcgaagtgtc

SEQ ID NO: 2782 - DNA, 414 bp, Lotus corniculatus
  Predicted polypeptide sequence is orthologous to G1146
agcgacctcctacctttccaacactcagcacctcccgctctttcccacaagcccaccttccgagcctatcttcgctcttctcaccccggtgacgcccgccccaccctcccttcaagatgaagaccattttcaacggcgactgcccgtgcggggagaaggacgagtccgagtgcagcgggtgtgaaaaggttcgttcgacgtgtgcacggtggccgagagagttggagagggatggtggcgatgtctccaccgcggtcgcggctgtggccacgagcagtgcgcgtagaggagtacgggctaagaaaccacctacctggcacggacactgacaagctggggggtctccgtgccgctgtgtctttacacttcctcgtggacggatggcgaatgggcttgcctgtttccgacttgggt

SEQ ID NO: 2783 - DNA, 481 bp, Lotus corniculatus
  Predicted polypeptide sequence is orthologous to G1198
cactcacaaagttatgattctatttcagatagggggaaaactctagcaagtgaaccaaacattcaaatttatcacatccaaactacttggaatgaaataaacacaaagcccttcaactactcttacaagggacaacattatgggtaataaacaagatacaatactctggtcaacaattcagtttctagattatgtgactagatgaacactgatatcagtaacctgaaaagtacaacacagtaaaattaaacctatgataacaaagtattcctggtgccagatccatgaaaatgaacttgacatgctatttatcactcatcaatctctggggcgggcaagccagagggagctaagagcacgcagcctagaaaagtagtcattgatggcaaggagtgcgcgggccgatgggcgagtggtcaatattcggtgaatttgttgcagcgtctgctggcgcaaatggtcagcctgccgaataaacccc

SEQ ID NO: 2784 - DNA, 515 bp, Lotus corniculatus
  Predicted polypeptide sequence is orthologous to G1198
gcaaccacaaaccattaagcaggaaaagatacaaaaagagaggaaaatctccctcaaataagctgatttctgaaatacaattaccagctgtaacctaaatacaaacactattctacattttccccttcacctctatctatcaaacacctacacaatcaaattattgagactattttcaaagcaagggaaagcttaaataaaaatgttgcaccacaccagcatcaggtggagagaagagtaatcacattatctaatgtttacagcacagctaggcttctagaggaattcattgccaaaggacaccagcttccaattaactgatttaatgcagaagattcaatcctcatgttgaatgtgatctggcttgaaaaaacttcatgaatggagccttgataaacttcactcccgtggcctggccagccagagagaactcagggctcgcagccgggagaaataatcacttattgcgagaagggctcgagcggattgtctagttgttaatatcctaagcattt

SEQ ID NO: 2785 - DNA, 344 bp, Lotus corniculatus
  Predicted polypeptide sequence is orthologous to G1198
actaagtttcaaaagcagatgttattatatgcattttacaagaccaactttaatttcacacaggctcatacagtttctaaatacttcattttgcaacaatctaatatacaacatgcgtccaaaattaatttatttacaaactcctatggatgaaataaacgaagcagccatattcacaacttctccaaaacgcaagactgcaggaaaaatttgatgctcaaggccagagaaactacatcacatcgcgttcataatcacaagtttttgttcttgtaatcttgtgtgactaagcaggttcacggggtcgattcgaccatagtgagcttaaagccctcaggcgttgg

SEQ ID NO: 2786 - DNA, 568 bp, Lotus corniculatus
  Predicted polypeptide sequence is orthologous to G1198
ctggttttcatttcagttaccagttataggaaaaccatgagttccacttgtaacaagttgagacagagaggcaggactcttgcaaacaaaccaatgaatgaggttaatgcacaaggagaaatcttcaaaattaagggtaatacaacttttgtgatgaactatgcacgttggctggaagaacataacaagcttatttctgagatacagagtggtttaaatgatcataaacaccttattggtgatgacaagctgctgtttcttaaagacagaatcatgaagcattattttgaactgtttgagatgaaaacaagtgctacaaatgtagaattcttcaagtatggcgatttgtggcggactggaggaggctttcgcccttctgaacttcttcaggttattctacctagacttcaacattcttggaccgaggaacaactttctgatatttctaatcttggatatacatgtcaacaagctgaagaagcccttgcacaaggcatggaaaaactccaggaaacccttgataaagccacagaagcaggtgacaaaggatttcaggtgacatgtgtct

SEQ ID NO: 2787 - DNA, 463 bp, Lotus corniculatus
  misc_feature (158)..(158): n is a, c, g, or t
  Predicted polypeptide sequence is orthologous to G1290
agaaaaatatagtaggtaaatctctactcagtaactgtatagctcttcaattagtgaaaagagaagtttaatgatattacaaaatttatacggaaatcatccccggccatagcgggagaaacatgtatccccaataaaagactccctactctcagatngctccaatatctatgcattatcgatctttagatgatacctctccttcctctgtagatttattgatgcttttaaacatgaactgtttttctaccatccaaaataagccatttgtcaagagagacactataatctggggctctcctttcattgcagcaacatgcaacacactatagccctgagtacagtatgtgattgacatctgtggctcaggttaagagaggtagcagtgaggtagctctaccttcaaccctctctactcaaggccttaactctgttgcattcatcttccacgccaaaagtacct

SEQ ID NO: 2788 - DNA, 570 bp, Lotus corniculatus
  misc_feature (534)..(534): n is a, c, g, or t
  Predicted polypeptide sequence is orthologous to G1421
tttttttttttttttacaaaaaacaaaaagtctcatccattcattccttaaaccataatagtcactactacttgagtacaccaagtaccacaaacaaaaagagattagtaattaaactgattacagtcattatactaatttgctgtcgatacaaaatttgccggtaaagaggcaacacaacgacaagccataatatccatccatccattcttgttaactgctaataaacccatcaaatcaaatcaaagaacaagaagcggatctgaaacaaacaaatcatcaatatcttggaaaaagtcacggttgctattcatcgtagtagtattattccaactattgaatccgaattccaaatcctcaaacaaatttgtactcgagctgcagcaaccaccatcatcttcgaaaaacatgcttctttctggcaacacatcattgaagctgttgtttccgtacaaaacatcttgaaactggacgtcaaattgcatcacatcatttggaattggaaacagtgattcagattcttccatcttctcntgtgttggcaatgcaatcttttcagtactcaaattc

SEQ ID NO: 2789 - DNA, 489 bp, Lotus corniculatus
  Predicted polypeptide sequence is orthologous to G1539
aataattcatcatagaaggaaattaaagacaaaggaaatgaaacgctgaaatagaattagcatttctgtttgaaattgtaattatgaacttagtatcttaaaagaaaagttacagggaaatcacttcaaaattatcagtaaaatgcaccaaacaactacctaggaactggtcacttttacaacagcaaacgatggatcaagctcaaactggaaaaaagaagaagaagccagctacagtacatgacgaaataagctagacaggctagctacaattcccgaaaattttgcaattgaaatcatttgacttatagatcaatctacgatgttgaagaaaatgggtttgatattgaaaatgtcaaatagaagaaatcaatggactgaatcgaagcagaatccagacgtcagtatgtaccagtacccgcaatgtagcttagctacatttcaagtcttgtcagattcagagcaaaaaccattttgcccttctaacaa

SEQ ID NO: 2790 - DNA, 501 bp, Lotus corniculatus
  misc_feature (317)..(317): n is a, c, g, or t
  Predicted polypeptide sequence is orthologous to G1594
ggaccaaactataagcattcattcagaatgtcagcagtttttcatcaagaatacaagggaagaaaattacatgatcatttcccttttgatctctttgtgggaaatgtaagcatattactgtcagtaatctgcttctagtttataatttacaaaagaaaatacaggcaacagttactaagaatatacatttgaatgcatgcatatacatatgcacctcattcatcagaaaggaaccgtccggtcagatgttccatcatagaaaactgcatgttctcagatggtttccaatgtcgttttctctgattaataaaccaatngttaatttgcttctggtctaaccccgttgccttagccaattcaatcttatcagattccgttgggtaaggccatttgtagtgaacattccaccactgaagcagtgtttgtcttgcttccttgggaagcttacccttctttttcttctttgagaactccaatttcaaagtaccaatgtgactccca

SEQ ID NO: 2791 - DNA, 681 bp, Lotus corniculatus
  Predicted polypeptide sequence is orthologous to G1594
atcaaagctaaaatcgtttcgcaccctcagtaccctcgcctcctccaagcctacatcgagtgccagaaggtgggtgcgcctccggaaatcgcgcgtttgttagaggaaatccggcgagaaaatgacctgtgtaagagggacgtagtttccacgcgctttggagccgatcccgaactcgacgagttcatggaaagctactgtgatatgctggtgaagtataaatcagacctggctaggccttttgacgaagcgagcaacttcctcaacaagattgaaatgcagctcagcaatctctgtactggtgcttcagttcccactctttctgatgaggggggtgtatcttcagacgaagaattcagtactggagatggtgatgctcaagatggacaacaattaaggggagaagatcgtgagctcaaggataggcttctacgcaagtttgggagtcacattggtactttgaaattggagttctcaaagaagaaaaagaagggtaagcttcccaaggaagcaagacaaacactgcttcagtggtggaatgttcactacaaatggccttacccaacggaatctgataagattgaattggctaaggcaacggggttagaccagaagcaaattaacaattggtttattaatcagagaaaacgacattggaagccctccgaaaacatgcaatca

SEQ ID NO: 2792 - DNA, 586 bp, Lotus corniculatus
  Predicted polypeptide sequence is orthologous to G1655
cttcgattcaaatctctctcatctcatctcatctcatctcatcaatcaacaaacacctcaatctctctctctctctctctctattcccatggattctcttcaaccaaacacgataacagattccgaaacctcccctgattccaatcacaaaaaacgccgcaaaatcacccaccctcaaaaccccctcaatctcatgccctggcgatccaacgccgaccagcagatctactccctccgcctcgccaacgccctccgccgcatccccagacccgccgcgcaaatccgcgacaccgccgaccgcgtcctcgccgccaccgccaaaggcaggacgcgttggagccgcgcgattctcacccgccggaagaagctccgcatcaagaaggtcaagcgagccgcctccggattgagaagagcggcgatcgggaggaggaagcggttaccggctgtgcagaagaaagcgcgcgttctcggccggttggttcctggttgtcggaaggtgtcgttcccgaaccttctggaagaagccaccgactatatctccgccttggagatgcaggttcgagccatggctgctctcgctgagctt

SEQ ID NO: 2793 - DNA, 614 bp, Lotus corniculatus
  misc_feature (115)..(115): n is a, c, g, or t
  misc_feature (217)..(217): n is a, c, g, or t
  misc_feature (585)..(585): n is a, c, g, or t
  Predicted polypeptide sequence is orthologous to G1944
ccccctttttttttttttctttttttaataaaaataatgtcataaattatatttatttaaataaactaacaagacattttaaataatccattttatttttaactaaataatcttntgaaaaagtcttcattataagtgcaaatgtttcgaagcgacccattaagcatccgccatggctgtcattgcagaccaattatctcaacggagattagacatnggaatagcagacacaggaacagctgcagtgggtcttgatcttatctcatatggcacaaaactgcctacaatcacctgcacgggagttgcagccaccaacataccagctaatgtaccacctgcaacacgtccatctggacttgcaaaaacaatgctcatgttgccagaacggccaagtgtttccccaccactttcatgtggacagaaatggcctgataatgatagaatcctaaactgtccctcatgggttactgtcctagcagaagaaccaggctggttaagggtgacagttgatatgtgtcccactgcagagagaatgcatatatctcgcggagttggctgagagaataccattatctccctaaaaanattctctccagaattgatggtgatgagat

SEQ ID NO: 2794 - DNA, 518 bp, Lotus corniculatus
  Predicted polypeptide sequence is orthologous to G1944
gcaaatttcaagcagctttggaaaatcccatcagccaacggaaaattttcattgttctggtttggtcaaattggcttgagagtggtaattcaatatatgcatggaagcaagagaaggtatcagttctggggttacagtgataggagcagaagctccatcagcttatcatgtggcaccgaggagtgaagctccgaaccaagttcatgtccctgcaccagcatcagcaggtactgctgcagctattgttggctcaccggtgagtgtagggttggatgttacaattaagaagaaacggggtagaccaaggaaatatggaccagatgggcctgtctccatggcattgtcaccattgccaatctcatcttcagttccgccttctaatgactattcatctgggaaacgagggaagccacgcgggatggaatacaagcagtcgaaaaaaattgggttggatcatcatctaggtgacttgaatgcatgctctgatggtacaagctttatgccgcatatcatcactg

SEQ ID NO: 2795 - DNA, 382 bp, Lotus corniculatus
  Predicted polypeptide sequence is orthologous to G2226
tgaagtaaacattttatttatctcatggttaacatgttgacaatactgttcaccagaagtacacaaaataatgcttcagatggtgctggaagacttgagagacctattcggataagggaagccaacttgcatatagaaaaaggctggcatcaatggaagctcaaaactaccctaagtgaacaacaaatggcacttaattcaagaagaagcaaaaatcatggagggactcaagcatagtggctatgcttattaataagaggggtagaacaaagtatgaaaactctatgggttcttctaaatattggaccagtatacacaataaaaaaaaaagattagaactctaaattacccacagaagaaaactctaagcccaaacgaaaag

SEQ ID NO: 2796 - DNA, 430 bp, Lotus corniculatus
  Predicted polypeptide sequence is orthologous to G2226
ttcaaaccccacttcgtaagatactaagaagagactaacagagtttccaatactttgttcttcctctctgattgatcaagcatagcatctctgctttttgtgtctctatttccatgattttcagtgctgcttgaatcaaaggcaatttgttgttcattttttagcttcaacaggtgccaaacaatttatatcagtaatttggcatccttaaaggatcctcaccattgaccaaaatgggtctctcaagtctcccagcaccatctgaaggagtgttatgtgtgcttcttgtgaacactgtgatgtccatttccatattcaaaggcattgtcagaacaattctacacattgttggtatccatctttcttcaccagatgcctcccaaaacccacctgaatcatttgaagtccatctcagcccctctgagagtta

SEQ ID NO: 2797 - DNA, 501 bp, Lotus corniculatus
  Predicted polypeptide sequence is orthologous to G2520
tccttcaaaatactagttctctccatctgtttctgttaataaaatttgaaaatgtctcaagtcttaaaacacaaatacacacctgctacacattgttatacaaaacaaatcaggggagatgaatcctattgcacaagagtttaaaaatgaaaaccagattttcttttccagttgctacttgctaatataatgaagcacatgcgatcagatgcacttcctataaataaatgatattatactataacaaaggacatacaaacctacaatctgcaataattgactaggttgttaataaagaaaataatgtaatcaatcccactgaatgatcgatcactcattcccaatgagacttccaagccaagaattacgttgctccttcaaaacccccaccaatctgcatatgcagccatccaggatgtgatccctgagcatacccccttgctgcttgtgattcatatatcactccagcaatgtcaaatggctgggtaacaacatcttttg

SEQ ID NO: 2798 - DNA, 502 bp, Lotus corniculatus
  Predicted polypeptide sequence is orthologous to G2574
gtgtttgaaatcctagaattacatatatatatatatctgagggtatgtgcattgggcttcttattctatacaaggaagagggtatttccctttaggaacatgacctcagtcattgaactaggaactcacaatcacccacttccagtttcagccacagccatggattctaccacttctgctgctctttccatgctatagtcaggttcttacacatctcaacctacaggtcactgtgctgcatctatgggaagtgcttctacaatgttcatgggtctgaatttcagttcttataatcaatcaagagcaacacaggccttcttaccaacccctaccccagattggttcccaacaatcactttagacctgacttaaacaacctctgagtcatggaattcttaagggagaggaggaggtcgatggagaaggacatgcttggaactggtgcatcattgtcaaaagcctcacattcataatcgtctgggacaccccaaggatctcactc

SEQ ID NO: 2799 - DNA, 625 bp, Lotus corniculatus
  Predicted polypeptide sequence is orthologous to G2885
aagaataaaaaatagagaatttccttttgttgctatgtgacagatgaatggtacaatgttcatatcaacaaaaattaatgattgactcaaacacagtaagatcataaaaacttgcactaaggaatttaaaaccctcaatacaggccctacccactaataagattagaggtgtcatctccttcctagagatgtcaccatttctgtaaaccaaaaaatagaaaaccctcaatacaaagacttgacaaaagagtatttcctcttttttcttcccttctagtgtattatgtatgacagttaatcttccaagataatttgtctggaaagatctttaccaatgccttcaagcaagcaactatctcctatgctttaattttttgcgtagctttcggctacattttaacacacctcacaagatgctccatatgcagtaactacagaaacgcctccaatatttggacattataaaccgagactgatggggatgtatgtattgttagcaaccatttacatcaaactgcagctacaaacaaggaacgtcagaatgttagatcagtgcatctttattcaccaataaaagaaacatagttgtaaacttataaacccgtcacgcataatacttagcata

SEQ ID NO: 2800 - DNA, 464 bp, Lotus corniculatus
  Predicted polypeptide sequence is orthologous to G2990
actaatctctcatcatcatcataatctcatccataatataaactaacaattaaaaaccagagagaataaagaagaaaggtaaaaattaaaccactaattaaactaaacgggtaccatccttaatctaatgttctaaacatgttattatcatcatcattttggttcttccccatgaaagatcgatcaagattcaagatgaagatgacccattagcacgaactgttgctccaccatcgttctggaagtgatgatgaatgggatcctcagcaccatggttgcgatttccattgccattgatttcagaggcgctgctaatgttggtgataacagggtcatgattttccttggcaaaaaaactcttagcagaaccagcatggttgatatggtggttgatgttgttgttgttgatttcgttgctaccatctctcttcccaaaagtgttcttgttgttatgcatccaaact

SEQ ID NO: 2801 - DNA, 727 bp, Sorghum bicolor
  misc_feature (682)..(682): n is a, c, g, or t
  misc_feature (684)..(685): n is a, c, g, or t
  misc_feature (688)..(688): n is a, c, g, or t
  Predicted polypeptide sequence is orthologous to G12
tccccgaccagctcgacggcgcggcggtggccgataaccccgagggccacagggacggcggcgcgggggcggggctcacggccgccgccatccgcaagaaggcggccgaggtcggcgcccgcgtcgacgcgctccactgcggcgttggcgttggcctcgctggcggcggtgctgcctctccgcagccgctgtcgtcccaccatcgccgccgccccaagaaccccgacctcaaccgggagcccaccccggacacctcagacgacgagtgatttcgtcgtcgttcttcttctccctcatccatctactactctcctagtccttaggcaaaactactcacctaaggggtagctagctagctagctagacagcagtagcaagtaaagcaggcaaccagatggcgccagggacgcagcgcaaggtgttcggtggaatgcggatgagctcggaggtggccaataatggagccgcgacgtcgacgtcagggccggaaaccgtagtaagttgtaggaggagcctagcgtgctagccgtgccgtttgcccggagtcgacgtcgacggacggcgacggcgctgtcaaaggctctagcaccccagtagcaggagacagacgggtgcgtgcgtgcgtgtcagtgtatgcgggcatgtagctaagcaagacggctatgtccctctccccttcccntnnggntcgagtgaaagaaaaaaaaaaagatactcccggcaagca

SEQ ID NO: 2802 - DNA, 551 bp, Sorghum bicolor
  Predicted polypeptide sequence is orthologous to G214, G680
gcacgaggctctggtgaggaaatggtggtcaaggtaagaaagccatacacaatcacaaagcagcgggagcggtggacagaggctgagcacaaacggttccttgaagccttgaaactttatggcagagcatggcagcgtatagaagagcatgttgggacaaagacggccgtgcagatcagaagtcacgctcaaaagttcttcaccaagttggaaaaggaagctatgaccaatggtacttctccggggcaagcccttgacattgacatacctccaccacggcctaaaagaaagcctaacaatccatatcctcgaaaaagtggtctcagctctgagacaccaaccaaagattttccaaatgacaagtcagcaaaaccaaatatgcccttgagcaatggaaatgtacaaatggcaggtgatgcatctcttcagaaatttcaaaggaaggagttgtctgaaaaaggaagttgctcagaagttcttaatctcttccgtgatgccccatctgcgtcattttcttcagttaacaaagctcttcaatcatggtgcaccca

SEQ ID NO: 2803 - DNA, 778 bp, Sorghum bicolor
  Predicted polypeptide sequence is orthologous to G214, G680
caacctcgtcgctagccggcaccctattctccttcgcttccacagaacatctcttgtatggcttgaagcctgttcggcgcgatttcagcttcaggtgcgacaattcattgggaaaggaagcccttggctcatccattgtgtcgaggtcatgatcaatgcttgtggcgttcttgttgaggtcaactgccactgtagtcacttcatcttcttcctccttggcaacctccttcgagtcttctgcttgtgggggagaaaagctttgcggaagcttttctctactgaacagcgcatcgaaagccagacgaccctcttcagaaacctccttccatgaatcactagtgcttccactgcttctaaatctgcggtggttagtgtcaccagctgaagagttgctgcaggaggcttgcttcaccttctcattagcattgtcctccttaggaacattgtctgcatcaacatcactacttgaaggtgtgttagaaccacatgaagagcgatcctgctttttcttattcctgaatgcatcacttgtatcagctcctgtggtaggtgttgcatcagcattctggacaggaggtatctttaactctgtgtggagagacacctcgccttttccactcccatcagacactgaagaagcagcaactcttaaaccttcaaattgtccctgtttttgagcttcttggcattccttctgtgcattttcaactgggcaatctctgtctttctctgaaggtcttggaacatcaactgtgggaaaggcagcactaggagctga

SEQ ID NO: 2804 - DNA, 656 bp, Sorghum bicolor
  Predicted polypeptide sequence is orthologous to G261
aaatgcagtcctgtacagatccacgaactaaggtgtctgagattgatgttaatatggagcctgctgttacagaaactggtctatcaagggaccaacctgtcgaggagcctcctcatgcagcaactggggtaaacgatggcttttggcagcagttcctcactgagcagcctggttctgatgcacatcaggaggcccaatcagaaaggcgagatggagatgataaaggcgatcagacgagaataggagatcgggaaaaattttggtggggaaagaagaatgttgaacagatgacagaaaagctggggcatcttacctcggtggagaaaacctgactgtttgtattacttgtagttgtaggtgaaaaaacagttagtacagaaacacataggacgttggtgcctctgacatgtactttgcagtgtatcatatcttcgccacctgcacctgttgactgacatcgaatttgtagtcatacttttttcccttgtactttggtcgtgttaagaatgatgcagagactagttgataatatacttttgttaggagtgctgcattcatacttggtcagtagacatttcttggtactgctgtccacagcttctatgatttttcaggtttgtcgacgtggctatatatgtagatgataatattcactt

SEQ ID NO: 2805 - DNA, 626 bp, Sorghum bicolor
  Predicted polypeptide sequence is orthologous to G280
gcaggagcgggggttcctgcatccacagtgaagagaggccgtggtaggccaagaaaggagaagacattggaaactggggacttgaaagttgcacagatgacggagggtcaacataaagctctgcctgcacaagctgtagaccaaggtgggcttatgcaaaatgaagttgaagctaggattttgcaatcctttggtactcctttgatggagaagagaggtcgtgggcgacctagaaagaggcctctggaaactgaaactacagaaacccaagttgatgcattggtgaagaagcgagggcgtggcaggccaagaaaggccaggccttttgaaactggatctgtggaaactgcagttgaggtgtctagggacttggcagaagatgggcctgaaaaagatggggatgttgtgtcagggaagaaagcagaagctcaaggtgtacttttggttgaggagatagacaatggcactgcagatgctggatgtttggtagtgccaagagaggaggtagcaattgctccaatggatgctggaggtgtgctattatctggagaggaggcagccgtcgctcccatggatgctgggtgtgcaacgccaagggttgatccgatggatgtgggcaccaagag

SEQ ID NO: 2806 - DNA, 662 bp, Sorghum bicolor
  Predicted polypeptide sequence is orthologous to G280
gagggctccagtggtgagcccgctgcagctcccgtcgtcagcgctgatgctgctgccatgcctgtcaagcgcgggcgcgggcgtccgccgaaacccaagaaccccgtcgccgaggacgcagctcccactgcggcttccgtcgtcagcgctgatgccaatgctgtgcctgtgaagcgtgggcgcggacgcccccccaaagcccaaggacaccatcactgtggccaccgaccgggccaccagcggcatgctcagcccacgtggccgtggccgtggccgtggccgcccgcccaagaaggccaaggtcgccgtggaagatcccagtggtgagcctgctgcagctcccggcgttgctgctgatgccagtgctgtgcctgtcaagcgtgggcgtggacggccccccaaggtgaggcctgcagtggttggggcgccgtctgagtcttaaaccacgcacgatgaatcttgtgatggtaatggttgcaaggtttggtagtagcctggctcatcaaattgagttctgcactaacttttgcagttggttaaatagcgtcggttaaagagtactctcagtaatctagatgtgtttctgtagtctgtacatcgaatggtgggtgatgtgtaatagttgactgctgctgagagcgatttaatcagtgctatttcct

SEQ ID NO: 2807 - DNA, 680 bp, Sorghum bicolor
  Predicted polypeptide sequence is orthologous to G504
tgttggccttctggaagatcatgcctctctctctctctcccttgtaacctatatctttcgtccttgagctagcctctcatagtctcatctacttactacagtagtctcagtagtcagtaggtagctagtagctagaaggtaggtagatcgagcagtataatccaagaggcagcagcgacatctcgccggcggtggcggccatggcgagtggtggcggcagtagcagtagagtgcccggcggcggcggcaacctgaacctcccagctgggttccggttccaccccactgacgaggagctgatcgtgcactacctcatgaaccaggccgcctccattccgtgccctgtccccatcatcgccgaggtcaacatctaccagtgcaacccctgggatctccctgcaaaagcattgtttggcgagaacgagtggtacttcttcagcccacgggaccgcaagtaccccaacggcgtccgccccaaccgcgccgccgggtcagggtactggaaggccaccggcaccgacaaggccatcctgtccacgccgacgagccagaacatcggcgtcaagaaggccctcgtcttctacggcggcaggcctcccaagggcgtcaagaccgactggatcatgcacgagtaccgcctcaccggcggcacgaccgccgcagcggccgatgacaagaac

SEQ ID NO: 2808 - DNA, 843 bp, Sorghum bicolor
  Predicted polypeptide sequence is orthologous to G504
cttgctagtctctatctccttccttccttaagagttcgagattttctctctttctctctctagctctctgacagtcgtctctccctctgagctctccagtgatctcttatcagtcggccattcccagtcagccattgataattggttttccatggcggcggcggccatgcctagccccagccctagccgcagcagcagtagctgctgcagagtggccgccgtttccaaacctaaacctcccagcggggttccgtttccaccccactgacgaggagctcatcgtccactacctcatgaaccaggccgcctccatcccttgccctgtccccatcatcgccgaggtcaacatctaccagtgcaacccctgggatctccccgccaaggcgctgttcggcgagagcgagtggtacttcttcagcccacgggacagaaaataccccaacggcgcgcgccccaaccgcgccgccgggtcggggtactggaaggccaccggcaccgacaaggccatcatgtccacgcccaccggccagaacatcggcgtcaagaaggcgctcgtcttctacggcggccggccgcccaggggcgtcaagaccgactggatcatgcacgagtaccgcctcgtcaccgccgacgccgacggcaagacaacggcggccaagcgcagaggaggatctatgaggctggacgactgggtgctgtgcaggatccacaagaagagcaacgacttccagttccagttgttgtcggagcaggagcaggatggctcttccaccgtagagcaggaatccccaaagtcagaatcacttgagcaggagcagttccagttccagttgcatcagacaa

SEQ ID NO: 2809 - DNA, 706 bp, Sorghum bicolor
  Predicted polypeptide sequence is orthologous to G504
aattccttccccgtttctcctagctactccctcctccgatcgatccagggtgcgagagcagagctctggttattagtttagtttagtctccctcaagctcgtggcgcagcagcggattcgaattcgttgagaggaggtggattagcagccgaggcctgcagctagctatctagggttttgtagtgagagttcctcgcagtcgcaggcttcgcttggtagcgtcgtcggccggccgggagccaataatgatcatggcgaacccggacatgctgccgccggggttccggttccacccgacggacgaggagctcatcctccactacctccgcaaccgcgccgccaacgtgccgtgcccggtcgccatcatcgccgacgtcgacatctacaagttcgacccatgggaccttccatccagggcagcgtacggggacaaggagtggtacttcttcagcccgcgcgaccgcaagtacccaaacgggatccggccgaaccgcgccgcaggatccggctactggaaggccaccggcactgacaagcccatccagagcagcgccaccggcgagagcgtcggcgtcaagaaggcgctcgtcttctacaggggccgcccgcccaagggcaccaagaccaactggatcatgcacgagtaccgcctcgccgccgacgcgcacgccgcacacacctaccgccccatgcagttccgcaacgc

SEQ ID NO: 2810 - DNA, 609 bp, Sorghum bicolor
  Predicted polypeptide sequence is orthologous to G559
gtcatttcctctcgcttctgctcggttgcagcccagcgtagatcttattcttggccgagaatcctcaagctctccaatttctgttcttgcgccgcttagcaattccgccccgaaattcttttgcggcgcagtcttcacccgaatcttgggtcgtaggttcgtagctaagaagatgaacaaggacaaggctccgatgccgggagatggcggccccagcgacggcttgccgccgcagtccacgcgccgtgccggggcgccgccctcgtcgtcaaccccaccaccggagtacgacatcagccgcatgccggacttcccaacccggagcaccggccaccggcgtgcgcactccgagatcctgggcctccccgacgacctcgacctcagcgctcccggaggcggcgacggaccatcgctgtcggacgagaacgacgaggagctcttctccatgttccttgatgtggacaagctgaactcatcgtgcggggcgtcgtcggaggccgaggctgagtcctcgtccgccgcgggtggcggcggtgagggggctgagctgggccacgcgcccaggccaaggcatcagcatagccagtccatggatgagtccatgtcgat

SEQ ID NO: 2811 - DNA, 605 bp, Sorghum bicolor
  Predicted polypeptide sequence is orthologous to G559
gatgaactttggtgccatgccacgctcgttgggaggcaaccagcagatgttccacaacaaccaagcgatgcaatccatgctggcaacgcaccagctgcagcagctccagctccactcccagcctcagcagcagtcgcaacattctcagcaccagcaccagcaccagcaactgcattcgattcaggcgcagcaacagcagcagcaactgcactcgctgcaggcgcagcagctccagcaggtggcgagagacctcaagatgaaagcgcatctggccggccaaggccagtggggcgatgggaagtctgggagcagtggcagctaagctttactggcactggaatattttggtgcacgtggtggttaggaatggagatcccttgttttggtgatgttgctgtgcaagtgtagttatcgttaactcagttatctacctataggctcagttcagcttcagttttatcgttaactcggtgatctataggctcagctcacctgcaacgtacttcagttcagaaactcggatggtaacagatgtttatctgttggattttgtttgtatctctttgctagtttaagggttaaaatggttggaatttcagggcttc

SEQ ID NO: 2812 - DNA, 703 bp, Sorghum bicolor
  Predicted polypeptide sequence is orthologous to G860, G1760
aaggtcatactcattatccatttcgttaccatgttttggttttctattcacttcaatctaatatgcagtaatgtcaaacaggaccatattttgaaaagtgaaattgaagagttacacaggaaggttaagtcctaaaagcaattgtcgttttttcttggttcaatggaagttagtgacatcttaatttatactgacattgaaacagggtagcctaattcaccaggaaaacatggaactcggtagaacagtagatgtcatgtcacagcaaaaagttgaactacacaggaagctccaggccagtgaaccaagaggtgttgctgatgcaagctctagcactccctacagctttagtattacaacacaatatgcagatgtccctgctaatcttgaacagaggcaatcacaacaaaaagagggggatcgacgcaaggaactgatggctcctgaactgggacttcaactgcactaagaagatgcagtacaagttcgaaaataccatggtgtgtttcaacaatttcatacagtgcagagcactctggttgcaatgagtatttgtgaaatatactagctgagtgagcaaaatggcttgtgtaaataatgtcacatgaggctcctccatattgaagatacactgggtttcactttggcatttgcatcatgtatatgtacttggtttccactaatgactgaactttgcaataag

SEQ ID NO: 2813 - DNA, 708 bp, Sorghum bicolor
  Predicted polypeptide sequence is orthologous to G904
tctgcgcaaagcaagaaccaagaaaccagagaggcgagacgaccaagaaacgagagaggcgagacgagagaccaagaagctcttctcctccgcgctcgccgatgggagcggtgagcagttcgctgctccggcgcggagcaggggcggcggtccgagctccgccgatctctctcgcttcacggccagaggccgcagccccgccggcgccagtcctctccggggccgcgcatctggtctttgaggcctcgctcgcctgtccgtggaactgggatcccaaagctcccggcgccctctccgacgggaacttcgttctgaacctggatggggcggcggtgatgcgtaggcggctccagttcggcctcttcgtcgccatgaacgagctcgcggacggggagggggccgcggtgcggaggctacagatctgcacgagggcagagatagcggactggatcccctttgtaagacaggtgggcatactccgtgaaccccaagcttctgatgacggagattgtctcttttgtctcgaacctctcacgaaggatcgactgcgcagtctaccatgtggccacacgtttcatacgtcgtgcctagagtaccatttcatcaagaacagacttatggagaacagaggttttcgggctgcatgtccggtttgccgcgatgcggtaattcagtcagatttctaggactgttattgggctatatgtc

SEQ ID NO: 2814 - DNA, 762 bp, Sorghum bicolor
  Predicted polypeptide sequence is orthologous to G904
agttcggcgcctgcaactcgcagtgtcacccgacaacctcctcttcttctgctccgtcacggcgtcggtggccgccgccttcgccctcgtctcgctgtgcaggcacctggcgcaccggcgaccacagcaggagccctccgcgtacgacggcggcctcgcggcaagctcaggaggccgaggctccgccgagtcgtcagaagaagaagatcagctcctgccgctgagcgccgccgccgcggcgctccccccgttcatgtacaaccggctggtgaggcacagcggcaagggcgcgagctggacggagacggagtgcgcggtctgcctcggcgtcatccaggtgggcgccatggtgaagctgctcccggcgtgcagccatgtctaccaccgcgactgcatcgacctgtggctgtcgctgtcgtcgcgctccacgtgcccgctctgccggtgcagggttggtgctgcctcggtggccggcgccggccaggagacgacgacgcaccggcagcttgctcaagctcaaccttcccctgcatagatagataaaatcctcacgcgccggcatgtagcagatgtttgtactactaggccagtttcaccgctcactcgtctgtaaagaccaagctgccgcttgtgctgtatatactatgcgagtttgcatacagtttcattagaaacgtgagcatatttacatctcagctattaggggttcgtgatttattaagttgagattacggaaaaaaaccttgtttgtactgttgaaaa

SEQ ID NO: 2815 - DNA, 447 bp, Sorghum bicolor
  Predicted polypeptide sequence is orthologous to G1020
gctcaccggatgcttaaggtggccccaccgccggtcaccgtggccgccgtcgcgcagagtgattcggactcctcgtctgtggttgatcacaccccttcgcctcccgcggtgacggcaaagaaggaggtgggcttcgagctggatctgaactggccgccgccggcagagaactaggcacaccggagtttttagctgacgaattagtagttacttttttttcctttttgccttcatcaggaatgttacttctggttgtttggtcctgtattcttgttctgtagactatgagattgggagccttgtaaatagttttttttttccgcgaagacggaaatgatctgagatctgttcgtctgtctggacggatcaagccggcgttggtacgggcttagaccatggagtattgattatattagtagtataattcctaagtttactgagaatata

SEQ ID NO: 2816 - DNA, 771 bp, Sorghum bicolor
  Predicted polypeptide sequence is orthologous to G1020
ccaaccaaaattccattcgcccacctcggaggccggcgagaaacgcaggcagaacccggcggcaggcaagcaaagcacgcgcgtccaccacagccacagagagcaaagacacaaggcagctcggtgtatggcacccaagaggagcatcagcgaggaggtcacggcggcggcggagctgccggtgccggagccggagcaggggaagccgaggctgcgcggggtgcggaagcggccgtggggccggtacgcggcggagatcagggacccggcgcggaaggcgcgggtgtggctgggcaccttcgacacgcccgagcaggccgcgcgcgcctacgacgccgccgcgcgcaggctccgcggcccgcgcgccaccaccaactacacctaccccgacgccgtcgtcccagcgggggcgccgtgcgccgccgctctggttccgagcgccagcgccagcgccagcgcccgggaagagtcttgttcgtcctcgttctccaccagggacgacgactaccacccgctggcagtgaccgtagcggtcgctgcgccgccggctccgtcgcagtcgcagtcgccgtcgtcgctcgacctaggccttgggctcttcccggcgatggtggccgcccagccgtacctgttcctgaacccgatgcagttggcgccggtgaagagggaggcggagcggagctgctactcggggtcgtcgtcgccgtcgccgtcggtgctgggactgggactcgacctcaacctgcctccgccggccgagatggtcatgta

SEQ ID NO: 2817 - DNA, 738 bp, Sorghum bicolor
  Predicted polypeptide sequence is orthologous to G1020
gccggcgcaggcagcttgcctgcggcgaaggccgtcaccggtggcggcggcagccggagcagcaacagcagcaccgtcgagtctttcagcagcggcagcgacgtgcaggcggcgcccatgcaggccatgccgctcccaccgtctctggagctcgacctgttccaccgcgcggcggctgcgggcacgggcacgggcggcgccgccgtacggttccctttcaacagctaccccgtgacgcacccgtactatttcttcgggcaggccgctgctgccgcggcggcagggtgccacatgctcaagctggcaccgacggtgaccgtggcggccgtggcgcagagcgactccgactcctcgtcggtcgtggatctgtcgccatcgccgccggccgccgtgtcgacgcagaaggccgccgccgcgttcgatcttgacctgaactgcccaccgccggcggagatggaggcctagccgccggagtttttagctgaaaaaatgactgcctgtagtttctttctttcgtcgccttttgcccgtagaggaaagcttagaagagaaccctcatgttcgacagagggcggaggacatttttgtaaatagtttttccgctggggacctagctttagctgatgataaaagcttgtattgtcacccaagacaggtcctgccggcgttgttatggaccggattattatattattattatgtattttgatagtcaagagaaacgcctcagaaaaatcc

SEQ ID NO: 2818 - DNA, 767 bp, Sorghum bicolor
  Predicted polypeptide sequence is orthologous to G1038
cttcgccttcgcccggtcgcccccccggctgcgagcgcgagggcgcggaggggctagcgcgctagcggcgccatggccctgaccgacgccaccgcgttcccctacggcctgcgcgtcctcgtcgtcgacgacgacccaacttggctcaagatcctcgagaagatgctccgcaagtgttcctacgaagtcaccacatgcggtttagcaagcgttgctctccaaattctccgagagaggggaaacaagtttgacattgtaatcagtgacgtcaacatgcctgacatggatggtttcaagcttctcgaactcattggacttgagatggatctacccgtcataatgatgtccatagacggagagacgagtagagtgatgaaaggtgtccagcatggtgcttgtgactatctcctcaagcctgttcggatgaaggaacttcgaaacatttggcaacatgtgtataggaagaaaatgcatgaggtgaaagagattgaaggtaatgacagctgtgatgatctccaaatatttagaaatggtgtggagggatttgacgagaggggcctatttatgagagctgactctgataccatgaggaagagaaaagacatggataaggaccatgcagatcaggactcaagtgatggagctactgttaagaaggctagagttgtctggtctgttgaccttcaccagaagtttgtaaatgctgtcaaccaaattggatttgacaaagttgggccgaagaaaatactggaccttatgagtgttcc

SEQ ID NO: 2819 - DNA, 830 bp, Sorghum bicolor
  Predicted polypeptide sequence is orthologous to G1075
tcccctccagaaaacaagcaccacacaaaccctaaagaaattcatcctctcctcgctctcgccgtctactattttcatcatcaccaccaccaccgtaccacttcttctactcgcgccgccgaattattaatattatcgctctcctcctaccctagaaagatggcaggcctggatttgggcacaagctcctaccttcaccagcagcaccagcaccaccaccaggtgcccctccacctccaccacgacgacggcgtcggcgcggggggcggcggctctgacgatggccaggactcgctgtcgccgggatcaggcggcggcggtgggggtacgcccagctccgccggaggcgccggaatcggcggcggggagatcgtcgctcgccgcccgcgcggccgcccgccgggctccaagaacaagcccaagccgcccgtgatcatcacccgggagagcgccaacgcgctgcgggcgcacatccttgaggtcgccgccggctgcgacgtcttcgaggcgctcaccgcgtacgcgcgccgcaggcagcgcggcgtctgcgtgctctcggcggctggcaccgtcgcaaacgtcacgctgcgccagccgcagtcgtcccagacgggaccgacctcgccggccgtcgcgacgctccacggcaggttcgagatactctccctcgctggctccttcctcccgcctccggccccgccgggggccaccagcctcgcggccttcctggctgggggccaggggcaggtcgtcggtggtagcgtggctggcgcgctcatcgccgcggggccggtcgtcgtcgtggccgcgtcgttcagcaacgtcgccta

SEQ ID NO: 2820 - DNA, 557 bp, Sorghum bicolor
  Predicted polypeptide sequence is orthologous to G1084
ttttttttttttttttttttaacagaggacatgtgaacggaccaatttgaaggattctcgtacaagaccccatttgtaagccagatcgactacagccaattaaggcatggcaactagcaaaatgctccatataacatgaaagtatgacatctatgccgtccccggattgcggacttctggtctaggtcatctccccattcattggcttcagcagcagtactcttgctggcaacaagaaacctttctacagttttagtgttgtttctcctcacgctcaaagctcagagattatgatacaagcatgactggtccttgagcactatacaaggctttggagaaatgggatgtgctgcttccaggttagaagatgaggaggctgtcaagatgtgctctgaatgtcaaagtgaagaaattcaaccaagcgcgggtaaacggcgggagtaactatgactctcttaaaagcctccctccgtcttccacttccactcctcgttcttgttcacacagcagcagcctcctggaaaagagagggaaaggccatctccctcactctcact

SEQ ID NO: 2821 - DNA, 621 bp, Sorghum bicolor
  Predicted polypeptide sequence is orthologous to G1108
ctactggatctaataaacgttgccgcaccgccgctggagactgtgaagcggaggaggaagaattcgagtccaagtcttggagctgcccccgcttgggtggagtggatctggccttctactctaggggaaagagcaaagcacattatcttgtaaaaattagcattttcctacatttatctcaaatcaaatcatctctgcttctgggaacagcaacctgtaatttcccatgcaacctcttggttgatggatgctcttcctgttgaatcagaaagagaaagtcaaacagatagtcaccctttactcatggagcatgtgattggcatcccaagggatgatgttgcttctacatcaacacctcgccgagacaacaatgatggcatggatcacttgcctcgtgattcagaaagttcttccggaacaactgctgcatataactccccgaatactcctatagcaagaagagatgataatcgccgtcgccgtcaacagagtctgaattctggcttctggatatcaattgaactagctgtaaatcttagccagattatagctgctatctgcgttctgtctgtgtcaaggaatgaacatcctcatgctccattgtttgagtgggtcattggt

SEQ ID NO: 2822 - DNA, 722 bp, Sorghum bicolor
  misc_feature (46)..(46): n is a, c, g, or t
  Predicted polypeptide sequence is orthologous to G1108
catgcttcaagctcagagcatcttgatgagggcggcatcctcggcncaggaactaagaaggaaagagttgtttcagctgaagatgctgtgtgctgcatctgtctaacaaagtatggagatgatgatgagctccgtgagcttccttgcacacatttctttcatgttcaatgcgtagataaatggctcaagataaacgcagtgtgcccactctgcaaaacagagattgggggtgtggttcgatctttcttcggtttgccatttggccgccgccgtgtcgataggatggctggaagaggtgtagcttgctcaagattcaatgtatagaacaatgttgcttttctgtgatatcctctcttacgcataaagagccatgctcatgttgttgcaatggtttgattgactgtcaagaaaagcactgtgtgattgacttcaagacaatgacacctagtgaggaacctgatgctcctaggcgcaagtttctgcagaaatgtgaaggacctaaggtgctggcgtgctgctatactctgatgtaacatttttccaaggatgtaaatgaggaacatgaagttcacttgccaggtatattgcaagcaacttcacaggtcttctagcatcggccttggtgttctttactgccagttctgtgattctctttatcacggcagtgcactgcaggcttggtaaaatgtgaaataaaaggcaattgcctatatttcgaaccc

SEQ ID NO: 2823 - DNA, 794 bp, Sorghum bicolor
  Predicted polypeptide sequence is orthologous to G1108
aaatgctgtgcttgctaatcctaggattattgcgctgtttgaccacttcaagatggccctggattgtttctttgccgtctggtttgttgttggaaacgtgtggatattcggtggccgttcttctgctgctgatgcaccaaacttgtacaggttgtgcattgtgttcctcactttcagttgcattgggtatgccatgccgttcatcctctgtgcaatgatatgctgttgtcttccctgcattatatctgttatgggttttagagaagatacaaacaatacaaggggtgctacctcagaatctatcaatgctttgcctacatataaattcaaaaccaagaaacgccgccatggttcaggaagtgaagctgaaggacaagaaggagggatagtggctgcagggactgacaaggagcgatcgctttctgctgaagacgctgtttgctgcatttgtcttgcaaagtatgcgcacaatgatgagctccgtgaacttccatgtgcacactgtttccacaaggattgtgttgataaatggcttaagataaatgcactttgccctctatgcaaatctgagatagcgggctcgtctggtacttctgatgctcgtcaattagatcagaacgccattcctgtgcaggagatcgaaatgcattaggttggtctgctctctcagcttttcacataagaatacatctgattgtggctccccgtcttcatgtataaagttggagattgatgtatggaatgtagtgacacatagttttttttaatcactgctatctggagaagttacagct

SEQ ID NO: 2824 - DNA, 842 bp, Sorghum bicolor
  Predicted polypeptide sequence is orthologous to G1108
gcgaggaaggcgactccttcctcgcggccgcccgcctcgaccccgaccccgaccccgatcgcttcgcctccgcgcgccgccgccgcgcgcgcagtgtccatcaacacggccgccctccgtgtgtggggcgcatctggtgctacctcgccgggctagggttggctttacccccgtctaccttttccgtctcgtctgacgcgcgcaggctccgtgcacgcggtcgtcggctctcgctccggttctgactgcgcgccgtcccccgcttgctccctcctgctacgggtgggccactgctgccgtcgcgtccaccgacgaattcccctacagagcaactatcttggagttggagatctatacctgaagattcatttgaaatctggaagcttctgttgttgggtacagagaaatatttcctgccttttgaggaagactgcagatcttctaaatgtgaaatttgcttcttttcttgtctactcctgaatgctgatgaactcagcctctcacgttacttagctcaaggtcgtactggtacggacactgaggatggagcaagcaacaggtgtaagtggtcctgagcacataattgatattccaagggaaattggtccttctgcttcggtttctcgtagtgttggtagagagaaccatgaagaattgaatcccgtggacaggccttcaacaagagctctagtacctgccttgcaggcaccatcagcaataggtgccgtacctaatgcagggcagacttcaggcactaggagaaatgataactatgttcgtcggcacagaagccctttgaattctggactgtggatttcaattgaagttatcgtcaatgtgag

SEQ ID NO: 2825 - DNA, 678 bp, Sorghum bicolor
  Predicted polypeptide sequence is orthologous to G1146
aaccacaatgatcagaattcaattgacaggagtggaaacatactcccaggtactgttgtagattcgaagatctgtcatcctactgaatttgacttctacttgtgtagccatgctggcattaagggcactagccgtccagctcattatcatgtcttgtgggatgaaaacaacttctctgctgacgagttgcagactcttacaaacaacctctgttacacttatgcaaggtgcacccgctctgtatcgatcgttccaccagcgtattatgctcacctggctgccttcagggctcgtttttacatggaaccagagacttctgacagtggatcggtggcaagtggtcctgcaggccgtggacctcagtcagcatcccatagcactcgggcccctggtggtgcagctgttaggccacttccagctctgaaggataacgtaaagagggtcatgttctactgctgaggctaggctggggcgcttatggtaccctcacttgtaaatatgtttggagatcgtaataatctggcagctgctactttgggtgctgtactgttaccatttactgtactggtctacgtttcttcctcgagcaccgcatgtatgcactcatgctattgtgtccacggatcatgtatgcacgctgtaacatagtaataccctcggttgtgtgtgtatgtacgt

SEQ ID NO: 2826 - DNA, 599 bp, Sorghum bicolor
  Predicted polypeptide sequence is orthologous to G1146
ctgcctggtactgtggtggactcaaagatctgccatccaactgaatttgatttctacctctgtagccatgctggcattcagggaacaagccgccctgcccattatcatgtcctgtgggatgagaacaaatttaccgcggatgggttgcaaactctcaccaacaacctgtgttacacgtatgctaggtgcactcgctcagtatcaatcgttcctcctgcatattatgctcacctggcagccttccgagctcgcttctacatggagccggataccactgacagtgggtctatggcgagtggtgctacgacaagccgtgccccaggaggggcacgcaacaccagggctggtgttggaaatgttgccgtgaggccattaccggccctcaaggaaaacgtgaagcgtgtcatgttctattgctaagattgacgctgtgagcaagcaattatcgggctttacctaagacttttgagtatttttccaagtacctgcactgttttggtgatggtggcacactgttatgcaccactgaagttaataatcagaagctgtgaattggagctaccttttatatatctggtattgtaaactggtttgcggta

SEQ ID NO: 2827 - DNA, 619 bp, Sorghum bicolor
  Predicted polypeptide sequence is orthologous to G1146
ccaagatttgccatcctacggaatttgatttctacctgtgtagccatgccggcattcagggaacaagccgccctgctcattaccatgtcctgtgggatgagaacaagtttacagctgatgagctgcagactctgacaaacaacctgtgctacacgtacgctaggtgcactcgctccgtgtcaattgtgcccccggcatactatgctcatctggcagccttccgagctcgcttctacatggagccagatacctctgacagtgggtcaatggccagtggggcccgtgggcctccaccaggtggggcacgcggcatcagaggggccgggagtgttgcggtcaggcccctacccgctctcaaggaaaacgtgaagcgtgtcatgttttactgctgagctgcattcaccaaggaatcctggagtattccatgtatccgcactgtttcggtgatactatcggacactgaatttatgcattaagacttccagttcattcaagtgatctggggattttatgtacgcttgttttgtattcgtgatgttgtgacgctgcagttcgaggagctttagtactgtgatgtgtgaactatttgttgacaagttgtaaccagccatacttagtg

SEQ ID NO: 2828 - DNA, 767 bp, Sorghum bicolor
  Predicted polypeptide sequence is orthologous to G1146
aatggactcaacctgcctgcgcccatctgaccgtgagaacaacattcgtcaggttgttgagcaaaatgactacaatagaactgaacgtgcaagtgaattcggtctggaggttgactatcatcctacttcagttaatgctagagttctgccagcccccactctgaagtaccgtggcactggatctgaaagtttgtgttgtccaaaggatgggcagtggaacatgattaaaaagcaagtagtacatggtgcaagggtgggcaactgggcctgcgttaacttttgtcataatttacctagagatgttgttggtaaattctgttctgatctggttaagtggtctcgtactactggagtggacatggataacttgagaattccaatatacgctgttcgtcctgaacaagttgaaactgatcttcataagctatgtcacgatgctgggaacaggctaagagtgcaaaagatagatcttttgcttgctatactgccagagaaaaacggcaacttatatggtaatttcaaaaggatctgcgagacagagattggtatcatgtcgcagtgttgcctggataaaaatgttagaagtgcaggtcctccatactttgctaatgttgctattaagatcaatgccaagtttggaggaaggaacttagaatttgctaatcccaaagaaagcttaccggttgtttcgattgaaccaacaattatatttggtgccgatgtcactcaccctgctgctctggatgatactgccccttccattgctt

SEQ ID NO: 2829 - DNA, 665 bp, Sorghum bicolor
  Predicted polypeptide sequence is orthologous to G1146
agagtttgacttcttcctgtgcagccatgctggcatcaagggcacgagccgtcctgctcactaccatgtcttgtgggatgaaaacaacttcacagctgatgcattgcagacccttaccaataacctttgctacacttacgcgaggtgcacacgttctgtatccattgtcccaccagcatactacgctcatctagcagcattccgcgcccggttctacatggagccggacagctcagacagtggatcactggcgagtggctctcgcggaggagcgccgtccagctcttctacatcccgcagtacccgtgccgccaccagtggagccgttaggccccttcctgtgctcaaggacagtgtcaagaacgtcatgttctactgctgatgaaccggagcctgtgtctacaagcagcatgactcttaacaacatgagcaggcagcctgcctgaaatttgatttgcttggtgttgtagtttgtttggtcagtaataatctgcttgctatgagcaaaccgtgttcaaagacgttgtgtttcagtgcatttgcttagtgtttgtttgaagaagtccggccagagcggatccgctctaggccctgcttgtactggagggatcccatatgttattttgagactattagtttcggatcatatcttttcctctaggttc

SEQ ID NO: 2830 - DNA, 652 bp, Sorghum bicolor
  Predicted polypeptide sequence is orthologous to G1198
acatgctgcagatggccaccgcggtggacaggctcaaagagctcgtcggcttcgtcacccaggcggaccatctccggctgacgacgctgcagcagatgcacaagatcctgacgacgcggcaggcggccaggggcctcctggcgctgggcgactacttccagcgcctccgcacgctgagctcgctgtgggcggcgcgcccgcgggaggcggcgattagctagatgcctgcggtggccgccagccaaaagctcactggtgaggtgaccgcaccaaagaacacgacgacgacgacgaagagtagtagcagttcgctgtatactttcccaagtggagaacgaagaaatcgacctcgctgggtttggatgaagaatgcaaggcttctcactcaatcagcggcggtggccgcgtttctcagcaacagcaagtcagcaagtggtgtgcgtttgtcaggcgattagagaataaacggaaatcgattgaggtctttttatttggcgggcggaaagacgtgtacatatcttgttttggtacccggccggggcctcctagaggcgtatgattgatgatgatgctggccttttataactactagagttgagggtatatatatacttatcatatatgtaattacctgtaactagtgttggtcaaa

SEQ ID NO: 2831 - DNA, 635 bp, Sorghum bicolor
  Predicted polypeptide sequence is orthologous to G1198
ctactggtgacgtcctccgctatccttagttgaaggaagaacttcacccagacatgcggtgaggtgattagtaataagtattgatttaagggagatcattttgagcatgttatgatggagctctactctggatatcttgaagatcatttcaacctccacaagctaagcatcggcagcgccgcctcgccgccggagtacatgacgtcggcgtcgccggcgcagttcgcagcggtgcccctaagaatggggtacgggcggccggcgccgtcgactgcgccgccggcgccagtaatggcgggcatgtggagcagcgaggccttcaaggtcgtcgacagcggccacggcaccagcgcgtccaccgtcatggaggccgacaccaagttcgagacaaggctagaagatgttcaggtagcacttgagccaacaagaagtacggatcaggaaacaagcaagccgccagagagggtcatgagaaggctcgcgcagaacagagaggctgctcggaagagtcgcctgcggaaaaaggcctacatccaccagctagagacaagccggatgaagctggcccagttagagctggagcttcaacgggctcgacagcagggtgcatatgcaaatgggaacatgggagactc

SEQ ID NO: 2832 - DNA, 630 bp, Sorghum bicolor
  Predicted polypeptide sequence is orthologous to G1198
tcatgggtcaaatggcccttgcccttggcaagctgtccaaccttgaaggttttgtgatacaggctgataacttgaggcagcagactcttcatcagatgcaccggattctgacagttcggcaggcagctcgatgtttcttggccattggcgagtaccacaaccgcctccgtgccttaagctccctctgggtttctcggcctcgagagatactgggtgcagatgaaggcaattgtggggagataagcattgcggcacaagcatctcaaagccaattttcatccttctgattcacgcatgatttggaactaaccttcgtcttaggagcaagagagaaacgactgggaagttgaaagagaagttttggatgccatcagatgtctgagaggcacagagagctggaaaatgaatgaagctttagaacagggagtgtttctgaaaatgtgcggaacctgtaggagcaatttccaggacgtgaaattgtttagttcactggactcgtgtccagtactgcacgttcttttggttctgtccagtctagattctcaaacagctctgcctttggttctgtccagtcagaattctcaaaacagctctgcctaggtaacgaaagaattcattctgcaactctac

SEQ ID NO: 2833 - DNA, 776 bp, Sorghum bicolor
  Predicted polypeptide sequence is orthologous to G1198
atgccgagcctttgggccacctcagcacgccatccacacagatgtgaacagcatgcaaccttctcgagttaccgactttggggcacttgcgcagtcagctggattccgaatagaagatcttgctaacctcaatgcaaatgctttgttcaatctgaagccaaatacccatacaattaacaacagtcctcttcagtttggaagttacggaaaagccgtttacgaaagaaggcatacatccaaaaccttgagagtagcagactgaaacttactcagttagagcaagagcttcagcgggctcgtcaacagggtatttttatttcgacatcaggagatcaacctcaatcaacaagtggaaatggagctttggcatttgacatggagtatgcacgctggttggaggagcacaacaaacatgtaaatgagttgagggctgctgtcaatgcacatgccggtgataatgatcttcgtggtattgttgatagcattatggcacactacgacgaaattttcaggctcaagggtgtggcagctaaagcagatgtttttcatgtgctgtctgggatgtggaagacccctgctgagagatgtttcatgtggttaggtggcttccgatcatctgagcttcttaagttactggcaggtcacctagagcctcttactgatcagcagcttgttggtatacccaacctgcaacagtcctcccagcaagctgaagatgctctttctcaagggatggaagcgttacaacagtcgcttgcagaaactctagcatctgg

SEQ ID NO: 2834 - DNA, 825 bp, Sorghum bicolor
  Predicted polypeptide sequence is orthologous to G1198
tacccgtcttcgctgatttctgccgctccaattccatctctttcctgcttagaacttcttcctctgcttctccccttcatagcttttggtgccttgtcatcggcgacctaaccgccggcggccggataaactaagctagccccttggctccaaaagtcgtctcccgtagagagcacttgctcacctgctcctcacgcccctctgctggaactggacttgcgcggtgtggagatccatccggacctggttcgatttcttcatttcgggaaggtgtcgccaccatgattctcagttaaccacagctaaatgccttttcttaatctttccgggtcgggaacatgcagttaaatctgaccagtagctgttgttggtaaaggttgcttctgtgtccagcgggtggatcactggactgtgggttgtgttaactgcaggctggcttatcagcctacccataaggaaagcgaaaaagagacagcaaagcaatttgttgtctcattcttaggagctggcgagtactcggcatggcagatgctagttcgaggactgacacctcgactgttgtagacatggatgataagaatcaaaggttagagaatggacagggtggagctatggtcctgccttctaattcatctgatcgatctgacagatctgacaaacctatggaccaaaaggttttgcgacggcttgctcaaaatcgtgaggcagcacgaaaaagtcggctgagaaaaaaggcatatgtgcaacagctagagagcagtaagctaaaacttgcaagcctggagcaagaactccagaaagctcgacaacagggaatcttcatat

SEQ ID NO: 2835 - DNA, 833 bp, Sorghum bicolor
  Predicted polypeptide sequence is orthologous to G1198
ccacccgcaccgcaagccaggcacgcggcttctggaagcttccctctcatctggttggttggtcacccacgacccaaatcgcccgcccgcggctcctccgccgccagccaggcaggtgtcgtctctgccctcggtacgaccgccggattcgggcgctggggtgggttgtttttggtctcccccaccggccacacacccacaccagcctcggccccgccgtctctccaagaccttggtcgactcctccgcccgggcatgcccccccaccgccgatcgcacacggtcgtatgattgcaatgaatcctgagatcgtactaccgtcttggaaacaattttcggcatcggtcaatcctgtgaaacactagaccgctcatcaccttgcaactggaaaggagagagcaaagtgatttgctgtctcctggtgatcgatgctcttgaggcctagtgatggctgatgctagctcaaggactgacacatcaatcgttttagacgacatcgacaagaatcagaggatggagaatggaagtggtgcggttctaccttctaattcttcagataggtccgacaggtctgacaaacctctggaccaaaagacaatgcgacggcttgcccaaaatcgtgaggcagcaagaagaagtcggctgaggaaaaaggcatatgtgcagcagctggagagcagtaagctgaaacttgcacaactggagcaggaactccagaaagctcgccagcagggaatcttcatttccagctctggagaccaaacccatgccatgagtggaaatggagcattgacttttgacatagaatatgctagatggctagaggaccaaaa

SEQ ID NO: 2836 - DNA, 849 bp, Sorghum bicolor
  Predicted polypeptide sequence is orthologous to G1198
aagacggttttgccattaatgactggttttggatccttttgctggagatgtgcatagtgtgaggagagagccagggtggaggatggtcagagccttcataaggccttcaggtggggctctgctggagacgacgaccgccgccgccaccatcacagggcatctgagctcccccaaggtctccggagcgcctctagctccccaccgacgacgatgatggcagcctcttccaccatgagcaaggaatcagcaagctacgacatggcggaattcgaccagtcagcaatctttctctaccttgaggatggccacgatcaagaacaacaacgacagactctgaacatctttccatcgcagccaatgcatgtggccgagccaattcctgctaagggtgttagcatgggcatggtgacagccagcatgcttcccaatggcaactcttcttcacccaagagacaagagcaaggtggccagcacaggagtgtcgctgctcctgcaggccccgttgtgccgttgcctagtaacaacttagccaaggataacaggaatagccttactaagaaggaagaaactagcggtggaaagggtgcagcatctgcaggtattgttcaggagagagtgaaagaccctaagacactgaggaggcttgcacagaatagagaggcagcaaggaagagcaggcttaggaagaaggcttatatccaacagttagagacaagtaggatcagactcagccagctggaacaacaagttcaagtggcaagagtacagggtgtcttcttgggcactggtgagcagccaggtttttcttctgccccttcaccagctgcagtatttgacgtggagtatgga

SEQ ID NO: 2837 - DNA, 834 bp, Sorghum bicolor
  Predicted polypeptide sequence is orthologous to G1198
caggcaagccaaagcagtgtgtgagaggagaggagagctgagaagagaaacaaacagacaaacaaacaaagaggaggcctcttcccccctctcctctgtgcttgttgcatgcttttgctacaaggatgagctagctagcagtggccatggtgcacggcgaggagagttcttggaggatggagagggcagcgctgcctctcaaccaggcgttcgcgtatggagcccaagcccacgccgccgccgcaccgccgacctgcttcctggacttccagcctgcggcggcagccgctgcctacttcgggttcggggagctggaggaggccctcatccatggcggcggcggcgctggcaacgcccacggcgtcgatcccggcgtgatcatcaagaacgacgtcgcgcaggcaaagtcggcggcagcggcaggatatctcgcgggcgctggcaggccccccacgctggagatcttcccttcgtggccaatgaggcatcaacagcagctacacagtgggaattcgcagtcagtagggagcaccactgactcgagctcagctcagaacacaatgtctcagatggagttggtgtccccagcctcctctgcgccgaggcaggaggtcatgatggtgaccactgatgattacagctacaagccaggcctcgccgctgcgcccgctgctgctgccgccccgccaccgagctttcagcagcaccacccgctcccgctgcagctgcacggaggagacggaggaggaggagggggagaccatgacaagaggaagcatggatccacaagaaaagatggcaagttggtagatgccaagacggaacggcggctgg

SEQ ID NO: 2838 - DNA, 819 bp, Sorghum bicolor
  Predicted polypeptide sequence is orthologous to G1275
cgatccccggagccgctacactataaatacaaagcttccccggcggtggtctagccggccatggcggcagtcggagcgcgcccagtgctgtaccaccacccggcgccggcgggcgacgccgcctccatgtcctcctacttctcccagggaggcagctccaccacctccagctccgcgtccgccagcttctccgccgcgctcgcgccgacgacgaccacgctcgccgagcagttcggcatctccgagttcctcttcgacgacgcgggagtcgccggcgcgccaggcgtgttcgccgatggctcggcccccgtcgtcgtgtcggatgccgccgccgctgctggtggtggtgcaatcagcgcagccgctgggagcgcggctgcggcggcggaggccgtgccggagcggccgcggacggagcggatcgcgttccagacgaggtcggagatcgagatcctggacgacggctacaagtggaggaagtacggcaagaagtccgtcaagaacagtcccaacccaaggaactactaccggtgctcgacggaagggtgcaacgtgaagaagcgggtggagcgggacagggacgaccccagctacgtggtgacgacatacgaggggacgctcaaccacgtcagccccagcacggtgtactacgccagccaggacgccgcctccggccgcttcttcgtcgccggcacgcagccgccgggctccctcaactaatcccgatggcccaccagcgtcgcgacgttccgctccggtccaccgcacagtgtttcgattcccagatggcagctagctgagctagctacactactacta

SEQ ID NO: 2839 - DNA, 791 bp, Sorghum bicolor
  Predicted polypeptide sequence is orthologous to G1275
agatcagcaggcacattaactgatacacaagcaaggcggctagctacagctagctggtgcgtgcagtgcatgcaaatggcggcttccctgggactgaaccctgaagctctcttcgcttcatactcgtctgcctactcctcctcctcgccgttcgtgtccgactacgcggcgagctccccggcggccgtcgactccgccacggccttctccgcggagctcgatgaccttcaccacttcgactactcaccggcgccgatcttcacagctgtcggagccggggctggcggcgatcgcaacgagaagatgatgatgtggtgtgagggcggtggtgatgaaaagagactcagaagcagtggaaggatcgggttcagaacgagatcagaggtggagatcttggacgatggattcaaatggaggaagtatgggaagaaggctgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagtcccggagccgccgccatcacccagtacggcggcggcggcggtaatagcggcttctacagcccgccgcacagtggctcgccgtcggctgcctcatactcgggctccttcgtcttctgacttttccgggccttgaccttgacccagagtgatttacctttaccccagtcgtaggatgagaagagtgttcagagagatcagttcagcggccggctaaattc

SEQ ID NO: 2840 - DNA, 777 bp, Sorghum bicolor
  Predicted polypeptide sequence is orthologous to G1290
aaaaccgagttgctttagcgaggatattgttccccatggaggcaagggtagcaatggacattgctcaagttgatggaaccttggaatttacccttggttctaatgctaatctgcctaccgagattcagcggacagttgacctgaacgatactcctttcataatgaaggaagagcacttggctcggatgagagccctagccaaaacagttgaactcgggaaacgtttcttcccacggtgttcaaaagtgctcgacaagatcatggatgacgaaaccgagctggcttccctcggacgagacacatccacagagaagaagaggaggttccatgacctgcaagacttggttcacaaggcattcagcgaggacaaggaggagaatgacaggtcggcggcccggtcgtcttcctcgtcgtcgacgacgtcgatcggaatcggagccgtccggcctcggagatgaaaggaggcatgggttctgtttctgcctcgccattttggtagttgatgatccccctggtcctaacagttttagcatcgcctgatattctcccaatccgttggccacatagagatcgtaatcatgctcacttgtgcttgtattgtatagtattagtgcagaacctatactcctactaactatatactaggtgtaaatcggtactggagattgtaatggtagtagtcacagtgtggcgtagtcaaattcccgcgtgtgtgtccagcagctagctgctcgggattgtaaaggcgttttagcaattaacgaagatcctcagcca

SEQ ID NO: 2841 - DNA, 695 bp, Sorghum bicolor
  misc_feature (682)..(682): n is a, c, g, or t
  Predicted polypeptide sequence is orthologous to G1361
aggctttcgatcgatctccctctctctctctatattccactctactcgtcaggccttaaacgaggagagactagatagagagggcgagatcgatcgtcttcgtcatcgtcgacggccatgacatggtgcaacagcttcaacgacgtgcgtgccgtggagaacaacctggccaccgccgcggccgtggccgccgccaagaaacagcagcaggcctcctcccacgtcaacctcatcaggacctgcccctcctgcggccaccgcgcgcagtatgaacaggtgcaggcggcggcgacgatccaggacctgccgggtctgccggccggcgtgaagttcgatccgacggaccaggagctgctggagcacctggaagggaaggcgaggccggacgcccggaagctgcacccgctcatcgacgagttcatccccaccatcgagggcgagaacggcatctgctacacgcatccggagaggcttcctggtgtcggcaaggacggcctcatccggcacttcttccaccgcccgtccaaggcttacacgaccgggacgcggaagcggcggaaggtccacaccgacgagcagggcggcgagacgcggtggcacaagacgggcaagacccgtcccgtgttcaccaacggcaaactcaagggctacaagaagatcctggtgctctacaccaactacnggaagcagcggaa

SEQ ID NO: 2842 - DNA, 538 bp, Sorghum bicolor
  misc_feature (484)..(484): n is a, c, g, or t
  misc_feature (494)..(494): n is a, c, g, or t
  Predicted polypeptide sequence is orthologous to G1537
gcacgagggttcctatggatctgccataacttgcccactgatggttaagggccatcctggaggaagaaagactcataacctgctttctgctgctgaccacattcagtcaggagacagcagtgttctatcaagatcaaaaggttgcatagctgtgccagagaatattaaggatgaatatttcttgtcaggctcggatgaaactggtgtccaccgccatgcgcatcctggtctacaagtggcaccaagtagggctctcagaaggttgaacacaagcacatcagatggaatgtcatcatcctcgtatatcactggaagggacgacattctgcgtggcagctgtgagtttggatcttcagactgggagcatgtgctgaaggaagaaatcggctcaacctaagggctcaagggatctggctggaagtatatactagtagtgtacatgtacgggcaaccacgaacctaggaattcgaggcctcttgattntgcttgacanggctgatgaatgggcactgcttgatatggtgccgctctagccta

SEQ ID NO: 2843 - DNA, 764 bp, Sorghum bicolor
  Predicted polypeptide sequence is orthologous to G1594
gcgccgcctcgctctccgatgaaatggtagggtcctctgaggacgaaccatgctcaggagacacagaggcgactgacctgggtcaggagcacagctcacggttggctgaccgtgagctcaaggagatgctgctgaagaagtacagtggttgtttgagccggctgcggtctgagttcctgaagaagaggaagaaagggaagctaccgaaggatgctcggtcggcgctgatggactggtggaacacgcattaccgctggccataccctactgaagaggataaggtgaggctggcagcgatgactgggttggacccgaagcagatcaacaactggttcatcaaccagcggaagcggcactggaagccatcggaggacatgcggttcgcgctaatggagggtgtcacgggcggcggatcatcctccgggacgacgctctacttcgacactggcacgatcgggccgtgatcacactctgacgacatcagttgcagcatacaatttactgggcatgtagtgtttgcattgcagttcaactgcattgcgctgcactgcactgccaatgggggtaattgttggttgatgatatggagattagtcacatgaacgaaccaataaccgctgtcattttgtcgggattttattgtgtatatgggcgacaacgtgttcggtacactgcacacagtatgtagtactacaagggaagttgctgtccagtccagatggccctgtaaagactctgtctgaaagtaccataacaattacttt

SEQ ID NO: 2844 - DNA, 641 bp, Sorghum bicolor
  Predicted polypeptide sequence is orthologous to G1798
gatatacagcaagtcaaagcagatgctgtaagcttggcaaatagactcgaagcccttgaaaagaccaaacgaaagttcttgggtgaaaatttagaagaatgctccattgaagaactgcacaatttggaggttaaactggcgaagagtcttcacgtcatcagaggaaagaagacacaactgctggagcagcagataaccaagctgaaggagaaggagaggaacctgctcaaagacaacaaagaattgcgcgataagcgcaacctccagcctccaccggaggcgccaccagtcctgaaccgctgtctccctccttggccgcgtaacctgccggcgccaccgagcaacgacgacatggacgtggagacggagctgtacataggattacccggcagggagcgctcctccaacagggactctggttgagccacggattttcagctcggctaaaaggaataaaaactctctgaaagcatcatcaaagggcacatgccaatggttttacttgcaccttgtatacaaagttgtgctggaaatgtaaaaaagtatgtagtatgtggatgaaagaaacggctgggtagctagctgcaaacctgcaagcctttctggggcctgaaaatgaaaatccatacacggatacaccc

SEQ ID NO: 2845 - DNA, 563 bp, Sorghum bicolor
  Predicted polypeptide sequence is orthologous to G1798
gttgctcggtggcgccggcaggttacgcggccaaggagggagacagcggttcaggactggtggcgcctccggtggaggctggaggttgcgctgctgcagcgataagaacagcaggttcctctcctggaagtggtagaagtaagaaacaacagaggtcaggaattggttactagagtttcaggatactctgggcccatgcattatgttaccttctccttcagcttggttatctgctgctccagcagttgtgtctgtcaaaacaaaagtaggatgcatatcaacttgggcgaacagtatctttgttatcgtctatgtagtaatttcagaggctagggtttatgtgggaggtctggcatgaactaaccttctttcctctgatgacgtgaagactcttcgccagtttaacctccaaattgtgcagttcttcaatggagcattcttctaaattttcacccaagaactttctgcaactcgtgtaaagacaatgaatggctggccttttagctccgaggaagaatgccattaatctttagtaaaatacatgattgctcaccgtttggtct

SEQ ID NO: 2846 - DNA, 697 bp, Sorghum bicolor
  Predicted polypeptide sequence is orthologous to G1911
ctagcttagcttccttcctctcgagcaagctccagaaaagctacggaatggcgtcgatgcagtcgatgacgagcgcagcggcgcgcgcgcagtggacgccgaagcagaacaagctgttcgagcaggcgctggccgtttacgacaaggacacgccggaccggtggcacaacatcgcccgcgccgtcggcggcggcaagtccgccgaggacgtcaggcgctactacgacctgctggaggaggacgtcggccacatcgagtccggcaaggtgcccttcccggcctaccgctgcgccaccggctacggggccgcctgacatgcaggctgaaacatctgaagatctccggagatgatgaacataataggacgaacgatcgatgatccagaagatacaaacatgtgtgtatataggattaatgggacagcatgcatgcaatggtccaagctgcaactgcaagtagtgatgtgaaagcaaaaatcagattggatgcatgcatatgcatgtgttaattaataataataaattttagtatggggtgagtactagacagtcacgcgagatcgaccgacccatctatctcccatgcatgcatgcatgcaagcttgtgttctctctccctacttgtcaacttgtgtgtgtatattatgtactattattgtaattatatatatgctactataatcgcatctgtgtagcat

SEQ ID NO: 2847 - DNA, 749 bp, Sorghum bicolor
  Predicted polypeptide sequence is orthologous to G1930
actactcatttcagactcagcaaccacctgcatcatctttctatcgatatcatcttgtcccagccctagcatagcaagcctagaacagtaaagtctcatcaataattccatactgtttctagctagcggcgaatactatccatcacaggccgcagagctgcagcaggcagtagagtacccaagcaaaaaagcaagaaaccaaaggcagcaagactccagggagcagcgcgagctgtagctctagctcatctcatcatgggtatcgagagcatgagccccacggcggcgccggcggaggattcctcctcctcctcctcgcgcttctccgccgcgtccacagccaccacggagtccggcgccgcgcagccacgggctgcttctgcagcaccgggcggcggcgcggtcgttgtcggccgggacgcctctctggcggacgagcaggccgtgacgtcgcagccgttggcggcgtcgacggcagcggccgtgacgcagggatcttcgcggttcaagggggtcgtgccgcagcccaacgggcggtggggcgcgcagatctacgagcgccacgcgcgggtgtggctcggcacgttcgccgacgaggaagccgcggcgcgcgcctacgacgtggccgcgctccgctaccgcggccgcgaggccgcccccaacttcccgggcgccggggcgtcggcgcccgagctcaccttcctggcggcgcactcaaaggcggagatcgtcgacatgctacggaagca

SEQ ID NO: 2848 - DNA, 758 bp, Sorghum bicolor
  Predicted polypeptide sequence is orthologous to G1930
gcgagagcaagggcgtgctcctcaacctggaggacgccgcgggcaaggtgtggcggttccgctactcctactggaacagcagccagagctacgtgctcaccaagggctggagccgcttcgtcaaggagaagggcctccaggccggcgacgtcgtcggcttctaccgctcgtccgcggtcggcgccggcgccgacaccaagctcttcatcgactgcaagctgcgtcccaacagcgtcgccaccgcctcgacgacgacaggccccgccgtggggtcatcgcctccggctccggctccggcgccggtggcgacgaaggccgtgcgtctcttcggcgtcgacctgctgacggcgccggccgccaccgccgcggcgccagcggaggccatggccgccgggtgcaagagagcccgggacttggcctcgcccccgcaggcggcgttcaagaagcagctcgtggagctggcactagtgtagacggactaatgcgacggacggagcgatcgatctttctctttccctagtttagcagctagtcgttttctttttgcccgatcgctcaactcagatggtagcatcaccgttcaccgagctgaatttagtcccttctcggcaagcatctcacttagttcgttcgtttgtttatttcccatttcttcttgcattgcttcgatgtaaatcttctcctcaactgtatacttactgctaatggaggaaaaagaaaaacagccctagaaggctagatgatgatcatctgatctg

SEQ ID NO: 2849 - DNA, 788 bp, Sorghum bicolor
  Predicted polypeptide sequence is orthologous to G1935
gaccatggcaataccggttggttcatttgcggactggcgcccagactgtgaggtcgaagttaaagatgtcactgtggatgccagcgacccacatcactctgacctgctgtctaagctgaccagcagcaataccttgcaggaacttgcataccccaccataagcatggatgacgatgttgtctacttgctttctaggactacacctaggaacatgaggaaactagagttggtggttgctattgatttgaggaagaagatcgtgcaaggagtagccgagcttgatgtccagaaagacttcatttttatgccgtcctattgtaccagtgagatttgcagacttttgaggaagagtacatgcgcaaaagaagaacttaaacaaactgagaacaaagctattaaagcaactgaaaaagaagagggtgaaccaactgagatgcacgtgaaaggaccatccagcaggaagaagtatgtgaagcgtcctgtcaacctgtttgatgcgtgatgcttcagcaggaagaagtaaagtgtgtatggtgtcctgtcaacctgttagatgcggaccggtgatgcttcatgcagatactaggattggggagcttggtgaatcgatttatgagaattatgccaaaaataattatctgtattgtactgcaggcctggctactcgatttctgtactagaacttgcgtaggctcatgtcactagagctgaagcattctatctatcgtttggaaccttgtcagatggtgataatctgggcaggaatctgcatttggttttattgcttg

SEQ ID NO: 2850 - DNA, 619 bp, Sorghum bicolor
  Predicted polypeptide sequence is orthologous to G2141
gcacgagggctggtgaagacaattccagctccaaaattcctgacacggaaggccagaaaagataacgcacaaaacagggaaggcaacctgatgacctctggcagaaatgttcactttggtccatctgtgccatctgaatccatacatgcagctacgagagggaccggtagtgatcaggctgtctcaagacatcagccagaactgaagcgaactactacaaccataactggaaagggccatcaaactacaggatctctgggagaagagctgctgataccactagacaacagcaatgtgaacattcatcatctaattctagtccaacaccccatacaaatcgatctgtgtttgacacacttgaatcgtcatcaaggggctcccagaaaacagtgaatcaagaaacaagctctgacaataacaagatgagaccagaaaggaatagcacccaggaagaaggtatatctcattcagcagcagcagcagcagaaccaccaaggaataacaacttcctattgcataataagacagagataccagaacatagtcctgggtctgcttctcctatgcactgccatgatgatatggacatcagttcagacttgcatactatggagaagtc

SEQ ID NO: 2851 - DNA, 881 bp, Sorghum bicolor
  Predicted polypeptide sequence is orthologous to G2141
aagagagaagattagccagaggatgaagtttctacaggacctagtgccaggatgcaacaaggtggttggcaaggcactcatgctcgatgagatcataaactacgtgcaatcgctgcagcagcaagttgagttcctgtccatgaagcttgccactgtgaacccgcaacttaatttcagcaacctgtcgactctcctacacaaagatatgtaccaaccatgtggcccatcagctaattcggtctttccattggaaggtgccggtgcagcttttccattttgtgaccaaggggatcttttccagaactttggttcgggtgctatggaggatcagtgctctctaagtctgttagacacggctctaccccacacggccaacccacagtttgcttttcaaaagcagcaaagggacttctgggaggatggcctacagaatgctttgcctaccggtagtgagcaaagacaggaggatgggcttttagtaccgaactttgatggtcagttacaagctgatcaggcaatgattgagttctagtccctggtgatctccaaggttgatatttttgtatataggcggtacgaagaagacctgtggcgagcaaagctctcctaagctgaccatcattagagtttaggcctccaaactgattcattctgtgatatgctggatgtttggcaactcgattcttcccatagagaccttgtgatcgatctcgcaaaattgaagtagattgtgtactagatatggtgcaaatattacatgcaccatcttctaaagttctactaatatgtaagagcgctggctggtattgggacgatgccgtgttactgtttgttgcatttttatcttatgatgacgaaagtacaagtatgagattttctcc

SEQ ID NO: 2852 - DNA, 781 bp, Sorghum bicolor
  Predicted polypeptide sequence is orthologous to G2226
cgctggcggggctggtgcgcaaggcgctggtgttcctggacctccaggacgacgacgccggggaccgcctcgtggcgtcagcgcccggcctgggcctggcggaccggttcctgagggcgttccggccggcgctgtacggggtgctggtgtcgacgtcgacgacgtgcagcgcggcggaggcggacggcgacgactgcagcgtgtgcctgtccggtttcgtggccaaggccgtggtgaaccgcctcccctgcggccacctcttccaccgcgcctgcctcgagacctggctccggtacgagcgcgccacgtgcccgctctgccgcgccaacgtgcccctcccgcccgaagagacgcccgtgctccgctacccggagctcgagtgatccggtccccctcctccggcgagcggtgacccccccccgggcggggctcggggtcgggctcggccgtcgcgcgcctcggctgtgtgctgcaagctccgtgtggccttccgtgtgtgtgcgcgtagcaaaaaacaaagtataggagcagtagtagtagagttgctgttgctttccccccctttccctttcccttctcgttttgtgttttttttttccttgtttttcttcttttccccatttctcttcttgttgtttccgtgctgtcgctgtagcgtgtaaatactgcagttcgcacttcgcagcagagagtagagtgctcccgtggctgtgctcatggtgtagcactttttacgagctcagctcgtgtacattgcaatgcatgcttcaattcaactccc

SEQ ID NO: 2853 - DNA, 829 bp, Sorghum bicolor
  Predicted polypeptide sequence is orthologous to G2574
gaggtacggccaggaaagccattgcgtgccttgccgaaagctgagcggagctagctagctgctgctcgatcgagaagggaggggtaggccggccgttgcggctagctagctagcttggttggttggttaagttgccatggaggtcgccgtcgaaaggccgccgccggcgccgcaggtgaaggcggaggagaagagacccgacgccaagccagagatcgccgcccggccaccgatggtaggaagcgctcttccgatagtcttcgaaagctttccatcgacgcaaagagacgcggccggcggcatcaacgtcaagcaggaggaacgcaggctggaggcggccagggcggagatgggcgaggtgagggaggagaacgagcgcctcaagtcgatgctgtcccgcatcgtcagccagtaccagtccctgcagatgcactttttttacctcgtcaaggtgcaggagcaagcatcgtctgcagccaaggtggccgagaagaagctccccgtcgcgccggcgccggcgccgaatcccggcaccgacgacgacggccccgacgacctcgtctccctgagcctcggcaccagggcaaatagcggtggcgcaccccgccgcaaggggcacgagaggtcgtcgtcctcgtccggcaccgctgagacaaccaccgccgccgacgctgatgaccaaggccaccaccagctctccctcggtcttggtttcgcgcgcggaaacgggctgccgtcgtccaccacgacggccacggacgacgacaggcgagccacgcgtccacggcgcccgtcctgaaactgacctccgacagcagcggcagtgccg

SEQ ID NO: 2854 - DNA, 570 bp, Sorghum bicolor
  Predicted polypeptide sequence is orthologous to G2741
ccttttttttttttttttttttttattttgaaaagcagactcactatgaacaaagtactttgcaacgagacctctgaacaccacaggatcaaatacagaattctctcttccagacgtgttcttccaagatgctaagaacctatccctatcctcttgagagatataatgacaataaaatccaatatgcctattcaaatgcgttgttccttgccctggcacagaagataactgaaacttgcaatacttgcagacagccttctcaactccatcaatgaattctgtgtcaagataaccccaaactttagctctctttttccctgacctgcctgactgatctgttgacatagcatcctcatcctctgctgctgttgctgatgaagctctttccataataccacttcttttcccgaagacgtaagaccaaaattctcgagtctagaaaaagatccttctttttccttttgcttagaccacaattcacctgcagtagcaacaaaattatatcagcttcgttgtatttatgcacagataaacacatgtatataagttgtgagtgacactgtaaaactt

SEQ ID NO: 2855 - DNA, 680 bp, Sorghum bicolor
  Predicted polypeptide sequence is orthologous to G2741
cctcatcctcgtaacccgccacacggacatggaagacgacgacgacgccggcgccggcgccggcgcgtgcggccgcgtgctcgagtgggagcacggcctgcccacggaggaggagctgacgccgctctcgcacccgctcgtccctccggcgctcgccgccgcgttccggatcgacgtcaggggcaccggccccgccttgccctcctcccccgccttcgactgccccaggcgtctatcgcgcgcaaggcccccacctctcacctgtcctgccgcggcgaggaccaggacgacgactaggactatgagggggagggggaaaggcactataatcgctccggctggaggtgtcagagagctgttgggtcctgaagtgggagccgtactccggcgggaaggccggaggaggctgctgcggctttccggggctgcgcgtgcgcttgaggtagatgcggtacttctggaggtggctggcgacgttctcgcgggtgaggccctcgacgttcatgaggcgcacgatggccttgggtacggcacccttgtcgccgaggtgcgccaccgcctcgacgaaccggtggtgcagctccggcgtccacaccatccgcgccttcttcccggccctcccgcctccgcacgagccgccgattccggaggtggcgtcctccccctcctcctccctctcc

SEQ ID NO: 2856 - DNA, 721 bp, Sorghum bicolor
  Predicted polypeptide sequence is orthologous to G2741
gcaggcctcttccttcctcctccccacgggcacaaatatctccgtccctgtcccctatctctcctcacccgccgccggcggtcgaatcgacggaggcgggtggctggattgctcgattcggatgggcgaggaggccatggacgactacgagctccacatggtgtgctacggcggcgacgacgacggccgcgtgatggagtgggagtcggggctcccgggcgccgacgagctgacccctctgtcgcagccgctggttcccccgggtctggcggcggcgttccgcatcccgccggagcccgggcggacgctgctggacgtgcaccgcgcgtcggcggccacggtgtcgcggctgcggcgcgcgccgtcgtcgtcgtcgtcgggcagcggagggagcggctcctcctccttcgcgcccttccatccccatccgcaggcggcggcggcggcgggacacgcgaggggggacgaggatgcggactcgtcggcggcggccttgggcggcggcaacgcggcgacgacgaccaccaacacaggcaccaacagcaagcgtccccggctggtgtggacgccgcagctgcacaagcggttcgtggacgtggtggcgcacctggggatcaagaacgcggtgcccaagaccatcatgcagctgatgaacgtggaagggctgacgagggagaacgtggccagccacctgcagaagtaccggctgtacgtgaagcgg

SEQ ID NO: 2857 - DNA, 600 bp, Sorghum bicolor
  Predicted polypeptide sequence is orthologous to G2741
atgggcgaggaggccatggacgactacgagctccacatggtgtgctacggcggcgacgacgacggccgcgtgatggagtgggagtcggggctcccgggcgccgacgagctgacccctctgtcgcagccgctggttcccccgggtctggcggcggcgttccgcatcccgccggagcccgggcggacgctgctggacgtgcaccgcgcgtcggcggccacggtgtcgcggctgcggcgcgcgccgtcgtcgtcgtcgtcgggcagcggagggagcggctcctcctccttcgcgcccttccatccccatccgcaggcggcggcggcggcgggacacgcgaggggggacgaggatgcggactcgtcggcggcggccttgggcggcggcaacgcggcgacgacgaccaccaacacaggcaccaacagcaagcgtccccggctggtgtggacgccgcagctgcacaagcggttcgtggacgtggtggcgcacctggggatcaagaacgcggtgcccaagaccatcatgcagctgatgaacgtggaagggctgacgagggagaacgtggccagccacctgcagaagtaccggctgtacgtgaagcgg

SEQ ID NO: 2858 - DNA, 801 bp, Sorghum bicolor
  Predicted polypeptide sequence is orthologous to G2990
tagtcctcctaacactacctgcactccagtttctcactagagcctgcagcctgctagctaagccaccgagcatattgagtccagttgctacacactactgcaccctctgctagctgcgtcggcgatgtgtctgccgttctcctgcggcggcggcgacaaaggcgacgattggtcacatgactctagcagcgtccaccaccattttcggcagccgccacaaccacaacctcctccgccaccaagggaagacgaaaagcaaacttattataagcctccccctgagaaagaagcatatggccaccatgggaccaacatgcctgccggcggcggcgatggcatgaataatggaggagctcgtgcggcggaagtgaacaagaacggaggagggcacacgacggacttcggctactcagatggcaacgtccatgcttctgtcggcgttttccgaggtcgagagagtcagagcgctgccgggaagaagatcgtggcgtccaccgctccagcggtgcaagccttcaataacaagcatagggatatggccgcagctcaacaagctcctcagggtatgtatgtcgtctctgctagtcctcgccaccccaccatggccatgggtcgtcggcagcatcgatatcgcatcccagcgaggccgctgatagcatgaaggcaccacttcaagtactaccgatgggtcgtcgtggtcctgaagactactagctatatataccctactgctgctgcagtcaccacacagacgccgtgttccccaacaatttcgttcgttctacggtaatcgtgagtgtt

SEQ ID NO: 2859 - DNA, 720 bp, Saccharum officinarum
  Predicted polypeptide sequence is orthologous to G2
gcatccttgcacccctgcacgtaccgcggacttaacgggccgcgagcgcacccactgccgtccgcttggataagcgcaggcgtagctgaaagaaccccggggggacactacgcgtgtgtggatggtggcaagctcagatgggtcactttcttggaaagaagtacatctaccttgttctgtatgacagtgtaatcgaactaccaagagcgtatgacaggccatccattcgtttcaatggaccggatgctgatactaacttcgactctagttcctatgatggagatgtcccacttccacctgcaattgagaaagatgtggttgatggggacatccttgatctgaatttgaggatttcacaacctaatgtgcatgatctcaaaagtgatggtaccctgactggttttggattaggttgtaattctcctaaagcttcaagctccattgtttctcagccaataagccctcagtggcctgtgcatcctcacagcacactgatgcaaccccagcatcaacatctgtatgcatctccttgtccaggcttctttgtgaacctcagggaggcgcctatggaggagaaacgggcagagccggcgggtccccatccccaaccggcgttcccggcttggacatggcaaatgcagggctcccctgccccgtttctccctgctactggagcatcattaggattttttaccgccaccgtcacccgtgtggaccccg

SEQ ID NO: 2860 - DNA, 705 bp, Saccharum officinarum
  Predicted polypeptide sequence is orthologous to G8
gtgcagggtgacgcctctgtacttggagctgcccctcgagaagccggtgctctgccgccgcaggacgtgcacgaactcctccttggataggctcttcatctgcttcatgtcgtcctcgtagtcgctgagattgaaatttatgtcggcgtcgacgccgcggaacttgatcgccgctcgatcgtacgcccttgcagcagcatgagcagtgtcgaatccacctaagtacacctgctttccgcaatcccagatgtgggactcccagcggccggtgcggcggtaaaaggtgacgccgcggtactgcgagctgcgggagcgctggccgcggcgagtcttcttgaccgggtgcagcttcacagggggcgggggcgccggcggcgtgccttgcgtgtggccgaagtcgtcgcggaagaagccgagctcgcccccatgcagcggaactggtgagagagggtagggaggggtcccgaaaaaggttctgaccccggtggataagaatgtagagagaggtggttggagtcgcgtgagggttgtctcccctctctccacccccccccccacgcggtggggtgagggtcggggggagggaggaaaaacaaaagagagccatgggtccccccccgcccccccctcgtatgtttcggatgtagaattcctgtaggggaggaggaagaaatagaaaaagtatttatgataagtgggagtgtt

SEQ ID NO: 2861 - DNA, 835 bp, Saccharum officinarum
  Predicted polypeptide sequence is orthologous to G214, G680
ccgcttcagagaaagacagagattgcccagttgaaaatgcacagaaggaatgccaagaagctctaaaacagggacagtttgaaggtttaagagttgccgcttcttcagtgtctgatgggagtggaaaaggcgaggtgtctctccacacagagttaaagatatctcctgtccagaatgctgatgccacacctaccacaggagctgatacaagtgatgcattcaggaataagaaaaagcaggatcgctcttcatgcggttctaacacaccttcaagtagtgatgtagatgcggacaatgttcctgagaaggaagacaatgctaatgagaaggtgaagcaagcctcctgcagcaacaactcttcagctggtgacactaaccaccgcagatttagaagcagtggaagcacaagtgattcatggaaggaagtttccgaagagggtcgtctggctttcgatgcgctgttcagtagagaaaagcttccgcaaagcttgtctcccccacaagcagaagactcaaaggaggttgccaaggaggaggaagatgaagtgaccacagtggcagttgacctcaacaagaacgccacaagcattgatcatgacctcgacacaatggatgagccaaggggcttccttccccaatgagctgtccgcactgaagcttgaatcgcgccgaacagggcttcagccatacaagagatgttctgtggaaccgaaggagataaggtgccggctaaccacgaggttggttacaaaaggattcgtcttgaaagcgaggcatccacataatccatctctacatggtcaccggtcgggctgcctctaccaatgaagttatg

SEQ ID NO: 2862 - DNA, 410 bp, Saccharum officinarum
  Predicted polypeptide sequence is orthologous to G280
cacgaggctgcccccgcacgcacggcagcggcgacccatcgtcgatgtggccgtggaacatctgacgcggttcacggagaccgtcgtgatcaccgcgttcgcgcatgacgtttgcattttcttcaaggttgtcgagatgatacagaagtaagatggcatgcaaggacggaagcgcgcgcgcgcgcgtgcgccgggcagcgggcactgtagtttcagatattacattcagccgtgcccgagaaatgaagttgactatagctaggtcgattactaggttatattatattatatgttttcacaaattaaattgcatgatggccgcagctcagagtttcagttgattcatttcatccctttgtgtgtgtaatattgtacataattttgattaaataaacattgtacagaattta

SEQ ID NO: 2863 - DNA, 880 bp, Saccharum officinarum
  misc_feature (803)..(803): n is a, c, g, or t
  Predicted polypeptide sequence is orthologous to G1108
agccccgaccccgatcgcctcacctctgcacgccgcggcgcgcgcgcagtgtccactggcacggccgccttccgtctgtgggggcgcatctggtgctagctcgccgggctagggttggctttaccctcgtctaccttttccgtctcgtctgtgggggcgcatctggtgcacgcggtcgtcgtctctcgctccggctgtgactgcgcgccagccccgcttgcttcgtcctgccacgggagggccactgctgccgtcgcgtccaccggctaattctcctacagagcaactatcttggagtttgagatctatacctgaagattcatttgaaatctggaagcttcttttgttgggtacagagaaatatttcccgctttttgaggaagactgcagagcttctaaatgtgaaacttgcttcttttcttgtctactcctgaatgctgatgaactcagcctgtcacgttacttagctcaaggtcatactggtacgaacgctgatgatggagcaagcaacaggtgtaagtggtcctgagcacataattgatattccaagggcaattggtccttctgcttcggtttctcaaagtgttggtagagagaaccatgaagaattgaatcctgtggacaggccttcaacaagagctctagtacctgccttgcaggcaccatcagcaataggtgccgtaactaatgcagggcagacttcaggcactcggagaaatgacaactatgttcgtcggcacagaagccctttgaattctggactgtggatttcaattgaagttatcgtcaatgtgagccagatngtagctgccattgttgtccttggtctggtcaagaattggaacaccacaagctccattacttgagtgggtccatagtt

SEQ ID NO: 2864 - DNA, 682 bp, Saccharum officinarum
  misc_feature (621)..(621): n is a, c, g, or t
  Predicted polypeptide sequence is orthologous to G1146
aaatgatcgccaatggacagacaggagtggaaatattctacctggcactgtagttgataagaatatctgccacccaacagaatttgatttcttcctgtgcagccatgctggtatcaagggaacaagccgtcctacgcattaccatgtgctgcgagatgacaataagttcactgcagatgctctgcagtctctcacatataacttatgctacttgtattcaagctgcactcgctctgtgtcaatcgctcctcctgcatactacgcccacaagctagcattccgtgcccgcttctacatcaaccaaggctatgatacggcgacaagtgtgggctcttttggttcatctgctcctgctgctgctggtccgaagccacttccggagatcaagggtgaactgaaaaggctcatgttctactgctagtccgtgaccactgaaaacctcctgaacaaggctttgctactgaagtctcaagtcccttgactgctctgaaggagacttggataataacgtctgcacttggatgcattattctgttcgctgttccttaaatggataataacgtctgcacttggatgcgtttttctgttcgctgttccttaaagtactgctataattgcagngactgcttggttgtagtttgtggtttgaattttattttataaacaaatgaactttttgctt

SEQ ID NO: 2865 - DNA, 542 bp, Saccharum officinarum
  Predicted polypeptide sequence is orthologous to G1146
gttctaaactctcaccaagttgcagacatctccctaagttgatagagttagatgatacaactagacaataactacataggaaaaatataaaaatacaatggatattactttgccacatgaaaataactccaaacaaaataccattgattcaaagattgcttggaagtaggcaatttacatagcataatgtcaagtacataaagagcctcttgaggagcgtctagttgcctcccagctagaaacatagccaaatggttactgtgagcatgcagagaagggtgtttctagatcttgttaacaccatatacacttgtcaccatttgtacttcaaagtttttctgaaccatatcacataattttaaatacaccactactaaatggagtttaaaaaattgactattatctctaaaggcagcaacacaccatagaaccagtggaattctagacatgttaatcttgttgaggggattggataattttcaagatgttctccccctccaaaaattaaatttatcagaaattaaaataaggttattacaacc

SEQ ID NO: 2866 - DNA, 847 bp, Saccharum officinarum
  misc_feature (3)..(3): n is a, c, g, or t
  misc_feature (9)..(9): n is a, c, g, or t
  Predicted polypeptide sequence is orthologous to G1146
acnaccggncttgaattaccggcccgagccacgcgtccgtgaagcaggagtggaacaacttctatcggaatgtgcaagatcgtgccgctaggggtcttggtcatgagctggcagtcatgtgccaaatatcacgaatggattttgctcttgagtctgtgctgcctccagtgactgcaaggcctgaacatgttgaaagagcgttaaaggcacgttatcaagatgcaatgaacatactgaggccacagggcagggaactcgatctgctgattgtaatactgccagacaataatggttctctttatggggatctcaaaaggatctgtgagactgatcttggattggtctcccagtgttgtctgactaaacatgtttttaagatgagcaagcagtatcttgcaaatgttgcactcaaaataaatgttaaggttgggggaaggaatactgtacttgtagatgctttgacaaggagaatcccccttgtcagtgacagaccgaccataatatttggtgctgatgttacccatccacatcctggagaagattccagtccttccattgcagctgatgatgcttcgcaagactgggctgaggtcaccaaatatgctggactagtgagtgcccaagcccatcgccaggaacttatacaagatcttttcaaagtatggcaggacccgcataaaaagacagtaactggtggcatgaaaaaggaacttttcatttctttaataaggcaacttgacagaagccccaaggatcttattctacaagattggtgtaaataagggacagttttaacactttttgtgaaagaaattgaggcgcctccaaagggctgtgtccaccttga

SEQ ID NO: 2867 - DNA, 972 bp, Saccharum officinarum
  Predicted polypeptide sequence is orthologous to G1146
ggaaaattaacttcggcggtgcattacggtgtgccagcatcaccaaaacagtgcaggtacttggaaaaatattcaggtcttaggtaaagcatgagcgcagcgtcaatcttagcagtagaacatgacgcgcttcacattttccttgagggcaggtaatggcctcacagcaacattcccaacaccagccctggtgttgcgtgcctctggtggagggccacggcttggcgtagcaccgctcgccatagacccactgtcagtggtatccggctccatgtagaagcgagctcggaaggctgccaggtgagcatagtacgcaggaggtacgattgatactgagcgagtgcacctagcatacgtgtaacacaggttgttggtgagagtttgcaacccatcagccgtaaatttgttttcatcccacagaacatgataatgggcagggcggcttgttccctgaatgccagcatggctacagaggtagaaatcaaattcagttggatggcagatctttgagtccactacagtaccaggcagtatgtttccacttttatcaacagcacgtgggtcattgtgattattagcaaacaacctagtgtgatgacgcttctggaccacaacaaaagtaactggaggctggtaatcccgacttcaatgatgcacaagcccttctaaatggcattaagttcatacaacaaaacttgggaaaactgtccctcactgacaccatccctggagaatatgaccccttttggttctgtccaagtggccgccaaaaagaaaggaaaagtccctgaccatgccaccaaaaacagaccctttggggaacttgattaccttgaaagaacctggttaattttggggatgggcttggacctccataaaccggcatactgggaaccctaaggccaccctggaaagcaacaaccgctgcaagggaaggactttaaactttcccaggaggggggaggggtccat

SEQ ID NO: 2868 - DNA, 621 bp, Saccharum officinarum
  Predicted polypeptide sequence is orthologous to G1146
agagccatcagtctccactgtgactccgtgagctgcctgccctgcacactccccgcaccgccgcaccagctcagcaatcatggctcgcctactcctcctcgccgccgccgcagcggcgttcctggccgcgtcggctgcatcgccggtggccagcgacttcatccgcaagtcgtgccgcgcgacgcagtacccatcagtgtgcgagcagagcctggcgtcgtacgggggctccccgccgccgcggagcccgcgggagctggcgcgcgcggcgctgtacaccagcgcggacctcactacatccattgctgcctgctgttgcttctcaagactgaccagacgttacgaaggatgcttgatagatttggactcaggcacaccggcaagagctgattcaagacctttacaacacataccatgatcctcagagaagcgctgtaacaagcggcatgagcatggaactctgaattgccttaaggagtgcttctgggcagaagccggtgagaataatgttctccgacgacagtaggacttgagaccagttggaccgaattgctccctttgcaaggagcaaacgcatgcccaacatcatgtacgttcgcgtggaaccgagttagccagccg

SEQ ID NO: 2869 - DNA, 979 bp, Saccharum officinarum
  misc_feature (440)..(440): n is a, c, g, or t
  misc_feature (498)..(498): n is a, c, g, or t
  misc_feature (510)..(510): n is a, c, g, or t
  misc_feature (520)..(520): n is a, c, g, or t
  misc_feature (556)..(556): n is a, c, g, or t
  misc_feature (561)..(561): n is a, c, g, or t
  misc_feature (613)..(613): n is a, c, g, or t
  Predicted polypeptide sequence is orthologous to G1198
ccaataacccatgatggtctacaatatgaactgagcgttcacttgaacacatacatgtcatcccttcataagatcttagattcaaatatctcactaacacatgagcaatgtgaagaaactaatggacatactagagacagtacaaaaaattatcctatttatgaattaattgaatttattcccttggacgggcaagccaaagagaactcaaagcacgcagccgagagaagtagtcgcttattgcaagtagagctcgtgctgattgtcgggtggttaagatgcgttgcatttgctgaagtgtttgcagccgtaaattatcagcctgtcgtagaaagttctcaagggtgccaagttttcccatagccatcgccatttgtcccatgtaatttgcaacattgccagaaggtccagcagggcccagggatccagatgctagagtntctgcaagcgactgttgtagtgcttccatcccttgagaaagagcatcttcagcttgtngggaggactgtngcaggtgggnatatacaacaagctgctgatcagtaagaggctctangtganctgccagcaacttaagaagctcagatgatcggaagccacctaaccacatganacatctctcagcaggggtcttccacatcccagacagcacatgaaaaacatctgctttagctggcacacccttgagcctgaaaattcgtcgtagtgtgccatatgctatcaacaataccacgaggatcattatcgccggcatgtgcattgactgcagccctcaaccatttacatgttggtgtgctcctccaaacagcgtgatattcatggtcaattgccaaacttcatttccactgggtgatggagcttgacttctgatgtccaaataaaattaacttgttgacagacccgctgaactctggctccacctgagtaatttcaaccggcaacccccaggtttggagggtgcccccaaccttaaaaggta

SEQ ID NO: 2870 - DNA, 742 bp, Saccharum officinarum
  misc_feature (545)..(545): n is a, c, g, or t
  misc_feature (599)..(599): n is a, c, g, or t
  misc_feature (615)..(615): n is a, c, g, or t
  Predicted polypeptide sequence is orthologous to G1198
gcacgagagtgaatgctcatgcaagtgacagtgatctacgacttattgtagatggcataatggcacattatgatgaaatattcaaggtcaaaggtgttgctgcaaaggctgatgtatttcatatactttcaggcatgtggaagacacctgctgaaaggtgcttcctgtggcttgggggttttcgtccatctgagcttttaaagctcctagcgaatcacctcgagcccctaactgagcagcaaatgctgggtttgaacaacctccagcaatcttcccagcaagcagaggatgcgttgtcacagggcatggaagcactgcagcaatctttggcagagactttagctggatctcttggtccatcaggttcttcaggaaatgtggcgaactacatgggtcagatggccatggccatgggcaaacttgggacactcgagaattttcttcgccaagccgacaacctgcgacagcagacattgcatcaaatgcaacgcattctaacgatccgacaggcttctcgtgctcttcttgccatccatgactacttnttcgcggtgcgtgctttaagttctctgtggcttgctaggccgcgcgaataactntggatcatcgctgttntgagttccctgtgcctgcctgttggaattctatggcacgctggatgcctggatcgcagcgacaccatgaagatcattcatggtcctgtgttttgtgtacaattacttttggctgctgcttggcgaaa

SEQ ID NO: 2871 - DNA, 676 bp, Saccharum officinarum
  Predicted polypeptide sequence is orthologous to G1198
acaaaataagcagataaatgagctgaggactgcagtaaatgctcatgcaagtgatagtgacctccgtcttatcgtcgatgggataatggcacattatgatgagatattcaggcagaagggcattgctgcaaaggctgatgtgttccatatactttcaggcatgtggaaaacacctgctgaaaggtgcttcttgtggcttgggggtttccgttcgtctgagcttctaaagctccttgtgaatcagcttgagcctctaactgagcaacaattgatggggctatccaatctccagcaatcctcccaacaggctgaggatgcattgtcacaaggaatggaagcattgcagcaatcattggcagaaacgctggctgggtcccttggtccatcaggatcttctggaaacgtggcaaactatatgggtcaaatggctatggccatgggaaaacttggcacactcgagaatttccttcgtcaggctgacaatctacgacaacagaccttgcatcagatgcaacgtatcctgacaatccgacaagccgttcgtgcgcttcttgcaatccatgactacttttcacgtttgcgcgccctgagttctctttggcttgctaggccacgagagtaacatcacccacgttggggtcactccatgaactgatgatctgtgaatgtgggactg

SEQ ID NO: 2872 - DNA, 582 bp, Saccharum officinarum
  misc_feature (580)..(580): n is a, c, g, or t
  Predicted polypeptide sequence is orthologous to G1594
gaagagcagaagtaattttatctttataagcccttcagcctatctaaaaattaaattgggtagcgagtattacaaatccatgagccaatacgtgaaactactaattaaatgcttttgcaggtctcctcaattcgcccatacatacagtttgttttgatacgatggcaccatatacacatgtgatcttgtaaaataatggggcaactgactaatgtgatcaacctcagctcgacagatttattgtcaattttgaccgggcagatcgtcacttcacatgccaggtcttactactgattgagttggccaattgtcatcccaagtggtgtgtgattcagggtccaattgtgcctgtatcgaagtagagtgtcgtcccagaagatccaccggcaacaccctccatgagcgcgaaccgcatgtcctccgatggcttccaatgcctcttcctctgattgatgaaccaattgttgatctgctttgggtcgagaccggtcatcgctgcaagcctcaccttatcttcctccgtaggataaggccagcggtagtgcgtgttccaccactctagtaatacttgccgtgcatnct

SEQ ID NO: 2873 - DNA, 725 bp, Saccharum officinarum
  Predicted polypeptide sequence is orthologous to G2574
agctggtggtggtggccgtggatgaacgaggccgaggcggcggaggtggtggagcccgaggtgagcatggccaccgccgcggaggtcgtggacgccatggccgtcgccgccggcgggagcgggtggttgtgcgcgccctcgtacgtggtgatcaggatcgacgtgtcctccgcgcaccgctgcacctgcttcctcaccgggcagtgcggcgccaccgtgcagcggtagtaggcgcgcgggcacgggttccccttggagatcttctgaccgtacttccgccattggcagccatcgggcatcgtgggagtgtcgcatttgaccctgacggaaaccctagccttcttgggctgctgctgcacctcgtcgtcagctccgtccccgacaccggtgctcgggctcttacgggcggtgcccgcggcggcctgcatagcaggcctggcgttgtcgtcgtcggcgctgccgctgctgtcagagctcaggttgaggacaggcgcggcggacgcgtggctcgccttatcgtcgtccatgggcgccgtggacgccgacagcccgctcccgcgcgcgaagccgagcccgagggagagctggtggtggccttcgtcatcggcggcaggggtggtcatctcatcagcggtgccggacgaggacgacaacctctcgtgccccttgcggcgggagggggcgccaccgccaccgcttttggcccctcgtgccgaggctcaggg

SEQ ID NO: 2874 - DNA, 725 bp, Saccharum officinarum
  Predicted polypeptide sequence is orthologous to G3061
tatcttcccctagctagctaggtagacacatacacatatcagtagtggtgtatatatacaacaagtgcaagatcaggcgaagctgctagccgcccttggaggcttggacttcacctagtatgttccaccatcagcaggagctcctacaggcagaagctgcagcggcagatcgggagagcagcatgtccaacctcacctcctccgcgtccggcggcctcaacgcgccgcctgctgctgccccgccgccgccggcctcagctggcaacaacaagcgcaagcggaacctcccagggaaccccgaccccgaggcggaggtcgtggctctttctccggcgacgctgatggcgacgaaccgtttcgtgtgcgagatctgcgggaaggggttccagcgggaccagaacctgcagctgcaccggcgcggccacaacctcccctggaagctgaaacagcgcggcacgggcaaggaggcgcagcggaaaaaggtgttcgtgtgcccggaatcctcgtgcgttgcacacgacccgggccgcgcgctgggggacctcacggggatcaagaagcacttctcccccaagcacggggagaaaaagtggaattgcacaaattgctccaaaaagtacgcccccccccccgaaggggaagggccactccaagatctgcggcacccggaaattacactgcgactggggcaaaatcctttcgagcgggaaagtttcacacgcacc

SEQ ID NO: 2875 - DNA, 881 bp, Solanum tuberosum
  Predicted polypeptide sequence is orthologous to G2
aaaagtattcctagtaaaatatttggcttctctatgattgctccacctaataataataataacgacgataacttatcgtcggagagtgaaccgccggttacccggcagttttttccggttgatgagtcggaaatcggaagtggcaattttaatgatagatcttgtagatttccaagggcccattgggctggtgtaaaattctaccaaccggagccatcgacagcagtattgggaaagggtagtgagttgtcgcaggtgcaggtgcaggtgcagccaatgaaaaaaaagccggcgtggtccaaggtctagaagctcacagtaccgtggtgttactttttatcggagaactggccgctgggaatcacatatatgggattgtggaaagcaagtttatttaggtggatttgatacagcacatgctgctgctcgtgcgtatgatagggcagcaataaagtttcgtggagtggaggcggacataaactttaacctggaagattatgaggaagatttaaaacagatgaagaatctaacgaaggaagaatttgttcatgtactgcggaggcaaagtactggttttccgaggggaagttctaagtatagaggggtgacattgcacaaatgtggtagatgggaagctagaatgggccaattattgggcaaaaagtacgtttatttgggactctttgatactgaaaatgaagctgccagggcttatgataaagctgccatcaactgtaatggcaaggatgcagtcactaacttcgatccttgcatttatgaaaatgaacttaattcatctgaatctagtaataaagcagcagatcacagccttgatttaagcttaggtagctcgagctcaaagcaaaagagccgagaaatgg

SEQ ID NO: 2876 - DNA, 893 bp, Solanum tuberosum
  Predicted polypeptide sequence is orthologous to G2
gaaacaagtttatttaggtggatttgatacagcacatgcagcagcgcgtgcatatgatagggcagcaatcaagttccggggagcggaggcggacataaactttaccttggaggattacgaaggtgacttaaaacagatgagcaatttaaccaaggaagaatttgtgcatgtactaaggagacaaagtactggttttccaagaggaagttccaagtatagaggagtcactttgcataaatgtggtagatgggaagctagaatgggacaattcttaggcaaaaagtatgtttatttaggcctatttgatactgaagttgaagctgccagatcttatgataaagctgctatcaagtgtaatggaaaagatgcagttaccaactttgatcctagcatttatgaaaatgaagttaactcaaccgaatgtagtgataatgcagcggaccacaatcttgacttaagcttaggaggttcaagccaagaaatgggggacaataggggtcaaaattcttcatctaatttgcaattggatgtccattggggccaccaagggtcatcaaggcttaataagccacgtagccaaatcaattttgatggccaaaaaagaagtggatataatgagactgaaacattgcaactcttgagccaaacgcaccttaattcgtcaggcagagtgcaaccaaatattaatgaaatgcaaaagtttggcgaatttattagagatggtgaaacacatatggttcaagcctatccccggcaattcaattcatatcaagttcagacttcgagcaacaataatgtaggccaaattggggcaacaagtaattctcaagaatggcaccctaattatgagataattacaactgctgcagcatcatcaggattcccccagcaga

SEQ ID NO: 2877 - DNA, 707 bp, Solanum tuberosum
  Predicted polypeptide sequence is orthologous to G12
caaaagttctttcatataatatactatctaattttctccttccccatcttctttcttccttctgaaacaagtgagtatatttttttgaaactatgatggaaggagaaaagagaaagcagagggaacaccaacaagataagccatacagaggaatacggatgaggaagtggggtaaatgggtagctgaaattcgagaaccaaacaaacgctctcgaatttggcttggttcttattcttcccctgttgctgctgctcgtgcttacgataccgctgtattttacttgcgaggtccttcagctaggcttaatttccctgaattcatagttgatgaccatgaaaatcacgatctatcagctgcttctattaggaagaaagctactgaggtaggtgctagagttgatgctcttcaaactgcgattcataattctactgctattcctcatgaatccaattctaaatccacaaggatgatgatgaagcctgatttgaatgaatatcctaccccagaaagttgcgacgaagataattgaatctctgcttcaaattaaagccataagcggcgagttacagaggcgaaaaggggattattgttatgacgattacatatattgaggatccatgtatgaaatataatccgaagggattatatgttaatattatcaattatggtagttattaaaagaaattaatctccaaattacgattag

SEQ ID NO: 2878 - DNA, 854 bp, Solanum tuberosum
  Predicted polypeptide sequence is orthologous to G12
tatgacaactggcttttccattattgaattccctctaaatttcccttagctcacataatacgccatctcccatcattagaacagccaaatttgattccaaaaacaaagaggaaatccaagagagataaaaaagaagaagaggatatttacacctacatctctagctatatagcctataggtgaaaatttgtgaggattttggggagcttttaacatggcggatggccaaccaccaccatatcttatgaggtccgagcagctaagcttttgttgaataaacaaaagggccaattgaaaaaattatactatccagcaggttactggtattactattattattattgattgtgtcggtgctttcaacatattttcttttcatttttcattttttttgaggagtcttttattatagagttaataatttaaaaaaatgcttttaagaaaatcaacgtagagtagccacaaccgctaccacaataaccttttcttcattcactaccagcttttgccttttcatgggtattctttctctctctgttattcctcccagtttattagctctagattacagggaaacaaaaattttgtaatttagtccctgtaatttcgcataattattatacagtaagagaaagatggagataggtggtgggggtcaaagtggagttgctgcaagttcaggggtttgttgtggtgggaagagaaagaacgaaaggccgtacaaagggattcgtatgaggaagtggggaaaatgggttgcagaaattagagaacccaacaagcgttcgaggatctggttgggttcgtattcaacgccggtggcggcggcgcgggcttatgatacggcggtgtat

SEQ ID NO: 2879 - DNA, 624 bp, Solanum tuberosum
  Predicted polypeptide sequence is orthologous to G15
tgcttgtcaaaggctgactatatactgggtgggactgaaaaacttttccaaaagctgttttcttccttatgatcacataataaagagaaagaaaagttctttatcatcaatttgtatggttcactaaaactgtcaattttgatgttcataggcacacaagaagaagcagcagaggcttatgatgttgctgcaatcaaattcaggggtgtaaatgctgtgacaaactttgacatatcgcgatatgacgttgaaaagatcatggctagtaatactctgcctgctggtgaattagctaggagaactaaagaacgagagccaattgaatacaacaacaacaacaatgacataggaggtgttggtggtcacaagaatgaggaatgtgttgacaacaacaacaatgggaatatcacagattggaacaatggtgttatatcaaacatctaatccttcagtaggattgaattatcgcaaccctacatcattctccatggcattacaagatttgattggcattgattcgatgactaattcaaataaccatcatgccacaattcttgatcatgaacagaacaagattggtaaccactttttcaaatgcgtccatctttggtaactagtcttggt

SEQ ID NO: 2880 - DNA, 769 bp, Solanum tuberosum
  misc_feature (709)..(709): n is a, c, g, or t
  Predicted polypeptide sequence is orthologous to G261
catatatcagtgtgtacagtgaacaaacattttaacaatcaagaacgtctgagctactgaacgcgtagagcagcaactattacctcataggaatctacccgagctctggtaaaccattcttaagggccaggaggaattagtttaaatgctaacagatcgagaaccatacaagatatccgcaaccatgacatatccagaatcagtatagacagtattacacacgtcgtgtgtttctactgatagcatgaaacaactgaatacccttatgtaacatggacaggcaacgccggaaaggatataactacataaaacatgaaattgtgccagactagcattactactgatcgactctatcattcactatatcatgtcatgcctgccacattacattctctctgctggagtaagatgtcccaactgttctgtaaggctaattacagtcttcctgttccaccaaaatttcccatcctcaactgtcttggattcacttattttgctctccatatcttccctttccggctttacatcagtagaaccagggttctcagtaaggaattgttcccagaatacatcatttactcctgttggcacattattactagcagtctctactcggttttctggcggagtaacatcaggagtagtgtttccattaggctcagagttcatgtcaatatcagaaaacttagatccaacatcaacagttagntgtgggtaagatatagcagggctaatcggcacaactgatagattcatccaagtctattga

SEQ ID NO: 2881 - DNA, 889 bp, Solanum tuberosum
  Predicted polypeptide sequence is orthologous to G280
ctgtaacaaaaatggctactgaagaagcaagtttaactttgccttcttatcctgatatgataatggaagctataggtgcgttgaatgaagaagaagggtcgaataaatcagcaatatggaggcaaattgaagggactcatgttacactaccaccagggcatggtacactccttgcacatcacttgaatcaaatgaagcaagctgggcaattagttatgttgaagaataactacatgaagccaaacccaaacgcgccaccgcgccgtgggagaggccgtccaccgaagccgaaagcttcggttccggttccggatgggtatcctagaccacgtggaaggccaccgaaggagcgtgttccatacgcgccgattacggtacctatgaagaagacgacgactgaaagtagttctggtggaagtgggaagaaacgtggaaggccaaggaagtatccgatgacggaggagactccggtggcggtgaagccaataggtactccgagaggaagaggaaggccgccgaaggtgaaaactccggtagctgcaactgtaggggcttaattgaagaaagacaaattagtttagggacttgtatggcaaaatatgctaactgttgttttctcttttttatttgaatttaatgtttagtccctgtagttttgtttaattacatttgtaggaagaattgtgtgactggtgagtgaatcagtttgtagagaagaaaggagtcttggtaaaaaagcatgtctgtctgtattgtttggaagtaatccatcggcaaaatgctgtgaaagagctagagttactcattgggaatgtctttgcccaattgttactcccaaattggtcgccatgatcaacccaaagcgaattattcgccttattcaaggctg

SEQ ID NO: 2882 - DNA, 927 bp, Solanum tuberosum
  Predicted polypeptide sequence is orthologous to G280
tactctctctctccatggctactcaaagcttcaaccagttcccttcataccctgagatgatttatgaagcccttgatgaactaaatcaagaagggggtgcaaacaagtcatcaataactaagtacattgaaacaaagtatggagatctgaatgaggaactttcaaagatgctgcctttacatttggacaacatgaagcaaactggagacctgattttcctcaagaacaattacatgaaacctggtccagatgttccagcaaagaggggtcgtggtaggccaccaaaacccaaagctccattgccacctggtgctgttgaatctgttgaatctgcaccaccaaagccaagagggcgcccaagaaaagaccctaatgcaccacctacttccaagaagccaaagccagcacctgttcctggaggtcccaattcaacagatcttggttctactactgggaggcctaggggtagacctaggaaagttaggccacagcctgctcatgatgatgatgatgatgttgaggaaagctgaaaactttaaggcttgttattggagtcgtgctgatggtgatgactctaatgacttagttgtcttattttccccccttttttaggtattagtagtattatcttatgtaatagtttcagtttgagttgccctagtgtgactagggggtcatggtttcaaaactaagactgcgtagaatagactaattgtggtctcagttagagttgtcgttatgggactaggaggtcatggtttacagtgtgcaatagactaattgttgtggtccggttctttcctgaaccccgcacatagtgttagctttagtgcactggtcttttttattagtattgttttcttgcttaatgcccctattagttctagtagatgtgggtataagtttgtaggggattgtgtacttgtg

SEQ ID NO: 2883 - DNA, 607 bp, Solanum tuberosum
  Predicted polypeptide sequence is orthologous to G481
ggagaagagaaagactttgaatggtgatgatatttgttgggctttgggaagtttaggttttgatgattatgttgagccattgaagaggtatttgcacaagcatagagagttagaaggtgaaagaattaatcaaagtaaaggtgttggtcttggaaataatattgaagataatcaaagggaaagagatgatgaattaacacaaaggggatctacaattccattcaaaatcaccattatggatcgtaagggggaaaacaattttctccctacaagaccttattaggcttcttcttcttcttcttcttcttcttttctctgtttaaccgttcagtatctggaatttactagtctgagtaatttggatttgctccatgtgaagttcattaaagggaagcgctatttatcaagagtttctggtccagacgaattgtcatgaaaaaaacttgggttgagttttacgtctatcttttaggcttcttcttcttctctcttttatctttgggtttaaccatcttgtgtgtgaaacatactgaccctattaatctggattctcgctgcatagggttggagaaatgtttcctctattggaaggtgtctattctttata

SEQ ID NO: 2884 - DNA, 741 bp, Solanum tuberosum
  Predicted polypeptide sequence is orthologous to G481
ttctattctgaagcctccaccaccacaattaccatatacttttggccgccatcgagtcagaatttaaagtttataatattctgaaacttcctctaccaccacaactaccacctattttggctcgctatcgagtcaaaatttgaagtttatatattctatctccgtccttgaccagaacctccaccaccggaaccaccaccaccacccccacccatatgattatatgacccatgactaccatacatttgatgaccaccttgaggatgatacatcattgaaccacccataccaccatacataccaccaccaccaccgttatacccacctccagaactaactccaccaccacctccggccatatctccaccacccccatctttctcccctgtacgacccatagtagttttttccccttccatttctctatacttggccaagtaaatcttcaatggctcaacatactcttcgaatcctaaagtcgtcatagcccaaagcaaatcatcaccgttaatcgtcttcctcttctctctctgacacttatccgatgcttctccggtaatgaaactgataaattccgatacacactcttgaactgtttccttagcatcctttgaaattttcgcgttcgccggtaaagctttcttcattattctgctcacgttagctatcggaaggaacctgtcttgctcccttggtgatccttcactgttcgcgttggtgtgacctcctgattcgttgtct

SEQ ID NO: 2885 - DNA, 916 bp, Solanum tuberosum
  Predicted polypeptide sequence is orthologous to G481
ctccaacatactgtttgttattagtttcataaaaaaaatccaattaccttagaaatttatctccatttttttgttcttaaagcttgtgtgtactgtcataggcagatcaagatagggacaagactgcgtacacaccactctcgtagaattgcatttagtatgttattgtttgtcagactatttttcatataacagagtaaggttgtgtatacattaggctctccaaatccacttgtgagattattcagggtaagttgttgttcttgtagttctccacaaagtattatctgagcaaagggtatatcgaaaaaagtctctctatcttcacaagatagtggttttatatttgatcaccaagatttaaggatttcgatggcggattcggacaatgaatcaggaggacacagagagaacagcaacattgagagttcactaagagaacaagacaggttccttccaatagcaaatgtaagcagaataatgaagaaagctttaccagctaacgcgaaaatctcaaaagatgctaaggaggtagttcaagaatgtgtttctgaattcatcagttttatcacaggggaagcatcagataagtgtcaaagagaaaagagaaagacaatcaatggtgatgatttgttgtgggcaatgacaactcttggttttgaagaatacattgagccactcaagatttatttgcagagatttagggatttagaagggcaaaaaagtggtgtttctggagagaaagataatggtggatcagtgaatataggtggttatgttgaggactatcatggcatgatgatgatggggaatcaacatcatcaaagacacgggtatggtaccggagtatataatcatcagacgggggagaatgctgcaggggttggtacaggagggtcgcgatttcctgatggtg

SEQ ID NO: 2886 - DNA, 924 bp, Solanum tuberosum
  Predicted polypeptide sequence is orthologous to G481
caaaatccaaaactctgcctcatctcagtcgtctccctttctcccttcttctccaacgtccgatcttccagttccctccatccccaggtatggcggatggtcaaggttcgtctaggtcaccggcgagtccgaacggaggtggtagtcatgagagtggtggggaccagagtccgaggtctaacgtacgtgaacaggacaggtttttaccgatagctaatattagtagaatcatgaagaaggcacttcctgctaatggaaaaattgcgaaggatgctaaggagactgttcaggaatgtgtttctgagttcatcagcttcattactagcgaggcaagtgacaagtgccagagagagaaaagaaagactattaatggtgacgatttgctatgggcaatggcaactcttgggtttgaagattatattgaaccactcaaggtgtatcttgctcgatacagagagatggagggtgacacaaagggaacgtcaaaggctgctgatggctctactaaaagagatgggatgcaacatggtcctaattcacagcttgcacatcaaggttcatactcacaaggaatgaattatgggaactctcagggtcagcatatgatggtcccgatgcaagggacagagtaaaaatccgatcttcgttctgtttgagaagacggtggacttaaaaacatattctatatatagatcttctgctgtaacctctgttatcatgggtttatttattctaggtgctctctagtgaggtgccatggtcatattttaaaacgtttgtaaaatttaggagattgtttcacgaaattattatgggaccatggattgtttggtagtaataattgcaacggggcgggccgggtaaccccaattcggcctattaggtggaggtcgtattaaggcgcggctccactgggccggccgt

SEQ ID NO: 2887 - DNA, 830 bp, Solanum tuberosum
  Predicted polypeptide sequence is orthologous to G481
ggacagataccttccgatagcgaacatcggtcgtatcatgaaaaaaggattgcctgctaatgctaagatagctaaggaagctaaagatactgttcaggaatgtgtttctgagttcatcagcttcatcactagcgaggcaagtgacaagtgtcaaaaagagaagagaaagacaattaatggagatgatttggtatggtctttgaccaccttaggatttgaggactacattgagccactaaaggcctatttgattaggtacagagagatggaggtatgcattgcttccccgcatcaatgatatagagttgctttttgtctttacctctgatatgtcactagctatgccttggggattgtttctaatgtcagggagacaccaagggatcttctagggctggagatacgtctgctagaaacgatatagttggaggtcagctcagtccaactacacagtttgtctatgatgggtctttttcccaaggcttcgactatgggaactcccaaatgtgaatttctaaaattacaacggtgctgatgcgagtatcttctgccttccgttcatgttgatctatgtactaagccattcaatggttgctgataatatatgtttgaaagctctaggaaccgaaagtatgctgcaaatcttgaatttagccatacaacaaaacactttattttctgaacttctcttccagtactttgatgctctgtacatgtaacatgtgaattggattttattgttgtaaactgagagcaatcttctttttctgcaaaacttggtaagttctataggtgagtgaccttaactttctgtatgaagttggttttaa

SEQ ID NO: 2888 - DNA, 338 bp, Solanum tuberosum
  Predicted polypeptide sequence is orthologous to G481
cacgaacataaaacacaaacaaattaaagatcaacacaaaataagacaaaagtgtagaggagcccttttttgtttgtttgtttgtttggtactgttgatgcctgtgttgggctccaaatttacaactctgtttctatagagaagaaatttggggattgggcttccgaccatggcccattaagcgcaaagctcacgacttgtttgcctccaagcccacatgaggaatcaatgtactcaaggcccaaattagatcgtcacctccaacattcataaaatattctttttctaaatagatatctcacagagtttattacaagtaaaaaaaaaaaaaaaaaaaa

SEQ ID NO: 2889 - DNA, 1072 bp, Solanum tuberosum
  misc_feature (748)..(748): n is a, c, g, or t
  Predicted polypeptide sequence is orthologous to G481
ctgccgttggatctatgtgtatagcgcagaaaagctcagcatccattttccgccaaattcctttctcaagcaaaaactaacaaaatattctcttggatcaacctctacctacgatcatccataaagttagggttccggtacactgagaatggcggagccggcaagtccaggaggcggcggcggaagccatgagagtggcggtgacccgagtcctcagtccaacttgcgagaacaggataggtacctaccgatcgctaatattggacgcataatgaaaaaggcattgcctgctaatggaaagatcgcaaaggattctaaggacactgttcaggaatgtgtatctgagttcatcagttttattactagcgaagctagtgacaagtgtcagaaagagaagagaaagacgatcaacgggagatgattatactattcagccctgggctacccttgggattttgaggaactacatttgaacccacttgaaagggtctaattttgaactcgaataacagaggagatggacgggaagatgcccaaagggaatcttggcaaggggtttgggtgaattgcatccttggttagcacaaaagacgtgtagttgggaaacgtcaaggtttgggggtccaaataacgcaaggtccaatggttattggaagggttgcctctttggccccaaagggttttaggaccttattggaaacttccccaagttattggattatttcacgaattggaaccaaaggaactntttgggatttgctttacgcaaaaagaaaggggttgtgattaacgtttgcaaacagagtggttaagagcccttttggctgggtacacaagaatgtgcaggacaaggggtgtctcctttctatggacggaacccccggggtgtgaacacgtgggtctaagcagcgccaagtggttatgaggggacctattaaacaccgctataagagggagctccccttacgtaagatttttgtggcgcagaaaaatatttttcgggttgggcgagataaccttggagtttaaaaatctctctttcccgggcctggtaaaaacccgaggggggttt

SEQ ID NO: 2890 - DNA, 864 bp, Solanum tuberosum
  Predicted polypeptide sequence is orthologous to G481
tcattcattacatccgaaagatacataatcagcaaacctataaattcaactacaatacttaacacatactaatttataaaagcaataaaatatgttaatttaaaaagaaaaaaagaaaagaaaaataaacataacctaaaaataaggtgtatgcaatatgttgagaaaacaaagtacataatatttttttcaaaaataaaataaaaataaactaccattcaaccccatgaagattagctttagatgtcaaattctcaccataattttgtgaaaaattcccattattatagctctgaataaattcaggccttgctaatgagaattttggtaaccattattattatcattataactagtacccaataatattatttgtactagttataattggttcatgtgaagtttcatcatttctagccatgatattttttttccccttcactttctctatacttatttagataaccttttaagggtccaacataattttcaaaccctaatgttgtcatagcccataaaaggtcatctccattgatggtcttcctcttctctctttgacatttatccgatgcttcgcccgtgatgaagctaatgaactcagacacacattcttgaacggtttctttggcttctttggagattttcgcgttggctgggagagatttcttcatgattctactaacattagctatagggaggaacttgtctagttctttagagaagttatcggatgtgttgcccgataacgggctttcaaccgggctagttagggttttttttccgtcatgatgataatgataatgatgatgaacgtcgaaagaaattaaagaggagatgtgtaaggggttttgtttggtttgggga

SEQ ID NO: 2891 - DNA, 985 bp, Solanum tuberosum
  Predicted polypeptide sequence is orthologous to G567
gatatttattggcttaaaaaacttaaaaaagtcttagttttttttttctttttccggagagaaatatggatagagtattttcagtggacgatgacattggcgaccatttttggtcgacgccgccgacggcggagttgggcgttgattcacctacctctgccgccaccgccgccatctcctactcgaagatgatgaatcgcagctcttccgaatgggctttccagcgtttcctacaagaagccgccggtacgaccacttcatctcctcctctgccacctacaatggcgtcttcgtcgtcatcttcacaccaaaacgatgttgtcgagatcaaggatgagaatctttctactcctaatctcaattccagtacggcgttgaattcgaagccggcagcgacgtcgtttgcctctgcacctccgcagaatattcccgttgatgctgaagagtatcaagccttcctcaaaaatcgcctcgatttggcttgtgctgcagtcgcattgactcgggcgaagaatctaaagcctcaagattcaagttctattgcacctgataaaggtccagagactgctagtgcatcacaatcagtatctcacatctccactaaaggatctggtcaggaagtgagaaaagttcaagataaggattctggtggaccagttggaataccctctttaccctcagtgcagaagaaacctgtggtgcaggtgaagtcaacaactagtggttcatctagagagctatccgatgatgatgaagctgaaggagaagcagaaacgactcaaggaacggatccagctgatacgaaacgcgtaaggagaatgctttcaaatagagaatcagccagacgttcaaggagaagaaagcaagcccatcttacagaacttgagacacaggtatctcaactgagagtagaaaactcctccctactgaaacgtctgactgacataagccagaaatacaatgaatcagctgttgataatcgtgt

SEQ ID NO: 2892 - DNA, 789 bp, Solanum tuberosum
  Predicted polypeptide sequence is orthologous to G663
ctcctatgatgtgtacatctttgggagtaataaggaaaggtcatggactgaagaagaagatatccttttgaggaaatgtattgataagtatggagaaggaaagtggaatcttgttccaactagagctggattaaatagatgcaggaaaagttgtagactgaggtggctaaattatctaaggccacatatcaagagaggtgactttgatggggatgaagtggatctcatcttgagacttcataagctcttaggcaatcgatggtcacttattgctggtagacttccaggaaggacagctaacgatgtgaaaaactattggaacactaaccttctaaggaagctaaataccagtactaaatttgctcctcaaccacaacaaggaattaagtgtgggcaagccaatgccataataagacctcaacctcagaaattcagaagctccatgaagattaatgtctcttggtgcaacaacaattagtatcgtaaataatgaagaagcatcgaacgacaacaacgatatgcaatggtgggcaaatatactggaaaattgcaatgacattggagaaggagaagctgaaagaacactaccttcatgtaaggaaattaattgcaatgaaattgataaaacaccaagtttgttacatgagggaggcaactccatgcaacaaggacaacgtgatagtggttgggatgaattttctctagatgatatatggaatctacttaattagcgggtgattacacgaatgactgagaggtgatggtctgaacttttgattcgttgtctta

SEQ ID NO: 2893 - DNA, 490 bp, Solanum tuberosum
  Predicted polypeptide sequence is orthologous to G663
cagaaatggtagtattataattaaaatatatgtcttagaactatatattattaaaaaaaatgaatactcctatgtgtgcatcgttgggagttaggaaaggttcatggactgaacaagaagattttcttttaagaaaatgcattcaaatatatggtgaaggaaagtggcatcttgttcctgctagggctggtttaaatcgatgtcgaaagagttgcagactaaggtggctaaattatctaaggccacatatcaagagaggtgactttgctccagatgaagtggatctcatcttgagacttcataaactcttaggcaataggcaagtctatgtgtttattagactgcgatcattttattcaaaagtttatgatgttagggatttacgatataattttctttttaatgtattatatatatatttataaatattaccatttcttaatatgtgtaattatttcatttaaaagttacgaaaaaaaaaaaaaaaaaa

SEQ ID NO: 2894 - DNA, 1125 bp, Solanum tuberosum
  Predicted polypeptide sequence is orthologous to G663
aaaggttcatggactgaacaagaagattttcttttaagaaaatgcattcaaatatatggtgagggaaagtggcatcttgttcctgctagagctggtttaaatcgatgtcgaaagagttgcagactaaggtggctaaattatctaaggccacatatcaagagaggtgactttgctccagatgaagtggatctcatcttgagacttcataaactcttaggcaataggtggtcacttattgctggtagacttccaggaaggacagcaaacgatgtgaagaactattggaacactcactttcaaaagaagttaaatattattactcctcctcctcgccctcgtcctaatcctcatctacatattaagcataagagcatcgtggttactaagaatgaaataataagacctcaacctcggaacttctcaaacgttaagaagaataattctcattggtgcaacaacaaaagtatgatcacaaacacattagacaaagacgacaaacgttgcaaggaaattgtagtaaatatttctgagaagccaacaagagaaaatacatcgtcgatagacgatggagttcaatggtggacaaatttactggaaaattgcaatgaaattgaagaagaagtagctgttacaaattttgaaaaaacaccaacaatgttgttacatgaggaaatatcaccaccgttaattaatggtgaaggcaactccatgcaacaaggacaaagtcatgattgggatgacttttcaactgatattgacttatggaatctacttaattaaatagtaatttctttttttgatttttcgtgatgtccggtacttatattagaatctgactgaattcagattcacgcgactccttatctagggggactcgaacccaacacctctgattaagaatgaatgagtacttattactccgacatatggttggtattaaagaaatatgtaatggtaattaatattattgtaaacttgtaatagggatccaatcgtcctttatactttgtatcctaattacaagttgttaggaatgtaattttaagaattattgtaagtgcatgcactctatttttatatttgatgtgaatttaaggattgagcataaatatgaaaaatcaaaat

SEQ ID NO: 2895 - DNA, 1071 bp, Solanum tuberosum
  Predicted polypeptide sequence is orthologous to G663
actcctatgatgtgtacatctttgggagtaataaggaaaggttcatggactgaagaagaagatattcttttgaggaaatgtattgataagtatggagaaggaaagtggaatcttgttccaactagagctggattaaacagatgcaggaaaagttgtagactgaggtggctaaattatctaaggccacatatcaagagaggtgactttgattgggatgaagtggatctcatcttgagacttcataagctcttaggcaatcgatggtcacttattgctggtagacttccaggaaggacagctaacgatgtgaaaaactattggaacactaaccttctaaggaagctaaatactagtactaaatttgctcctcaaccacaagaaggaattaatactagtactattgctcctcaaccacaagaaggaattaagtgtgggaaagccaatgccataataagacctcaacctcagaaattcagaagctccatgaagattaatgtctcttggtgcaacaacaatagtatcgtaaataatgaagaagcatcgaaagataacaacgatatgcaatggtgggcaaatatactggaaaattgcaatgacattggagaaggagaagctgaaagaacactaccttcatgtaaggaaattaattgcaatgaaattgataaaacaccaagtttgttacatgatggaggcaactccacgcaacaaggacaaggtgatggtggttgggatgaattttctctagatgatatatggaatctacttaattagcgggtgatttacacaaatgacctgagaggtggatggtcttgaacttttaattttgcttgtcttatcctattgataaaaattcaagttttacaagtccttatttttattcttgaagatttgcctatggagtaaattgaggtaaaaaattcgagaccacacatataattaggtgcatggcctttgtattatctacgtgtgtgcttttgtgtttttaaggtgaacaagtttatagtggaatgtgaaagtattccaagtgtgaagtatgtaatatgatatatgaaatgaagtgattattatatt

SEQ ID NO: 2896 - DNA, 1120 bp, Solanum tuberosum
  Predicted polypeptide sequence is orthologous to G663
atcatgagtactcctatgatgtgtacatctttgggagtaataaggaaaggttcatggactgaagaagaagatattcttttgaggaaatgtattgataagtatggagaaggaaagtggcatcttgttccaactagaactggattaaacagatgcagaaaaagttgtagactgaggtggctaaattatctaaggccacatatcaagagaggtgactttgattgggatgaagtggatctcatcttgagacttcataagctcttaggcaatcgatggtcacttattgctggtagacttccaggaaggacagctaacgatgtgaaaaactattggaacactaaccttctaaggaagctaaatactagtactaaatttgctcctcaaccacaagaaggaattaatactagtactattgctcctcaaccacaagaaggaattaatactagtactattgctcctcaaccacaagaaggaattaagtgtgggcaagccaatgccataataagacctcaacctcagaaattcacaagctccatgaagattaatgtctcttggtgcaacaacaatagtatcgtaaacaatgaagaagcatcgaaagacaacaacgatatgcaatggtgggcaaatatactggaaaattgcaatgacattggagaaggagaagctgaaagaacactaccttcatgtaaggaaattaattgcaatgaaattgataaaacaccaagtttgttacatgatggaggcaactccatgcaacaaggacaaggtgatggtggttgggatgaattttctctagatgatatatggaatctacttaattagcaggtgatttacacgaatgacctgagaggtggatggtcttgaacttttgatttcgcttgtcttatcctacggataaaacttcaagtttaacaagtccttatttttattctttgaagatttgcctatggagtaaattgaggtaaaaaattcgagaccactaatataattaggtgcatggcctttgtattatctacgtgtgtgcttttgtgtttttaaggtgatcaagtttatagtggaatgtgaaagtattccaagtgtgaagtatgtaatatgatatatgaaatgaagtgagtattatatt

SEQ ID NO: 2897 - DNA, 784 bp, Solanum tuberosum
  Predicted polypeptide sequence is orthologous to G668
acttctctgtaagacttaattccagtacacgtcagagaataaatagctttcataatcaagcaaagcacaaaattctactagctaattttttgctttgcttaattatgaaagttaaaatatacactaatgttaaaaagcattgtgtaccagacaaaaaataagaatgaggatgacatccatccctagttaaaatgctactactagaaactaattgggaatttgggagtaagaaaaacaaaagataatggaacacaccccaaatagaaaagcaaaaacaaatccttctaaattaataaatcgtcattttcatcaaacagccaactctccagcattactgacaattgaatttcatcatctatttctcttttgctttcaccatgaaatttaccagcagcttcaggtgtcgtagcttgagaaaattgatctgaattcgacggttcaaatgaagacgaatattcagtcatggcattattattattagtattacaagaatattgagtacttgacgaagcctttgattgctcggaattatttgtggattcacttttagtccactgtttgagtaatttggctatgttttcagcatttgatgcgtaagtagtagtagacatttttgcttcttgtttaatgtatgggtaacatccaatatcagtaattgtatagtcaggaattgggcttgatttatcgagtgacagtgcattttgtaaagcttgtttggctgtgttaatatcagcttgaagtgtctttcccatgggcctctggaaagttgattatatggttgata

SEQ ID NO: 2898 - DNA, 1166 bp, Solanum tuberosum
  misc_feature (558)..(558): n is a, c, g, or t
  misc_feature (840)..(840): n is a, c, g, or t
  Predicted polypeptide sequence is orthologous to G668
ttttttttttttttagaatctaaagagtctggtaaatattattactagtactactataaactattcactacatgtgcatatatttaagattacttgtaatatatacacttttctttactcttgcaaattttagaatttttgctcaggctagctactaagtaagtaaacctgttaaactaaattacaaagctctaattaacaagtaacaaacattaaaaagacattaaagaaaaccccaaatttgaacttctatgttttttctgaagaaatatttactagagctgtcatttactagtaaatatttcttcaaaaaaagtcagcagattcacccaaacccattcccataaactcttcttcttgtgctggtgcattaatagcatcatcaaatagccacttctctagcaaagttaacgggacttgtgactcttccaaacttggcttgctctccgcttgaaacaaaaaaccattttccgaattcacattcggaaaatttggcttgctttccacctgaaaaatctcaggtgtgaaagcattaccttcgctaaaaaaggagtcaanatccctcaggtgttgcagcacttatggtaccttcactaggactcgaccctgaccctgaccccgacccaattgacgggttattcaacgagctttgagttgtctcagaagttgatcgacttaattcagatgatttgggggaatccttcatccaattttgaagtaacctggaaatgttttccgcactggatgcataagagctggatcctgtaacgggttgttgagcaagaaattgggctaaattggatttagcagattgaatcagatttgtcaaaggtgataaangcctcgcagaagggcttttctagccatgttgaatatttggctcgtgccgaaattctggcaagcccgggggaatcccattagttcttagagcggccgcacgggggggagctcaagtgtgtcccttatgaggttaatgccccgctggagtaacagggcaaaaccggtcccggtaaaaatgttaccgacaaatcccacaaataagacagaagtttaatataaaacgggggcgaagaggagcaacaaaaatgggtcgccacagccgttcaaaggaacaggtggcgacgttaaaacgcacgaggaggtgtatgggcccccaccaaaagcgg

SEQ ID NO: 2899 - DNA, 773 bp, Solanum tuberosum
  Predicted polypeptide sequence is orthologous to G729
ggcatctaactttttgttaaaatgatttagcaaaatcaactaaaaaagctttaaccttttttggtcaaaacaaaattgaaccatattcctgcagtcacgtacagagaaaactatagtctaatagttagggcaacttaattaattataattactctacataatccaaattatttaacacttgagaagattcaaatcatttgaggatgatccagcttgtcccattttccagtttggtcttcctagtgtaaattcaagatcaagcaatgtatcatttgaagatgagttattggctgtctcaaatccatccatatttgtatatatgtgaggataattagcaaatgtcctttctctatttgagtggctccatgcatttgtctgatcaggcatgaatgatgaaggatccctcaaatgagacatattttgtgatatggtacttggttgtgataatgcatcaatctcctcaaaagatttttcatattcaccattattaatcccattgttttggttcaaaaatatattaatttctccctgccctttagctgtagctttgtcagtgctcttcactgttctatacatctgtaagtgactcttcacatgagctaaggttagatctttcacattcatcaactctagcacggattttggtgttgctcgttcatgtccacctaggagctgaacggcatgaacaaaatgagcatgaagagttgaagtccatctcattctcggagctctaacgcttcttttcactccactatcatctcgaactctcttga

SEQ ID NO: 2900 - DNA, 551 bp, Solanum tuberosum
  Predicted polypeptide sequence is orthologous to G729
cacatcaaatattatactattaaagtattataaaaattctttacactatcagataactagtgccctctttgcttttggcacaaaaactaatttccacatataggtccatcttttttactagggtttagctttcgcgctaagacccttttggctataaaaaaaagtacgaattcacatttttgggaataattttttagaatagcatatgaaagttcaccttgaagagttgttccaaaaaccctgaaaatcattatcttgatgaatattccttttatcttgttgaactgataattcagactttcttgaatattcttcattttcaactagaggtggatccaggatttagagtctctgagtgccaagtaaattcatctattatatcaatttagacttcgaatcaaaatattcatcaaccatcaattcctctgatgtatctccggatgacaaattatcgaatacctcagattggcctgaagaagctgatctatcagttgtcttcacagtccgatacatctgtaaatgggatttaacatgtgctaaggtgagatctt

SEQ ID NO: 2901 - DNA, 786 bp, Solanum tuberosum
  Predicted polypeptide sequence is orthologous to G812
gctaaaataactcaacttcttaactgcataaactaccttacccaaagagaaactttccatttccaaaatccaaaatccaaacttttttcttcctaaaaatacatatattttcccctgtttcttgatgatgaatcaattgtattctgttaaagaggagttcccggggtcaagttctggtgggggtgagcccccaccgttgacaccacaaccaatggaagggcttcatgacattggtccaccaccattccttacaaagacatatgaaatggtggatgattcaactatagatcatgttgtttcttggaacagaggaggtcaaagcttcgtagtctgggatcctcatgccttttcgactacactacttcccagattcttcaaacacaacaatttctcgagctttgtcagacagctaaatacttatacgaattaagatctggtgatgttcctctgatgaatccttcaagttctggtggttggtataacctattaaaatattcatcgtgctgcggacccaaaaaaaaaaaaaagcactagtgtcaagaattgtttgctaagatggatcttggaaaaatttggaagatgatgatactaagctgcagatgggatttgattgttgcagggatttaaaaagattgatccagagagatgggaaattcgcaaacgaggcatttctaaaggggagttagcatcttctaagaacatcaagaggcgaaaaacgtctaattctcctacagagcaaggtctcggtccttgtgtcgaattgggatttgatggagagttgatcga

SEQ ID NO: 2902 - DNA, 716 bp, Solanum tuberosum
  Predicted polypeptide sequence is orthologous to G860, G1760
gctttgatttcatttctaaagccctcaacaattaatccaaatccaagtaaaaccctagatgggaaggggaaagatagtgatccgaaggatcgataactcaacgaacaggcaagttactttctcaaagagaaggaatggattgttgaagaaagctaaggagctcgcgattctttgcgatgctgaagttggattgattattttctctagtactggaaagctctatgagttttctaacaccagcatgaaatcagttattgaacgatacaccaaaacgaaggacgattgtcagcaattgcacaatccagtgtcagaactcaagctgtggcagagggaggcagagatcttgcggcaacaactacaggatctgcaagggaatcaacggcaattattgggagaggaggtaagtggtttgggcgtaaaagaactaacagatctggagaatcaactggaaatgagcttaaagggaatccgtatgaaaaaggagcaaatattgaaggatgaaattcaagagctaactcgaaaggggagcataatacatcaagaaaatttggaactctacaagaaggcatatggtacaagagatgctcatgcagtgaatggaaacatcaactatatatatccgtatcgctttacagtgagtagagaagttcaggcccccatccatctgcagctaagccagcctgagacacaaaattttgagaatgcagtaggaacat

SEQ ID NO: 2903 - DNA, 679 bp, Solanum tuberosum
  Predicted polypeptide sequence is orthologous to G860, G1760
ctccttttgtcttctccatcaacagcaactttttttttcccttttcctcgaaaaattcctccactgatttgttcttctgcttcttctcgtgaattcaatttctctgagagagagagagagtgtgtgtgagatcggcgatggggagaggaaagatagtgataaggaggatcgataattcgacgagcaggcaagtgacgttctcgaagaggagaaatggattgttgaagaaggcgaaggagctagcgattctgtgcgatgcggaggccggagtcattatcttctccagtactggaaaactctatgaatattcaaacaccagttttggcaaagggaagcggcaatgctgaggcaacaactacagaacttgcaagagaatcaccgacaaatgatgggtgaagagctttctggtctgagcgtcaaagatttgcagaacttggagaaccaactggaaacgagtctccatggtgttcgtgtaagaaaggacgaaattctgattgatgagatacaagagctaaaccgaaaagggaaacctcattcatcaggaaaacatggactatataagcacgtaaacctaattcgtgaagaaattatgacttgtgtagcaggtatcatgtacatcactaaaagttcacatgttcagatcattgtttctatacagtgaagaggaacatatctctag

SEQ ID NO: 2904 - DNA, 569 bp, Solanum tuberosum
  Predicted polypeptide sequence is orthologous to G860, G1760
tttttttttttttttttttttttaagtccaagactaataactataggcatgaattacaaatatatgaacaacttagtgtcgcccctttagaagaggttcattgacaaagaaaagtatggcttagaacattgatgacgacactaataacacgcattacgcgaggcgaagcggtcaacacgttttgagcctcatttcaggacttaagcgtgcatttgataatacgggtctttaataatttaaacatatgtttgtgagttggaacacttggtcgagaagagaggctaatggcataatgtgcatattctccactaatgcagtgacagcctcaattttgtagttcctggcatttcatagtgttgtagctgtggttggcttagctggagatgaagaggtgtgagagggtcctcgttgacgcttaaactgtttgaactcatggcatttctactcactgcatttgcttctctagttccataaaccttcttatacaattccatattttcttgacgaacaaggtctagtttcttataaagttccttgttcccttgatggctgaagtctctctttcggtt

SEQ ID NO: 2905 - DNA, 470 bp, Solanum tuberosum
  Predicted polypeptide sequence is orthologous to G860, G1760
ctctcttctctctctctctctctgtagaatcagtctactatcaaaatctctcaaattatagcatttaatcgagaagagatgggtcgaggaaaaatagtgatacaaagaattgataatacaacaagcaggcaagttactttctcgaagagaagaaatggacttctcaaaaaggctaaagagcttgcaattctttgcgatgctcaagttggactcattgttttctcaagcaccggaaaactctatgaatttgccaacaacagcatgaggtctacaattgatagatacaacaagataaaggaggagaataataacatgaatcccatgtcagaggtcaaggtaacctgatttttgttttgtttccacaagtgtatgatatccttttggatgtccttgtatatatatatggataatatgctgattttattcatgctattctaaaacccttttaattaaaaaaaaaaaaaaaaaaa

SEQ ID NO: 2906 - DNA, 909 bp, Solanum tuberosum
  Predicted polypeptide sequence is orthologous to G913, G1753, G2514
cttcaacatacatgtataaaccatgcctctctcaatgtacgtggtgggatctcaattgagttataagaaagaaattaaattccatggattcatttgttttaatagctccatagattttctgcatcagaatgtcccggtgaatcatcggaccgcggcaagctcattcttggagggctcaccatcattgcctccgccatgtcaactagcaaattaggcatatcaaataatgcttcttcatcaatgtattcatgatccctagtttccatcatatgcacactccccgacgattgatgatcatccgtacctgatacagagaagagacagattcaaaatttaaactgtactgttgaattttcatgattcttcaatactacaattattctacttttgaaatactgaattcagtatcagagacgaattcagaatttaaattttactattagagtttttaagaatcatttatataaggttatctttatatatatccttttcgaattcatattgatagtgtaaaaattgtttacattgtcaatatatataaatttaagtctatatgcatttttgtatcgaaaatactgaattcagatgattgtatcacaaaaaaggtgaatatatttacctggttgagttcccgaggtggtttctccggtttcaatcttcatcagggcggcggcggtggcggcagcttttcgtatatccgcggcggcgggtgaaggaggaagtgaaggatacgaattaatattaccaggaaagttaattacggcgtcgtctccttttaaagccattgcagcgacgtcgtatgcagcagcagccatttcgggtgtagggtaagtacctaaccatattctcgtagtcttacgtggctctcgaatttcggacacccatttcccactcctacatcgtattccg

SEQ ID NO: 2907 - DNA, 999 bp, Solanum tuberosum
  Predicted polypeptide sequence is orthologous to G1020
gatcacaaacaaaaatatggctgtgaaagataaagctgtgaaaggaggtaatgtgaaggtgagtaatggagttaaggaggttcattacagaggtgtaaggaagaggccatggggtcgttacgctgctgagattcgtgacccgggtaagaagagtcgggtctggttgggtacttttgatacggcggaggaagcggcgaaggcttacgataccgccgctagagagtttcgtggacctaaagctaagacgaatttcccctttccggcggagattaataataataatagtaataatcagagcccttgtggaagcagcaccgtcgagtcatctagcggagaaactgttgctcacgcgcctcatacgccacacgcgcctctagagttggatctcacgcgccgtcttggcgccgttgctgaaggtggacgtggaggtgtcggctacccgattttccatcagcagccgacggtggcggtactgccgaacggtcagccggttttgttgtttgattctatgtggagaccgggagttgttagtaggccgtaccaggttgtgccggcgccgatggagttcgccggtgtcggtgccggagttgtttctactgtgtcggattcgtcttccgttgtggaagagaatcgttacaggaaaaaaggacttgatcttgatcttaaccttgcgccacccatggaagtttaatttgatgacgacgataacctaattttgtgaaagagagattaagagtgacagaactaatggctgatttttgtatataagtttaaaagaactgttccttttttttggcagttgaaacgtgttgttatgaggtttctgttgctttttctaccaattgtaactcttaaatccttttgattaatgagaaaatctatgttttctccttcctctattcgtgctggtcgcttgaatctataggctaacttctcttatccgctttgttcatcttttaagtttatttttctctttagatcctgcgacgtattgttacg

SEQ ID NO: 2908 - DNA, 993 bp, Solanum tuberosum
  Predicted polypeptide sequence is orthologous to G1020
gatctaattctctaatgacttgttcaaattctatacgtatatatatataattgtccatttccggtaagcggcgaactgaaaatggcgcccaagcaaaaatgtacgacggcggcgacggcagtgacagcggcggcggtgaaggaggtgcattacagaggtgtaaggaaaaggccgtggggaagatatgcggcggagataagagatccggggaaaaaatgccgtgtttggttaggtacgtttgataccgctgaggaagcagcgagagcgtatgataaagctgcgagagagtttcgaggtgtgaaagcgaaaactaattttcagattgtgatgcagccggaggatgtgaatcggagtccgagtcagactagtaccgttgagtcatcgtctgcggcggttgcggttgcggttgcggcggcggcggcggtgacggtgactgcgacggcggcggcaatggtggaatcggttccgttggatctaagcttaggaagctcatcatccgttggtatttttagcaacggtgtaggtaagtttttgttccagaattctcctaccggaggaatcgctccgccgatgtactatttacaaggagctggagtgattcgtaacggcggcggcggaggtagtggagatggaggtgctgctgccggcggccagagtgggatgatgaagagtgaatccgattcatcaactgtgatagattttatgggtaacgatctcaagccaaaagctaatttcgaccttaatcttcttccggcaccggaagacacgtgaaaattcttctgtatggatcggaaagttgccggagttgatgatcggagattctgcatgctttttgaactttggctttatttaattagttgtaagcttgtttaattagcgttaattccccttttaatcaccagtaattaaggaaaaaaaagataagggaaactatagtatatatagggggaaaacgatgacgttctgttcatcgagttactaaatgtgatatcg

SEQ ID NO: 2909 - DNA, 1009 bp, Solanum tuberosum
  Predicted polypeptide sequence is orthologous to G1020
attttgaataaatttaattagtctttagtatggcgcccaaagaaaaaattggtgcagtgacggcggcggcagcggcagcggtgatggcggtggggaaattgaatggaatttcgaaagaggtgcattatagaggtgtaaggaagaggccgtgggggagatacgcggcggagataagagatcccggtaaaaaaagccgggtttggcttggtacttttgatactgcggaggaagcggcgaaagcttatgataacgctgctagggaattccgtggagctaaagcgaaaactaattttcctccattacaaaaggaggaagatctgaaattccctgttaaaaatgaaatcaatcggagtccgagtcagactagtactgttgaatcgtcgagtccggttatggttgattcatcatcgccgttagatctaagactttgtggatcaatcggcgggtttaaccataatactgttagatttccgatctctggtggaggttttaccggtgctgtaccggcggtgaatcatatgtactatttagaagcacttgcacgcgccggagttataaatttagaaacaaatcggaagaagacggtggatttcctcggtggtggtgactccgatacatcaacggtgattgattttatgcgtgttgacgtgaaaccaaccatcgccggtctaaatctggacctcaactttcctccaccggaaaatatgtgacatcaccggagacgacgatcggagatattttgtgaaacatttttatttattgcaatttcctttttaatgtttttatttaaacagaaaaggaaaaaaaaagaaatagtatatagaattagattagatggtagaaaactgaagagccatcgccgttgctgctgccgtcgccgccagcgacaatttatcaccgccgatgtccatatcaaccaggctgatctacttttaccttttttttgcacagaagaaacaaatctattgattttgcaaagctgtttgtttcattagatcatcctataata

SEQ ID NO: 2910 - DNA, 665 bp, Solanum tuberosum
  Predicted polypeptide sequence is orthologous to G1038
cccaccgccaccgtacgactggatttatcaacccaatctccgagcagcaaatatggatttttcatcaatatggcttcactaatggtgtaattttggtttgttatcgatcatctagctatgtattactcatttgatatgattctagcagctttgcagaagcagagtttcattatgttccattgctttccgagtttggtcctgactctcgaaattcgaacggtgccacaaaattaaaaagagttcatggcagacatcgggcacacgtttgatgatgatgatctcaagcaaccttattacaacatgttttctctgatggggactgggttctttggttctgttggttgcattataaacttcggttaaatctttgccgcagattcaaaccttgcttaccaatggaagttgagacacatatgtctttcagaactgctgaaaaaatcagcattttggtggtggatgatgatgccacgtatcttccggttgttgctgggctactcaagaaatgcaactaccaagttgtgactgtcaaatatccagtagatgctgtgtctaaacttaagatcaaaggcgactcttttgatctcgttgtcactgatgtgcacaagtctgatatgaatggctttgaacttcaacaagtgatagcccaagcatttgaaatacctgtt

SEQ ID NO: 2911 - DNA, 878 bp, Solanum tuberosum
  Predicted polypeptide sequence is orthologous to G1047
cacccccctttagaagcgattttccggccatgttgtccacttttccggccactactctgtccactgatggcctttttccctatttatttccggcttttgatggcgggttcactccttgggaatgtatagaaccggcttttctattcccacaagaaatggaagaagaagaaccggttgtttcacccaaggaatccccacctcctgaaccggttattttaaactccgattcaggttctgatgactccaaaccgaattctgttcactctagttccggttcagatgacccgaaccggaataataacacgaaccgctgtcctgacgagaggaagcggcagcgcacgacatcgaaccgtgacatagatgagaggaagcgtcgacgtatggtatcgaaccgggaatcagcgaggcggtcccgcatgcgaaagcaaaagcatctggagaacctgcggaaccaagcgaaccggcttaaagtagggaaccgggaaataatgaaccggttacggttaattacttaccagtgccaagtggtccagtgtgagaacgagcgggtcaggaccgaatcggctatccttcggcaaagacttgagggtatacgtcaaatattgatcacccggcaacttgagcagcaatttaattcttattctgcatgggcatgcaataatatggaacaaagacctcattaattaatcacttggacctataataaatcatcattaaacgtgcttcttcctctaattagcaccactatataactatcagatgaaatgaagtcacaagaggattttctctctctcactctctatttcttgtaaattaaattaaaaggtgcgtataatagtggtaaagagatatagtaatatgtattgtagctactagct

SEQ ID NO: 2912 - DNA, 714 bp, Solanum tuberosum
  Predicted polypeptide sequence is orthologous to G1075
aaagaaagttctccataaagaacattaattaagatgacaaatttcagaattcatagagttacaagaccccaaaataacatacaagacaaaagaaaaaaaaaaactcaaaatctctagaacaaagatggtacactaattttgctgacctttttgattcaagaatccccatatttcatcattgatccaaattagcttccatttcatatcatcagtatgaacaagctcgaattctatttcccttttcaagatttgcactaaactccaaaaggtgggcgaagacctgaattccccacccacccatcaacagaagcagatccaggatttaaatagttaggcatatttaacggtagattaaaaaatggaagcccaggattagacgggtccggaaaagggttattattaacaaccccatcaccaccaccaccaccatcggagccttgtgtattaccatcttcctctaaaggcaatctttcataagcaacattagtaaaagatgaagctataacaataactggtccagcagccatcaactcacctaccacacttcctccaacaacttgtccttgtccaccagccaaaaatatagtcaaacttgttgcccctggtggtgctggtggtggtaaaaacgaaccactaagtgacaaaatctcgaatcgaccatttaatgtaacgaccgatgaagaactaatattaccagtattattattattacca

SEQ ID NO: 2913 - DNA, 1040 bp, Solanum tuberosum
  Predicted polypeptide sequence is orthologous to G1075
cttctctgtatactccactcagttctctctttacttttctattcgttcctagggtttgaaatttcttgtgttcattttgcttttccataaaatatattttcacgttcaagaattatatatatacatattttctactcatggtcattaattaatttcccgttattattaatcatatcatacttgattatagcttagttttctgttcactacttttgttaattgtatatatgtcatcgttatcgtctatggctggtttgagacttagagttccgcttctcatcatcgttttctccctcatacatctccacatatcctcaagatgacgaaatcaagccggaacaacactcaattttccgatgatgatgacaacgaacaacaacaacaacgattataataacaatagccccggggtagcacgtagaccaagaggtcgtcccgcagggtccaaaaacaagcctaagcctcccgtgataataacacgggagagcgctaacgcgctccgtgcgcatattttagaagtgagtagcggacatgacgtttgcgaatccgttgcgacttatgggagaaaaaggcaaagaggaattggtatactaagtgggagcggtacggtgaataacgtcaccatacgtgcagccacaggctgccggtactgtggtgacgttacatggaagatttgagatattatctttagtctggatctttcttaccacgaccgttccccccggggtcaccaggttaacgattatttagctggttggtcaacgtccagtcgtaggaggaaacgttgtgggtgcgctaattgcatcggggcccgggtcactgtaactagcattcttccatttactaattgttgtttatgaagatttgcctttggatgacacatgagtcattccaaatgacgcagaccaagacaaagtggtcactttggggaacccctatattggatacacttttttaattgcgcttaaacatggcaactgcggtccactcacactggcaacaggggtcagaactgatggaaatccacaaaaggacccaat

SEQ ID NO: 2914 - DNA, 726 bp, Solanum tuberosum
  Predicted polypeptide sequence is orthologous to G1084
tttttttttttttttgaaactaatatatatatatatatagatatatcaaggcacctctatatagctttctattccttctgtgttctgcataatcagtagcccagattggttaaggcacctctatggctcaagttactcaacatataatttacattgcattccttcctacctaacctaatatttttaatgtaaattacactgcattttgtggctgtttgatattctcacaattctttaccaaatcagtatatccatcagctgaagctatggcaaactctgtcagtgagctcagagcaactgacattcctgcacatagcactctaatggcaacctcagccatcttttctgctgtcattatgtcctcatcaagctgtccaacttccacgatattcatgttcccatcagattctccgccgagactctttgacccaccagaagtccggcgggaatcttcctttagttgttgtgcatagagtgagcctactcctgctgcaaaaaaatctagtccttcaagcactggtgtctcctggatggagtctaataacctggaccactggatgcaaatgctgaatattggtggagctcccgtggaacaacgaggagagaagggaaatttcgatgtgtcagaatctgaacgagcacagggcaaaagacagtttgctaaaagcatgccaggtatgatcgttgaaaaacgatccaggactcgaaacagggtctccaatttcc

SEQ ID NO: 2915 - DNA, 963 bp, Solanum tuberosum
  Predicted polypeptide sequence is orthologous to G1108
atctgattcttcagctacagtggaaaaactgcttagacttctcctataaagctgctgcagtccctgaattaactgggtgattgtgaagagcagaagaatttttcattctggtgaactcatacttgcactgcttaagacttttgcatcccatgtttcctatacttatctctcagtcagtggacttagatggccatttcctcattggggctacaccggaaaagccaaactaaccagtttcaattattaatggagcaagcagataaccgtagcaacaatgagcatgttattgacataactactagcaacgatgcatcctcatctagcaacccccatgatagaccagttaataatgtgcttcatgtccaagctgaacatcccccatcaacaagcacaacagtgcccgtctcccaacatgcattttcttctgctaatagatccaacttgaggaactcatcatttgctcgaagaggaaatgggcgccgccatcggagtcctctgaattccgtgctctggatatccattgaactagtcttgacaatgagccaaataattgcagcaatcgcggtgttggccatatcaagggatgagcacccacgagctcctctatcccaatggatagttggttatgcatctgggtgtgtagcaatcctccctcttctctactggcgttttcttcatagaaaccaaaattcagatcaggattcatctcagcagccacagatttcttcccaggttgaactcccggccagaccttcctcaagtacaaggagttcagaaggagaaggtcgtcagacaactgctacagcttctacaggtggtcaaagtaatgaattactgagcagaagggtaaaggcatttgttgagtacttcaaaatggcattagattgtttttttgcagtgtggtttgtggtttggcatgtatggatatttggtggacactcctcttcctctgaggctccaact

SEQ ID NO: 2916 - DNA, 824 bp, Solanum tuberosum
  Predicted polypeptide sequence is orthologous to G1108
caagacgccacagatagctcgttttctactaactgactgagcaatcttaccacctcacatgttttgcaacagaaattgtatataaatctagtaaagctaacaacatttagcccaaaagaaatcagaagagtgatggaagaaaatgaaatatatatatgaaggtaactactattcctttaaaaagcatctctatactagcatgtgggcagagtggcaacttaaaacgcggaactctgacgcaaacttgcagttgcttcggtaagagagctcaaaagggtctcacccacctcagctttgcaaaggggacatgagttgttgattttcagccacttatccacacagtccttgtggaagaaatgagaacagggtaactccctcagctcatcattgttcacatactttgccaagcaaatgcaacatgccgcatcttctcctgaaatcacacgctccttgtctgttcctgcagccacaaccccaccttcagcagcctctttgttgccacttttgtttttctttaccttaaatttataggtcggaagagcattaattgattctggtgtggcgcctttgttttgagtcagatcttctcggaagcccatgactgaaataatgcaggggaggcagcagcagattgttgcacatagaataaatggcatggcatacccgatacagctaaaggtcagaaatactatacacaacctgtacaagttgggagcctcaaagcgaagcaggagtgtccaccaaaatatccatacattggcaaccaaaaaccacactgcaaaaaaacaatctaatgccattttgaagtactcaacaaatgcctt

SEQ ID NO: 2917 - DNA, 907 bp, Solanum tuberosum
  misc_feature (720)..(720): n is a, c, g, or t
  Predicted polypeptide sequence is orthologous to G1108
ttttttttttttataacaaagtagaaactaaaatttgtgataacaagcatctctagtgtaatctcaaaagcaacatctgaggagaatggtgtgtacggagccttacccttaaatgtatttatacagagagagagggagagaagtaattggtgtgctatgtctgcttagatgatggacacttcaaaaatatcgcccggtttagatcttccaaaagctatgcattttttgaagatccaacacgagtgcaactaacatttttttggaagttctaagtaacatagctggtgaggcatgaaatgagagtatcaacaatggaattacctcttctttcaagcttgttatggattcttggtatgaactacaactatacaaactgaaattcatgtggtaaaaacagcagtagcagtagcagtagcagaagaagtaacagtcagttgggatatactctccgtggctccccatgcaacaagctagccgcgatgatctctgtttcgaccataagaaggtggtttctgcatcaccttaggattgttggagggattcctcttctacagaaggtagatctctgttcttggcatcaatttcagatttgcagagggggcaagtcgcattaatcttcagccatttatctacacattgtgtatggaagaaatgcgagcaaggcaattccctcagttggtcattgtcctcatattttgttaagcaaatacaacataccgnatcttcgcctgatatggcacgttccttctctgtgccctgcagctacacaaccaccttcctccctctcctagatttttactttcatttactgcgcagttcccatcttgtctttgaagcgctgctactttgaagtgtctgggaaagagccgttgatgggactccttgctgtgggatccttcttcactcc

SEQ ID NO: 2918 - DNA, 968 bp, Solanum tuberosum
  Predicted polypeptide sequence is orthologous to G1137
agaactgaatgccctactctactctgatgatgataatgattattccgaggatgatgaagaaacaagcactggtcactcgcctagtactatgaccactcatgatctgcgagagtggtttgacggaaggggtgaagaagttgctagttctgctgggccgattaaaaggcataaactactagatggtagcttcaatgcaccagagctcagggatactgcaacctctgcaaaagcctatacatgctccgacttagaggatgatgcacaatccagttgtggcaatggtttcgaacaagattcaggagcaccagattctccatctggaaaaaagaggcaaagacaagacaaaatccgcgaggacaattaagcattttgcaggaaataaattcccccgggagggggaaaagggaaaagactccgatgggttggtttatttgattgaaagcaatcccaattaactttgagatcccctggaagatgaaaaggccaagtccccttaaggaactttgattcttcttttgagctttcagcttgcccacttggtcatcatattattgaggttactaaatgggtatttctttcttgtaagctttctcgccttgggtcgagaaggtacgtatatagagggttttaaaattaaataaagcctgaattagagtttaaatggtggtatggcaaatgttgtgggctgatcagaatacaccataaaacaaaccagattggagaatcctttttagagtctttattccatcatttcttgtttggggaaccttggctatggctttgaaaatccagtggtcatgtcttctctttagattacggagggaacacttcttgtcactacttccataaagggttggtacattcatgagtttatatcttgacccccaagagaaaaaaagttgattctggccttgggaaatgtttttagctttgcccacataatggttcgtcgttggttgaacgacata

SEQ ID NO: 2919 - DNA, 779 bp, Solanum tuberosum
  Predicted polypeptide sequence is orthologous to G1145
gcagatttattcagacttctggagggaatatcgatgatacttccactgcaacttcttttcagcatcaggctagcataactctggcaagggtgattagtagtaatacagttgataaagtgtggggagagacatacaacaaggccagaaggtgataaatcttgaggagatgaacaatcaggagagagagctaactcttggtgagacaactttggaggactacttggtgaaagctgggcttttcgttgctgatgcttctttaggacatacaatgtcattggataatcctacggcaatgcaaaattttatgcctccaataggcttgtccccatctccttcgctgtctgatacaccagtttctgatcggaagaggggtgcttcggacatcgataagactattgataggagactaaggagaaagatcaagaatagagagtcagctgcacgctcccgagccagaaaacaggcttaccacaatgagctggtgaacaaggtgtcacatctggaagaggaaaacatgaaacttaagaaagagaaggagctggagaacttgttatccgagttgtcgtctgaaccaagatatcagctaagacgaacgacttcattctgatcgagtcctttctctagttcttttgctagtctttatagatataggattgtgtatcctctatgaaacatctaattagggagttgggagatagatattatagcttgtttgatctttgtttttatctggatatgtttagatgcacatgaaaaactgaagaatgaatggaactctt

SEQ ID NO: 2920 - DNA, 964 bp, Solanum tuberosum
  Predicted polypeptide sequence is orthologous to G1145
atagtattggtgcagctcaagctcaagctcaagctcatgcccaagacccaaagacaaatgctttggctaggcaaggatcattgtatagcctaactcttgatgaggttcagaatcaattgggggatttggggaaaccattgaatagtatgaatcttgatgagcttcttaagactgtatggactgtggaggctagtcaaggaatggggggaacggattacggggtgttgcagcatggtcaggatgcttcggggagttctttgaatcgacaatcgagtattacactgactagtgatctgagcaagaagactgttgatcaggtgtggcaggatattcagcaggggcataaaagggatagtatcgataggacagctcaggagaggcagcctactcttggtgagatgacactggaggattttttggttaaggctggagtggttgctgagtcgactccagggaagaaaagttcggggtcagttttaggggttgattcaatggcattgcctcaacagcaagctcaatggtcgcaatatcagatgcatgcaatgcatcagctaccgccacagcaacaacaacagaacacgctaccagtttttatgcccagccattcgattcaacaacctctgactattgtttccaacccaacaatagatgcagcttatcctgaatctcagatgacaatgtccccaaccgctctgttgggcacattatcggacacacaaacacttggaagaaaaagagttgcaccagatgatgtggttgagaagactgttgaaaggaggcaaaagaggatgattaagaacagggaatctgcagcgaggtcacgagcaaggaagcaggcttacacccatgaactggagaacaggtttcacgccctcgagaagagaatgaaaggctcaagagacagaaggagatagagcaggtgttaccgagtgttccacttccagagcctaagtatcagctgcgc

SEQ ID NO: 2921 - DNA, 800 bp, Solanum tuberosum
  Predicted polypeptide sequence is orthologous to G1146
gccacaacagggaggatatggtggccgtggtagtggaggagctccaccacgtggaatggcccctcagcagtcatatggtggacagcctgaatactatcagcaaggcagagggactcagcagcatcaacaacgaggtggaggaccaccccagcaacatggtggcataggtggccgtggagcaccttctggtgggccttctaggccaccaattcccgagctgcaccaagcaaccacacagactcaacatcaagctgtaatgactactcagcccataccttatggaagaccagctgacacatccatggaagtgggttcctcatctgagccccctgagatgtcaactctgcaagtgacacaacagttccagcaactggcggtgcagccagaagcagctgcaacccaaacaattccacctgtgtctagcaaatcactaaggtttccgctgcgtccagggaagggaaagtttggtcagagttgcatagtgaaagccaatcacttctttgcggagctacctgacaaagacttgcaccagtatgatgtcaccattactcctgaagtatcttcacgcggtgtcaaccgtgctgtcatggcacagctggtgcttctttaccaagaatctcatcttggaaagagacttccagcttatgatggaaggaaaagtctatacactgcagggccccttccatttgttcaaaagagttcaaaatcactcttactgatgatgatgatgggcctggtggtgccaggagggaaagggaatttccaagtgtgatcaaatttgcttcccgtgctgatctcat

SEQ ID NO: 2922 - DNA, 540 bp, Solanum tuberosum
  Predicted polypeptide sequence is orthologous to G1146
ggagggacaacgatacaccaaaaggttgagtgagaagcaaattacttctcttttgaaggtcacatgccaaagaccaagagatcgtgagaactcaattttgcagactgttcaacacaatgattataatgaagacccatatgcaaaggagtttggaatcaaaatcagtgaaaaacaagcatctgtggaagcccgtgtgttgcctgctccttggctaaaatatcatgagacggggaaggagaaggattgtctgcctcaagttgggcagtggaatatgatgaataagaaaatgataaatgggatgaccgttagccgttgggcatgcatcaacttttcacgaagtgtccaagagagtgttgctcgtggcttttgtaacgaactggctcagatgtgtcaagtatctggaatggagttcaatccggaaccaataattccaatatacatggccaggccagatcaagtagagaaagccttgaagcatgtatatcattcatgcgtaaacaagctaaaaggaaaagaacttgagcttctattggtcattct

SEQ ID NO: 2923 - DNA, 964 bp, Solanum tuberosum
  Predicted polypeptide sequence is orthologous to G1146
caatgtgtggaatatctggaatgaacttcaatccgaatcctgttctgcctcctacaagtgcacgccctgatcaggttgagagagtcttgaaaactcgatttcatgatgccatgacaaagctgcagccgctatcgaaggagctcgatctcctggtcgttatcttgccagacaataatggatctctttatggtgacctgaaacgaatttgtgagactgagcttggagttgtctcacagtgctgtttgacaaaacatgtatttaagatgagcaaacagtatctagccaatgtagcactgaaaattaatgtgaaggtgggaggaagaaacactgtgctagttgatgcaatatctaggcgaattcccctagtcagcgaccgtcctacaatcatttttggtgcagatgtcacccatccccaccctggagaggactcgagcccatccattgctgcggtggttgcttctcaagattggcctgagattacaaagtatgctggtctagtttctgctcaagcccatcggcaagagcttattcaggatctgtacacgactaggcaagatcctgttaaagggactgtgtctggcggcatgattaaggacttacttatctccttccgaagagctactgggcaaaaacctcagagaatcattttctacagggatggtgttagtgaagggcaattttatcaagttcttctttatgaacttgatgcgatccgcaaggcatgtgcatcattggagccaaattatcagcctccagttacatttgttgtggttcagaaacgacatcataccagactttttgccaataaccaccgtgacagaaatgcagttgaccggagcgggaacattatacctggtactgttgttgactcgaagatttgccacccaacagagtttgatttctatctttgtagtcatgctggcatacagggtacgagtcgtccagctcattaccatgttctatg

SEQ ID NO: 2924 - DNA, 968 bp, Solanum tuberosum
  Predicted polypeptide sequence is orthologous to G1146
gtgaaactgatcttggcattgtctcgcaatgctgcttgacaaaacatgtgtttaagatgagcaagcagtatttagccaatgtgtcccttaagattaatgtgaaagttggaggaagaaacaccgtgcttgttgatgcgatctctaggcgaattccccttgtcagcgaccgcccaactattatttttggtgcagatgtcacccatccccaccctggggaggattctagtccgtccattgctgcggtggttgcttctcaagattggcctgagattactaagtatgctggtctggtttctgctcaagctcataggcaggagcttatacaagatctgtacaagacttggcaagatccaactagaggaactgtgactggtggcatgataaaggaattgcttatttctttccgtcgagcgactggacagaagcctcagagaataatattctaccgagatggtgttagtgagggacagttttatcaagtgcttctttttgaacttgatgcaatccgcaaggcctgtgcatctttagaacccaactatcagcccccagttacgtttgtcgtggttcaaaagcgtcaccacacaaggttgtttgccaacaaccaccgtgatagaaatgctgttgatcggagtgggaacattttgcctggtactgtggttgattcaaagatctgccaccctactgagtttgatttctatctctgtagccatgccggcatacagggtactagccggccagcacattatcatgtcttgtgggatgagaacaatttctctgctgacgggctgcagtctttgaccaacaacctttgttatacatatgctaggtgtactcgttccgtctccattgttcctccagcctattatgcacatttggcagctttccgtgctcgtttttacatggaaccagagacatctgatagtgaatctgtcacaagtggagctgctccgtacaagaggtggtgtagg

SEQ ID NO: 2925 - DNA, 723 bp, Solanum tuberosum
  misc_feature (702)..(702): n is a, c, g, or t
  Predicted polypeptide sequence is orthologous to G1146
cgtactatcacagggcagaggacccagcagtatcacgagggggaggagatcccagcgtcgtggtggtatagggggccgtggggcaccttctggtggctcttctaggccaccagttcccgagctgcaccaagcaactgagactccacatcagcccgtaccatatggaagaccagcagaaacatactcagaggctggctcctcatctcagccacctgaaccaatgacacatcaagttactcagcagttccagcaacttgcatgtgcaaccagaagcaggtgcaccccaagcaataccacctgtatctagcaagtcaatgaggtttccacttcggcctggaaagggtagtaatggcactagatgcattgttaaagccaatcacttctttgccgagttacctgacaaagacttgcaccagtatgatgtttcaattaccccagaagtagcttcccgaggtgtcaaccgcgctgtcatggagcagctggtaaagctttacagagagtcccatcttgggaagaggcttccagcctatgacggaagaaaaagtctgtacaccgcagggcccctcccttttgttcaaaaagattttaaaatcacacttcttgatgatgatgatggacctggtggtgctaggcgagaaagggagtttaaagttgtgatcaaactggctgctcgtgctgatcttcatcacttagggatgttcnacaagggaggcaggctgatgc

SEQ ID NO: 2926 - DNA, 847 bp, Solanum tuberosum
  Predicted polypeptide sequence is orthologous to G1146
caagatttgtacaagacatggcatgatcctgcacgtggaacagttagtggtggcatgataagggatctccttatatccttcagaaaggccacaggccaaaagccacaaaggataatcttttatcgggatggagtgagtgaagggcaattttaccaagtactgcttttcgagttagatgcaattaggaaggcttgtgcatctctagagccaaattaccaaccgccagtaacttttatcgtggtacagaaacggcatcacacccgactatttgctaataatcacaaggacaggagcagcattgataggagtggaaacatattgcctggtactgtggttgatacaaaaatctgtcatccaacagaattcgacttctatctttgtagccacgctggcattcagggtacaagccggcctgcacattaccatgttctgtgggatgaaaacaatttcacagcagacggaatccagtccttgaccaacaatctctgctatacatacgcaaggtgcacgcgttctgtctctgtggttcctccagcatattatgcacatttagctgcatttcgagccagattctacatggaaccagacatgccggaaaataattcaggcagccctcatcaaggcagcagcaaggctatacgagagatgggtgttcgaccgttgcccgcgcttaaagaaaatgtgaagagagtaatgttcattgttaggaagaagaataaacaagggagtagcaaatgtaacaaataggtaggggttcagaccacatgcatctttctttgtatatgtatgtatgtgatcatcctaggttaatttcatgttagtttaaatgatggtaaagcggctttgt

SEQ ID NO: 2927 - DNA, 838 bp, Solanum tuberosum
  Predicted polypeptide sequence is orthologous to G1146
cttcttcttattactctttttctctctctcgttaacaatgtcggaacgtggacgaggacgtcgcggtggttctccttatggtggtggcagaggcggtggaagaacacctccttatggtggcggtaaagcgacggtcgaacacctccttatggtggcggcagaggcggtggtcgaacacctccttccgatggtcgtggcagaggatatccgtctcccggtggtcgtggtcgaggaacttattccagtggcggatcatcgagttacagtgcttctcctagttacaatgctcctccgagttacaatcctcctccgatatatcatcatcaacaaccgtcaatggcggtttcatcgatgactcgggaggttgaacaaaagctttcgcttcaaccttccacatctgcaaatcctcctgctgggcctcagcctgtgcaacagtcgtcaccgcctgttgctaccatccctgcgcatctagcgggaccgtcgacttcgacgcagccgccaaggccgccaccggtatcatctaaaaacatgcggcctcctcctagaccggattacggaaccatcgggcgaaggtgcctagttaaggcgaatcactttctcgttcaggttgctgatcgagatgtacatcactatgatgttacaatcactcctgaggttctgtcaaagaaagtgtgccgactgataatcaaacagctggttgagagctataaactttcacacttgggtggacggcgtttggcatatgatggtcgaaagagtgcttacactgctggtgcgctcccattcgctcccaagaatttgttatcctgtttgctgatgataattggtggagcaagga

SEQ ID NO: 2928 - DNA, 913 bp, Solanum tuberosum
  Predicted polypeptide sequence is orthologous to G1146
tgtgtattttcctgcttatatattaaaggcacatatataggcatataagccaccaacagaaaaaaaggtcaaaggaaataagtaaaatataattgaacatttactgtctgttgtgaccataacttcgacacacaacatgcagttgcaaaaagcatgaccatgatccacagatcaatttaaaaaataaatagattgatagtttaatttataacttaatttaaaagaagatttctactgaattcagtgatcgatgatcagtgaatttttcagcagtaaaacatgacctccgacacattttcatgaatgttaggaagtggcctgaattgtgcagctgcttgctccctggttgctgctcctccctcaccaccttcattagctgctcttacatccacgtcattctccatgtaatagcgtgcacgaaaggcagctagatgtgcatagtaggcaggtggcactaaggaaactgatcgtgtacaccttacgtatgtgtagcacaggtggttcgttacattctgaatggcatctgcggtgaaattgttctcatcatacagtacatggtaatgtacaggacgactggtacccttgatcccagcgtggctacataagtaaaaatcaaactcaggtgggtggcatatcctggtgtctaccacagtacctggcaaaatgtttccactcctgtctatcaaactacgatcatcgtgattggaagggaatagacgtgtatgatgtcgcttctgcactaccacaaaggtaactggtggcatataattattttccagggcaacacatgccttgcggattgcatccatttcttccaattaaaacctggattgaatttgtcctttcgctgactccatctctatagaaggattattctataagcgctttcgtttagtcactttgtaaaacggct

SEQ ID NO: 2929 - DNA, 770 bp, Solanum tuberosum
  Predicted polypeptide sequence is orthologous to G1198
taacaagatttgatgattctgctgtcttattttagctttttggcaaagcttgagccttttgctatagacccttttcgtctcttgaactaagatactacatctgatttttgttccaatttcaattgattacccacaaagttggctatagtccatgatggctgatatcagtcctagtacatcaacagatgccgatactgaagataagaacaggttcctaaatcaacaactgtgtgccgtagcttctgatggaagtgacagaccgaaagatcaaaagacactccgtagacttgctcaaaatcgtgaagctgctcgaaaaagccgtctaaggaaaaaggcatatgttcaacagttggagagcagcaggatgaagctgacacaactagaacaggagcttcaacgagctcggcaacagggaatatttatttcaggttcaggagatcaatcgcagtcgatgagtggaaatggagctttggcatttgatgtagaatatgcccgatggttggaagagcagaaccgacgaattaatgagttaaggggagctgttaattctcatgctggtgatgctgaacttcgcataatagtcgatggaatcttggcacactatgatgacatattcaggataaaggcggatgcggcaaaggctgacgtttttcacatattgtcgggcatgtggaaaactcctgcagaaagatgcttcttgtggcttggtggattccgttcatctgaactcctcaagctactcattaatcaagttggagccttttacccga

SEQ ID NO: 2930 - DNA, 1477 bp, Solanum tuberosum
  Predicted polypeptide sequence is orthologous to G1198
gtttgggtatatcaagaagtgtaaatattaggatttttctaccattaatttgattcaaaattgaatcttgataagattttctttatcttctttcacacaaaattgaattcatttgggtttttcggttgagctgagattttgctgttggccttaaaagtccgtacaaatgaattattcaacatacactcagtttgttgcctcaagaaggatgggcatatgtgagccgatccatcaaatgggcatgtgggatgatttcaatgctagttgtccgagtacatcggcaaccatgattctagaagttgagaaatgcctagaggaccagatacctattatagacaaaagattagacattgagacagaagatacttcgcatggaacagtagggacttctaatagatatgaagcggaaacaagtaaacccattgagaaggtacttagacgtcttgcacaaaaccgcgaggctgctcgtaaaagccgtttgcggaagaaggcctatgttcagcagttagaaaatagtaaattgaagctgattcaattggaacaagaactagatcgggccagaaaacagggtctgtatgtaggtgctggtttagatgctagccagctaagttactctggaactgctagctcaggaactgctgtatttgatacagagtatggtcagtgggtggaagagcaaaatagacaaacaaatgatttaaggaatgctctgcatcattctcaaattagtgaagcggaattacgcattatcgttgatggttgcctgaaccactactttgagctcttccgcgttaaggctacggctgctaaagctgatgtcctatatatcatgtctggcatgtggaagacatcagcagaacgcttttttatgtggattggggggtttcggccatccgaacttctaaaggttctcacaccacatcttgagctcttgacagaacaacaactccgggaggtttgtaacctcaggcaatcgtgtcagcaagcagaagatgccctgtcacaaggaatggtaaaacttcatcagattcttggtgaggctgttgcagctggccgattaggtgaagggaattattctcttccgcagatggggcctgccattgagaagttggaagctcttgttaggttcgtaaatcaggcagatcatctccgccaagaaacacttcaacagatgtcccgcatcctgaatacgcaccaagcagctcagggcttacttgccttgggggagtactttgaacagcttcgtgttttaagctcacactgggctacccgtcttcatgagcctgcctaatgatgcaatagaagatcccttagtacaccattcgacgagttttgccttcagaaattatactatgtaagctaaaatttagctcttgtttatgtcaataaagctctcaatatgaatgtaggacattaaactagttgtacaaagggtttccgagagtctattgtggcttatgtttccgagcaacttttg

SEQ ID NO: 2931 - DNA, 1466 bp, Solanum tuberosum
  Predicted polypeptide sequence is orthologous to G1198
ggaattttgattttcaagattccattcaatttttcttctatgggtgtttagaaggatttaggcttttagagttttgaagtggggaaaaaaaggtttcttgaagactttgctgttgttggctttaagtccaaaggcaatgaattcttcaacatatactcaatttgttgcctctaaaaggatgggtatatgtgacccaatccatcagattggcatgtggggagatttcaaaggtagcagtttcccagataccttgattcttgaagtcgagaattgcctagagaacgagatgcctattatggagaaaagactagagaatgagatagaggaaccatcacaagtgactgttggaatgtctaacagatatgaacctgaaacaactaaacgtattgataaggtgcgtagacgccttgcacaaaaccgcgaggctgctcgtaaaagtcgtttacggaagaaggcctatgtccagcagttggaaaatagtaaactgaagctgcttcagttggaacaagaactagaacgtaatagacaacagggtctgtatgtaggtgatggtttagatgctagtcagataggttgctctggaaccgcaaattcaggaatagcttcttttgaaatggagtacggccattgggtggaagagcaagatagacaaacagatgatttaaggaatgctctgaactcccaaatgggtgaaatagaattgcgcattcttgtcgagagttgcttgaatcactattttgatctctttcgcttgaaagctacagccgcaaatgctgatgttctctaccttatgtctggcacatggaagacatcagctgagcgtttcttcttgtggattgggggatttcgcccctccgaacttctaaaggttctcacgccacatgtggaaccattgtcagatcaacaaatccaggaggttagcaacctcacccagtcttgtcagcaggcagaagatgcgttgtcccaaggaatggtaaaactccatcagattcttgctgaggctgttgcagctggtacactaggcgaaggaattatccttccacagatgaccgctaccattgagaagttggaagctctagttagatttgtaaatcaggcagatcatcttcgccaagaaacccttctacagatgtcctgcatactggctgcacaccaatcagctcagggtctccttgccttaggagagtactttaaacgtcttcgtgctcttagctcactttgggctggtcgtctttctgaaccggcttaaagaagtaagaaacaaccattatatatgctacctggggttttcaactttgccaatcaaagctgtgtgaggtaaaatctgcctcgtgttgctcgtaaaaactatgagttggcgctcattcagacactacaaatctgtatataagttctgctatgctgtaactggaacttggaaattgcgtttattttcttttcacattggttttgatgattgtaaatca

SEQ ID NO: 2932 - DNA, 975 bp, Solanum tuberosum
  Predicted polypeptide sequence is orthologous to G1198
ggatcggggtcaatggggcgatcaataagacctatggcctaggcttgtgacctccattgcactttggaggggtgcttgcctaaggtcggcccaagtggtcgagcctacgtcataatttgttacagcgggggcctgcgttcgcgcggcccctgcccaaatccttggcggagacattagctaacggatctcctgctactgaagggtcatcaggagatgtagctaattatatgggtcagatggcaatggctatggggaaattagggactcttgaaggttttctccgtcaggtaactctatttttgctgctgcttcctattctttgtttgtttaaattgtttacaatagataagctgcaaatgctcgttcagttgtttgaacatgtggaagtcgggggcaagcaaatgttgttctggaggtctttgtaactgcaaccagcatgcattgcccacagaatcttcagaatgtcttgtttgtattggtctttggacaaaaagtctggatactttgtcctcttgtatgtcctttaatgaggtcataaaataactgaagggttatgttcgccaacacattcttaaatcaacaattgtccttctgtctcatacttgtaactctcttgtgaattatatgattcaagacagccagtcatgttcagagatttctggtttgttatattagttttatgtcgtctctggaggcaaaatacgtgaagctaaaagtcattgcatctttctgactcttttaacaggcggacaacctgcgtcaacaaacattgcaacaaatgcatcgcatattgacaaccagacaatcagcccgtgctctacttgcaataagtgaatacttctcacgtcttcgagctctcagctctctttggcttgccagaccacgagagcaataagtatgacatgcatcgcaatactctactgaaactcggatatactacttcgatacactggccagtatatgagatccagctaa

SEQ ID NO: 2933 - DNA, 980 bp, Solanum tuberosum
  Predicted polypeptide sequence is orthologous to G1198
gtttagcacaaaatagagaagcagcaagaaaaagcagactaagaaaaaaggcttatgtacaacaactagaaacaagtaggataagacttgctcaactagaacaagaacttcaaagggctagatctcaggggattttcatgggaggtggtgctactggtcccaatatcagctctggtgcgtcgatgtttgacatggaatattcaaaatggttagatgatgatcagagacaaatatgtgagctacgtacagcattgcaagcacatttaggagatggtgaacttagaataattgttgatgcttatattgctcattatgatcacatttttttactcaaaggagttgctgccaaatccgatttctttcacctcctcactggtatttgggcatctcctgccgagcgcgggttcctttggcttggcggttttaggccctctgaccttatcaagatgttgattgcacaattggaccctttaacacaacaacaaattgttggaatttatagtctccaacaatcatcacaacaggctgaagaagcactttcacaagccttagaacaattaaaacaatctttaattgaaattctagccactggttctgtcaatgatggcatgcatcatatggctattgcattgggaaaacttgccaatctcgaaagcttcgtttatcaggctgataacttgaggcagcaaacgatacaccaattgcacagaatattgacaattagacaagcagcaaggtgtttcatgatgattggtgaatattatggtcgattaagagccttaagttccctatgggcatcacgtcctagagagactatgatggcagatgacaactcttgtcaaacaacaagtgagttgcaaatgatacaagcatcacaacaccatttctcaaatatgagatgataattattcatttctgatatctctataatatatattaattaatattactcttttatctgtaaatgtataaatcatttt

SEQ ID NO: 2934 - DNA, 994 bp, Solanum tuberosum
  Predicted polypeptide sequence is orthologous to G1198
cccttcttctttgtataattccataattcaattttaattttcttgaaaaactccaatttgcagaagagtttctttgtacttatgaacagtctatgaacatgagttctacatcaactcaatttgcccccacaagaaggatgggcatattcgaaccgttccaccatatgagtatgtgggaagacgcgtttagaggtgacattatgcccagtgttggtgcgtgtatggtcacaccggcaaatgacagggcagatgacaagtcgggatatacttctagtgaccaacttataccctctggctctgaggataatcaagcaggaaagagtgtttcagacaaggtacagcggcgtctagcacagaatcgtgaagctgcacgtaaaagccgtatgaggaaaaaggcttatgttcagcagctcgaaaaaagtaatttgaagctagcacaacttgaaatggaacttgagagagctcgacagcaaggactgtacattttaggttcaaatggtaatatgggcctaagttcaacaattaatccaggaatagctgcatttgaaatggaatatagtctctgggttgaagagcaacaaaaaaagaacgtagagttgaggaacatattgcaatcccatgtaagcgaagtggagctccagttgctggtagaaaccgtcttaaaccactactacaatctcttccgaatgaaagctgatgctgcaaaagctgatgtgttttacttgatatctgggatgtggagaacttcggtggaacgctttttcctctggattggaggattcaagccatctgaactcataaatatcgtgatgccacaacttgagccattgtcagatcagcagatcgtgaaaatctgtaatctgcgacactgttgtcagcaagctgaggatgctctcactcagggaatggataaacttcagcagactctggcacagaacatcctaactatgaccactggaacgggaaagtacagttctcagatggtttctagtat

SEQ ID NO: 2935 - DNA, 844 bp, Solanum tuberosum
  Predicted polypeptide sequence is orthologous to G1198
cattcacacaactttcccaaaagtggagcaaaagctctagtataatagtcatgggctgagctcacagaacatttagctgaatggatgcaatgggtgatcgggaaggccctaggcttgtgagctccactgcactttggaggggtgaccgccggccagcacaagtcgtccaagcatcgcagttggagcaaaactttcagcgagcacctcaacagggcgaaagtgatgccgttctgcagggcccttaccatttgatatagaatatagtctatggttggaagaacacaccaaacacatcaatgaattgaggattgctgtcaattcacatgcacgtgatcctgaactgcgaagtattgtggatagtgtcattgcacattacgatgatgtctttagggtgaaaggaaatgcagccaaggcggacgtattccatgtcttgtcagggatgtggaaaacccctgccgagcggtgttttatgtggattggtggcttccgcccctcggaacttcttaagggcctgtagcatttgatgcagaatatagtcgatggttggaagaacacaccaaacacatcaatgaattgaggactgctgtcaattcacatgcaagtgatcctgaactgcgaagtatggtggatagtgtcattgcacattatgatgaggtctataggatgaaagcaaatgcagccaagggtaacatagagcatctcttgtcaggaatgtggaaaacccctgctgagcggtgttctatgtggattggtgacttccgcccctccttactgcttaagcttctagtcattcaggtggagcctctgaccgaccaacagataattggcattgtcaacttgcagc

SEQ ID NO: 2936 - DNA, 755 bp, Solanum tuberosum
  Predicted polypeptide sequence is orthologous to G1198
atgagaattttttttccattaacaaacaacaaacatcaattgcaaccaacagccagaaggatgatacttgtacatacaatgaacaacgattaactaaggaccatcttcgaataggtaactaacacacctagtacaagaaaatagctaagactagataatagtatacagataactaattgtgctcaagatatctcgaggcaatgtgagtcgagatagtacacgagtactatacgtttgtcattgtgtgattccgagtgaaagacttttgaaagttgtgaactactatataatgacttatcttcacaatttcaaaggtgtaggaaatgactatgaataggaggaaccttgtagggatgagtacggcgtactagagttggtctttggggcgtgctaaccacaacgagctgagtgctcgaagccttgacatgtaatcacttatgacaaggagggctcgagcagcttgacgagtagtcaagattcgatgcaattgttgcaaagttcgttgtcgcagaagatcagcctgatgaaggaagctctcgagagtggcaagctgcctcattgcaattgccatttgccccatatagtcagctacatttcctgagccagtagggccgagagacgtagatgaaagtgtatcaacgagtaattgttgcagggcttccataccttgtgatagggcgtcctcggcttgctgagaagactgttgcaagttacatatgcctatgagctgctgttctgtaaacggttcaagatgg

SEQ ID NO: 2937 - DNA, 722 bp, Solanum tuberosum
  Predicted polypeptide sequence is orthologous to G1275
ttcttcctataaatataaataattgtacataaatagaacaacatacaatatttcttataaaattaataaaagtcttgattattctcctcaagaagatcaataggaagaagatgactcattcaaaaagttgtttgctggcttttcattgcagtaaatgataaagggactttcatgattgtgttttccttcatatgtagtcatcaaatatcttgaatcatttccatctctttctacctttttctttactttgcaatctccacttgaacacttgtagtaattccttagatttatgttggttttcactttctttttcccatatttcctccatttgtatccatcatccaaggtctcaagttgtgtctttgttctaaaagcaattgcatgtttttcacctttcttttctttctcaatccccatgcttgaattttcatgattcatgtgtacatgtgttggtgtggcatcaaatgaactagctgatgatgagtttccactagtactataggtactagtacttatctcttgtttcatgaagagattttctgaaaaaattgaagcattattgtagctattatttgagtaattggaataatattcttgatcaccatcaactaacaaatcaagaaataaagtgtcataatcttgatacttattattattactattgttatggccataatcttgattcatgttgatgagaggatcatgaaagcaaaagaataggg

SEQ ID NO: 2938 - DNA, 742 bp, Solanum tuberosum
  Predicted polypeptide sequence is orthologous to G1275
tttctatcttttctttcccttcacaatggaaaattttccatatagctcatcaaaccctaaccctaatttcatcgatgcatcggagaattttgagctctcagattataattatctctttcttgatgatggatcaaatgacgattttttgtcacaaaatgaaattgttcaaagtgtttccgatagtagtggatcatattcaaataatcccactccaacaagtcataacataaaatgtatgaaaggtgtaaagaaggtggatgcaaagtctagggttgcatttagatttagatcagagttggaggtgttggatgatggatttaaatggaggaaatatggcaaaaagatggtcaagaatagttcaaatccaaggaattactacaaatgttcaagtggaggatgcaatgtgaagaaaagagtagaaagggacaatgaagattcaagctatgtcattactacttatgaagggattcacaaccatgagagtccttatgtgtttcactacacacaattccctcccaacaatattgcccttcacaatctttgcctttagaaccttttaaacgtgtcagtaaatttcagttatatatttgtataatggtaggttctaatagaccactttgatcatatgataaagtgtttctattaaacattttcgacttatgttttaaaaaaatgtgtgcacgtgttttcaagtgcccgatatatagataagttaatcacataaaatatgtctctttctttg

SEQ ID NO: 2939 - DNA, 343 bp, Solanum tuberosum
  Predicted polypeptide sequence is orthologous to G1275
aatcatgtagaggcggattcagaatttgaattgaattttcatcgtcgaggagggaagagagtagaaagagatcatggacatgattcaacctgtatgattactacatatgaaggcaaacacaaccatgaaagttgttcctctatcatatgcagccatgaaatgcccactgaatttcctcaatgaatggactttgaaaacaacttcataatttccataaaaagcaatcgggatccctttgtaattttcttgtacaaatataacataggacattatattatatacatacgtttaattatttcatcaattatatcgtgtgacatgtaaaaaaaaaaaaaaaaaaaaa

SEQ ID NO: 2940 - DNA, 955 bp, Solanum tuberosum
  Predicted polypeptide sequence is orthologous to G1275
gttatttctctccaaacacaatgaactccaccttcctagaaacaaacattcctcatatagaaaaccctaatttcacctttccctttctttactcacacatgactaatcaagattgtacttacaattttcaagatacttttcttgatcaagattttaaattttcttcatttcttgatcatcttcttgttgattatgttcctacctataacaactccaataatactcctcttttagaaattaatccctccatgcatgaaataagtagtagtagtagtgccaatagtgcaagttctaccacttccttttatgcaccaccaccaaatattaatcacttgaaagaaaaatccaaagtggggattataaagaaagagatgataaaaaagaatgaaagacatgttattgcttttagcacaaagactcaacttgagattttggatgatggatataaatggagaaagtatggcaagaagaaggtgaaaagtaacacaaattatttgaggaattactacaagtgttcaattcgaggatgcgaggttaagaagagagtagaaagagatggacatgattcaagctatttgattacaacatatgaaggtaaacacaatcatgaaatcaactcctttatcatttacaatcatgtagaggcggactcagaatttgaattgaattttcatcgtcgaggagggaagagagtagaaggagatcatggacatgattcaagctgtgtgatttactacttatgaaggcaaacacaaccatggaaagttgtttcctctattcatttgcaggccatgaaaatgcccactgaatttcctcaatgaaatggacttggaaaccacttccttattcccttaaaagcaatcgggaatccttggaatttcttgtccaaatttaccttggcaattttttttttcacccgttattattcccatataccggtcctttaaaaaaaaaa

SEQ ID NO: 2941 - DNA, 461 bp, Solanum tuberosum
  Predicted polypeptide sequence is orthologous to G1275
tttttttttttttttttttatataaaactctttaaatatagcattatacagtataaatcctgttggaagcaggaaaagagtacatgccaactgaaatgttctaattgatttcattttaagttacagatagacgcctccatctgactccagtcaagctggaacaggttaggagatccaatttactggcctgatttagctaagctacagtactcatagtaactttgaactgatctcttcttcatcgatcagaacggggatggaccttgatggttgtggacaccctcgtaggtggttatcacataccgagaatcctctttgtctcgttcaactctcttcttcaccggacaaccttccacggagcacctatagtaattcctgtaagttgatacacaaaacatgctcatgtgagttataataagtagttatcatacaagtttccataagctgctatagagcaaaag

SEQ ID NO: 2942 - DNA, 897 bp, Solanum tuberosum
  Predicted polypeptide sequence is orthologous to G1290
cggctttctcctcatcttttccctttttctctgtcccaattcctcatataattcctaactagctagctatcccttgttcaatttcttttctctccccaaattcaatggctctttcttcctaatgatccctctatttcccctttctcccattaacatacagaacgtatgctctaatggatagtagaactgctttttcggattcaaatgatattagtggaagcagtagtatatgctgcattggcagcatgaacgaatcggaaacttcaccggcagacgtcaattccctcaaacgtctatcagaaacactagagtctatcttcgatgcgtcttcgccggatttcgacttcttcgctgacgctaagcttgtggttccaggcggtaaggaaattccggtgcaccgatgcattttgtcagcaaggagtcctttttttaagaatatattctgtgggaaagataggaagacgaagctggaactcaaggagctgatgaaagagtatgaggtcagttttgatgcggtggtcagtgtgctcgcctatttgtatagtggaaaagttaggccttcacctaaagatgtgtgtgtttgtgtggacaatgagtgcttgcatgtagcttgtaggccagctgtggccttcatggttcaggttttgtacgcatcctttacctttcagatctctcaattggtcgacaagtttccagagacacctattggatattcttgacaaagcctgcagcagacgatgtaatgatggttttatcccgcttgcaaaaccatttggccgttaaaagcattgttggaagagattagcttttcaaagccctgtcctttgaagattatttgtccacgtcttaattgttggatatccattaacccttgaataaagttccttgcctccatgg

SEQ ID NO: 2943 - DNA, 681 bp, Solanum tuberosum
  Predicted polypeptide sequence is orthologous to G1290
gaagcttcattatctcttgctatggcaggcgatgatttgcgtatgaagctgttataccttgaaaatagagttggtctggctaaactcctttttcccatggaagcaaaagttgcaatggacattgctcaagttgatggcacgtctgaattccccctggctagcatgaggaagaagatagctgatgcacagaggacaacagtggatttgaatgaggctcctttcaagatgaaagaggagcatttgaatcggcttagggctctctctagaactgtggaacttggaaaacggttctttccacgttgttcagaagttctaaataagatcatggatgctgatgacttgtctgagatagcttacatggggaatgatacagcagaagagcgtcaactgaagaagcaaaggtacatggaacttcaagaaattttcgctaaagcattcacggaggataaagaagaatttgctaagactaacatgtcctcatcttgttcctctacatctaagggagtagataagcccaataatctcccttttacacaaataattttgtattagagatatgagaaaaacatagactctttttttcttttcatcatttgatgcgttatacatacaaacacatgtaccataaacttgtattgtgaaacaaaagcatttacatgctaaaacagaggaaaaaaaaaa

SEQ ID NO: 2944 - DNA, 929 bp, Solanum tuberosum
  misc_feature (834)..(834): n is a, c, g, or t
  Predicted polypeptide sequence is orthologous to G1361
ctttttcttcctcttctcttttcttttctctctttgtactggtttcaacacagcagcacaaaaacagtactccattttcatctaaacagaagagaattagaaactacaaaaaaaaaaaatcaatcaaattaaattagggatcgatgttagtagaaatatggcatggtgcagtcaatcaacagttctcccaataatatcatcatcagatcaggaaaataatgttattatgatcaattcaaaaactagattcataacttgtccttcatgtggacacaacatacagcttcaacatcagaggggaatactacatgatttgcctagtctaccagctggagtgaagtttgatccatcagatggagagatacttgaacatttagaagcaaaagtcctttcagatacccataaaattcatccccttattgatgatttcattttgaccattgatggacaaaatggtatttgctacactcatccacagaaattaccaggagtgagcaaggatggtcaagtgcgtcatttctttcatcgtccatcaaaagcatacacgacggggactagaaaacgtcgaaaggtacacactgaaattgatggtggtgaaacaagatggcacaagacaggtaaaacaaggccagtttacataagtggagttctcaaaggttacaacgaaaattttggtactttatacaaattatggtaggcaaagaaagcctgagaaaacaaattgcgtaatgcaccaatatcacttaggtgaaaatgaacgaagaaaaagatggagattagttgtttcaaaagtttctaccaaaaaaacctagacttgtggatcattacacatanaaaaaccacttggatcacagcaacaatattattattaaccctgttctttaaaacaacgaatttcggcgaatattataatcctgaatctttcaatt

SEQ ID NO: 2945 - DNA, 681 bp, Solanum tuberosum
  Predicted polypeptide sequence is orthologous to G1421
gccgccctaaccccaccgtcttcgccaccgcagctgttcgccgccggtagcttttcacggcagtaaagtcttaggtaccccgagagctccccaactcttctatatgctcagatactaaagatctatgaagccacagagagagattcagaaaatcagaattactggtttgtctgagagcttttgagtttcttttcaagctatggcctccaaggatgaacataaggaaaatgaggcagtcgaggaaccctcagaaattcccagagatgaaaaatcgatcaacccagtgggtgaaagttctgttgtcttgccgcgtgttgtgcgtatttacatgccagacagtgacgccacagactcatctagtgacgaggaggaaaagcttcaaggagagaagtccaagagacatgaaaggacgtgtataaaggaaatcatcattgagaatggaaagaccagggtcatttccaagaagacgtccaaagagaagaaagatataaagctgttccaagaaaatgcgaagaagtacaaaggagttagacaacggagatggggcaaatgggcagcagagatccgagacacaaaaaacaaaactcgactttggctgggcacttttgacactgctgaagaagctgctttggcttatgattaggcagccattgaaaatcagagcatgacctctaggggaga

SEQ ID NO: 2946 - DNA, 976 bp, Solanum tuberosum
  Predicted polypeptide sequence is orthologous to G1421
tgtctctctaaaatccccacactcatgtttctctctcttaataatcagcatctcactgtttttcaccattcaaaaaggactaaaaacatcatcaccttattcaaccatttggattcattactgttttttttctctcttataaactctttggtacttactctattttgtagttcgatttctttttttaatcgtctcaggctttgttgttctccgtgtgtgggactgactgtgggtgtgtttctccttttataatctcatcttttaatgttttgggtcttttttttgtcagtgaatcatcgtgttttaagcttctctttgacggttccattgctcgttctcatcttttaagagtgctacttttagtggtgtcactctcaaaagcacctttcttggctcttttttctccattctttctaatcggtttggcttagcagtgaaaaatagctaattcaggtttattcgatggatcatcatttgttgtgtccgatcaaatacaccgagcaccggaatgttatcaggaaagttactaaaccatctttggtgaaatcaaaaaaattcccagaagccacaaaatcctctcagttcaatccctctgttccgaggactgttcggatttctgtgacagacccagacgcaacggattcttctagtgatgaagaagacatgctttttggacggcgacgggtgaaaaaatacatcaatgaaatcagtattgaaaccgccgtcaagtgtgaagttagcattcctaacagtggcaatggcaaaacggtgaataaaagagcaccggagcctcttcagactaagcagaagccaatgaaagttcaacctcctcaatcggctggcgctgttaggaagttccgcggtgtgcgtcaacggccgtggggcaaatgggccgctgagatcagagacccggctcgccgtgttcggctttggttgggaactacgacactgctgaagaagctgctatggtttatga

SEQ ID NO: 2947 - DNA, 931 bp, Solanum tuberosum
  Predicted polypeptide sequence is orthologous to G1421
ttttggtataccatgacggaaaattcagttccgttgattaaattcactcaacacatagtaactacaaacaagcatgttttttctgagcacagtgaaaaatccaattcagagttacagagagttgtgaggattatacttacagatgccgatgctacagattcttccgatgatgaaggccggaatactgtacggagagtgaagaggcacgtgacggagatcaacctcatgccgtctcccaaatcgatcggcgacagaaaacgaagatcggtttcgccggattctgacgtcactcgtcggaaaaagtttagaggcgttcgtcaaaggccgtggggtcgttgggcagcagagattcgggacccgacccgtggaaaacgggtgtggttgggaacttatgataccccagaagaagcagcaatcgtttacgataaagctgcagttaagctcaaaggtcctgacgccgttaccaattttccggtatcaacaacggcggaggtaacggtaacggtaacggaaactgaaacggagtctgttgccgacggtggagataaaagcgaaaacgacgtcgctttgtcacccacctcagtcctctgtaacgatgattttgcgccgtttgataatctagggttctgcgaagtggacgcttttggtttcgacgttgattcacttttccggctgccggattttgctatgacggagaaatactacggcgaagaattcggcgagtttgactttgacgattttgcccttgaagctcgatagtgtacgaggggctatttcatctatttttgcaaatgggttcacactggttagttgactggtgacgtggtatttttggcgggaatatatatagtgattagcagtctctattcatacgaagactttgtgagagatttttgtttttatttttctgttaattgtggtgaacattgta

SEQ ID NO: 2948 - DNA, 574 bp, Solanum tuberosum
  Predicted polypeptide sequence is orthologous to G1421
ttttttttttttttttttttaagaacatcccagtaagttgggaactaaccaagtttaacactaatgataatgtacagcaaaatagtaaagcagtttcaaatccctggcatcatctgtgggtaaagatgatggctaaaacaagtagatctcccccttcagaagcggatgcagctttagtttaaccgttaacaggttcaaatgaacctagaattcttcacatggtacatagatgtatatgtgaaaaactactaaaagttcaacagatattaacttttgaacctcataatttcaaaggtgcaatggatccgcctatggaaggttgaaccaatcaagtttaactaacctatggatccgccttctgtctttttagtggtggcacgatgaagttgatcttgatggggttgtttttcttcgctggtggcttgaggatgtttgtcagagcattggcacctcttatttcaatggctgccttgtcatatgccaaagcagcttctaaagcagtgtcaaaagttcccaaccaaagccgagttttctttcttgtatctcgaatctctgctgcccacttgccccattt

SEQ ID NO: 2949 - DNA, 695 bp, Solanum tuberosum
  Predicted polypeptide sequence is orthologous to G1482
gaagatccagtgtgatgtgtgtaacaataatgaagcctctgttttttgtgttgctgatgaagctgctctttgtgattcttgtgatcatcgtgttcatcatgctaataaacttgctagcaaacatcaacgtttctctcttattcaaccttcacctaaacaaatacctatttgcgatatctgtcaggaaagaagggcttttttgttttgtcaacaagacagagcaattctatgcagagagtgtgatgtttcaatacacaaagctaatgaacatacacagaaacataatagatttctattaactggtgtcaaaatttcagcgaattcttcgctttatacttcatcagaatcagcaccagcaacttcatgtagtacgaatcaagattctgttacgaatttcaataagtctcaaatttgcacaaaaaagactttgcctgtttctggttctgttcctcaacaagtgtcagtggcagctaatattggggaaaatagttacacaagtagtatatcagagtacttagagatgttacctggatggcatgttgaagaattgctgaattcctctacaattcctactaatggtttctgtaagattggtgataatgatgtgtttccgatttgggatactgagattgagagcacaatgaattcattctcaccagaaaatttaagtatttgggtgcctcaagcacctccac

SEQ ID NO: 2950 - DNA, 872 bp, Solanum tuberosum
  Predicted polypeptide sequence is orthologous to G1482
atcccccggctgcaggtttcctctcacttatagcaacaatcttgatccatcaaaataaaagagaggctataatttaaatttaaatttgaattcaaatgaagattcaatgtgatgtttgtaacaagaaggaagccgttgttttttgtacagcggatgaggctgctctttgtgatgattgtgatcatcgtgtccatcatgttaacaaacttgctagcaaacatcaacgtttttctcttcttcaaccttctcctaaacaagctcctatgtgtgacatatgtcaggaaaggaggggtttcttgttttgtcaacaagacagggctattatgtgtagagagtgtgatattccaatacacaaagcaaatgaacacactcaaaaacacaatagataccttcttactggtatcaaactctcaggcaaactctgatctctactctggctccatcacaattacaatcacaatcaggcaatttcctccggcggatttgtgtgtttcaaatttaaagtctcagaaccccattagtaagcctgttgctgtgtctgtttctgtttcctccacgaatactagcaacactaagggaggagcagtatcatccggttgtgagaatccaggtgacaggttgttcaaacgagcaaagttgggtggatgttaataattaattgtgcaaattctggtgaatgggaggggggaaataacttaaacaaggtagtattatcccgatctttagcagaatgtttgcctggtttggcgcacgttaagaatttcctggaattgttcaactccctaactgtttaatccagcactattgggtgatgacgcaaagtgtcaattgggaaacgaactttaaaatcaattaattctttccaccccaaa

SEQ ID NO: 2951 - DNA, 914 bp, Solanum tuberosum
  Predicted polypeptide sequence is orthologous to G1482
caaagattactatacactttcttagatctcaccagcaatcccctgaatcccaagaactcccaaatctcagtctcagatctcaatcatttaccatcaaagctgttaaatgcagtaatttaggcaaattttcttgaattccttgaattgggggtgtcttgcttggttggtggcccaatcggttaactttacaacattcacagaattaattcaggaattgttgtacaattcaaaccttttaattgcccaaggaaaccaaacctggccctttaaaggttcgcaagacattgtgattttgggcaatcctccaaagttccacgttgccgccaattgcaatttggcaaagggcggatcctccttgttgttaatttaacgccccgaagaatatgctaacattggttccaaaacgcacggatattgcattttaaaacgcgttatgaattgtcacatgcattggaaagaaattcactttgaatcttagattatttgacacagacgaatttccggtggactgaacaatcggcctccaagggggttccaattcctaaattgtttgttataccacctttccaacgccgccattacccattctctggaattaatggcggctccggtaccacacaaggaaagccttctaccttatgtacattggcaaactatttggtgaaaccaaattcctttgggttaaatggtccctttgaagaaacccggaagggaagccttggggctttactcttttgcagaggagacaaccaagtggtccctctttaataattcccggggtattgtttgttggcacacagccgggttcccttttggctaattgcaagctttgtccgaattcccccgaaccgccattaggctccaccaggaagaatttacacagggcgctgagaaaccccttttatgtttagggg

SEQ ID NO: 2952 - DNA, 810 bp, Solanum tuberosum
  Predicted polypeptide sequence is orthologous to G1482
ttttttatttttttttttttccaatacctaatcttaagtttccattcataggattcataaaaaaaaaagatatttacatcaacaaaaagatccttgcactaagctagtacgaggtacaacaaacttgagattttaagaactacaacaaagccaattgtagcaaaaagataagggccatcatcatttttttgaggttcaaactcaaccaaaaaaaaagacgaaagtgatgaacaagttagagaaaaagattatagaagccttctcgatttgttgcttgtcatccttgcatagaaacatcagtataaaattggaacgatacagagaagatcatcgttcaaattttctaccaaagagttcttgatctcttgaaagaagtggaaggtggcttcatttgtgggacagcaaatgagttctcatctgtccactttctactggacttgatgttagtaacttctcttgattcttttaggccaattttcccaccaaagttcaaattttgtgaaggaaaaaaattggatctgagtctcttgctttgactctggaagaggaggggcttgagggacccaaataccaacattttgtggtggaaaagaactcaattgactctcaagatcagtatcccaaaatgacaacatatcctcatcaccaaatattcttggagtaaacattaggagttgaacaatcaagaaaatcttcaaccgtgccaacccaggcaacatctctaaaatactctgatatactacttgttcaagttattccccccttccattccaccaatttgccacattatttattacttccaccaaattt

SEQ ID NO: 2953 - DNA, 913 bp, Solanum tuberosum
  misc_feature (639)..(639): n is a, c, g, or t
  Predicted polypeptide sequence is orthologous to G1560
tattactttgtcctacttctttctccctcttacccatactccaaattaatattaaccctatcttttctcatatattcacaaactcttttattaccttgccaatttcctctatcttcttaactttgacattgactcaaaataatatactatctttataagcatatttgttgaagaatcaaagcatggatgattttggaaatttaataaaagaagagtttgatggatcatttttgattcctcaaccaaaggagtgtcttcatgagaatggacctccaccatttcttacaaaaacatatgaacttgtggatgatccaagtagcaacgacgtcgtttcttggagtagaggtaacaatagtttcatagtatgggatccccagaacttggccattaattttcttccaaggtatttcaagcataacaatttctcaagctttgtcaggcagctcaatacttatggatttaggaaagtaaatccagaccattgggaatttgctaatggaggttttttgagaggggaaaagcatctcttgagaacaattaggagaagaaaaacaagtaatttcatcaagtcgtcgtcgtcaattaaccaaggtatggattcttcaacatcatcatcatcatcatcatcatcatgtgtgngagttgggaagctttggatcattcgatggagaaattgatgaattaaggcgcgacagcaggttctcatgattgaacttgttaaaactttaaacagcgtccaaaaggcttacaaaaatccaccaacttcaaggttatggaaacaaaaagcttccaaggggacacgaaatcacaccagggacgaaaataactgagtttcttgggcaaaagcattacaaaattccaaaacttttgttggacgcaaataatggcaccaaacagggataagcaaggaaac

SEQ ID NO: 2954 - DNA, 1383 bp, Solanum tuberosum
  Predicted polypeptide sequence is orthologous to G1594
gagtttctctcccttttaaaaaagaaaaaaaaaacacaacacccacttcaaatatcaaacaaatttctcatttgattatttctaagtgatttacactactttgtatttttgtttgtttttttttagatatatatatggatgatgaaatgtatggttttcattcaacaagagacgattacgcggataaagctttgatgtcaccggagaatttgatgatgcaaactgagtacaacaatttccacaactataccaactcgtccatcttgacttctaatccgatgatgtttggatccgatgatattcaattatcatcggaacaaactaattctttcagtactatgactcttcaaaataatgataatatttatcaaattagaagtggaaattgtggcggaggcagtggcagtggtggtagcagtaaggatcataatgataataacaataataatgaagattatgatgaagatggttcaaatgttatcaaggctaaaatcgtctcacatccttattatcctaaattactcaacgcttatattgattgccaaaaggttggagcaccagcgggtatagtaaatctgctggaagaaataaggcaacaaactgattttcgtaaaccaaacgctacttctatatgtataggagctgatcctgaacttgatgagtttatggaaacgtattgtgatatattgttgaagtataagtccgatctgtctaggccttttgatgaagcaacaacgttcctcaacaagattgaaatgcaactaggtaatctttgcaaagatgatggtggtgtatcatcagatgaggagttaagttgtggtgaggcagatgcatcaatgagaagtgaggataatgaactcaaagatagactcctacgtaagtttggaagtcatttaagtagtctaaagttggaattttcaaagaaaaagaagaaagggaagctaccaaaagaggcaaggcaaatgttacttgcatggtgggatgatcactttagatggccttaccctacggaggctgataagaattcactagcagaatcaacaggacttgatccaaagcagatcaacaattggtttataaatcaaaggaagagacattggaaaccatcagagaatatgcagttagctgttatggataatctaagctctcagttcttctcatcagatgattgagtttgaatggaaattgtgaaaatactgctcttcatttctctttttattatatataatatataaatagtatatttttgggaaagaaagaagttattttattaatcaaaatctctataaataatggtagagattaattaatgttgaattcttcttgatcatgtaaatattcaatctagctaattgtcaaaattaatgcttacctaaaaaaaaa

SEQ ID NO: 2955 - DNA, 936 bp, Solanum tuberosum
  Predicted polypeptide sequence is orthologous to G1594
gggtttaaagaaacgtacttccatatatatacagctaagtatttttaattacaagttgttgttcacatactgtgtaactgtttgatgatggatgaattgagcaaacttcattctgctattgtatgttcacgcagtagacaacaacaacaggctgaggctgaggctgaggatgaggctgggccgacaattattaataacactcatactagttttgctattcatcattatcgtcaattagaagccgctgatcatcaaaataatactaaatccagcaccaatatgtcagatcttattaaagctcagattgcaaatcatcctctttatcctaacttactttctgcttaccttcaatgtcgtaaggttggagcaccgcaaggaatgacatcaattctcgaagaaattagcaaagagaacaacttaatatccagctcatatcacagtagtgaaattggagctgatccagaacttgataagtttatggaatcatattgtgcggtattagtgaaatacaaagaggagctttcaaagccgtttgatgaagctacaagtttcttgaataacataaagtcacagctcagttccctatgcaaagataatttaattacttcaacaagtttcaacaattatacatctgatgaagcaggtggtacctcagaggaggatctaggctgtgaggagatggaagcagcggatagtcctgctaaccgtgaaggcgataatgagctaaaagaaatgctgatgcgcaaatatagtggctatcttagcagtttgagaaaggaatttctgaagaagaggaagaaaggcaagttacctaaggaagcaagaattgtattgctggactggtggaatactcactatcgatggccttatcccacggaagaagagaaaaataggctatcagagatgacagggctagaccagaagcagataaacaac

SEQ ID NO: 2956 - DNA, 880 bp, Solanum tuberosum
  Predicted polypeptide sequence is orthologous to G1635
atttcttggaatattggagcttaatacggattgaatttgaaggtgactgttgatatttctgggttttgggaactgaagagaattgattgggtaaaaactggtttcttctattttaggggaaagtaaaaactttggcagcagttgttagtgattttggctcaaggagtactgatttgattcagcagaaatgactataggggatcaaagtgagtcggacacgatacttccaagtaggaatagaatgtcagttgatgtgggagctccttctccaaggagcatccagatggaagagcaagttattccaggagaagaatatgctcctaagataagaaaaccatacaccatttcaaagcaaagagagaggtggtcagaggaagagcacaaaaagttccttgaagcattaaagcttcatggtagggcatggcgacgtatagaagagcatgtgggaaccaaaactgcagttcagattagaagccatgctcagaagttcttttcaaaggttgttcgtgaatcgagtaatggtgatgcaagctctgtgaaatccattgagatcccacctcctcggcctaaaagaaagccaatgcacccttatccacggaaaatggtaactccacttaaaagtggaaccctggcttcagagaaattgaataggtctggttcacctgatctctatctctccgagccagagaatcagtctcctacctctgtgttgtctgcctttggttcagatgcatttggcacggtggattcaactagcccagtgagcagtcatcacctgttcatcagctgtcgctgagaattctgggtgatcttggttactttccttgaaaccattcccgcttttcatctgtacaaggaagagcaaatctttcaccctggc

SEQ ID NO: 2957 - DNA, 946 bp, Solanum tuberosum
  Predicted polypeptide sequence is orthologous to G1655
atctctctctacataatccttctctcctccgccacctaccgctgccgtctccgccgccaaactcacaactcaggtattgttttatgtgctttagtttctgtttctcgtttgtgagctgattttcaatttattttttttgtttttttgaacggagattcctgagaatcaaaatattagagtttcaattcaaggaggagtatcatgttactactgccttatgtgtataggtttattttgcatctatttacagaagagaagcaaacgtaccattcgcgagaatcattccgaattttgcatcagaaaattgttccttctgatggcgtcatctcaaaccgtctcgaatcccgatgttaactccagtcactcgcgagaatccaagcgcaaaaagagaagaaaaattgtagatgctggggaaattgagcaacaaacaagccttgatcaatccaggtggagaactgataccgagcaacagatctactcttcaaagcttctccaggctctccgtcacgtccgccggagtaatgataatccgtctccggttaatgccggacgcgccgtcagggagaccgccgacagagtccttgccgtcacagctaagggaaggagtcgttggagtagagcgattctcagtggccgtctcagcctcaggcttagccaaatcaataaaaagcataagaaagctaagctgaacagcggcaatataaaatcgaaaaaaccagcggcgaagaagcgattgccggctttgcagcggaaagttcgtgttctcggccgtttagttcccggttgtcagaaactcccgtttacgaaccttctagaagaaactaacgactacatatcagctctacagatgcaaatcaaagccatgacttttctgaccggtctgctctccgccggtggagcaggatcagttgccgctcaccccgatcggctcggctaagtggctcgt

SEQ ID NO: 2958 - DNA, 557 bp, Solanum tuberosum
  Predicted polypeptide sequence is orthologous to G1662
gatcaagttgaagagtaaacatgttggtggagctttttctaagaataacaaatgtaagctctcccctatattatcattgttttcaattttttcatttcccttgatagatttgttcaataagcgatgtacttcattcagaggcgaatccagaattttaacttgatgagttcaacatttaagacacttagtgacttttcacatacattcaaccctctctataacgtcattagtccagatattttttaactgctatagcgagatgctattttacagaatatataatataacataataagaaagtcggttgccaagaaaacttggccgttatagtaaaatgaacaagatgattgttatagagaagtctggctatatgtatttatgctcccctatctacaaaaatattgggttcagttgaactcttgtagcatccgcctctaacgtcattcattatgcaacaggtgttgtatatgaagtatgtgatgaaagtgaaccatggctattcaacaaagagattgaaagcctagatttgtaccttagagtaaagacagctcatggtc

SEQ ID NO: 2959 - DNA, 784 bp, Solanum tuberosum
  Predicted polypeptide sequence is orthologous to G1662
actgaagattttagtctctccaattattaagtacaacttacatctgaagtatcataaaacagacaaaccaagaactatctcaaacatttttatacataaaataacacaaaaaatgaaaaactaagttagtctaaaagctcttgttgattttcaacattgtcattgagccctcagtatcttcatataaactggttttatcaagaagcttctgaattccatcaacccatttttgtttatggcttttgttcttgcacttgaactctagaagaccctgagctgtctttactctaaggtacaaatctaggctttcaatctctttgttgaatagccatggttcactttcatcacatacttcatatacaacacatttgttattcttagaaaaagctccaccaacatgtttactcttcaacttgatcacaacctgagatttcttgtttatataaacagaaacgcgcttccatcgttgcagaccttttcttgtgagatgcagcaattcacccgcaaacagagaatcgtgttcatccatctcattagggaaaacagcagcaaaactttgagcttccaccatgcttctgtcacaaggacttattgatgcattcctctttgcttcttttggtaatcttgacttaagagttgcttctcctctcaaagctgtggcagctgcagctgttagtgtgacaagatcactagcactatgtatgtctacagctgatctaacaactgaagctacacgatcatgatccgccccagctgattcagccatttcaaggcatgtgaggcc

SEQ ID NO: 2960 - DNA, 711 bp, Solanum tuberosum
  Predicted polypeptide sequence is orthologous to G1798
agcttcacttctattctatacttagcctcattgatataacttgcaaacataaaacttgtcagtttttaccaattttgagatatggtgagagggaaaacacagatgaggcgtatagagaacgccacaagcaggcaagttactttctcaaagcgaagaaatggtttgctcaaaaaagcttttgaactttctgttctatgtgatgctgaagttggattgattattttttctccaagaggaaaactatatgaattcgctagctccagcacgcaggagataatagagcgatataagaggcatactaaagacagagttcaacctgaaaaccaagctgggggacaacatctacagcatatgcagcatgaagcagcaaatttaatgaagaagatagagttccttgaaacatcgaaaaggaaattcttgggagaaggtcttcagtcatgtacccttcaagaagtacaacagatagaaaaacagttggagaggagtgtcagcaccatccgggcacgaaagcttcaagtttttaaggaacaagttgagcgactaaaagaaaaggagaaaatccttgctgctgaaaatgcaaaactgagggagaagtttggtggtcttcaacagagagaaacaccaagtgtagagaaggaaggagaagctctttgtacagatggtagcgaaaaatcagatgttgagactgaattggtttataggaccacccgg

SEQ ID NO: 2961 - DNA, 876 bp, Solanum tuberosum
  Predicted polypeptide sequence is orthologous to G1798
gatgcgcgggagaaagaaagaccaaacacttcagcctaacgggaatgagcaacgacaaaatgagaagatgaggtgcctcgggcaccctatttagaaagaagggtcaaaggttttgggcatgtagctttccccgtctccccttcgtcgggcggtgcttgtgtggagggtgcgccatactctttgggaatagggactataactaatgcaattacagcatgcagaagataattgagagataccgtgcacgtgcaagagaaataatgacggtggacaaaagcactgaactcgagcactacatggagaacttgaagcatgaaacagctaacatggcaaagaagatagagatccttgaagtttccaaacggaagctaatggggcaaggattagggtcatgttcaatggatgaactagaagacatcgacagccaactggagaggaccctcaaaattatcagggctagaaagactcaattgttcatagacgaaatagaacgtctaaacgcaaaggagagactattgctccaacaaaatgcaagtttacgtgaaaagtgcgggcttaggccaatgctattagagtcagcacccacacctgcacccgtaccagcaccaccaccaacaccaccagctcaagcgaaagaaagaggaaattgtagccaaagtacaaagagttgggaagtggagactgaattgtttattggcattcctcaaatgcgctgcttatagtagctcggttagtggctgagctagcattttttcatcaaaggaatttaaaatctgaagaagtaagcacacaaagaaggcaaaaggggttcaaagtctactctatatacattaaaagataaattttaacaatgtaattttcactgaaggaaaatca

SEQ ID NO: 2962 - DNA, 794 bp, Solanum tuberosum
  Predicted polypeptide sequence is orthologous to G1798
ttttttttttttttttttttaaaaaaaaaaactatattaaagtaatttagtttttttattacaaccctataaattataattacagtactggtaatataaaacttgaaacaccagcaattttcacaattaaagtgatgtaggtggtgtgtttaaattaggacaatatgaattttttctagtctctggaagtccaataaagagctctgtctcaacttccattatttgtctttcaacatctttctctacttgaggaaatggtgtcaaagtcaatggtagcacctcacaccttttcctcaagtctgcatttttcttcaatagaattttttcctcttccttcagttgagcaatctgttccttgaataacagattctttcttgccctaatgttgcttaaacttttttccaactgttcttctacctgttgaagttcatccaaggtggaagattctagaccatgtcctaaaagctttctcttagagtcttcaagaaattcaagctttctagtcatggttgcaacttcctctttcaaatgctcagtggttagttgatcagttaattttctgttgagtcttcccaggctcttgtcattcttctgatagcgttctattgtcttgtttgtactggaacttgagaactcataaagctttccttttggagaaaataccataagagcaacttcagcatcacataaaactgaaagctcaaatgcttttttagaagcccacttcttcttttgagaacgtcacttgtctaccttgttgcttttcaattctttcaactccatttttcctctca

SEQ ID NO: 2963 - DNA, 848 bp, Solanum tuberosum
  Predicted polypeptide sequence is orthologous to G1844
tttttttttttttttttttttttttttttttttttatggactaactgtcacccttacttttgatataacctctaatttacatagtcattgcattacatacaagttatcgagacgctgcagcagcatctctttatttatccttacacagtttttcagtgtttcaaccataccaagacaacatacaagagaagactacatagtagcacaccctagttagatgcagcagatataacctcggcaggacatatcccacggcaagaggagtggctgctctgctatattttgggaaggctgttatttatatcttgagcttctatctgatatgtgatgccttcagtgtgtttagactctagagaaaattcagggtcaccctctgttgtccacaatccatatgggttggtgcaatgttatttaaattcattgccatctcattttcttctctgttctttatggtacctatctcatcctccagaactttgttttcttctatcagctgcttttccttgtcatgaagattcttaattgattcaatcaacaagtgtgtctttctaaatctggtttgtgtcagagcagtctcgacttggttttccaaatggacaagatcagtaatgctcagatcatcaacatcaggctccttgatttgttttctaccgtctgtagcagttcttccattctccatgaaactttgcagggggggcccgggtaccccaaattcggaccttataagttgagtcggtaattaacggcgcgcttccaattgggccgtccggttattacaaaaccgtcgtgaacctggcgaaacaacacttggcgggtaaccccaaattaattcggcctctggcagaaaa

SEQ ID NO: 2964 - DNA, 753 bp, Solanum tuberosum
  Predicted polypeptide sequence is orthologous to G1844
ataaaactcatagcactttatgaaattcgtgaaagtgaaatggaagatggaggtacaaagcttcttatatacggccattttcatttgtgagaattagttagggtttgggagtttgaagaaatgggaaggaagaaagtggaaataaagcgaattgaagataagagcagtaggcaagcaactttctccaaacgaagaaatggactcatgaagaaagccaaacagctctctattctctgcgatgttgatgtcgccgtcctcgtcttctccagccgtggacgcctctttgaattctccagtaccaacagtctgacaggagttattcaccaatataacacccacatgaaagcagaagataaggtctctgcagaagtcgatgacacagaggaatcaaaatatgcaagtttcatgagaatggaagaactgctacagacggtagaaaagcaactcaaggagcctgatgttgatgatctcagcattactgatcttgtccatttggaaaaccaagtcgagactgctctgacacaaaccagatttagaaagacacacttgttgattgaatcaattaagaatcttcatgacaaggaaaagcagctgatagaagaaaacaaagttctggaggatgagataggtaccataaagaacagagaagaaaatgagatggcaatgacatctaaataacattgcaccaagccatatggattgtggacaacagagggtgaccctgaatttcctctagagtcttaacacactgaa

SEQ ID NO: 2965 - DNA, 814 bp, Solanum tuberosum
  Predicted polypeptide sequence is orthologous to G1844
gaacccaagagatttagttggagtgaagagagtaaaacaacaaaaatggttactctgtaacaacacacacaaaaaatagagctgggtaggagtaacggcgatcatactagaaacttctagacatctgaaatctgtggattagggcttttctccggcgaaaaaatggggcgaaggaaggtagaaattaagcgaattcaagacaaaaactgtagcaagttgctttttgtaaacggaggaaaggtctattgaagaaagctaaagaaatttccgttctctgtgatgtcgatgttgcggttgttatcatctccaatcgtggcagactccatgaattctccagcaataacagtctgacagaaacacttcaacgatatgaaagccacgtcgaagcagaaaaagagagctctgcagaaatccaggtgccagagcactctatatactcagggttcacaacaatgggagaactgctacaaacaacagaaaggcaactcgaggaaactaatgatgatgtctcggtgtgactgaccttatccatttggagaacgaacttcaaactgcttcggaatacaagtcagatctagaaagacacatttgttgcttgaatctgctaaggtcttcatgagaaggaaaaactgctgcaagagaaaataaacatctggaggacaatatagctagtatcaagaaaaacagagaagtgaatgagatgtctatggatttcgccgacttttcagcagcgccatataatttgtggaccacagaaatgacgctaaatttctctataatgcattgtacgtgtcaaataatcctttgtaaaggc

SEQ ID NO: 2966 - DNA, 826 bp, Solanum tuberosum
  Predicted polypeptide sequence is orthologous to G1902
ttcaaatttcaaatctatttataccctgtgtcctcttttttctcgattttctgaaagatttcaactcaatttggtggaaaattggaggtatagatcttcagaaatcttgttttcatatattcaggaaattttaatagcgccttctaaagaagttgttttcgtttgaaaaatatctattcctttttgtcctctttttagtttcacctttgctgtttcgccacttctcagaaacccataaaggccagaaaaatcactctttaacaacaaatttggtttcaattctactatacccttatcatttttaaggtcaaaattcactatactcctttttcatcattgaatcaatatgcaagacccatcaatttattcacaaattaagcctcaattcccagagcaagaacacttgaaatgccccagatgcgattcaccaaacacaaaattctgctactacaacaattacaacctttctcagccacgccactattgcaaaagctgtagaaggtattggactaaaggcggtactcttcgtacatcccagttggtggaggctctcgtaagagcacgaaacgatcttcatcatccagtaaaaaaagttcatcaactacaacctcatcccctgcaactcctccattaacatccccttcttcatccacaaatccaaaaccagagccattcggtatatctgcaattccatcttttgatgtgatgactactgggccattcagctcactgttagcgtcaaccgagcccgcatttgggaatttttctcgagctttgatccccataataacagttgggtaacccaatttcagttcggccttggttc

SEQ ID NO: 2967 - DNA, 586 bp, Solanum tuberosum
  Predicted polypeptide sequence is orthologous to G1911
atgtctcccccttcttgttcttcttgttcaattcattactaaaatggccacaaattgttacaacaaaacaaaacaagaagtttgaagaggcaattgttatgtatgacaaagacaataatggtgaaaaatggcataatatagctagatatgttggtggaaaatctgttgaagaagttagaaggcattatgatcttttgataaaagatattactcaaattgaaaatgatcaagtccctttgcctaattataggactacttctgatcaaaccaatgctagaggttatgctaatgaacaaaggcttctgaagaatttaaaactacagtgagcagaaatttggactcataagtcaacaacagtcaaagacatatttatccaaatgtgtcagtttataaaattccaaaaatttggaatctttaattaattgtaaattcatgtttaattaagtgtttcttatcttatgtattaattaaattattgttgcccaattaagagataagaaaaatgtgtacgtaactaaatgtttttcagctttaaatgtacctttatttctgcataagttatcatcctataatatataaatttgag

SEQ ID NO: 2968 - DNA, 491 bp, Solanum tuberosum
  Predicted polypeptide sequence is orthologous to G1911
ttcacgtttcatacttataaaaaaaaaatgacatcaaattcactcactgcttggactccaatagaaaacaagaaattcgagcaggcactcgcggtctacgacaaggacacatctgatcgctggcaaaacattgctagatacgttggtgggaaatcagttgaagaagttaaacatcactatgctatccttgtagaggatcttaagcacattgaatctggtgacgttccattcccaaaatacaagtcaggtcgttagtctattacaggcgtacgaggtataataccagtcaaagtcaaagatatgtggacgaattacatacgtggaaagacatatttttctctcaagattatgaatacactaagctattattttcttcttagatctagtgagatgtgttagtgttatcattgtataaccctgattattatcgtttcgaattaacgagcataatataattttatggacgctacgtaaaaaaaaaaaaaaaaaaa

SEQ ID NO: 2969 - DNA, 897 bp, Solanum tuberosum
  Predicted polypeptide sequence is orthologous to G1930
cttcctaattttccttttctcatcaaacaaatcaacacacacacacaacaaaaaaagtttaaaaaaatggaaggaagtattagtagcatagatcaagagagtactactagtgactctctctccattgctccggcagcatcgtcgtcaacgatgataaaatcgttgacgacgataaaaccgccgccggagagcggcctttgccggatggggagtggtacgagtgtgataattgatgctgaaaatggtgttgaagctgaatcaagaaaactcccatcttcaaggtacaaaggtgtggtcccacaaccaaatggtcgttggggcgcacaaatctatgaaaagcatcaaagggtttggttaggcacatttaacgaggaaaatgaagccgctagggcttacgacgtcgcggcccagagattcaggggccgcgacgctgtaacaaatttcaaacccttgcttgagaatcaagaaagcgatgacatggaaatcgctttcttgaattcgcattccaaggcggagattgttgacatgctacgtaaacatacgtacctcgatgagcttgaacaaagtaagagattatttggatttactaaagatggtatgataaacagaaaaaatggacaaataattagttcgatttttggtagtacaaatgataaagtcaattgcaaagcgcgtgaacagctatttgaaaaggctgttacaccaagtgacgttggaaagcttaataggcttgtgataccaaaacaacatgctgaaaaacattttccattacaaaatggaaataattcgaaaggggttttgttgaatttcgaagatttgaatggtaaagtttggagatttaggtattcgtattggaatagtagtcaaagttatgttttaacaaaaggatggagtcgt

SEQ ID NO: 2970 - DNA, 989 bp, Solanum tuberosum
  Predicted polypeptide sequence is orthologous to G1944
tgatgcaccatcagattaccatgtggcacctaggaccactgaaaatcccagtcaagtttctggatcagcacctcaaataatgactattgcaccaactccggccaccggtgccggcgccggagcactggcgttagtgaagaagaagagaggtagaccaagaaaatatggaccagatggagttgctgtaccgtctacggcggcagcgctttcgccgaagccgatttcgtcggcggctcctgtgtcgtcgccggtgattgatttctcatcggagaaacgggggaaaatccggccggtcggattagttagtaagcctcatatgcctaagttggaggttgaaaattcaggtgaatgggtctcatgctccgttggtgctaattttacgccccatattatcaccgttaatactggagaggatgtcaccatgaagattatatcattctctcaacaagggcctcgagcaatatgcattctttcagcaaacggtgtaatttcaagtgttacactgcgtcaaccagactcttctggtggcacattgacgtatgaggggaggtttgagatactgtcattgactggatcatttatgccatccgagacaggaggaatgagaaacagatccggaggaatgagcgtttctctagcaagccctgatggacgtgttgttggaggtggagttgcgggtctactagttgctgccggtcctgtccagattgttgtggggagcttccttgctggaaatcaacatgaacaaaagacgaagaaaaacaaattggagcctataacagctgctgttgttcctctatctagtccagatattgaagaaccatataatcagtcttcagcaaaacctactatgcccgcttcctcgattaactggtcatcatcgttggcaactgagtcaagaagtaagacagctgacatcaacataacgttgcctgcataggagtccgtccgtcccttttctattgatctcacatccatttgttgtttaa

SEQ ID NO: 2971 - DNA, 925 bp, Solanum tuberosum
  Predicted polypeptide sequence is orthologous to G1944
caaagtacaaaatgtggcatttaattaagaggatgaatatgcctgttaaaactagacataaaccattaaaacactaagaacctagaccgttgtaaccttcgtaaccaaagcgtcacgaaaacatcataaatctaaaactctacagccaaacaccagaatagcaaaggctatctagaaaactagtttggattactgcacagagacctcaaacaaacatcaaataggaggtgagaaagatcaataggaacctcgttaaagacgcgtagtccttatggtctagtaaaatcacattcaaatttcaccctatgctggaagagttacatttatttcagctggtttattcctagaatcaggggctgaccaattatctacgcggaaagaagaggaagttggtgtagtttgttttactgaggagtgataagggtcttccgtctcgggtagaggaacagcagcaataataggctccggtttgtttttcttggttctctgttcatgttggtctccagcaagaaagctgcctataacaatctgcacaggactggcagctactaatagaccggctactccgcctcctacaacacgcccatcagggctagctagagatacactcattccaccagatctgtttctcattcctccagtttctgatggcataaatgatccagtcaaagacagtatctcaaaccggccctcatacgtcaatgtgccaccagaggagtctggttgacgaagtgtaacacttgaaattacaccatttgctgaaagaatgcatattgctcgaggcccttgttgagagaatgatataaccttcatggtgacatcctctccagtatttacagtaataatatgaggtgtaaaattagcaccaacagagcatgaaacccattcacctggagtttctaaatcaactttaggttgctgatgt

SEQ ID NO: 2972 - DNA, 970 bp, Solanum tuberosum
  Predicted polypeptide sequence is orthologous to G1944
aatttcaccaactctctcaagaaattttgaaagcacaaaaaaaaaaattaaaaaaaaaaaaaattctttccattttcataaaattagtttgttcttttaagttctgttctttcttctgcagtaacagagtatcagttagtcattagatttgcactgcacatggtcagatgatctttctttagatacaattaattctagcatttgcagatttgctgagtttgtacttctcttggtattttgcttgttatatattttagcatttgaaaaaagattgtatttttattagtatttgttattatggggttttgagttcttgaaaaacaaatatatttttgctgttttgggagcgtaagttatttggagttgtcttaagggtttaaggggttttgagttcttgagtacaaaaatctttttgctgtttttggggcttaagttatttggggcttaaggggttttggttattttattattgtgtatatgcatggaggagaaagaaggagttaatagttctggggttacagttaaaggtgatgaagctcctgagagctacagagtggttcccaggagtgaaagtaataatattgagtttagtggatcaattgtagcaacaacacctgtaaatgtgacagaagagacgaagaagaagaggggtagacctaggaaatatggaccagatggtaaaccagccgttgcattatcaccaatgccaatatcagcttcaattcctcttgctggagatttttcagcttggaaaaacagtggaagtcgccccgttgattcctttaagaagaagaacaagtttgaggtcgaaactccaggggaggagatggcatactctgtcggtgcaaattttacaccgcatgtgatcactgttaatactggtgaggatgtcaacatgaaaataatttcatttgctcaaacaggatctagagctatttgtgtgctggctgcaaatggtgcaatttcaaat

SEQ ID NO: 2973 - DNA, 963 bp, Solanum tuberosum
  Predicted polypeptide sequence is orthologous to G1944
tggtgacaaaaagaaaagaggaagaccaagaaaatatgatgctgatggaaatttaacacctcaatatataaaagctgctgctgcagcagctgctaaagcagcagctgcagtaggaagtggtggtggcggtgtcgtcggcggagctgtcacttcacctggaggtggtggagtgacatcgccgccgactggttttactataacgtcgccggtactttcttccggtggcttttcttcatctaaaagaggacgtggaaggcctactggtgctggtaacttgcaattaattgcttctttgggtgaactgtttgctcacactgctggaggtgattttatgcctcatgtggttactgttcatactggagaggatgtggcaggaaaggtatattcttttgtgcagaagggttcaagagggatctgtgttctgtctgcaaatggtgctgtttcgaatgttacgattcgtcagcctggttcttctggaggtctattgacatatgagatggtggttggaagtttcatgccaaacgcttttaaaacacacaacaaaaggaagcatcatcagatcgaaccaagaatgcctccagtcatccacagctctccggacccggtttcaatgataagacctgtctcacaagcaccaccggcgagcaacattactcagactcagacatctcaaataccaatccacaaccacggtgaagctgacaacagcacgagcaacaaagacatgccgaattccacctctacagacacttctgactgtaatggatctgaaccaacattcgagcagagatcatatccagatattaacgtgtctatacctatggagtaaagtaaagctcgacgaatcgaaccaaaacttgactatagttcttttctgcttagctgattccttgttttgtgcttgtctgtgctgattgtaattttgaggaatcattagggactgctttattagaaacttttttt

SEQ ID NO: 2974 - DNA, 888 bp, Solanum tuberosum
  Predicted polypeptide sequence is orthologous to G1944
atttctttctctcttttttttcttcttttttcagtttgtaaaattttgatctgtgacatagaaaagtttgcaaagcattaatagctgctgaaaaaaatggagtcaagggaagctatgaatgctggagttacagtgatagctccagaagctccatcaaactatcatatggcatcaagaacagaatctactccgttaccacccggaacattggctgtgattacccctccggtagctactgcctttacaattagctcagagaagaagaaaaggggacgtcctaggaagtatgggcctgatggggcagttgcaaggacaatttcacctatgcctatttcagcatcggcgccaccaacctccggcaacttcttgtcggagaaagtgagtgttgcccgtcctgcttcggagaaaaagcctcgaaacaaagttggggctgaaaatttaggtgaatggatttcatgttccacaggtggcaactttttgcctcacatgatcacagttgaagctggtgaggatgttaccatgaagataatctcattttctcagcaagggcctcgagctatttgcattatttctgctgttggtttgatatcaaatgtcactctacgccagccaaattcatcaggggggaactttaacttatgagggtcgatttgaaatcctttctttgtctggatcctttactccaacagagtttgggggttctcgtactactagcaaaaccggaggaatgagcatttctttggcaagtcctgatggtcgtgtagtcggaggtacacttgcaggactgctaatagctgctagtcccgtccaaggttgtaatgggaagttttctaaccaaagcacttaccaagaagggccaaggccaaagaaaacaggaaaggcagaaac

SEQ ID NO: 2975 - DNA, 734 bp, Solanum tuberosum
  Predicted polypeptide sequence is orthologous to G2226
cactgtcccaatttggatcctatgaatctccttcaacacatcaacccttaaaaaaagaaaaatttctcttccaaaatcttgtaaatcctattttctcttgtcaatattacaaaaaataataattgtaaacaaaaagtttcaagttttcatattattagatccagtatattgagctctttcaaaagtttttgaagatataatcatcatttcaacataaggttccgatccattatgggcctctcacaatatccaactccggcagatgcaggagtacttggtgtgattctagtaaacacagccatatccatctccattatcaaggagatactccgatcgatccttcgtgtgattggcatccgtatcgcatcatgggaagactattctgttgaaggacccttggactcacttgaatgccgtggaagcccaccagagtcatacatggaggagttcagaaaccgaacacctgcatttcgttatgactcgctatgtatctctaaccaccctgaacaagaatgctctgtgtgcctgacaaaattcgagcctgatgcaggggtaaacagtctctcatgcggtcacgttttccataagctgtgtctaagagaagtggctcaagtattggcatgtaacttggtcctcctttgcagaaattacttgatgtctccaacaaagaaagaggacgatacgtgtccgaatgtggagattaaacgtttaacggtgccacttcatcccatttg

SEQ ID NO: 2976 - DNA, 508 bp, Solanum tuberosum
  Predicted polypeptide sequence is orthologous to G2226
tttttttttttttttttttggagaggacgaaaagcattaataagctacaggactacaccatgtactataatgtacaagtttttggtcacacgaaagagacccgtcactctgaagaggacgcaaagttttacaaacacaacaagcgtacaggactaaatcatgtacaacaagggtattaaggttttgtgtggtcacacgaaagagacccggtcactcatggagaggacgcaaagcatcacaaatatgacaagctaacaaactacatcacatcaaagatcaatgcatccacatactcaggctgtacacaactaatgctgtaaagtgataccatcatcaaatggatgaagtggcaccgtaaaacgtttaatctcacatcggacacgtatcggcctcttcttgtagagacatcaggtaatttctgcaaagaggcacaagttacatgccaatacctaggccacttctctagacacaagcttatggaaaacgtgaccgcattgagagactgttt

SEQ ID NO: 2977 - DNA, 923 bp, Solanum tuberosum
  misc_feature (137)..(137): n is a, c, g, or t
  misc_feature (429)..(429): n is a, c, g, or t
  misc_feature (721)..(721): n is a, c, g, or t
  Predicted polypeptide sequence is orthologous to G2226
ggatgaaaagaaaaaaagactatttttttatgcagttcttggatggtccagttcactcagctattccagaagttgttgctagtagaaaatctcttagtttcagcctagattccaatccagtatgggcctctcacagntatccaactccagcagatgcaggagtgctctgtgttattctagtgaacacagccatatccatctccattgtcaaggagatggtccgatcgatccttcatgtgattggcatccatattgcatcatgggacgattattccatcgaaaggtccttggaatcctttgaatgtcgcagaaaaccatctagagatcatatatggaggaattcagaaaacatatacctctggaatcgggatgagtatcacaactcgggtactcttatacactgcgtgagaaacgagagcgccgcgctgnctcgacaggaggatttgagagcccatgtcgtgagataaaacacactctcatgtggggcaccgtgtttcaccaagacactcgtgctgagaacagggggcccctactcgggacgtagacaaagtggcacacctgcgaggagagaacactgatgtgtccccaaaaggcgcgaagaaacatgtgccatcgtcgaggtgggagagaccatcgaccgcgcgtgacactacgatacaaacctctgtcgggaggagacatgcgcgtgcgaagacaccaacaaatgtacgagccacacgcngctacatagcaaaacagcaggggaagcgacactgcccagaaaccggagataacatgcagacagacacggcgccgttaatgcagtggcgggcgctccccacagaaggagggcgctactgtggggcgacaatgacatcacaatccgggcgcctaatataacgcaaggaaagcgcggagggtttctccacacagaaaaaaaaaac

SEQ ID NO: 2978 - DNA, 652 bp, Solanum tuberosum
  Predicted polypeptide sequence is orthologous to G2226
gcatcatgggaagaatattctattgaaggccccttggacccatttgagtgtcgtgggagcccctcgggatcatacatggaggagttccgaagcagaacccctgctgttcgttacgattcattgtgtatatctaatcaccctacacaagaatgcccggtatgtctggcagatttcaaccatgacgcggagataaaccacctctcatgtggccatgtttttcataagctctgtctcgagaaatggctaaagaattggaatgtcacctgccctctctgcaggaattacattatgcctaaagaaggtgaggaagatacttgtccgatgtgaattttgtagtttgtcaggctactccttctgtttgagatgttctgatgtacagcttagttgggtaaaagttttatagatgactgcctgatcgttgagacggcataattctgtaatcttttatgctgtaatactctgcgtcctatcatagtgacgggtctctttgttgcgaccaagaatccatacattgttgtacatatgttatgaaattgccacttcctgatgttttccatctctggcttagctagcaaccttataagggaacattttaatgcttgattgatatggtgaaatgtcacatattcctaaaaaaaaaaaaaacaaacag

SEQ ID NO: 2979 - DNA, 829 bp, Solanum tuberosum
  misc_feature (406)..(406): n is a, c, g, or t
  Predicted polypeptide sequence is orthologous to G2291
tcaaaaagctgaaccattcttcttctctacacaaaaacctctttattacccaaatgaaccaaatcataatttctccattgacaacactaattattccctcgacccattttgggataattactctgtttctgctaatgaaaatgaaaatgaaaaatcccctgttctagaaggaattgctgctgttgttggagaacatgttcttttcggttataataacaatgaaaacaagaatgatgatccaaattcagcagtttcaattctgaaacgcacgtgtcctgcagaaaagaggaataataataataataatgttccatcagtggagaaaagttacagaggagtgagaaagaggccgtgggggagatggtcagcggaaattcgcgaacgtatagggcggtgcaaacactgngctgggtacattcgacacgccggaggaggcggcgcgtgcgtacgacgcggcggcgaggtggttgagaggttcaaaagctcggaacaaatttccaaattcctccgattgttcctctggctacttcaccaaacatcgaacgtcatccatcttccaattccgcctccgtggaaattggaaccattggaaacatggaaaacaggaaaaaggacccattgttcgcctattaatcaaaagaaaatgctcagtggtaacttcaactgcgcatttatttagctctaatgaatttaacaaaaaagttagtgttactgtggagcttgatctcaagctcggattcgagaggaagtagactcaactgctataacgaaacaactacttcctattattaatgtttagttttgtatcgtaaaaaaaaaaaaaaaaaaa

SEQ ID NO: 2980 - DNA, 882 bp, Solanum tuberosum
  Predicted polypeptide sequence is orthologous to G2520
tgtcctaaagacatacaacaactctgttcctgatcagaaacaagctattatctacctataaatcaaggaactgttatatattttggcagttcctgggggaagcattagcctcctaagaatttattagcctttgatgcctccgattatttactttatgtcgttctttcaaatccaccacctatctgcatgtgcaaccagtctggtgatgttcccccagcatattcccttgtaccttgtgaaccaaatgccatagcgtttgtctcgaatgtttgctgcccaaagtctttagtaggaattccatcgatggttggggttactcttgtattaactgcttcaagcttcattgataggaactcaacctggcgttgtaatgattggacataattgattatctcatcaaggacaagagcttttccaataaccttgttacaaccagggaccaagtcttgtaggattttcatcctgtcactaatcttttctcttctggctctttctgctaggctatgactatcggtagcttgacctctcctcgctcgcacatggatgtagtccttaggtggttcagctggtggctttgcaggttggtctgaagattttcctgaattccctcctcctgaatattccccattctcgtttgatctcgtggccttcagccgcttactatcagattcagtcaaggcatttgcactagttgaaactccaatggcagattcatcatcgtcgcgtcgctttctggcggcgtgatttgttgtgtggtcgagaagatgctgatagggccagatctccgccaaattaggcgcagtttgaaaggcactcattatagtagaatgaggatccattagagaaatgctaataatgcatatataattagcatagtaatgt

SEQ ID NO: 2981 - DNA, 975 bp, Solanum tuberosum
  Predicted polypeptide sequence is orthologous to G2520
ggtcgctattatacgccagtagatacagtacgcaccaacaacttccattttcgtacacgcagagcttctatatatatcttctctcattcacatttcctacgtgaatgcctaatacttcaccattcgcttcggatttggattgggtattgaaatggatccacaagcttccatgatgaaccacgccggaggttttcagtctccgccgtttaatttatctgagatctggcagtttccgatcaatgcaggtgaaggcgagacgccgtatagttttccgtcgtctgcggcggcggcggcgcagaatgtgagtgatgttcggaataatgatcccatggttctagaccatagaacaactaattacagcggcggcggtggtggttcagctaggaagcgaaacgaggatgatgaatcagctaaaggagtttccactagcggcaatggcttgactgaatctgctagtaagcggatgaaggttacaagatcaaatgagaattgcgaatctagaggtgatggggaagggaattcagggaaatctgcagaacaacctgcaaagcttgctgaaccaccaaaagattacattcacgtgcgagcaaggaggggtcaagctactgatagtcacagtctagcagaaagagctagaagagagaagataagtgagaggatgaaagtcctccaagatatagtccctggttgtaataaggttattggcaaagctcttgttcttgatgagataataaattatattcaatcattacaacaccaggttgagttcttatcgatgaagcttgaagcggttaattcaaaaatgccaagcatagaaggatatccatctaaagatttcggacagcagccatttgatacaaatgctatgacatttggttcacaagctactaggggatatgccaggggaacatcaccagattggttgcatatgcagcttggtgggaggatttgaaagaacaacataaatctgcatca

SEQ ID NO: 2982 - DNA, 407 bp, Solanum tuberosum
  Predicted polypeptide sequence is orthologous to G2520
agtgatccccgcgctgagtaaaagatctagcacatcagctttggatacactggaatgattttcggcactcaagcaccgagagaatatgctcaaggggcacaatccgagtggctccatatgcaggttggtaacagctttgacagagcaacatgacagataccctaatgaattggaacatagattattcaggaacatcatgatgtcttttagagaaccttggtattggatccagcagcactatagaagaaccattcttaaatgtgtaatcataatcatttccagtagaattgtctgtattatcgttgtatgatcaatgtcctctaactcaagtgtacttgtaatatgtttgtattgatataagaaatagcctaagcaaactttctcagaaaaaaaaaaaaaaaaaaaaa

SEQ ID NO: 2983 - DNA, 1095 bp, Solanum tuberosum
  Predicted polypeptide sequence is orthologous to G2574
tgcgttgctactttttagctaatggccacaattgttacttcttggttttgtaggttcaaagatgtgccgaagacatgtcaatattgatcaccacatatgaaggaacacacaaccatactcttcctctttcagccaccgcaatggcttcaaccacctcagcggccgctagcatgctgttatccggttcatctagttcatcagacccaaacccacaagtaactgccaccaccaccaccacccctacttccactacttctgccaatatcaacggactcaacttctatctctctgatacctcaaaacataataaatcgccatattactttcctaatacatccatctcaacatccgcacctaattccctccctacaataacactcgatttgacttccacttcgtcctcgtcctccttctccttatctcatctaaacagaatgagtcacaattttccaactagatataattacaataacaataattcctccacaaacctcaattttagctcagtacttgaatccaattcccttcccatttcttggaccaataattatccaaatcaagcctataacaaaaataaccaaaattttggttcacttacattttcatcaagatcaagtcaagataacattttccaatcatatttacaaaaaaatactacacaatcttctttaccaccagagacaattgcagccgcaaccaaagcaatacatcagacccaaatttcactctgcattagctacagtcttacatcaaatctttggaaattctgggaattgaaataaatctagccatgttacggagccattccaattttgtcaggtctccattagctcaaatccgaattaaggttcggctcagttttaattaaccaaccctttttaattcgcgaataatattatagttccagcgccggaatatagcaggcggtttcgggcaattttcttcatgcccattcgaggtataggggaatacctcagggagggccgacacaaattttcgttcgccgagagcattgccgtgggaaacctttggagatttgtcaccccgcgaactcttgtgccgaagtgatcacgtttgggggtgtgaaaaaaaaaa

SEQ ID NO: 2984 - DNA, 1018 bp, Solanum tuberosum
  Predicted polypeptide sequence is orthologous to G2719
ataacaataagcagagaagatgaatgaaaagacggagcagaacggttacgccgccgccggcgacggcgatggcggcgacggaggatgtactttggttgatgccggtgatgcgatgttgcacggaggaagaggaagtacagttagtagtggaagagtcaaagagccctggtcgccggaggaagatggaatactgactgaacttgttaataagttcggtgcaaggaattggagtatgatagcgcaagggattgcaggtcgttctgggaaatcgtgccgacttcggtggtgtaatcagcttgatccggtgcttaaacgcaagccttttactgatgaagaagaccacattataattaatgcgcatgccgtccatggaaataaatgggccgcaattgcaaaattgctccctggtagaacagacaatgcaattaagaaccactggaactctacactaaggcgtcgatttgcagggctatggagggttaaaccagtatgcagcatgatgttagatgatagtagcatttacaaagccagggcattatctgaagaaactatgtcacgtgaagatgttaaccaaattaagcccctcgaaatgcaagaagttagtcgtactgagtgcatgaccagccagtctgaagacaaagatcaaatatatgggacgtgtggtattcctgagaaaactccacacttcgcttttgaaagaagtcgtcctacatctatgggaaacagtgatccacctgcttctcatccaactgagaaaattggcgcatttaatgtttataacccttctgtaacttcaagaatagtgccaatgcaggggcctctgatccacacattctcaccagactttgatatatgcaaacttcttgaaggtgtatctggtgaaaccatagttcctcaggggtgtggccatggatgctgtgcagctaccaccaagagcacctccaaaagttcattgttgggtcccgagtttgttgattacgaggaacatcctcctctcctcagccatgagttagcttct

SEQ ID NO: 2985 - DNA, 985 bp, Solanum tuberosum
  Predicted polypeptide sequence is orthologous to G2741
attcgccggatatcttctggtgaccggaataaaatttagtagttacaaaatattgttaccatgggtgaagaagtgaacctaaccgactatgaatacagcggtggtaacgatgacagacttctctgggaggttggacttcccgacgtcgatgatctcacgccgttgactctgcagttgattccctcggaactcgctgctgcgttcagaatatcgccggaattgtcaaagacgatgaccgatgtaaatcgtgcttcgcagaatacgttttcttctctccagagatggcactcacaggatatggcttcgatgaataactcatatttcaagccgtttagctatgagaggactagagaagagactgttactgaaagagatgaaacggatctgataagagagggatccgacccgaggaagctccgacgggttgaatccggaggcactgaggaggctgattcatctctgtgtaacgagaattttgcggatgattcgtctgctaagactccgaagcgacccagacttgtttggacgccgcagttacacaagcgttttattgaagtggtggcgcacttaggtatcaaaggggctgtgccgaaaacaattatgcagcttatgaatgtggaaggattgacgagagagaacgtagcaagtcatttacagaaatacagattgtatacgaagagaatgcagccgaacgagggtccttcttcgtctgatcatttgtttacttccacaccggcggcagagagtatgcgtgagtccagtgagggtggtcacctgcgcaatactaatggccacatggcagcgccaactctgatgccgtaccaaccacaaatggtgccgatgccaatgatgggaatgccaaatggaggacatgtagttatgcctgttggttacgggggtggaccgccacttgggtttcatcatcactataatatggtgcagcagcgggactggtctggaaataattttggttactgtcatcctg

SEQ ID NO: 2986 - DNA, 945 bp, Solanum tuberosum
  Predicted polypeptide sequence is orthologous to G2741
atgggtgaagaagtgaacctaaccgactatgaatacagcggtggtaacgatgacagacttctctgggaggttggacttcccgacgtcgatgatctcacgccgttgactctgcagttgattccctcggaactcgctgctgcgttcagaatatcgccggaattgtcaaagacgatgaccgatgtaaatcgtgcttcgcagaatacgttttcttctctccagagatggcactcacaggatatggcttcgatgaataactcatatttcaagccgtttagctatgagaggactagagaagagactgttactgaaagagatgaaacggatctgataagagagggatccgacccgaggaagctccgacgggttgaatccggaggcactgaggaggctgattcatctctgtgtaacgagaattttgcggatgattcgtctgctaagactccgaagcgacccagacttgtttggacgccgcagttacacaagcgttttattgaagtggtggcgcacttaggtatcaaaggggctgtgccgaaaacaattatgcagcttatgaatgtggaaggattgacgagagagaacgtagcaagtcatttacagaaatacagattgtatacgaagagaatgcagccgaacgagggtccttcttcgtctgatcatttgtttacttccacaccggcggcagagagtatgcgtgagtccagtgagggtggtcacctgcgcaatactaatggccacatggcagcgccaactctgatgccgtaccaaccacaaatggtgccgatgccaatgatgggaatgccaaatggaggacatgtagttatgcctgttggttacgggggtggaccgccacttgggtttcatcatcactataatatggtgcagcagcgggactggtctggaaataattttggttactatcatcctgttgcttctaatgataagtag

SEQ ID NO: 2987 - DNA, 944 bp, Solanum tuberosum
  Predicted polypeptide sequence is orthologous to G2747
ctagtttatgaggatactctttctttcaccctagctatctagttccagttcctctcacactaataactactggacgcaattacttttttcccatcacatcttctctaattagatctatgctgggtcctagatcatgaatttcttcgatcaaggaggtacacgccaattttctcattcttcttcttccagccagaagattatagttcctgatttctcttatcagcaaagaagcaccactaataatggtgaagatagtactgatctcgtgatgaatatggatcttgaccctgcagatgaagttggtgaaagtaatacgattgagcgagaacacatgttcgataaggtagtcactcccagtgacgtcggcaagctcaatcggttagtcatccccaaacagcacgctgaaaagtattttcctctggattcctctaccaacgagaaaggcctccttctcaatttcgaagacaggaatggaaagccttggcgcttcagatattcctattggaatagcagtcaaagctatgtaatgaccaaaggttggagccgcttcgtcaaggagaagaagctcgatgctggggatattgtctcatttcagcgtggagtaggtgaattgggcaaggatcgtctcttcatcgactggaggcgccgtccagacgcccccgaccatctccactacacccacttcactaatcatcatctccataataacttgtaccgctctaatattcagtacccagctgctgctgcttggaatcgtcctctctttttgcagcctcctcctcctcctgaccattcacatttacaatattccctggaacctgcagctggcagcatgtctcatcatcatcaacaacaatctcacggatccagtcctaattattactacgacactttgtatttcaacaacagccgtacaaccgtggtaaatggaaacccttgtccga

SEQ ID NO: 2988 - DNA, 990 bp, Solanum tuberosum
  Predicted polypeptide sequence is orthologous to G2763
ccctccactcctaaatctctctctctccgattcatcaattctgaagaaataatttctcacttctaatcctcatcttcttcttcatcatcatcatcaggttttcttcttcagacctcaaattggatagtgattcaatcgattcggtcctaaatttgattcgattttaactgaatctgatggaaccaatggttgtagagatgtcttcaacggtgatctcgaatcctgtaatgtcttctgacagagtaatatcaaggagaaaaaagagtaagaaaagtttgagaaatcaaactcaaaacattagcaacaataacagcaacagtgaaactccgagtaatactactgaatggaaaactcaagctcaacagcaagtttactcttcaaagctactcaaagcactccgtgaattgcggatcagttcaccagcggcggcgacgacgacttcatcggtgccggcgccaaaaggcggtcgagccgtacgtgaagttgctgacagagtccttgccgttactgctaaaggacgatccaggtggagccgagctatacttacaaaccggctcaagctcaagttcatgaagaaacacgccaagcggcagaaaatggcggtttcctctaccagccggttacctaggaagccgagagtggggattttgaagctgaaaacgaagaatttgccggcttttcagaaaaaagctcgagttttaggacggcttgttcctggttgccggaaacaaccgctgccggtgattctagatgaagctactgattacatagcagctcttgagatgcaaattcgagcgatgagcgctttagctgacctcctttctggtgcttcctcaagtactactgctcctcttgatcagctcagctcgagtcgacctcctcctatttgatgatttatggttttcttgcttttctattttatctattttcttctctccctttctatgaatattcctctgttacatatatttcttctatcttttcaagtgt

SEQ ID NO: 2989 - DNA, 828 bp, Solanum tuberosum
  Predicted polypeptide sequence is orthologous to G2885
ttttctggaccatgatagatataatgagaattggcaaacttctctccagcctctgaagttccagtcaacctcctttccgttaaatgaacctttcagcaacagccatttgcctcaagacagagtacgagacaatgatacttcaactggccctcttttgcagaacaaccctgttgatttttcaacctctgccatagtttccgtacctttcgaggcttcaagaggagaaacacaatgccgtgaaagtttagagggtgctgttcagattatgaaccaagcaacctgccaacggtggccagatcagaaccaacattattcccacaattcaaacaatatttttggtaacatgagctctcaagtttctagcaatggtggaatggcctctttacctcatcctatggaccaaaacaatgatatgttctgcacaagggtggagacttctttgaccggcagatcaaatggaggttcttcaatgcacatacacaatcgtgaaagtgaaaaattaactcatgactcgaggacaaagacaaatgaagactacctctttcagacaacaaagcaacaagttggttttcttcctcagggctatggctcccttgatgatcttatgggtgaaatgaaacgggatcaagatggagccatgttaggaggagaattcggatttgatgcttattcacttggttcaggtttatgaggtttttgtaactagcaagttacgaaagagaggatctagctgatatagcaaaatgttatttgctcatttaagagtcttcttaaccaatatattgcatactatggctttttttcattggtctttccagtcggaacgtg

SEQ ID NO: 2990 - DNA, 956 bp, Solanum tuberosum
  Predicted polypeptide sequence is orthologous to G2990
taagaagtttgtcttattgtaatgtttctatatattcttcaatcaccatcatcaatacatagaagagaaaaactcaaccaaccaaaacaaaataccaaaacccccatttacaataaaccttcaaaattttccaattcataatcaccatatccattaattatcatattttcttgcccttcttgtttatttgtagtcattttatttcaaaaaaacacatatttaaacaaacaaaaatggagttaacttgtagtactaaccccacccccacctccaccaaaaccccagattcagaagttgatacccctcctttaattaagcctttatctttcagcaacggcaataatcaccacaatcatcaccacgaactgccgccgtgcacggcggtgatttacaaagaatgtttgaagaatcatgcagcaagtttaggtggacacgccgtagacggttgcggtgagtttatgccttcgccggaatccaccccatcagatcccatttcactaaaatgcgccgcttgtggttgccaccgcaacttccaccgccgtgaaccgtcggacgattcatcaccgccggcccacttcatcgatttccgccaccatattttcccccaaattaagcgattttctccctctccgtcaccgtctctgtccctttctccgccgccgctgccgtcactgttccagccccaacccgttactcctacaggtttaaaatcagagaacccaaatggtagaaagcgatttaggaccaaatttacagcagaacagaaagagaaaatgcattcgttttcggagaaattgggttggaaattgcagaaatgtgatgaaactgctgttgatgaattttgcaatgaaattggagttggaaaaagtgttcttagagtttggatgcacaaataacaaaacactattgggaaaaaaagataccaaagtagtagagatcatagcttcgagaacaaa

SEQ ID NO: 2991 - DNA, 912 bp, Solanum tuberosum
  Predicted polypeptide sequence is orthologous to G3032
caaatcagccgcctctcccttcaactccaccgacgatggcgcgtctccgacgagaaccagaggagagggaggccgatctcctctcctcttcgccttctcctcctctcctgtccgccttctcttgctctctctcctcttctccctcacctcgtatcttttttttttctccgggcagcagcaaccggagcagtgctccgaccagcgacagcagcgcctggcgaggttcatgacagcagtagcgactgctccaaacagcaacgtcaacgacgccaccagcagccctagccggacagaaactagcagctaggtgcagtgagcaccagcaatgcagcagcagcctgctcttccctttctctttcatcagtgaacaacagcagcagtcatcggcgccgctccattctctagcgatggatcggcgagaacaaggcaggcgaagccaccggcgaacagtgaggacgaagcaacaacaacgccgaccaaacgaggcagccaccgcctctgctcgcctccaccttccctcttctccggccagtagcatcgagccctggcaaacccccttttaggggatttcgaggtcattaaagatggatctgttacagatccgtcaaggtatgctctttttttttcttagtgtgactgatttcaatgcatgtttccatactgtatgtgaaattatctcaccttaaacatttgccattatttgtgattctttgaaatggttgtaatatgccattatgttatatgatttagtcacttggagtgtattataatatgcttcgaattgctatactgctgaagttttattcatgttaatgtgatatgtgatcaaacttgtatcaaaaacctttgcttaaaatcaaaggtttgtgcttgcttatccccctctttagtgatctgattagtggaccttgt

SEQ ID NO: 2992 - DNA, 1088 bp, Solanum tuberosum
  Predicted polypeptide sequence is orthologous to G3044
ttttttttttattaaatgcaatgtgcatatacggaaaaacgactctacaacacttggaatttgctttcctagcttgcaaacaaatacataccaaactaactgccataaatatgctttcgtaattatctagtcaggttgaagatgcaactattaacttaatgaacatagtaatacaaggccattaacaaatttaggccaggttacataaattgtggcaaagaggtttggtggccggtcttcccttggaacccaatactttccattttgtggttaagacccaattaaagtgggttcctaaagaatccggttggccagaaaggttggtggccaagaaattaattaagcccggttattgaatggaaagattgaaccaccaatccaaacactggggtccggttattaaggcttcgcctcctggaatttattgttaagaattccctttgtggttccacggtttcccgaagttcttcctggcaagggttttccagggaattgggcaattcaagccctcttccaaagtttttggtggcatttgggaattcgcttaatttattaaacccttgggaattatccaaggcattacaaagaaaaaggttccaaaaaaaggcacccattaattacattcttggccaatagttcttggggtcccgggtcaaatggacctttaagacagtaaggaaccacggccctcaatttttaccaacttccctcttggaaagactttcaaattgtttgtccgtagcaacatagcttaatgttcccaaatttgcccatgaccctgggggaatgggcacagaaattcgaaaagatgggaaagggatccacggcaaattgaaccatgtaaggttcaaacaatcttcttaacatgtgaacaaaggcattgggtgtaccatttcatttgagcaccatttgcacctgccttaaaccgaagttctcccttccgtaactttaaagttccttcaagccttgtttaaccattatataactccaatatcttcacggggccaggaaaccataccggcactggggtacctccatttatatcttccaaataatctcgaataaggtgttcccgaagaattaaaccc

SEQ ID NO: 2993 - DNA, 931 bp, Solanum tuberosum
  misc_feature (666)..(666): n is a, c, g, or t
  misc_feature (856)..(856): n is a, c, g, or t
  Predicted polypeptide sequence is orthologous to G3061
atactaaaatcaaacataaactcaaagaagaggaaaatcaagaagaagtgaagttgttataacaactctattgtttgtttttgttttaaaaacattgtacactatacaatgagtatttcttgggatttagctgttttgagcaaatcttgtgacttctcttgaaatcgagctgagctgagctgaactaaactaaactaaaccgaactttttttttttttggtgtgtgtgttcattttacttcaaattttgaggttcaagaagaaaatgatgtctaatgatggactttcttgttccatgagaggtggtttcactttcattcaagatccaaaaaaccctagtactaatattaatcatccaaatccaaaccctaattcaaatccagatgtttcttgtgctaataagaggaagagaaatctccccggaaatccagatccagatgcagaagtgatagctttttcaccaacatctctaatggcgacgaatcgattcgtgtgtgaaatatgcaacaagggtttccaaagagatcaaaatttacaactccatagaagaggtcacaatttaccatggaaattgaaacaaagaaataacaaagaagttattaaacaaaaaacgtttatatttgtccacgaaaaatcatgtgtacatcatgatccatcaagagcattnagtgattttaactggggtttaaaaaacccattattcaacgcaaaaacatggtgaaaaacacaaatgcgcaacatgtgaaaaacatgttccaaccaccacaactaatgcaggttcaatctgattgggaaaagctcataagtaaagattgtggtactaaacgcagtacacatgtgcatgtggcaccactttntttccagaaaggatagtttttaacacacagacatttgtgatgcctagctgaaaagtccagatttcttcaatccca

SEQ ID NO: 2994 - DNA, 738 bp, Physcomitrella patens
  Predicted polypeptide sequence is orthologous to G261
cgtcaatcaatatgaacatatcctctcgaagtcttttaactaagtaacaagagctataatagctcaagataataattctaataccaaccaagtcccgacatcattttaaaggttaattaaccaggcgctagctgacccaattgatgagataggaattcaacacgaggcctaccgaaactactttgctgcgcattcttgccaccctgcgacacatcttctgtctcagactcaggctcacgctcaagatcgatttcggcacgggtgacaggttgtgggtcttctgttaggaattgctcccagaaaccagaattgtgcgctgcggaatccgtgcgtgcgctctgcacttcagcttcatgggatgccgtgcctctattacagtccggctcatgcaaatcattactatcacggtattcagagtgaggatgcctgctcctctctgcagatttatcgccggatgacgctctcatgatatcaaagttgagtggcgatatagatgtagcttcctgcgcttcattgacactcacgtcaatcacaacaggcgcactagagaaaatatcaggaagtttggtattaatttcctcgactgtgactctggattgtcgattcaaaatattgctatctccgctattaggagaagtgtctggctctcgcatgagggcttcaaaatgacggctatccatagcggagtgggagtcagaagagcaaaagatctcaataaccctggcacgtgctctagct

SEQ ID NO: 2995 - DNA, 770 bp, Physcomitrella patens
  Predicted polypeptide sequence is orthologous to G261
atgagtgatgagatagagatcgtcaatcaatatgaacatatcctctcgaagtcttttaactaagtaacaagagctataatagctcaagataataattctaataccaaccaagtcccgacatcattttaaaggttaattaaccaggcgctagctgacccaattgatgagataggaattcaacacgaggcctaccgaaactactttgctgcgcattcttgccaccctgcgacacatcttctgtctcagactcaggctcacgctcaagatcgatttcggcacgggtgacaggttgtgggtcttctgttaggaattgctcccagaaaccagaattgtgcgctgcggaatccgtgcgtgcgctctgcacttcagcttcatgggatgccgtgcctctattacagtccggctcatgcaaatcattactatcacggtattcagagtgaggatgcctgctcctctctgcagatttatcgccggctgcgacattgaaaagaacttggggttagataatagcaagagtaggatggtctcgtgtaaactgtagacatcatcacaagggacctgacaacctgacccacaatgaattgagcaagttgtcggtgcagggttcaggctgtttaaacaaaacaatgcaatcagggtgaaacgaaaaaatatagttggagggaagttaactcacatgacgctctcatgatatcaaagttgagtggcgatatagatgtagcttcctgcgcttcattgacactcacgtcaatcacaacaggcgcactaga

SEQ ID NO: 2996 - DNA, 679 bp, Physcomitrella patens
  Predicted polypeptide sequence is orthologous to G280
tagaacgtctacaactcgatgtgtgcaacaacaaatgtccactacactacgggtgtgagcaacaacaaatacagcaaaattgagctggaagagtcaatgcaccagtaaataaacatgcacacttcaccagcaaagagccactttaaaatgacaacctagctagtcaaaaggctgcatctaaaaagatatcaaatttgtcagctggacgatttcgcctttggtggacggcctctcttcttcggcgttggcgtcgtagcggcggcttcggcaaactgtgtttgagcctctaccgagtcatcttcaccctcagcttcagatttaaccttcggaggccgacctctacgctttggtgtagcaccagcctcctctactttggccttcttcgcaacttccacctcttctgcagcttcaggtttagccttcggtggcctacccctgcgtttcggggttagaggactagctagatcagcttcacctgcagccggcttgccacccttgcctcccgaggcaggagcctcttccgaagacttgctgactgattccttagaagcatctgtttttgccttcggaggtcggcctcttcgtttggcaggctcactatcctttccaccttcctctccatcgctagcgcgagagggagttttcagcttcggaggtctaccccgcttctttgctcctg

SEQ ID NO: 2997 - DNA, 803 bp, Physcomitrella patens
  Predicted polypeptide sequence is orthologous to G280
cagcaaagagccactttgaaatgacaacctaactagtcataagacaactaaatctaaaagtggaatttgtcagctagcagacttcgctttgggtggacgacctctcttcttcggcgtcggcgtagtagcggcggtttcggcgtctcctgagccatcctcagcttcagattcagctttggccttgggaggacgacctcggcgctttggtgtggcaccaccttcctccgtcttacccttcttcgcaacctccacctcttctgcagcttcaggcttagactttgggggcctacccctccgtttaggagtaataggactggatagatccttcttctcagaatcatcctcttcggaagccttgctaaccgattccttggaaccatcagtctttgtctttggaggccggcctcttcgtttgggttcactaggactttccttcccggtctcttctccttcactggcagcagaggaggttttcagctttggaggtctgccccgcttcttcgagccaggagccgcaggactttcggttgcaggggctcttcgctgggctgtcatttttgtttttcggaggtcgacccctgccacgtttaaggtgtttcggtgacgcctactttctcttcagttgcctcttcctcggttgcatcggcagcctcctccacattcccaccaccggcaataggttctgccacgctgtcatcatgtggtatctcctcttcaacagcttgtctcgtcctggcacctttcaactcgggtccagtatacttctgtacattggcaacgaatgctgacgaccttccgctaat

SEQ ID NO: 2998 - DNA, 745 bp, Physcomitrella patens
  Predicted polypeptide sequence is orthologous to G481
tttctttttttccaaagattgtacagttcccgcactgggtcagcagcatgttgaaaaaaatgctgacaaattcctcactgcttgatcccttaactgacgctgtgctgactggagctcaaaaagccctccgatttttccgcagacagcatctaaaatgagcagctagggtagaactgtcaaaaccagaagtgcatccacgactaacttcctcttcttttccttatgctaactcaatcgtcacgtaaaactgaccgttccccataagctctctacacctaaaggactatgggtttctgggttactccctaatcttcatctacaaggagagtcgaatgcctttacacagatttacaactttcacccaggagctcccatcatcagttgctgcatcttgtcatttcaaagatgcagaaacagaagcctgtaatactaataatgttgaacctgtagttgccaggattcatcatctgcgcttgcatgtaagggttatagcctccttgctgcaccatctgaacgccaggagataccatgccacttccctccttcttgccagaagatgattcaccagccttgttcgtcagagcaccctcagtctctctgtacttgtgaaggtaaaccttcagcggctcgacgtagtcttcaaaccctaatgtgctcatggcccaaagtaaatcatctccattgatcgtctttctcttttcccgctgacacttgtcgctagcttcgctcgtgatgaaactgatga

SEQ ID NO: 2999 - DNA, 733 bp, Physcomitrella patens
  Predicted polypeptide sequence is orthologous to G481
actttgcttcagcacgcgcgcgttgtggtcgatctctcgctggagcaacagaaagccattcttacttctagcacttctcggaggttattgatttctcgcaaattgctcttccacctgccctctttcgtgagggagttcgaagctgaaaagtaatgagctgaagattaaggtcttttacgagtgaacagcgagcacacagctagcaactctttcggagaatactccaggcgaaattggtcggatggccgatagctacggtcacaacgcaggttcaccagagagcagcccgcattctgataacgagtccgggggtcattaccgagaccaggatgcttctgtacgggaacaggatcggttcctgcccatcgcgaacgtgagccgaatcatgaagaaggcgttgccgtctaatgcaaaaatttcgaaggacgcgaaagagactgtgcaggagtgtgtgtccgagttcatcagcttcatcactggtgaggcgtcagataagtgccagagggagaagagaaagacgatcaacggtgacgacttgctgtgggccatgagtacacttggtttcgaagattacgtggagcctctgaaggtttacctacacaaataccgggagctagagggagagaaggcttccacggccaagggtggtgaccagcaaggagggaaagaagggagtcaaggtgttatggggtccatgggtatgtcgggcggaatgaacggtatgaacggtacg

SEQ ID NO: 3000 - DNA, 783 bp, Physcomitrella patens
  Predicted polypeptide sequence is orthologous to G913, G1753, G2514
atttctcttcttctgctgctgcacacgtgcaccatgcacacaccaccccaacggctggccataacagccatgaagattgattattattctgaacaaaaccacctacaacctaagtattaactccattgtactgctccgtgtgggcttcgcttcatgctcaagtggttggaactcgtaacctttaagcaactcattcgaacatcaacatcatggcccacatggattggcgagttcgcatccgatggtaattctcagccgaccagtcttgcttgcactgctgggtccaacctagaaccgacgccgctaacgtaaccgtgcctctgtctatctgtcctctctccctctttctttagccggaagaaggtactctcgcacgcttagcagccgaggtcgccctctgcttcacaagggcggcgaagctctcccacggaagctctggggggatggggtagagctgcagctgctgcggcgaatcctcgaaattgtaggggattttcttcttggtgtagaagatgcccacatcatacgcacgcgcggcctcttcaggggtttcatatgtgcccagccagattttgcgcttctgcgatgtgggtcgaatttcggtcacccatttgttcaactcaggccggtgccgaactcctctaaagatagtagtatcgccagtgccaacactcacatcatctgaatcccatgcggatggcaccttattcaaatctatattccgaaatttaagcgcattctgaccgctatcatctcttgccgctaaccgcattcctttcctct

SEQ ID NO: 3001 - DNA, 790 bp, Physcomitrella patens
  misc_feature (712)..(712): n is a, c, g, or t
  misc_feature (787)..(787): n is a, c, g, or t
  Predicted polypeptide sequence is orthologous to G975, G2583
atggtgtgaaaggaaatcatccgcaatgcatgatgcaaaatgatcttagtcacaacgcattttttttattattattattaagattttctaatttcagagtgcattgcggcaaaacgccttcgcaacaatggatcgagtatctgtctacatgcaaccctatgttgctggcagggaccttctggaacttacgccagaaagaaaccccaaagaatgatagtgaatcgaagagtaaaacaattactctgactatgtacaaaacttccatgtcatttgcaaaaaattcctcgagcatagccgatgagttggagaacagaacacaattgttcgtgctcatcgcacatttctttgccgttgccgttgccgttgccgtgaaagtactcgggcaaagaatagcgactcatctctgatacggcgggctacaacaaaaccgtaagatctactcttacatgcacagaaaggtctccgcccattcggaaatgagaattagaagaaaaaccatagccctcgccccgaagtagaccaatttcaccagatcaccacagaaagaacatcttataaccctctgtgacgcttcgcggcagagacggcttgcttcttgacaaaaggagcaatctcctcccaactaccgcaaggcaactcggggagattttccattgaatcggggaaattcaatggtatcttcttgccagtgtaaaagattccaacatcgtangcccgcgctgcctcctccgccgttttgtacgtccccaaccaaatcttccgcttctgcgccgtggggcctaatttncgt

SEQ ID NO: 3002 - DNA, 535 bp, Physcomitrella patens
  Predicted polypeptide sequence is orthologous to G977
acgactatctcctacttctcttgatcggtagcttgttgggtagctctcgcacttgtgaagtatagcattcctcagctccccacaatctcccctccccacacacacacacacaacccaaactacttcgttgttgcaagacgagaccagtgcggacagatacagagtgtgagtgtgtgtgtgtgtttgagtgcgtgtgtgtgtgagagagggaaaactagcagtagtgtttgagttggtggagatcatgggcaggccgcagagataccgcggggtgcgacaaagacactggggatcatgggtctccgaaattcgtcacccacttttgtatgtgactctgttgctgcttcctctcccactcggaacttctcatgttggcttgcttgtagcattgtgagtgtgtgggattctgttaagtgagtgacaatttacttgcattggttgtgggggagctcgggacgcttgtgaggatgttttttttctttttgtcttctctctctctctctctctctctctctctctgtttttttcatttttt

SEQ ID NO: 3003 - DNA, 607 bp, Physcomitrella patens
  misc_feature (579)..(579): n is a, c, g, or t
  Predicted polypeptide sequence is orthologous to G1075
taccttatcagtacccttcagaatccttcctttggttatttaaagtcactttacatcttccctgaaagtaggatgtaaagtaaaagctagacacgtcacgccgcggatctcaagtaacgagcccggttaagcgataagtttatgtgtgttccgcttcttcgcggtttagaaatttagcgatggtggaatatcgttttcgtcttctctccgtcgcccagtcgtagaaggaacatcctccaaacaacggtcgatgtgttgcatttctagggctcgagctcgagctttcaatttcgagacgacgatgaaatagacgattgcaatggctccggccacaacagccaccaccaccacgacgtaacccgtgtgacttgtggttgtcggcacgatgacaaccccttccgccttaacggggagtatgagtgatgacatcaccagcggaaggccggttttagtccacagcgatgactttgtcctcgctgccccgtagtccacggcgtcctcattccatcccgtgtcatgcaacccgggaaaaccgttcacctcggcccgatttccacgttgcgcggctgcggctcctanggtggatgtacagccgtcaattgccgtg

SEQ ID NO: 3004 - DNA, 605 bp, Physcomitrella patens
  Predicted polypeptide sequence is orthologous to G1075
attgcgctgcctgctggctgttcaggttcggattgctctgtgggactatgttatacaagttttgtaatgcagtcgatgggttataagaggacaaatccggtgattgcattgtcggtgcagctgaagctactgtcacttgcagcatcggcggctcgtcctccgctagcggaagccgatcatacgttgcgcccgtgaacgacgtcgcaaccaccaaaactgggctggccgccatcaacgctcctacaacacacccacccaaaacttgccccgacgcccccgcaaaggaaattgtgagccccgttgtaagccctgctggaggagttggagacggtggaggcaaatacgacccagagagcgagatgatttcaaagcggccgtggatggtaacagtcgccccgggcgttgtagattgccgtagagtcacattcgtcacagtcccgcttccgcccatgacgcaaattcctctctgtcgccgacgagcgaagtctgcaacgctctcccaaacatcatgcccacttgcaacctccaggatgtggggtctcatggcattcccgttctccctggtgataataactggaggtttaggtttatttttggagccagga

SEQ ID NO: 3005 - DNA, 646 bp, Physcomitrella patens
  misc_feature (632)..(632): n is a, c, g, or t
  Predicted polypeptide sequence is orthologous to G1084
gtgatgtttgggagtctccaacgtttacatatgtaaaatgcctcctgatctaacaacttgtggtttaattggaagccttttggtgaacaagtgctcatgccaatgctgcagcgttgaacttccccgagatagttcacgtttggggaaagcctgatcgccacggacaaacttctataaggtcattactatcattggccaaaaatcttactcctgaaaatcccataacaccatccttggactcggcacttcgcattcatgcagacgcaatcctgtaggtgtcccagccaagggactattgaaactagtatgattcgcgttggtagcactgctcgagctagagtactgtccaccgtaccctggcaacgtctgctgggttgtcatgtccagaacagaaccaggggtgctagtcgatgacgttgtggatggcccactgaagttcctgtagccgaaactttctggcagaggtctctgttgattgtatccgagattgatcctcacatccaacttactcggcgctgatgttgactggggtctcgacaaatctgatccctgcatgtaggaaacttcagcgtggctttgagcgagctgattgtgcacttcggaactgaaccggctgagcggcagttgcgaancggcgcaactggga

SEQ ID NO: 3006 - DNA, 663 bp, Physcomitrella patens
  Predicted polypeptide sequence is orthologous to G1108
aactttcgattcatacaactcgttctgatcacaaagaatggtgaattcggtgccgcctgaaagcgtcgcactcacacaggaccacacatgtcggcaacaattattcaaaatctcggatgctgtctcgaccggtgcaagtgcaggttaacaagctaggttaaggacttccagttcagatttgtctagtctacgccatggcctacatcactacctccggacgatagtcgaacattgacgatagaccgtagtagctggctctggcgatgactcgcctccgaacgatgtgtaaagccagattcccagcaggaggagcaaccagtgagctccataatctagcaatatcgacatcgtgcctggctggttgttccggttgcgagcggtggtggatgttgcagtacactaaggggccaccagggccataggaagcgccgatcctcctttccgatgcgccaaggcgaccgtatacgggactcctggagtttcctgcaaaaaactgaaaccagagaagtattgcgataggcacccacatgagagaaggaaggaagggagctggcttctccttcggtggatggtatgacacactgcgacattgcatggtgggtttcggcgcctctttgtacgcaattgcaacgagaagaacaaaggcaagaattatggcgggca

SEQ ID NO: 3007 - DNA, 431 bp, Physcomitrella patens
  Predicted polypeptide sequence is orthologous to G1146
atcatatagctctagttcttggggcatggggcgagaccttttgcagaagaatgaagaacggacaagtctaaacaaggatttgcccgaaagcgaacacaacccggacggacggggtcgaacaactgacccgacggtcgtcggatttcaccaggacgaagaccggcattgggtcgccgagctttcctgtggtcacacccagcacttgcgccaccagccgccctggcaatcccgggcctgggtcacagacccggcgcaacgccttgaaaaaatagacaagccctttacgtgcggctggtgtgcgcaaggctcagataaagataaccttggcacctgattcccggtaggcatccaggcataggccgccaccgaagccatgcacctccagagaattcgcatgcagactttttttatcgcgccaaaaaaaaaaaaaa

SEQ ID NO: 3008 - DNA, 549 bp, Physcomitrella patens
  Predicted polypeptide sequence is orthologous to G1146
gctttgtcacttcctttgcctccgagagcgttgctgcgctgctgttccttttctattgctgctctcacaggacgtgtggttcatcgttgcggagttggggaatgtgatatgaaggtatctgcggctccgacgcgttgttttggactaatttgttctgttttcatgctcttgcgctcggatccggggtgtgtaatgaagttcctgttgcggtttgcgacactatcgtgcctgtgtatagttcagtactgccggattggagtggcgtgtccatcagcttcggccctttgttgacgcggcgttttcggtcattagattgagaagaaggtttggcgccgtgttacaaggtagagagacggctggcattagtaacgtgaattgaagttgaagcaccagggaccttcccgagaatttcagtttgcctcttgaagaagtgtgggataggttggcgaacttcagttagtcaccttgtggagctgggaggtctgctttaaactggaaagccgaaggagaagtacgttagtcttaaagatgttgccatgtaccaagaat

SEQ ID NO: 3009 - DNA, 405 bp, Physcomitrella patens
  Predicted polypeptide sequence is orthologous to G1326
gactctacggtagtttttgtatataggacgttgagatggtccgactggcggccgattttcagtgtaggggcacgctttccttgaagtgctatggatccagcaagggtggaaatggcttttggagtaggttttttaatttaattttaaatcatcatcaggggtctgtacttagaatgtaaagttcattggagagcgcaaattatcaagaccaagtgcacatgatggttgacggagattgtccaagctaggttgtgttcggtcaattgagttggctgacctatttccattatcagtaggcctaatgaagctccttcttgctgcgccattgagctacggagtggcattccaatcttctggaccgtgtggtatttagtattatcctgtggacttgatagcacggatgga

SEQ ID NO: 3010 - DNA, 1837 bp, Physcomitrella patens
  misc_feature (1835)..(1835): n is a, c, g, or t
  Predicted polypeptide sequence is orthologous to G1935
gggatgatgcggtggctgtttgtttgatcaagataaacatggaggtgggaactgccggaactcatgtcaacgctgtctagatatttatagtcggtaagggccaagcgtgcgtgtgtgcactttgtcgaggattctgccaggaatttggagagcggtcgtcgcgtgcttagtgggttacagtagtgtacacttagtgtgtgtgtgtgagagagagagagacacacacacagcgagagtaactggagtgacctgggagttttaaagtttttgggttcggctggcggtgcattcaaagaggggattgtagcagcggcagagatggggagggttaagttggagataaaaaagatcgagaacccgactaaccgacaggtgacattctcgaagagacgcaacggcctcatcaagaaggcgtatgagttgtcagtgctatgcgatattgacttagcgctcatcatgttctcgccgtctggcaagctcacgcagtattgcaattgcagcattgaagaagtcatcgccagatttgccaatttgcccatgcacgagcggaacaagagttttgaggatatgttggcacgcttttcgaacaatcacatgcaccatgaccgcagcaaatacaataggaaggttgaaaacttggagcagctgcaaagggcgttgaaaaagctcgcagaagaacatggtcttgccgctagtcaagatcatttgtctggaagtaaatcaacgtatgaaatcgagttattgcaacaggagttaaagaaagcacaacaagagaaggaattggtgcaacagagagcaaggttgtacttggctgatgagcagcttttgcaaggtgttacctccgttccgcagcttgctaatatggaaagcgaattagagcaggcacttgagcgtgtgcgggcgagaaagaattatgtgagcagtgcttaccagaatgtaatacaacggcagcaacatgaatttcttgggaatagtttgcagatgatggcactgagacagcagcaatcgcagcaagcgcagcaacagcaggcaggcatgacaccatcacaggtaccatacatgcactggacgatgcaacaagagcgcccagaacctacaccccaagattttatggacagcaaacgaatccagctgctccactcaggcatgcatcgctcaacagagagccaggaagtaacggtgaatcaaatccaggtgtgggatatttcccatctggaccacaaccatcgaacatggaaacactgcggcaaattgggatggggggtgtcagtcgaggattgacaatgcacgagatgtcgctggaacagccgaatgtggcccagtacagtgaggagcagaaaaaagcgaaggttgaagccagcatgggctttgttacctcaaccagtgcgggtccggttggcgctgaagcagtgtcaaagactaatttttctcgagagcaacaacctgaacaggctcatggcaccgtcagcgcttcagagtggccgccacacccggcgaaccatcaccctcatgcgtacggtaacggcagtctattcttcagccagaatgaacaccatgcatggaagtaagttgcgtggacttgcaatctttttagctttagacacgtagttgaagaagcagcttcatatgggatacagacggctcatccaagtcaaaccacttcggtgtcaactactcagtcggctgtatcaatttgtggacaagagatgatatcagtgaactttcgagtgacgctcgtgggatcatgaatctgaccactggtggaagttttgtgatctaggcgctgtgctacgtagagcagctatcacccatgtgtgttcgttgtaccccacctntg

SEQ ID NO: 3011 - DNA, 2292 bp, Physcomitrella patens
  misc_feature (1951)..(1951): n is a, c, g, or t
  misc_feature (2245)..(2245): n is a, c, g, or t
  Predicted polypeptide sequence is orthologous to G1935
gatttcggacgttgaaggcacggattctgtagtgaagtggattgtagggatggtccagcgagcgtttgcgtggtcatgagaattacgtggagtgtgctgtgtgctggcactcacgtcaacgctgtctagttagaacccggcgcgtggttactaggttgcggaatctgcaattggatatcgagcggtggtcgcatgcttgggaggacgttttagtgggcagcgggtgccgagggagttaaggcgtagacacagggagccttcggtgttcaggaggtgggagaatttggaagggttgcacaattttatttatttatttatttatttttatatacaaattatcagggagaagagaacgggtttagcgagcggttgctgagatggggagggttaagctggagatcaagaagatagagaacccgaccaacagacaggtcacatactccaagcgacgcaatgggctcattaagaaagcttacgagctgtcagtgctgtgcgatattgatctggcgcttatcatgttctcgccttccggaaagctcactcagtattgcaattgcagcattgaagaagtcattgctcggtttgcaaatttgcctatgcacgagaggaataagagctttgaggatatgttgactcgcttcgcaaacaatcagatgcatcatgaccgcagcaagtacactaggaagatcgaaaatttggagtatctacacaaggcattgaaaaaacttgctggagagaaggatcttgtttcgaatcagcagctcttgtccgggagtaaatcaagttcttacgaggctgaggtgctgcaacaggagctgaagaaagcacaacaagaaaaagaattggtacaacaacgagcaaggctgtacttggccgatgaacaacttcttcagggcgtgacttctgttcagcagctggcgaatatggaaactgaattagagcaagcactagagcgagtacgggccagaaagaactacgtgagcagtgcttatcagactgcaaatgccctgcaacggcagcaacacgaatttcttggaaacagtctacagatgatggcattgcgacaacagcaacagcagcagcaacagcaagcgggtatgggaggaactccgtcattcttgcactggacgatgcaaccgagcgtccagagcccacccaggatttcatggagcagcaaacaaactcctcggcgtcactcatgcctgcaccgttcagtattcgggaaccaggggacaacgggggagcaaatccagcagcggcggcttatttccccgctggaccgcaaccgggagcattagaatcgcttcggcagatgggaatggcggccgccagccgtggattgaccatgcacgagatgtctttggagcagccgaatggccagtacatcgaggatcaacaaaagaaagccaaggtggaaggcagcatgggctttgctacctctagcagtgccgccgaagccgtctccgagaatactgtcacgcgtgatcatcaacaatctgagcagactgacgtcaatggcggtgctgcagattggcctccacatcccgcgaatcaccatccgaatgcattcacgaatggagggttgttctcaagttttagtcagaacggacaccatcctgcgtggaagtaataaacggtgggaggggcctaatttcacttagatggagaaggagctactcatggtccgaatttgagattcaactccggcaaaccgtgccagaaatctgtcaaggtgggtgcaagctaagtcatcaaccactgagctctcgggttagtgggaagctggtcatcatcgggctaagggttggtcactagaaacagtgtgagaaaaacgggcactatgtgctttgagcgcccgatgaccaaacgtgctctctgctctttctttcccccgcgtcctttcactgactccaccttccccgaagaatgctcatgtcaccacgccgagcanaaggttgacttggattctagcgttggcgtggagtgccggagatttttcacctcgtgtgcaattgtaatgagagaacgattcatctagttgactgtttctctgaatccgagacttgcatgtgatacatgacttggcccctgatgaggatgcctgaaccggagtcttggacctcggtgcagtgccatcagtggctcatgtatcatagttaggctgaccgtttttgaaacctagactcttccagactctcatcggtcgtggcagtcggcctggccttgtgtcatgttgcaacgtctntgaattgtactcgacaagcttatacttgaaaaccaacctcgtctcgt

SEQ ID NO: 3012 - DNA, 1795 bp, Physcomitrella patens
  misc_feature (24)..(24): n is a, c, g, or t
  misc_feature (26)..(26): n is a, c, g, or t
  misc_feature (173)..(173): n is a, c, g, or t
  misc_feature (675)..(675): n is a, c, g, or t
  misc_feature (806)..(806): n is a, c, g, or t
  misc_feature (813)..(813): n is a, c, g, or t
  misc_feature (815)..(815): n is a, c, g, or t
  misc_feature (854)..(854): n is a, c, g, or t
  misc_feature (1646)..(1646): n is a, c, g, or t
  misc_feature (1683)..(1683): n is a, c, g, or t
  misc_feature (1716)..(1716): n is a, c, g, or t
  Predicted polypeptide sequence is orthologous to G1935
caattagacctttaggggtggtananatgggtcgtgtgaagttggagattaagaagatcgagaacccgaccaacaggcaggtgacatactccaagcggcggaatggcctcgtcaagaaagcctacgagttgtctgtgctttgtgatatcgacctcgcgcttatcatgttttcnccatccgggaagctcacgcagtacagtaattgcagcatcgaagatattatcggtcgattcgccaatttacctatgcacgagcggaacaaaagaargcttgaaaatctcgagtatcttcacaaagcgcttaagaaactcgcaggtgacaaggaactggtctccaatcagctcatctctggaagtaagagctacgaagttgggttgctgcaagaagagctgaagaaatcacaacaagagaaagaattagttcaacaaagagccaggttgtacttggctgaccagcaactacttcaaagtgtcacttctgttcagcaactggctaatatggagacagaattggaacaagccattgagcgtgtgagggcaaggaaggcgtacgtgagcagtgcttacgaggcagcttctgtcatgcaaagacaggtgatggctttacaggtccgggctcagcagcagcaacaacaacaaggcttatcagggagtacacaccctccatttttacagnggaataatcctgagcgcggagaggcaatacttcaagactttatggagcagcaaacaaactctcagtcaatagttccagtgcagatgaacagggaaataggaagcagtaatgaagctggtccatcaaccttnttccctnanactggttctcaatctaacctgcacagtttagccggacanatgagtctcgtcggagttaatcgaggactaagcatccatgacatggctttggaacggtccagaggccagtacgaggatcgcaagaagtccaaaggcgaatccaacacgggcttcggagcttcgtcaagtagcagtggggctgccgcggatcaaggcaccggtgagaccttcaccggccaatctgagcctgcacatggaagcgcccccagcgccccgaactggcagctttcgcaccaagcacatcacgcgcaagcttattccgctgctcactatccaactggctacktcaatcagaacacagatacttggaagtagttccacgcgctgaggcggcttaccactgtaggctacagtctgtatagaagactaagctcagaggaattaaccacttagaaaggttgaccagtggtcatgcaacttgctcggtttctatgttggggtgattattgtagagggaagaatcattttcgagacgaaaacaaacgtgctatttgaaccgcatgttttctcgggagcaagtcttgagggatcaaacaacgcaggaagcacatgcacattgccgcgtcgaccgatggactgttcagcttttcgtcactggaacattataacgaacgccaacatgatgttcgtgactacgcagctacgaaggttcggcgtccaacagtttctcagcggagacacggccccacctcgtgcaaacaaaaacactcttggactgttcgtctgtgacgtataatatccagcttcttatacaaatgacgttcaggtaacttatagtgaggatacattccnccttaggactccaggccagctgcagcagtattcgtanactcaatggccaatttgcagtatattgcaaggnggacaagtatcaggttcwtgatacctatatacccgatgtattttggctccaacaagctggttaaataagaacgattctc

SEQ ID NO: 3013 - DNA, 1713 bp, Physcomitrella patens
  Predicted polypeptide sequence is orthologous to G1935
cagacttgggggcttcagttcagtctagcgcctgtggatgcgcaggcacgctggtccggtttgcctagatcattcctggaatggatcttgtgccttgtggcaagcgcccgcgggaacaagagaattcgccccgctgctacgaggaagggaacaatacctgattgaagaccgctgttcaccttggtgtgattggttactgttctgaaagcgcgaaacttttttgttttttttcgtgtctttttaggtgatctgaggcctagttgtgagattcggctcaggcttgcctgcaccttgtcctcttttgtctgcgcttgtctgtagcagggtcgaatccgtctgtgggaagaattcgatcgaaatttgggctctgaggaagcggagatgggcagggtaaagctagagattaagaagatcgagaattctgccaacaggcaagtgacgtactccaagaggcgtaatgggctcactaagaaggcctacgagttgtcagtgctctgtgatattgacctcgcacttatcatgttctcgccgtctgggaagctcacccagtacagcaattgcagtattgaagatatcatcgatcgctttgccaatttgcctacgcaagagcgaaacaaaaggaagattgaaaatctcgagtatttacaaaaggcgttgaggaagctaacaggagagaaggaatgggttcccaatcagatcatctctggaagtaagagcgaagaggttgagttgttgcaagaggagttgaagaagactcaacatgagaaggagttgattcaacaacgaatcagattatatttagcagatgagcagcttctgcagagtgtaacttcagttcagcaactagccaacatggagactgaactagaacaggcacttgagcgtgtgcggacaaggaaggcttatgtgacaagtgcttatcaggctgtttctgtgatgcaaagacagatgttggctttacaagcacagcaacaaaagcagcaacgagacaccttggggcaacaaccgttaccgttgcaatggaacaatcctgagtgcggccattcgatgcttcaagaatttatggatcagcatgcaaaccctcaagcaattgtcccagtgcagcatatgaacagggagatggggagcaacagcgaagcgagtccatcaagcttcttttcccagtctggctcccaatcaaacctacacaatttggctgggcagctaaacctcgtgggagctaaccgagggttgaacatccacgacatggccttggaacgctcaggcagtggccagtatgatgagcagaagaaatctaaaggtggggccaacgccggtttcgcttcttcaagtagcagtggtgctgccgctgaagggagtgccgagacgttcactggccaatctgagcccaacgcatccaactggcaactctcgcatcaagcccaccatcacatgcacgcatattccagtgcgcagtaccctactgggttctctaatcagaatgaagaggcttggaaatgattctgcccgttgatcaggaggctcggaggatatactattgcaagctctgaaatgagagggtgatgaatgatcaagggactcatgaaccgcatgaagctcatcaagaccttagacaatcctgttagaaagttactttagatggtcgacgtaacatgcatgccgattgttcagataataatttttactggtaaatgaggcgtgtaaaaattcttc

SEQ ID NO: 3014 - DNA, 1615 bp, Physcomitrella patens
  Predicted polypeptide sequence is orthologous to G1935
atgggaagggttaagttagagattaagaagatagagaatcctacaaacagacaggtgacgtactcgaagaggcgtaatgggcttattaagaaggcttatgaattgtcagtgctttgtgacatcgatctcgcactcatagtgttttctccgtcggggaagcttacacagtacagtaattgcagtatcgaagatgtgatctctaggtttgccaacttgccaatgcatgagcggaacaaaagttttgaggatatgcttacacgcttcgctaactttcatatgcatcatgatcgtaccaaatataatagaaaaatcgaaaacttggagtatttacacaagtcattgaagaaattaaatggagaaaaagactccgcatcgaatcaacttctcttgggaaacaagggttacgaagttgggttattacaagaagaattgaaaaagtctcagcaagagaaggagttagtgcaacaaagagcaaggttgtatctagcggacgagcagcttctacagaacgtaacttctgttcagcagcttgcgaacatggaaaccgagttggagcaggcactcgagcgagtgcgtgcaaggaagagttacgtgagcagtgcttatcaagtctccagcgcaatgcaaagacagcaacacgagttcctaggcaacagctatcagcagatgatggtactacgccaacagcaggctcatcaacatcatcatcagcagcagcagcaacaacaacagaaggctcagcatcagcatcagcagcagggaggtattccagcagcagcacaacagttgccattcttgcagtggaacggcgcacaagagcgaccggaggcgacgcttcaggacttcatggaacagcaaactaatactagccaggctatcgtgccatcacagatgtctcgggaagtggtgagccaaagagaagtgagtccatcaaataacggtttcttcccaggcacagcatcacagtccactctgcacaacctggggcagatcggtcagctcgtgggagcaaaccgaggaatatcaatgcatgacatggccctggaacagcgtggtggtcagcacgaggagcaaaagaaagctaagcttgaaataacgaagaacatgggatttgcatcgtcaagtagcagtggaggagcagctgcagaaggatctgcggaaactaatctgaatcaaaccttcaacaaccaaactgaacaagtgcatggcaacgccaatgcttccaactggcatcaggctaaccaccaagctcaggcttacatcaactctcagtacccaaacggattctttaatcagaacgcagatgcgtggaaatgatatacgctaattaatgcatcgtcacataacagaggtaggtcaaaattgaatggttcaaacgcggatgacatcagggatgaagtgaagagagaacactatgctcttgccagtggagattcacatcagagtatttaaacaattgcgtaacgagatcactctgaagagttggcaggggttggaggcttggagcagcaatctgtaatgagacacatgtgtcttcctttagagtatcatctgtctcatcccggattgtcactagtatcattagctcaatttagtgaaaatgagacttgaaact

SEQ ID NO: 3015 - DNA, 1318 bp, Physcomitrella patens
  Predicted polypeptide sequence is orthologous to G1935
ggtagcgaaaatgggaagagtgaagttagagattaagaagatcgagaatccaacgaacaggcaggtaacgtattccaagaggcgaaacggtctcattaagaaggcatatgagttatcagttctttgcgacatcgacatcgcattgatcatgttctcaccttcaggcaaactcactcagtacagtaattgcagtatcgaagatgtcattggtcggttcgccaacttgccaatgcatgagcggaacaaaagttttgaggacatgctaacgcggtttgcgaatttccatatgattcatgatcggaacaaatacaatagaaagatcgagaacttggagtatcttcacaaagcactgaaaaagcttgcgggagagaaagaccttgtgtcaaatcaacttctgctgaatggcagcaagagctacgaagttgggttgttgcaagaagagttgaagaaatcacaacaggagaaggagcttgtgcaacagcgagcgaggttatatctggcagacgagcaactgctgcaaagtattacctccgtccatgagttagccaacatggaaaccgaattagaacaagcactcgagagagtgcgagctaggaagaattatgtgagcagtgcatatgaggctgctagtgttatgcagagacaacaacacgaattcttagggaacagttatcaacagatgatagccatgcgtcaacagcagcagcagcaacaacaacaccatcagcagcagcaagccggcatgacagggacacaatcatcattcttgcaatggcctgtgcaagagcgtggagaggctactcttcaagattttatggagcaacagacgaatcctgctgctgcactcatgccaacaccgttagcgagccgggaggtgcctagcagtggtgaagcgaattctactggtttttttggatctgcgtcacaatcaagtttacaatcactgggacatatcaatattttgggtggtaatcgaggtttgagcatacatgacatggctatggatcagtcttctgctcagtatgacgatcacaagaaagccaaacttgaagcgagtatgggatttgcctcttcacctggtagagctgctgcagaagcagctgcagatacttttacaaatcagtctgagcatggaagcgccaccaattctaattggcaccaggcacaccaccatgctcaagcatacacaaattcccagtatccaacaggatactttactcagagtgccgatgcatggaaataatatttggaatagcatcagtgtggagaaatttgaaatgggattggcaagtattcaaaggggggtgttcagtgagca

SEQ ID NO: 3016 - DNA, 752 bp, Physcomitrella patens
  misc_feature (720)..(720): n is a, c, g, or t
  Predicted polypeptide sequence is orthologous to G2226
gagccgaacttcatcacgtagcaagaacacatgatgcaagacagtgttgtgaacaaaaactacataaaaaaaggactaaacattaccactgtatagagactccctgtgcaccgcgagtagcaaggtgacttggaggcacgtctggagacattggggtcgtcgtcttgtacccagaggtggaggtcgtcacttttctacaacgagatcaaccctacaaattgggcaagcagttcctccgcacgagagccacgattccacacaatcggcgtggaaagtatgcccgcaggaggtcgtatggttcttgtttgcatctgagttgggtccaaatgcctggaaacagatggaacaaggctcatcctgcggtgcctccgcattcggaccatctttggaaacaactgggagtttctttgcaacgatgatcagattctcccacttcaccatgttgtttgcccgtttgaaatactcatacttgtccgatgctctataccacggaactgacgatgtcttggccgaccgtgtcctgctgcttctccaacgtggggtagtagtcatcggttggagatttcccactaaagcactttgtaagaagattagtaaccttactgcaccgtcgtgacagttctgagccacgtaagggtggggaagttggtgattgctttgcggccctcatacatccacatacaactcgtgaaggagcaagtcttgacttgcaccccttgnttgcaaatcggacaggtaccttgctccttgga

SEQ ID NO: 3017 - DNA, 488 bp, Physcomitrella patens
  Predicted polypeptide sequence is orthologous to G2574
taatataaattgcaattcacaaatacatttttttaattacaaataatatccagtcgtcactcaattccgcccccctacgctcccaaacgtggataatatcacattttgcatactcgaaatcacagatctgaacatcattcgtaagtactcaaattgcagagtccccagaagaacaaaatgttgaaccttcaagtgggatttgtaacttacaagtccggtaaaggaataacacgaacaagaccaaagcctgctctggttatgcttatcttccatgccatcactcacaattcctccacacgccgccgctgcggcaacagtcggcagactagcaacctgcaattaggacggggattcgacaagcaagtccacaacaaccatgaaagagcacactaactcccaaaacatgtcaacgatcaatcgaccagtaaaacgagcgcagagagagagagcagcgctgaaggaacgctatgatgagtgccgcactacac

SEQ ID NO: 3018 - DNA, 717 bp, Physcomitrella patens
  Predicted polypeptide sequence is orthologous to G2574
gtcagctgactccgcaacaaatatcacttggatcagaagcaatcaaagtctaacaatcaacagggtggttcttagtcacaggaattgcatcccactatcttcttggggatatcaactcaaatgtcacctattatgaataacaacttcaggaaaagggtatttcccatcatgtctatattgtgaccttgcatcaatgttgagcctagacattgtagcaaagtcgaaccttacagtacaaagccaaaaagctaacctttttctaaagggtcctgaatacaacgctccccggaaataaaatggttagcatccatctcctacctatcaaatacaactccagtcattacagttccaaaatgtccaaagaggagtgcacagatatttactatgctcctgagcttcatccaggaatcgagtgctgacgggtaatagacagccactgtgacagttcagtgttaaacaaagggattaacaccaccagcggggcggacaacgttttgtgagaaaaattggttgttgggataaggaccgtcttgaccaaggggttgagtggatatgtatcctccagaaacattcgactgcgttgaaaacacagggctaggtgacgtcgattgatctgagccgaagttaagagatcctggaggaaaagaatgatcatgaaactgcgagaaggaatgtgcccagtcatgtgtagccgcattggttggtatagtctgtgga

SEQ ID NO: 3019 - DNA, 587 bp, Physcomitrella patens
  Predicted polypeptide sequence is orthologous to G3032
tggggaactccgtgtttagtcgccggagcaagctgcgagcttaccatataatagcactggacttgtgttctatccagggtatatgtgctgctcaaatctcgcacttattcgcgatttcaacgggctgcgactgaggctgctttgggagggtggtcggagctgatcgggagcggcgcttggtttttggcgtcgagcttcacaattaatggggggaggggaggacgacgagatctcgatggcagaggtcccgatgcagactgcggagaaggaaagggtcgacggattctgccccggaagggttgagaagacaacggagggtggtgcgaaagaaggtggaggtccagaggtgtcgctggcaattcatggagagaagtcaaataaacaggatgagagtaggattgaaacgaatgactccagcttagcgaatgataaagatggatcacaacaagtatgttcgggcagtgactatgacggcggcaaaagtgatgacgtagaatccaccggtggaggtggatatcctaaaactaacgaaccaatccaagatgcctctgctgcccaaatcgcccaagagaacaatgatgtagcaa

SEQ ID NO: 3020 - DNA, 2108 bp, Physcomitrella patens
  Predicted polypeptide sequence is orthologous to G3032
gcgggcggggaatcatcgctagcggggaagggagcgagggagagagagagagcgagcgaggaaggcaacatggagttgtcgaccctgccctctctgcatttctcccgcagtatttgcactgctgaggtgcggcagccaggttgttgtggaattggctccggtttcgcaacggcagcgtctcggattgagcccaggctgggaggtggagctgcagtattgcggcgagctagccatggctatggcgtgggatgtgaattttctataccacgcttcgtgttggggtcattagatcataagttgggtgaaaagctgttgcgtagggctgtgagaagcggagcgtcgggtttgaggaatcgacgggaatggagatgtatgaacgcggaatttggagctgatgccagcaacgcgggttcgccaggatctgtgcattttgttggtattggaggagcggggctttcagcacttggtcttcttgcactgcgacagggttggcaagtaagtgggtccgacttggtatggagcgaggaagttatccggttgaaagaggctggtgcccgtgcatatgttggccacagtgtggctcaactggtgcctcaagggtcgcagccgccggatgctgttgttgtatccagtgccgtgggtccaggcaacgaggaggttgaggctgctcgtgccctaaatgtgcccatttacaagaggggtgattggctagggaagattacagaaggctaccaactgatagccgttgctggaactcacggtaagaccacgacgacagcaatgttaagtgtggtcctgcgcaacttaggggaggacattactgctattgtgggtgctcaagttccacagtttccagatggaggcagtgcattgtgtggaacgactcgcaagtttgttttagaggccgatgagtatgatggctgcttcctaggtgtttcacctcacctcgcagtattgacgaatgttgaatgggaacacgtcgacatgtttcctgatgaggaagctgtcaaaaatatgttcaagaagttcgtcttgcaaatcaagccaggaggttgtcttgttgcttgtggcgacagtgccggtgctaaatccgtgttaggactgatagaagaggagcaagagaaagatttaggttctccattccccagagagagacgggttgtaacttttggtttaggagcgagcgattggcgagcgataatgcttgtcccaaatccacagggtggaactgattatacggttgtatacaagaacaggcccatgactcgagtcagtttacgcttgcctggcatgtacaatgtgctcaattctctcgctgtcattgtggttatgtcgctgctggcagcagagaaggaaagcgacgttggggcacaggcaaaactcatgaagaggaccgccgaggccgcaggaagagctctaggagctttttcgggagtacgcagacgctttgattttgtaggatctgttcatggatgtcatataatcgacgactatgcccatcatccaactgaggttcgtgctgttctacaagcagctcgtcaacgatatgatcagcagcccatctgggtgatatttcaacctcatacggttagccggttggctgcatttctaccagactttgctccggcttttagtgctgcagatcgagttattgtgacacaggtgtatgctgctcgcaacattccaactgagaaggttgtaactggggaagatttagccaatgccattattgggcctccagccgtctatattccagacttggatgttgtagttgagcggctatcgtgggaactggcagccctagataagaatgagatgaatgaccgcggcaacattgtgttgcttactcttggtgctggtgatattaccgacgtgggtcgacgactcatgcaggcatgtgaagtcgcatcacgatagaactttacttcgaaaacccaaattttactctgcatcgattcctgagcgtaggcagctttatgttggtggtatgagtctgttggtttcttcgctggctcacactcatcacatgattttatttcttatgtaatttgttcctgtggttataacttaaagatagcccttgcaacaaaagatgctttcacagtgcc

SEQ ID NO: 3021 - DNA, 2261 bp, Physcomitrella patens
  Predicted polypeptide sequence is orthologous to G3032
tggagagagagtgagtgagtgagagagtgagagttagtgagagcgggcggggaatcatcgctagcggggaagggagcgagggagagagagagagcgagcgaggaaggcaacatggagttgtcgaccctgccctctctgcatttctcccgcagtatttgcactgctgaggtgcggcagccaggttgttgtggaattggctccggtttcgcaacggcagcgtctcggattgagcccaggctgggaggtggagctgcagtattgcggcgagctagccatggctatggcgtgggatgtgaattttctataccacgcttcgtgttggggtcattagatcataagttgggtgaaaagctgttgcgtagggctgtgagaagcggagcgtcgggtttgaggaatcgacgggaatggagatgtatgaacgcggaatttggagctgatgccagcaacgcgggttcgccaggatctgtgcattttgttggtattggaggagcggggctttcagcacttggtcttcttgcactgcgacagggttggcaagtaagtgggtccgacttggtatggagcgaggaagttatccggttgaaagaggctggtgcccgtgcatatgttggccacagtgtggctcaactggtgcctcaagggtcgcagccgccggatgctgttgttgtatccagtgccgtgggtccaggcaacgaggaggttgaggctgctcgtgccctaaatgtgcccatttacaagaggggtgattggctagggaagattacagaaggctaccaactgatagccgttgctggaactcacggtaagaccacgacgacagcaatgttaagtgtggtcctgcgcaacttaggggaggacattactgctattgtgggtgctcaagttccacagtttccagatggaggcagtgcattgtgtggaacgactcgcaagtttgttttagaggccgatgagtatgatggctgcttcctaggtgtttcacctcacctcgcagtattgacgaatgttgaatgggaacacgtcgacatgtttcctgatgaggaagctgtcaaaaatatgttcaagaagttcgtcttgcaaatcaagccaggaggttgtcttgttgcttgtggcgacagtgccggtgctaaatccgtgttaggactgatagaagaggagcaagagaaagatttaggttctccattccccagagagagacgggttgtaacttttggtttaggagcgagcgattggcgagcgataatgcttgtcccaaatccacagggtggaactgattatacggttgtatacaagaacaggcccatgactcgagtcagtttacgcttgcctggcatgtacaatgtgctcaattctctcgctattggcaggtcattgtggttatgtcgctgctggcagcagagaaggaaagcgacgttggggcacaggcaaaactcatgaagaggaccgccgaggccgcaggaagagctctaggagctttttcgggagtacgcagacgctttgattttgtaggatctgttcatggatgtcatataatcgacgactatgcccatcatccaactgaggttcgtgctgttctacaagcagctcgtcaacgatatgatcagcagcccatctgggtgatatttcaacctcatacggttaggtaggtacttagttcctgaaacttgaatgtttttcacttttttgaagactccgttaataacatcttttgttgatttttgttgtcacagccggttggctgcatttctaccagactttgctccggcttttagtgctgcagatcgagttattgtgacacaggtgtatgctgctcgcaacattccaactgagaaggttgtaactggggaagatttagccaatgccattattgggcctccagccgtctatattccagacttggatgttgtagttgagcggctatcgtgggaactggcagccctagataagaatgagatgaatgaccgcggcaacattgtgttgcttactcttggtgctggtgatattaccgacgtgggtcgacgactcatgcaggcatgtgaagtcgcatcacgatagaactttacttcgaaaacccaaattttactctgcatcgattcctgagcgtaggcagctttatgttggtggtatgagtctgttggtttcttcgctggctcacactcatcacatgattttatttcttatgtaatttgttcctgtggttataacttaaagatagcccttgcaacaaaagatgctttcacagtgccaaaaaaaaaaaaaaa

SEQ ID NO: 3022 - DNA, 921 bp, Aquilegia formos X Aquilegia pubescens
  Predicted polypeptide sequence is orthologous to G2
tcttattccgatagagaattcatggttacaagaattaaattggcaaaataacaaatggggttagaagaactcattggaaaaagcagatgatatactggatcaagggagctggcaaatcaataaactaacgagtcaggtggatctcatatgagagtggaaactgttcgttggccaagctgttgttggtctaattatctgcaatgggaatcctgatgatgctgcaggggtcgcatagggtgtaccagcaagccaactattactgcttctgttccagccagactgccgaagttgctcgcctgttggaagagaaggtccacctcccccacctagaccagttaggcctccattgtcgctatttggtaattggtagtttggtggactgaattgtggttgggcaatatgaaacatcgacacttctccactcctccttggctgcccatatatgaatggttcactggcattaagtctgttgggtggagattggatgtgggtctggttgagcaaccgtatggcctcactctcactatacgcattctgtttgtaaagatagctatgatttgcccccatgtgatttgcattggcatcaaacttgcgcatagaaccgcgttgattgttgctccaatctgatacatacggcatctgggaatatctcggatccattgcatgcaatctgttgtcatccctcgattcatgactatcactagtagaggttgaattccccaggctcaaatcaagattatgaacagcattgttaccttgcagcttctgtttcagtatcgaagagaccaagatacacatatccaaaaattgtcccattctagcttcccatcttccacatttgtgtaaggtaacccctctaaatttagagcttcctctaggaaatccggtactttggcgacgaagtacatgaacaaattcctc

SEQ ID NO: 3023 - DNA, 971 bp, Aquilegia formos X Aquilegia pubescens
  Predicted polypeptide sequence is orthologous to G2
tggaatgatgagaagattaattaacatgacaaattaacttgaaaaagagtggtggttatctctgctcatctcatgaaagagtgaaatccattctttggcagatatgtacttgtttgtgaagggaatcctgatgatgctgcacctgtgtatatttgttgttggttaggtggatttgatccccaactagtccaaccaggttgttgctgctctcctgttgctagatacagccctccacttccaattcctatgcctgttcggcttccgttgctgctgctaggaaattggttcataggtggattgaaatgatgaaggagttgaaccataggggttcctccatttctgttgaattgatcatatcttggcagatcagccatcctgagtgagactggtgattgaatgtgtgtttggttgagaagtcgaattgcatctctctccttacttcctccaaattgctcatccaaaggcattggcctaatgccatgattggtggtgttattcctccaatctgtttcaaaccgccgtggtgacaatggacggtctctttcctgaatcccattcttggatgaattccccaagctcaaatcaagattatgattggggacactaccatttgagctgagctcagtttcataaatactaggatcaaaattggtcacagcctccttcccattatacttgattgcagccttgtcgtaagccctggctgcttcaatttcagtgtcgaaaaggcccaaatacacatattttttgcccaagaactgccccatccttgcctcccatcttccacatttgtgcaaagtaacacctctaaattttgaacttcctctaggaaatccggtactttggcgacgaagtacatgaacaaactcctccttagttagattattcatctgttttagatcatcttcataatcattaagactaaaatttatatctgcttcactcccctgacttgatgctgctctatcata

SEQ ID NO: 3024 - DNA, 919 bp, Aquilegia formos X Aquilegia pubescens
  Predicted polypeptide sequence is orthologous to G2
catatataccctccatttaataagaaggttcaagcctaaaccacattctgtattgtgtgttggtaatgggaaaacatatttaccatatattatgtcaagcagatatgaagtctcaatacatatacacgagaaggggatgaattagatgaccacaatggtcgttctggttgcttacccccaaacttgtcattgtattttggtgattcagctccagcagcaatgttgtcgtggttttaacttctgtagtggtgttgggaggtggtggaaggaggataatatccatagtgtgtcatgcttatatgcggagggtgtggtggatgaagggcagctgccgaaacggaggtacttgacgaagagaatcctgatgatgctgcagtagagaacagtggcattggggtactgtcatctatgtggccgtgcagttgccatgcccagttggagagacgcctagaacctacttcaacccttttctctatctttctttcctcataattaggaaagaagctgggatatccaccattccacatgggaggatgcttggatcccattgccaggccatagaggggttgaccgcccaaggttgtcaaagaggggttgtctgtccttgctctcttggcatcaagcaagttgagagggtcaacgtggagattaaaagctcccacactttcgctctgatttaggtcatcagcagaagaagggggagtgatccccaagttcatgtcaagattgcacgcatttcctccattttcaatttccatgatctcgctatcataagtgctgggctcaaaattggtaacggcttccctaccattacatttgattgctgccttgtcatatgcccttgcagcttctacttcgctgtcgaacagcccaagatatatatacttcttgccaagaaattgtcccatacgagcttccc

SEQ ID NO: 3025 - DNA, 879 bp, Aquilegia formos X Aquilegia pubescens
  Predicted polypeptide sequence is orthologous to G15
ggaagagaaagctgctagagcttatgatcttgccgcactcaagtactggggtgcttctacccatattaactttccgttggatagttaccaagacgaacttgaagagatgaagaacatgagtaggcaggaatatgtcgctcacttaagaaggaaaagcagtgggttctcaaggggagcgtccatatatcgaggagtaacgagacatcatcaacatggaagatggcaagcgcgaatcggcagggtggctggaaataaagatctttatcttggaacattcagcacccaagaggaagcagctgaagcctatgacattgctgcaatcaagtttcgtggtgtaaatgcagttactaactttgacattacaagatatgacgttgaaaggattataggaagcaatactctcctagccggagaacttgccaagcgaaacaaagagattgaatacaacgttaaagctgttgaacagccttcttctaagaattgcaggaaggaagctagattgcctgaagaggataatcgtccagagtggaagatggtccttagtcattatcctgaacagcagtctatcactacaagtgacccacttgatcacaaggaagcagagcttggtaattacatgaataaccctttctcctcatcggtacatagctcatggattgaagcgatgaactcagcccaacaagggatagatgagtcgggcaaactagcacctcacttatctaacaactcgtcagtggtaaccagcttgagcaactcaagagaaggcagtcctgataagaatggactgtcaatgctgttcccaaagtcccccccatgctcaaagttttcaactcctattgcaccgacttcaatcccatcttcacagctgaagccttcaat

SEQ ID NO: 3026 - DNA, 926 bp, Aquilegia formos X Aquilegia pubescens
  Predicted polypeptide sequence is orthologous to G15
gttatctaccaattctttccctcctctccaatacttgtgttttttaataccctcttcttttcccccctcatgcaagattttacaagttacattagtcatggatattttaagtatcagtccaagcagcaaacattggcatatgtgacatagaacctgcaggccttaattgagcagatgaaatccaagaattcattgatgtaactggattgatgaatttggaagtcgatgtaggccttgcaaacagcattgacatcccattcttatcggggcttccttctctcgagctgtttacgcttgtcactagagaagatgaattggataaatgaacacctagtgtggcagagtcatccaccagttggtctgaattcatattgtgaagttcgatcagatcatgtaaggcacccgagaatgatgaattcctgtaatttccaataccattcggtttctgctcaatagattcagcaacatcacttggtccatgaggggaagactgatacatgaccattttccaatctggtccacctacagtatgctcttctgataaaccgacatccccattgctgttctgagtagatggatggtgatcaatggcttcattgctagctgttatctctttgtttcgcttagcatgttctccagcaaggagcgtattacttgccataatccgttctacgtcatatcttgtcatgtcaaagttagttacagcattcgtgccacgaaacttaatagcagcaatgtcataagcttcagctgcttcctcttgtgttccaaatgtcccaagataaagatctttgttccctgcaaccctaccaatccttgcttgccatcttccatgttgatgatgtcgtgttactcctcgatatatcgagccctctcgagacccgctgctcttctttcagtgagcacatatctgctagtcatatctc

SEQ ID NO: 3027 - DNA, 916 bp, Aquilegia formos X Aquilegia pubescens
  Predicted polypeptide sequence is orthologous to G214, G680
atataattataaaagacaatgattaagaaaacgaataaaggaagaaactcggcttatatgttgctcagtcacaaacctcttcggagacctccctccaaaactcgttcatattgccagcgcttctattgcgatgattgttaggctcactcgtccaattatttataatctgatcattgaattcatcctttccattggtatgcttctctaacaaatccatctctacctcactgctggatggtgtgttggatccacatgaagaacgatcaacctgttccttggattttcccttatcggcctcctgcaatgcagccaaggacagagatttctgcttgtgacttgcagcttctacttcagcgttgcttgacctagtatttccactcttattacagtctgataatgatagaggcggtagtttagtatctggaacttttgattctaaagccttggagagtcctggatcaagttgttgtccttcacaaggagagaccaagatcctgtgatccgatttctctttttcaatggtatctgtttgagaaggaataattggtgcaaaatttaaacctgtgtgaagaggaagaggacgcataggcaagattccattagctgcccaccatgcagaagccgccattactgtagcgacagcaattgctgaggtacttggagacaagtctccatgtctggactgaaatctttcaaaggagcacaaaggagaatctacaggtgtttccatatttgaaaagggccagaacgatgctgcaaagcttgctgcagcatgggcagctgggttttgtaaaagagtggatacgataagatttgaaaatgttgggtttacaaacatgctgtaactatctcgattggagaacgggttaagcaatgaaggaaagctcgaaagcgattgctgaatggatatgctgct

SEQ ID NO: 3028 - DNA, 842 bp, Aquilegia formos X Aquilegia pubescens
  Predicted polypeptide sequence is orthologous to G280
agtggaactctctaaaaacaaacaaatcctataaagaagaaagaaaaaaccttgccatcatcaactgcttccatactttacatccccaattacagaaacatgaaacacccaaacttaaaaacaccaacaagtcaacaactactaaactcaacaacaaacagacagatcagatagattcaggtaaacaaactaactcaaagataaactaaaatcagcctaggcttcctcaatcacacccaactgctgcaaattggggcttaaccttaggtggtctaccgcgaggcctaggtaatccagtcatcggcacagtggtggtagtttccgtttccgtttccgttgccgttgctgtagattctttgtcagctcctgaatctttctttgggggacgaccacgacctctaccagtaccagaagtagtgactttgagaggagcaacagtaacagagagaggatctctctgcttaggaggacgacctcgacctcttggtggagcagttggatcagctgttgctgcagctggagtagttgaagaagcagaagcagcagcagcagcagtcttggctttaggaggacgacctcgacctcttttgggtggagcattagggtttggacgcatatagttgttcttgaccaaaacaagctcaccgttgtctttcatctggttaagactgtcagtaataagtgtggtatgagattcaggtagatctccataagtagattcgatatatttcgaaattgccgacttgtttgaaccatctttatcatccaaagagtcaattgctgctagtatcatctgtatatttaatagacaaaattaaaacaaacccacatcaagatagatc

SEQ ID NO: 3029 - DNA, 916 bp, Aquilegia formos X Aquilegia pubescens
  Predicted polypeptide sequence is orthologous to G504
agagtgtgttaaacaagacttagagaattaaaaccacaattatataatatgatggagagtactgattcatcatctggttcacagcaacctcagctaccaccaggataccgattccacccaaccgatgaagaacttgtcgttcactaccttaagaagaagattgcttctgatcctcttcctgtttctattatagctgaagttgatctttataagtttgatccatgggaactaccaggcaaggcaacttttggggatcaagagtggtatttctttagtccaagagataggaaataccctaatggagcaaggcctaatcgagctgcaacttctggttactggaaagcgacaggaactgataagcctatcttaacagcaggtggtactcaaaagatcggagttaagaaggcgcttgtgttctaccgtgggaaacctcctaaaggaatcaaatcaaattggatcatgcatgagtatagactcatagataacactggtatcatgaagcctcctggaaccaagaagaactcttcaaggcttgatgactgggttttatgccggatctataaaaagaacaactcgcaaagatcaatagagtgtgataaagatgttgccatcgataacgggttttcaatcatggatcgccagcataacttgcaagcgcaggcagccaaggctacaaattgtgggttatatcttgaaaacaatgagactttctttgaaggactcttatcagacagtgtcaacaacaataacaccctatctcacttagcctcttccagctcaaagcctgacgtttcaattatggttccaccaagcgcatccactatgcttccgcttcgacgcactcttcaatccccttactggaatgaggcaggtagtgagtcatcagataagagattccagaccaatcagagcagca

SEQ ID NO: 3030 - DNA, 965 bp, Aquilegia formos X Aquilegia pubescens
  Predicted polypeptide sequence is orthologous to G594
attcattaaaaaaaaaaaaaaaaaaaaatttaaacagcgcacattagcaagaattatcacagtttgatcaaatatgctacactgcgcagcagataccatgactgttttagaaagacaacaagctcggcaaaaatggcaacaagtcccactactacaacaacaacaacaacaacagcagcatcaacaaagctattttagtgatacccatttcaatttattaccaaattcttcttcttcttcacaacaatttcatattatgatgaatgatgattcagtgattagagattttgtgaatcgttcaattaaattggacccaagtttggataataatgggtggcaggattttgggaaatacccagtttctggaaatggatttggtgttaatggagttgatttggttgattattcactttctagaacatctagttgtccaccggcagatgtggtggtggaagcaaaaggtggtgaagttgtggtggcggagaagttaggtggtaaagttgggaaagaaagctttaagaagagaaaagcacagaactcaaaggttgtagcagaggaagttattagagacaagagaatgaaaggggattcagaagaagagtctaaagttactgaagtgaataacagcaacagcagtactagcaataataacaacaaagaaacttctggggattcagtgaaagagaattcaaaggcatctggagcacaaaaacaagattacattcatgttcgagcacgtcgtgggcaagctaccgacagtcatagcttagctgaaagagtaagaagagaaaagattagtgagagaatgaaatatcttcaagatttagttccaggatgtaacaagatcactgggcaaggctggaatgttagatgaaatcattaattatgttcaatcactacaaagacaagtcgagttcttgtcaatgaagcttgctgctgttaatcctagacttgactttaacatc

SEQ ID NO: 3031 - DNA, 890 bp, Aquilegia formos X Aquilegia pubescens
  Predicted polypeptide sequence is orthologous to G668
gtctgatctagctaagaagaaaaaaccaagaggaagaaaaatcaatactctctctcagctctcacacttgatcatcactactactactactactactacatactcatagcttatttttttcctcaagtgaattaagataatgggtagacctccttgctgtgataaagttggtgtgaagaaaggtccttggactcctgaagaagatataatcttggtttcttatattcaagaacatggtcctgggaattggagggctgttcctactaatacaggtttgcttagatgcagtaagagctgcagacttaggtggactaattaccttagacctggaattaaacgcggtaacttcactgatcatgaagagaagatgatcatccaccttcaagcactgttgggaaatagatgggctgccatagcttcatatcttcctcaaagaacagataatgacatcaagaactattggaatacccatttgaaaaagaaactgaagaagcttcaaacaggtttagatggtcagaacagagatgggttttcaagttttcaaccatcaatcactaaaggtcaatgggaaagaaggcttcaaactgatattcacacagccaagaaagctttatgtgatgctttatctcttgatgataccaaaccttccaatagttgtttatctgaattgaaagcatctaatggttattactctctcacaagatcaagtcaaccaagtcaatctagtactacatatgcttcaagtacagaaaacatttcaaggttacttgaaggatggatggctaatgcaccaaaacctgcacaaactaattcagaaacaactcagttttccttcaacaatgtgactggaacagattcttcatcagaggaatgtacaccaactgcaacaa

SEQ ID NO: 3032 - DNA, 972 bp, Aquilegia formos X Aquilegia pubescens
  Predicted polypeptide sequence is orthologous to G729
tcttcttcttcaaactattttacatgcttcgagtaattaaattaacagttgagaagggttagttctttcgaaggttcaacatagtccatttgccagctttgccttccaagggtgaactcaaggttaggcaacatatgtgaagatgccaaagagcttacatacaacttgtcactttcattgggacacaccaccaacgggtctggcctatatacttccttggttggtttatctgacgattctttggattggaagtgaacacgagttgtttgattctccttagacaatgggctccaggcatttctttccactcctccttgctcgaacccaggagatacaggtagtggtggtcctggtggtgatggtggtggttgtagaggtagtgtttgatgaatagaatgagatggattgatatcagctttctcacaagatagtccaccttccacttcaagaacatctgtcctctgattcaaacccatttctgtctgcccttgacctggtcctttgtcagtgctcttcactgttctatacatctgtaagtgactcttcacatgagctagtgttagatccttcacattcattagttccaaaactgatttgggtgttgctctttcatgaccaccaagaagctccacagcatgaacaaaatgggcatggagtgtagtagtccatctcattcttggagctctaacacttcttttacctccattacccattctagaatttctcttaaactctttaccaaacatttgggggtgatgaagatgatgaagataatgaagattcctttgtaatgatattggtgaaggatcaaatctttccatttcaatccctaaacttaatttaggctcaactccatttcgatgataacacttctcaaggttcaataaaccttgttcatgacttatatcacttccactactacttgcagagcttctatcaccacaaatcactctcctcattgctgaatcaaaa

SEQ ID NO: 3033 - DNA, 915 bp, Aquilegia formos X Aquilegia pubescens
  Predicted polypeptide sequence is orthologous to G860, G1760
agaaaaccagatctctctttcttcttctagttttctctcactttattcatcttcttcttcgttgattgtgccctagatcttaaaattctctttattagttttgtttcagtactcaaaccaaccaattccaaagcttcatcaatgcagattacgtgtggatttcgacgatcgttatcttcataatctttgttaattatttgctgagtttcgcttaaattaactgagtaatcaatatgtaaaagaaatatatcaatgctcggatcgttaactatctgttcagcacataacatgattcctttcagtacatatcagtttatcagattttgaaggaatatggaagtgttcagtttaccccaacttggtagcccctggtgaagtctcatagttttgttgctctggctgacacaactggaggtggataggaacatgcaactcttctgaaatgctgaaaccatttggaagagagaagattgcataatgtcaaaagcagattcagcagagaatacatgaaacacatttaaaatggtggtaggtctataaaatatggcgaaggaaagttgatggatacctttacttctgaagttggattcaatagttgatgatgttcctccttggatttgttgtatcgttcaataacagtcttcatgctgataatgacacaggaaatgttttggaaatctgctctcagttgagattgggttgtattggagcacccagaaccagcatgtagagtggttccagaaagatgcattgctgcatgggaaaggaactggcttgactaataactactgggcccaatgttgtgctattgctgagttgtgaattggcaagacagcatggcttagtgtatggatggaatcaaactctgctgctgcagttaatgcattcagagaggcaaaataccatgggagctaa

SEQ ID NO: 3034 - DNA, 970 bp, Aquilegia formos X Aquilegia pubescens
  Predicted polypeptide sequence is orthologous to G1020
gatagagattacattagaagcagaactagcagaagcttcttgtaaggtgaaaaaacaacatcaagaagaagaaagaaagaagaagaaactcttccctctctttcttctactaagttgcaaaaaacaaggattttgtgacatatatgtacatctgttcttccttctgctgattactcttctgtcatttttttctttaaaagaaaataaaattaactaaaaataaaaattgaaatttcaataaggagccgatggatgatagatctgtaaaatcttgaaacgaacagataaatccaattaagccacttccggtgcaggagggaagttaagatcaaaatcaagaactctccttggagggctaggatgattataatcaacaacagatgatgaatctgaatcactttgaacaccactctgattattattgttattaatcatgctgtgatgctgctgttgttgttgatgaagaaaattagtagccgatggatcgaatcgaagacggctttgctgttgttgatgatattgatgttgttgattcatcatcatcttatcagacctcacaatcgcatcaaagtaaaacaaaggatgtgctgcattagttggcaaaacaccaacttgatgtggatgacgctgatgatgttgattaaaaggaaatctaacggttccagcaccaccaccacgatgcatcagatctagatctagtggtggtggaccaccaacaacagccgatggtggtggtgcttcacggctagatgattcaacagtactactctggctagggctttgattattactatgattaatattattattgagaatctcgaggttgaggtggttgtggttgttgttttcagatgaagatggaattgggaaattagttttcgctttagcacctcgaaattctcttgcagcagcatcataagctcttgctgcttcttcagccgtatcaaatgttcctaaccaaacacgactt

SEQ ID NO: 3035 - DNA, 973 bp, Aquilegia formos X Aquilegia pubescens
  Predicted polypeptide sequence is orthologous to G1108
tcatctgacatacattctgccatgcacacataccttgcgttacacagtacatccttaacgtatctaatcaaatcaaattttctattaggtttatttgatagtacaaacattccataactgtttcagaaaagaaaaatgaagtacggacattatgaaataaagctcgtgcaccagcagattatgaagtagtctctgagatgactagcagccaaatgaactgaacgaattccttctacaaacaagcttctgtttatataagacattgtcacaagtttgatctcatcgaaaaccatctcatgttaactgttaacacaaggatccatcaaattgtgtacccctttaaattaacagttccatcagagttctgcagccaaatcgaagcaaaccgtatatattttgtaatcactcttaatttaaaactgttcacttttgctaccatgtatattaacagcatgaaacctgctgtccattgctgcaagtgaaccgcctggtggggagggagtggtgctgtggtggggaactaaataattttaaagatcaacgtttccctcagataagctagaagagtattgggcagcatcagaccgattcaacattctctttaccacctcaacacttcaggctagcgaaagtcagactggcttatatatatatacacaggagctttaagacattctcactaaaacacagtgctcccatacgctgacccacctgctgattcgcttccaacccccctttcaccttgccgatggctggagtttgctgcagatggtgagccctcgttgttctccccaacctcacacttgcagagtggacataatgcgttaatctttagccatttgtccacacactccatgtggaaaaaatgattgcatggcagctccctcagctcatcgttgtcggcatactttgccaaacaaatgcaacaaacagcatcttctcctgagattacacgctctttttcagttccagc

SEQ ID NO: 3036 - DNA, 924 bp, Aquilegia formos X Aquilegia pubescens
  Predicted polypeptide sequence is orthologous to G1137
gactgccctagcaaatggacctcaagggtggttctatggcttaccccgttatcgccaggccttaacacacattcctgactgtgctcccaaggagctcaatgctcacccagaaggatacaatggggatatcacttcagaagcagcatcaaggccacctgaaaagaaatttattgtttttgatcactctggaaatcaaacaagattgatttatagtcctggcactgattatcccaatcagtgccctgttgttcagaacccaatagcattcgacaatcacagcctccaaatagaggaatggaggattaagaatggccttttgtatggaggcagccccgtttctttcaatggaattgatgagaagagggaatatattgaaactgtggaggaaagtgaaatgcatgaagatactgaggagctaaatgcactactgtattctgatgaagaagatgaatgggattgtgaatgtgatgaagaagttagcacaggtcattcccccagcaaaatgaccagccacattaagccagaaaaaaatgcaagtgctgaagaagttgctagctctggtggctgccatcctaaaaggaagagattacatgatgaagagtatagtgcatcctcacttgtggacactgcaagttcagggaaacctagtggatcatcggagtctgaggatgatgcagaatctagttgtggggggagcagatttgattcattaccagtcaacaaacgtttgaaaagggaaaaaatccgtgagactgttaacatattgcaagacatcattccaggtggaaaggacatggatgcgatttatgtgttggatgaagcaatccaatatttgaggtcccttaaactcaaagccaaatccaatatttgaggtcccttaaattcaaagccaaatctttcggagaaagtttagactaagcagca

SEQ ID NO: 3037 - DNA, 922 bp, Aquilegia formos X Aquilegia pubescens
  Predicted polypeptide sequence is orthologous to G1146
tatattaatctgcaatataaaactagttcttcgaaagttcagatattgaagtttcaacaacggcagacattaaagagtttaaaaaataaaacatatctttcacattatccctgatgatgagaagcgggtgtgcctctccatttacttaagtaccagcatgcttccacagacgaacaaattccaaaatatggcagatatatgtatcaactacagaacttgttagaattgccactttttttttctctggaatttccacgaccatgttcttcagaaaagctgtggtgtcttttccgcataactacaaagaaaacaagggggagatttttcttcttcaataaaagaatatgccttccataaagcaggacaaaactgaactggccttcactgacacccaattctatgcggcttgaaactagttgatctcctgaacaaaatcaacagctcccaaatcattactgaatgaactgcaccattccaagaatcatgtaaagatcttgaatcaactcttgctgatgggtttcgctgataccagattaccagacctctgtatttttgttacctctggccagtccatgcacgccaccccatgttgtattgaaggactagaatcttcaccaaatggggatgagtaacatcaacatcaaaataatagggactgtccgtcaccattggaattttaagaagtgcatccaatagaatgtgtttcaaccaccagcctttcacgttggtctttagagccattttcatggtactccttgctcaatgacctgtatctccatacaaagtgtttcttcaaaatacgagaaatatttttcaattgcaatatctcgtaatgaatctgagcatgtcgatgaccaggttctgctgcagtgatgtcaactactaacgtcatataaaagaatctctctcatgatgtcatttt

SEQ ID NO: 3038 - DNA, 877 bp, Aquilegia formos X Aquilegia pubescens
  Predicted polypeptide sequence is orthologous to G1146
tttgaaatcacggtaccatgagttgcatgaccaaagtccagcgcaaagaactggacttactaattgttattttgccagacaataatggttctctttatggtgatttgaaacgaatatgtgagacagatcttggtcttgtttcacagtgttgtttaacaaagcatgtttttaggatgagtaagcagtatatggcaaatgtagctcttaagattaatgtgaaggttggtggaaggaacacagtgcttgttgatgcgttgtcaaggcgcatacctttggttagtgatcgacctactatcatttttggtgctgatgttactcatcctcatcctggagaggactcaagcccgtcaattgcagctgttgtcgcttctcaagattggccagaagttactaaatatgctggtttggtatgtgctcaagcccatcgccaagaactcattcaagatctttacaaaacctggcatgatcctgttaaaggaactatgcatgggggcatggtgaaggaacttttgatatccttccgcagagcaactggacagaagcctgagcgcattatcttttacagggatggggtcagcgagggacagttttaccaggtcttgctgtatgagctggatgcaattagaaaggcatgtgcctccctggagccgaattaccagccacctgttacttttgttgtggttcagaagcgtcaccacacacgactatttgcgaacaaccatgcagatcgtcgtgcagtggacaaaagtggcaacattttgccaggaacggtggtagactcaaagatctgtcatccgacagagtttgacttttatctttgcagtcacgctgggatacagggcactagtcgtccagcccattatcatgttctctggga

SEQ ID NO: 3039 - DNA, 997 bp, Aquilegia formos X Aquilegia pubescens
  Predicted polypeptide sequence is orthologous to G1146
tactaatttactatagtctggaataaaaaatcacacttgaaactccacaatcaacaagaaaataaaccgattacaaatccacaggttccagggaagaatccttaaagagatcttcttacaaaaccaagagcttctaataaagctcattcttaacaaaataacacaatgttcaaatcatttcacaaagatggaaagttgttggacagtaatatcaatttaagggctttgagcacacacacagctttatttcatttctccagacacagctcaccattaacaataaaatgttaagttcttcagattgtcacaaaggggcggaagttgtttaacttgggcatctgcaacttggtgaatcttgctgtctctgactgagctttcttcagaaaatgagccctcctcaaagtagaatcgtgcacgaaaagcagccagatgagcataatatgctggtgacacataggagaccgaacgtgtgcaccttgcatatatgtaacacaggttattggtgagggtttgaagttgatctgccgtgaactgattatcatcacatagaacatggtaatgagcaggacggctcgtggcctgaataccagcatggctacacaagtagaagttgaattgtgttgggtggcagatatctgaatccaccacagttccaggatatatatttccgctcctgtctacagacgagaaatcatcatggttccagggaaataacttggtatgatgtcgtttttggaccaccacaaatgttataggaggcacaacagattccttgaattcattcctccatgcctcccgaattgcttctagctcatactcgcggacttgattaaattgtccgtcactaacaccatccctgtagaatatgatcctttcacgcctccgctgattgttcttctcaaaagcgtgaaaatgttccttggccattctttccagatctaggatcttttcctcacgaccaagttgtgctgacagtataggaatataatttgtgaca

SEQ ID NO: 3040 - DNA, 972 bp, Aquilegia formos X Aquilegia pubescens
  Predicted polypeptide sequence is orthologous to G1146
atagcatgcagagtcatacttgggtggtgaatgtatagcagaacatgagttgggacaaaaccaataaaaactggtatctgaacaagtatttccctctgccacatctagcagtcaaaactaataaaaacggatatctgaacaagtatttccctcttagccacatctagcagtaaaacatgactttcttcacattatctttgagtgccgggagggctctcactgctccatttccaccaggggccctagtagtgcggccaccaacacctgaaccaccacgaccacctgctgcaccactagataaggaaccactatcagaggcatcaggctccatgtaaaaacgtgcacggaaagctgccaaatgagcgtagtatgctggggggactatagaaacagaacgggtgcaccttgcatacgtataacagaggttattcgtgagtgactggagtccatcggcagtaaagttgttctcatcccataatacatgataatgggcaggacggcttgtgccctgtattccagcatggctacacaaataaaagtcaaattcagttggatggcaaatcttggagtccaccaccgtacctggtaatatatttccgctcctatcaattgtgcgccggtcagcatgattattagcaaacaaccttgtatgatggcgcttttgaacaacgacaaatgtcaccctgggctgataatttggctccagagaagcacatgccttacgaatcgcatccagttcatatagcaagacttgataaaattgtccttcactgactccatccctgtagaatatgattcgtgaaggttttcgtccagtagctttatgaaaagatctcaaaagatccttgatcatgcctcctgtcattgtaccttttgcggatcgttccagactttatacagatcttggatcattcctggcgatgagcttgagcacaaaccaaaccagcatactttgtgacctcagccatcttg

SEQ ID NO: 3041 - DNA, 943 bp, Aquilegia formos X Aquilegia pubescens
  Predicted polypeptide sequence is orthologous to G1146
tgagcatatacacaacaagagatacatcaattgatagtggacaatgatttactaggaacattaactccacaagttctatttttaacagtaaaacattactctcttcacattgtccttcactgcgggtaacggcctcacaccaacctcccctgctccccgtgtagcacgcacagatggttggctaccacccgttgagttgttttcttgtaagtctggctccatgtaaaatctagctcgaaatgctgctaagtgtgcataataagcgggtggaacaactgagacagagcgcgtacaccttgcatacgtgtaacacaaattgtttgtcagggattgaattccgtcagctgtaaagtggttttcgtcccataaaacatggtaatgagcaggtctgcttgtgccctgtatcccagcatggctgcagagataaaaatcaaactcagtcggatgacatatttttgagtcaaccacagttccaggtaaaatattcccgctcttgtcaatactgctgcggtccttgtggttattagcaaacaatctagtatgatgtcttttctgtactatgacaaaagtcactggtggttggtaatttggttctaaagaagcacaagccttcctaattgcatctaactcatagagtaggacttgataaaattgcccttcacttacaccatccctgtagaatataatcctttgcggtttttgacccgttgcctttcgaaatgaaatcaaaagatcccttatcatcccaccactaacagtgccgcgcacaggatcgtgccaggtcttgaacaagtcttgtatgagttcctgtctgtgagcttgggcacaaactaaaccagcatattttgtgacctcaggccagtcctgagaagcaactacagccgcaattgaagggcttgaatcttctccattctcccggtgggtgacatctgctccaaatata

SEQ ID NO: 3042 - DNA, 847 bp, Aquilegia formos X Aquilegia pubescens
  Predicted polypeptide sequence is orthologous to G1198
cagaaacacttgcttccaccaactaatctagctctggcattcaaacagggcctactacaacttatataatttataacaaacagtgcctactacaacttacagtgactattgttctaaaggtgatcactaaattaaacatacaacaccttggtgactagattttgctgctgttacaacttacaggagattagaacttgtgctactatcgtgctttccatagacatttgacagcttttcagaacagcgtcgagttcaagctggagttgcaagccggaccaagatactcattgtggttcagtgactcttgaatgctacctgccatttccttaaatacgttcagacaaaataaacaaatggccctctcactcccttggacgtgccaaccacagagaactaagtgcacggagccgagaaaaatagtctgtaatagcaagaagagcacgtgcagattgccgggttgtcaatattcgatgcatttgttgcagtgtttgttgcctcaggttgtcagcctggtgaaggaatccctcgagagtttcaagcttccccatggccatggccatctgacccatatagttcgccacgttccctgatgttcccgatgtgccaggagaaccactagctaatgtctcagccagagattgttgcaaagcttccataccctgtgacaatgcatcctccgcctgttgagatgattgctgcagctcgcagattcccattagctgttgctctgtcagaggctccaaatgatttacaagaagcttcagtagctctgatgaacggaaaccaccaagccagagaaacacctttctgcagtgtcttccacatgccagatagcatatggatacat

SEQ ID NO: 3043 - DNA, 758 bp, Aquilegia formos X Aquilegia pubescens
  Predicted polypeptide sequence is orthologous to G1198
aattttgattatataacaaacagcaatacatgcatattatttcaactacagcttcaaacataactaaattacagcacctaatttgaccacataatgactgttacatgtaagaggtgaaatggcatatttatgatcacaataccaccatggggtcctagaacggtcaaacagattggcacacttccaaaactgggaagcatacactgaccatggaggatgaaactattgctgtgtaatcatctgatccatcatctcttgaattgttaggaaattacacttacagggcctctcattcttttggtcgggccaaccatagagaactaagagcacggagcctagaaaaataatcatgtatagcaaggagagcacgcgctgactggcgggttgtcaaaatccggtgcatttgttgaagtgtttgctgccgcagattatcagcctggcgaaggaaaccctccagagttccaagctttcccatagccattgccatctggcccatgtagtttgccacattcccagatgaccccgaggggccaagagaaccactggccaacgtctcagccaatgactgctgtaatgcctccattccctgtgataaggcatcctcagcctgttgggatgactgctgcaagttgcagatgcccactaattgctgctcagtaagaggctccaattggttcaccagaagcttgaggagttcagatgagcgaaagccaccaagccacatgaaacacctctctgctggagttttccacataccc

SEQ ID NO: 3044 - DNA, 961 bp, Aquilegia formos X Aquilegia pubescens
  Predicted polypeptide sequence is orthologous to G1198
gtaaattgcaaatgacatttcattgatttacatgtacaagatctcatctctagctttccatgcatcttcattttctcctttcaatagcttgaaaacatctgatggccatgaaatggtgatgaaaatgcaaagttgatcatttgtagtttgtttcattctcttgatcaataatttgaaaaatggctctgttgatgttgaaccatttgtaaatcagatgttgtctgacatgagttatcatcgctgatcatgtgttctcgtggtcgtgatgcccacaacgaactgagtgcacgtaatctgttgtagtactcaccaattgccagaaaacaccgtgctgcctgtcgaactgtcaatattcggcgtaactgatgaagggtttgttgtcttaaattatcagcctgatgaacaaagccttcaagattggagagtttccctagagcaagagccatctgacccatgtaatcgtcaacattggatccatcgcatagggacccagtagcaatggtatcggccaaagattgatggagctgctcaaggccttgggacagagcatcttctgcttgttgtgaggattgttgtaggttacatattcccattaactgctgctcagttaatgggtctaactgaggcatcaatatcttgatgagttcagacggacgaaaaccacccatccagaggaaacaacgttcagctggagtgatccacattccagtgatgagatggaaaacatcggatttagctgcaattcccttaagtcgaaaaatttcatcatagtgagacagatatccatctgttatcatccttagatcaccatcagataggtgagcttgcaatgcagtccgcagctctgacatgtgcctatgatcatcttctaaccatcttgcatattccatgtcaagatagcagcatctgagctgagacttccacctgcaccacctcctgctagaataatccctgagatctg

SEQ ID NO: 3045 - DNA, 1027 bp, Aquilegia formos X Aquilegia pubescens
  Predicted polypeptide sequence is orthologous to G1421
catttcttcaaataatcttcaacacctaaagatgaagacttgaaatcttcattataacaaggaaaatctccaaaatctccaaaatcatctctcattaaattgttgtttggtatactgaaatcaccaaacaaatcatcaagtggagctctaaaatcgaatatatcgttcaaaaacggtgtatccaacggcaaaaactcatctccgaaatgatttgataaacaatttgtttcatcttgaaattcttctgagtctttaggggttttggtgttttggggttttgcttcttcttcttctactactacttcttgtttatttgaagaagaagaagatgaagaacgatatcgaagaacagaagttggtgatgagatattgtgagattcttctgatgaatcataaccagaaactgaagtagtaaggtttatctcaggtttaatactagtcttttctttcttcactcttaccttttcttccttcttcacttcttcttgttgttcttcttgttgagaaccaaagttgattaaagcatctggtcctcttaacttgatagcagcattatcataaacccttgcagcttcttcagcagtatcaaatgtaccaagccacaatcgaacacgacgagcaggatctcgaatctcagcagcccatttaccccaaggacgttgtcgaacaccacgatacttcttctttccatcaccaactcttgatcgtttgttgttgttgttgttgttgttgatggttttgttttctgccaaaactttcttggatctgatctttagaccaccatttgattcttgaataacacttgaagaacaaggttcaacattgatttcatttatatatctcttaacacgacaacgacttaaaaaagtatggtcttcttcatcacttgaagaatcagttgcgttgttatcagttacagagaatcgaacaactttaggaccaagaatagttgatgaagagagagatcaatgtttggtggtggcttcttcttgttgatggtggttgatgtttaacaactttctttatc

SEQ ID NO: 3046 - DNA, 805 bp, Aquilegia formos X Aquilegia pubescens
  Predicted polypeptide sequence is orthologous to G1482
cttgtgagagagaccaggatggatagctatactaaaagttgctaactcaatgcgccagttgtggagcttctgccacctttgcgcccccaccattgcccatactaatttggaaattctctcaacttcaagatctttccaatcaatccccatatctatttttttaatacccttataataaagttagtatttgcttcaaattgaatattgcattatgggctcttttcttttcttagagatgagatgagatgagatgagaatgagatgagcttttccgcttccttcttgctttagagaaataataaacagtttgtaatagtaatactactataataaattctcatactagctaccaaaccaagaaatgaagatccagtgtgatgtttgtaataaagaagaagctttagttttctgttcagcagatgaagctgccctttgtaatggatgtgatcatagagttcatcatgctaataaactagctagcaaacaccatcgtttctctcttcttaatccagcaaacaaagatgcccctcgttgtgatgtttgtcaggaaagaagagcttttttgttctgtagagaagacagagcaatactctgtagagaatgtgatattccaattcacacagcaaatgaacatactcagaaacataatagatttcttcttactggtgttaagcttgcttcttgtaatcccacatcttcatctaatggttgtgatgattttcaaaaggtcaacaacaaatctcagtcattcataaagtctactccaccaccaccaacttctattgaaaatagtagtactactcat

SEQ ID NO: 3047 - DNA, 603 bp, Aquilegia formos X Aquilegia pubescens
  Predicted polypeptide sequence is orthologous to G1482
ctaaaaatattttaaaacctaagattgggaatgctcttacaaatggaaagaataaacccagattcagatctgagaaactgtaaatacaaaacttcccaaagaagaaaccaagcacacaagcgaaaaaaataaaaacataagataacatacaaaagtagtaaaaacaagaaaatcaagatttggggttggtgttcaactgttgagtgttgattcaattcatttcatttggctaccaaaaggacctgcctctcttatttgatggaggactaattgaaggaactgtaaaaccatgatcactccatctcttgttgttcatcttgattgggattacatctttgatttccttgaaaatcccagtctttttctcattgattgtgtgtgatggatgatcacaaggatttggagcttgaggtacccacatacacaaatcatcagaagaaaaacttcccagattggtttcaacttcagcatcaagaaaaggcatcaaatcatcattcttacagaaaccatgaggagcaactgaagatgaatccagaaagtcttcaacatgccatccaggcaaagtttctatcaagtactctgctatactacttgtagaaccat

SEQ ID NO: 3048 - DNA, 885 bp, Aquilegia formos X Aquilegia pubescens
  Predicted polypeptide sequence is orthologous to G1539
ctggtcaaaatgcagtatatggcattggcaatcttattcacattcacatcacttcatatatttacttccccacgtttgcacttacatgatctatccattataccacaaaaacattgaaaaagggttcccaatttccaataacaacaaaaactagactaacctactagactaccaccttacactacaggagaacatatagacttgcattgggtaagtttccatgttaagcccttcaaaggaattcaaaaaactgtttgggactgcaattagtattaactgtttcaatgcaagctagttcacttgccttctgaacagctacatttggaccactttcgacgccactgttccgagcaggaaagagttgaagagtatgtgattcttcatgtttatcaacattttcactctggggttctttagaaatgttcaaatattgattgtttataattgctggattcattagtgttcctagaactgctgcagatgttgttgttgatgtggtggtatacattggagttgttgtgggagaagaacaagatagctgcatcatttgccacatggcatgtctatcaaccaaccttctttgttgtacttgttgtgcctcttcaaattgaattctttctgatatttctgctgctctttctgctctttgcattgaaacagaatcctgtgtaactgtactaaagttagtagtgaaaccccagtgtttggcttgttgttcatgaacttcaaaatttgtcctacttgaccctgattctttgttttctatgctttcgacacttccttgttgatgttcttcttctgcagatttggatcgtcttcggcgcttttgtctctcccttgctttgtgattttgaaaccaataaaacacattctttccttcaattt

SEQ ID NO: 3049 - DNA, 880 bp, Aquilegia formos X Aquilegia pubescens
  Predicted polypeptide sequence is orthologous to G1594
cacattgttatggatagttgtacatatttgcagaaggtttgaattccaaagacaatataaaagcccaagttagatacatgtacagttacagttcatcgtttcctcctgggttgtcataaaacattgatccacctccgccacttaccccttcaatgacagcaaagcgcatgtcttcagatggcctccaatggcgctttctctggttgatgaaccagttattaagctgcttctggtccagtccagtcatttccgcaagcttagacttgtcctcttccgtgggatacggccatctatagtgagagttccaccagtccagtaatgtagttctcgcatccttaggcagctttcctttctttcttttcttcaagaagtctttcttgagactactaagatagccactatatttccgcataagcatatcttttaactcttggtccccagatcggagacttgaagattcttggctctccaatgattccttctccccacagcttagctcctcttctgaagacccaaccgtttcatcagattgatcatagtttccagatatggtagtagtagacattcctttacaaatatgattaagttgtgtttcaatcttgctcaagaatgttgctgcttcgtcaaatgactttgttaactcttctttataaccaaccaatatcttacaataagattccatgaactcatcaagctcgggatcatctccaatctcactattaaaactattgctacttggcctactttctcggctaatttcttcaaaaagtgatgcaacttctggtggcgcaccgatctgtacatagattaaaactagttagaaaatagataaacaaaagtagagttttatgtgttaagaaagagagaatgaagtaacctt

SEQ ID NO: 3050 - DNA, 944 bp, Aquilegia formos X Aquilegia pubescens
  Predicted polypeptide sequence is orthologous to G1944
gaaattttgatgcatggaagggagagaagtaatgagttcaggtggaattacagtgatgggtgcagatgctccatcaaactatcatgtagcagcaagaagtaatgaaaaccctaatcagattggtggatcaacagctgtagctacatctgtgagtgtagctataggtagtggtagtggtagtgggactagtggaattggaggaacaacttctttgaagaagaagagaggtagaccaaggaagtatggaccagatggtacagtttcattagctttatctccgatgccgatttcatcttcagcaccggcatcatcaccggtattacagacatcatcagcagcagcagcagcacccttgacaggggagttttcgactgagaaacggggtagagggcggccagctggttcggtgaacaagcaacaacagaaagtggaggtggtggagaatttagggaattgggtatcttgctccgttggtgcaaatttcatgcctcatgtcatcactgttgctgcaggcgaggatgtaacgatgaagattatatcattttcgcaacaagggcctcgagcaatttgtgttctttcagcaaatggtgtaatttcgaatgttacacttcgtcagccagattcatcagggggtactttaacatacgagggccgttttgaaattctttcgttgtctgggtctttcatgccctcagagagtggaggaacaaggagtcgatctggtgggatgagtgtttctttggcaagccctgatggtcgtgttgttggaggaggagttgcacgtctcttagtagctgccactcctgtgcaggttgtggttggcagttttcttccctgcactcaacaagaacagaagccaaagaagcaaaaacctgaatcaacatcagctgctgcaccaactgcggcagttcctatttctagtgctgagatggaggaaggctaca

SEQ ID NO: 3051 - DNA, 967 bp, Aquilegia formos X Aquilegia pubescens
  Predicted polypeptide sequence is orthologous to G2141
aatttggtatgtctagcaatgaatctggtgaaggtgaattcagcggtggtggccaaggagaacactctattccggaaaatgatggtggtgagccttcctcgtcgaagggcattagcacaaagaaaaggaagagggctgctcagaatgctgaaattgatcaagataagggagcttcacaacactctggtgaggctaaggctgatgataagtctaaagagaagggtggtcagaatattaattcagcgaccaataagtctgctggtaaacatggtaaagatgtctctcaagcttcggatgcccctaaagaagattatatccatattcgagcaagaagaggccaggctacaaacagccatagtcttgcagaaagggttcgaagggaaaaaatcagtgaaaggatgaaatttcttcaagagcttgttccgggttgcagcaaggtcactggcaaggctgtcatgcttgatgagatcattaattatgtgcaatcactgcaacgacaggttgagttcttgtccatgaagctagcaactgttaatccacgactagacttcaacattgaagggatccttggaaaagattcacgaagtggtccatcgacattaggattttcgcctgatatgagtatggtccatccccagatgcatccatctcaacaggctttactccaaacaggaatacccggtgttggaaactcgtcagatgcacttcgtagaaccattaattctcaattggcagccttgaacagtggatacaaagatcttatgcctcagaaccatcaacagattgcgactgggtgggatgacgaactccacaatgttgtacagatgggctttggcaccaatggccctttcaacaatcaagatttaaatggtcctctgccaccaggccatatgaaagttgagctttaaacatcacctttcttctatcaccaaccaagtgaaagcaccttctgtgtttttttgcattg

SEQ ID NO: 3052 - DNA, 915 bp, Aquilegia formos X Aquilegia pubescens
  Predicted polypeptide sequence is orthologous to G2141
cagactggtggtgagatcatgcctcggaatttatcacagtttccagctgattccaacttcattcaacgagcagatagattttcatgttttaatggtggaagtttcagtgatgtagtaaacccctataacatatccaaatcaatgaattcttattccaaggatggagcaatgattcgaggctcatctgaagctctttcacccaatgcattgaagaatgcattaggtgtccaaactcaaacaaaagagaaaactgatgatgtagcgggatttgtaagagccactgatgaaactacgaatgaatgtaaaatgtccaatgagactgaggtcagtggcagcgatcgtcaagtaaaaccatctttgctggagactcctggagaaccttctgcatctaaaggacaaactgtgaagaagaggaaaagaatttgccagggtactgagatcgacagaactgaaggatctccacaacttcaaagtgaaactgctcaagatgacaatgaaactgaacagaaaaatggacagaagagatcaaatgttggtaaaacaactagacatggtaaagagagctctcaaaattcagatgcagccaaggaggattatattcatgttagagcgcgtagaggccaggcaacaaacagccatagtcttgcagagagagtgagaagggaaaagatcagtgaaaggatgaagtttctacaagacctagttcctggttgcaacaaggtcacaggcaaggctgtcatgcttgatgagataattaattatgtacaatcactacaaagacaggttgagtttttgtcgatgaaacttgcaactgtcaatccacgacttgaccttaacattgaagcttgcttgcaaaagaaatcatcagtcacgggtgtcatccatgtttctttctctcagatacaaatatggtca

SEQ ID NO: 3053 - DNA, 919 bp, Aquilegia formos X Aquilegia pubescens
  Predicted polypeptide sequence is orthologous to G2520
tgaaatctgtcagatgatatatggaaaagaatgaatttctaacatgctgggatggagactgttcagatttttaagtttgagctcatcatataaacagaaacatagctccatgcctgatgaagaaaataatagtggtccttgaaataacctgatagatgggcagaatatatattccacaatgactgaaggagaatacacagtacttcatgcaactccatttgagaaggactttataaacttatgtcgttctttcaaaaccaccaccgacttgcatgtgtagccattctggtgctgatccttggccatattcccttgtagcttgtgagccgaatggtataccagaagcatcaaaaggctgtgcgctaaaatctttcggtgagaatccatcaatggcggggttcattcttgaattaactgcttcaagcttcattgaaaggaactcaacctgacgctgtagtgattggatgtaattaataatctcatcaaggaccatcgctttgccaatgaccttattacatccagggaccaaatcttggagaatcttcatcctttcactgatcttttctctcctagctctttcagctaggctgtggctatcagtagcttggccccttcttgctcgtacgtggatgtagtcttgcttaggtgcctcggaaggttgattgctctgttcggctggcttattacctgcgcccgaacttgcttcaaactcagcttttgaatcaccattttcatttctgagacccgaaactttaaggcgtttaccatcaacatcattcaagtcattgccactgctagtagacataagcttggaagactcatcttcagaaccagttgcatctcttctcttcttcccacttgcatcaccatttcttccactatactcagtaacaacactagaatcatcaatagacatatt

SEQ ID NO: 3054 - DNA, 938 bp, Aquilegia formos X Aquilegia pubescens
  Predicted polypeptide sequence is orthologous to G2741
tatatgaggattttatctattattgggaggaacatgatggcgaggcccaatcgaattgaatttattaacacaccaatctctttgctgctccctatacatattataatgatgctgatcgaacccctgataggtggcagatggtggattaccaactggtattccgatatgactagcaccatgagccacaccaagaacaggcataggcatcaaaggatgatggccataaggcattggatgcggcactgcaggtgatgggattgctctgattgactcatttaagcttggtggaacaggtgtagacgcaaagagctgatccgaaggcgatggaccctcattcgacaaaccctgcattctgttcaaatacaatctatatttctgaagatgactagcgacattttctctcgtaagtccttctacattcataagctgcataattgtttttggtacagcattcttaatccccaaatgcgcaacaacatcaacaaatctcttatgtaattgaggagtccaaactaatcgagggcgtttcaatgcacgcgcagtttgatcatcattagaattatctacaccttcttctatcaaattctccattccttcttggtgttgcatcaacacagatttccgtttctcagatccatctttttgttcattttgaaacttatattgattatcatgttcatcagattcaatttcaatctcattttcttctctttcaacaacaacagaatccttaccagtaccaccaacacttccatcttcaccaaatgaaaataaagacttgaaattactagataaaaacccttgatttgatttacgcaaactcgaaaatgttttctgtgatgctcgattaacatcaatcaaagttctagatggctctggagttatactgaaagcagaagctaattcacgagaaattaaagattgagataatggtgtta

SEQ ID NO: 3055 - DNA, 935 bp, Aquilegia formos X Aquilegia pubescens
  Predicted polypeptide sequence is orthologous to G2741
caaccatcattaatgttaaacaaggattcctcaggaacaacactgagggacaatcaataagatttgatcatatcagtatcacaaattcacaatacatatgcaattgtacaaacacaaacagtaagcatgatgagtacacatttcaagaagaaaaaaagttggagggggaagcctgcaagaagatgaacggctgggttggaacatctaaacgatgagagtaatagaaaatccactgtcttccttaattggtgcatacaagaacaagcaaaaaggccaaaataacctgaatcctgtactggtgagagtcatatagaatccaccgtcttcattaattgctacaaacaagaccaaacaaaaaggccaaataacctccatcgtagatctttccttgacatggagtgaaagaaagtggaaacaagaaagccatggatctgtctaccaaggtgtggatcttcttttatgtgtatccatgaaagcacatttaacgttcttatccaacatgcaagtttacatagtttccaggccaattcccttgatgctccctattcatgctgtagggatgataatcaaacccggtataggatccaactggcatcccatgagaagtaccagcagctggcattgacggcgcaggtgccccatatggcaccgaagcaggaggcaggtttctgttcccactcgactcacgcaagctctgcggaacaggagccgaggcaaaaagttgatcattagaagatttcccttcattgatcctcttcaagtacaatctatacttctgtaaatgactagcaacattttctcgcgttaagccctcaacattcatcaattgcataatagtttttcggcacagcattatcaatccctaaatgcgcaacaacttccacaaacctcttatgaagctgaggagtccataccaatcttggtcttttcaaagc

SEQ ID NO: 3056 - DNA, 901 bp, Aquilegia formos X Aquilegia pubescens
  Predicted polypeptide sequence is orthologous to G2747
gtttgataaagttgtcacaccaagtgatgttggtaagcttaatcgacttgttatacccaagcagcacgctgagaagtactttccactggactcaactgccaacgagaaaggactactcttgaattttgaagatagatgtgggaagtcatggcgatttcgatattcttattggaatagcagccagagttatgtaatgacaaaaggatggagtcggtttgtcaaggagaagaagctatatgctggtgacattgtttctttcgaacggggagctggtgaatctgtcaaagataggttatacatcgattggaggcgtcgatctgatgttcaggatcctgggatgttaccgcctctacctcttctccatcccctctctatgcccaggtctgcaccttggggaggactaatgttgccaccaaacatgccaatgcacatgccacgggacgatatggtttggcagcggatgaattatgctcagaatcataatcatttccaaaggactaattacagtggcatcagtgccaatggttacaatgtagtgaactccggatcaagcccaattttttatttaagatcatcagctccatcacaacagattggggtaatccaacaaggtagggatgcgccgacggtattcaattctgtgccagtagtccatggtaaggcatcggcgaagagattcaggctgtttggtgttaacctagaatgtccaatgccagaaaaccctgaataccaatttttggattcggcaacaataaatcatcctacaattggttctcttgctccctcccaaattcccccttccattccacctctccagctaaggctctataacagtgaatcaccaccaagagaacagtctgattcgccaagggaaaacgcgtctatgtcattggatttggac

SEQ ID NO: 3057 - DNA, 850 bp, Aquilegia formos X Aquilegia pubescens
  Predicted polypeptide sequence is orthologous to G2763
tcaacgccgtcccttctctctctctgcaactcttcttttttaacttctctctgccctgcccatctaaagaaagaatctctccatcatcgatcgttttcttctaaaagcaatctctctgaattctgaacaaataacagttttcttttccttcttcttcttatcttataaggtttgataagaagattcagatattcgaattagaagaattctgaagattgatcgatctaattcgaaattcgaatcaaatggaaacatcttctactatgattttgaatccagaatcaaattcaacaagcagattgatagaatcaaaaagaaagaaaagaaagaagaatcttcttcaaattcaaaacaaaaaagaaacaacaagatggagaacacaagatgaagaacaaaactattcatcaaaattaatcgaagcacttcgtcaagttcgtcgtaattcttccaccacaacaacaacaacaacaaacgccaccaccaccaccacaactaccacagtttctccaccttccagtcgtattgttcgagaagcagctgatcgagctttagcagtagcagctaaaggaagaacaagatggagtagagcaattctaacaaatcgattaaagttgaaattcaagaagaagaaaccaagaatgataacaggcaagtgtcggtcaaagaaacaacaagaagaaagtatattaaaacttaaaggtaaaaaacaaccggcgttacaaagaaaagttcgtgttcttggacggttagttcctggttgtcagaaactttcatttccagttattctagaagaagcaacagattatatagctgctttagagatgcaagttagaactatgactgctcttac

SEQ ID NO: 3058 - DNA, 883 bp, Aquilegia formos X Aquilegia pubescens
  Predicted polypeptide sequence is orthologous to G2990
cttttctcatcttcttaaaacatacttcagttaatacaacaattagacccaaattaataaaagaagatcagagaaatttaaacaactactacaattaattaagtctacaacaagtacttcgatcccctaatctaaaaaaaaaaaatctaagaagaagaagaagaacaattagtaccaacatgatgatgaacactactattaccatgattctcatgattgttgttgttgttgttgttgttgttgttgatgttgttgggaagaggaggagaactagaagagacagtagtgttgttgttattgttgttgttgtgatgaagaagaagattaggagtaatggcaccattaacatctcttttcccaaaagtatgtttgttgttatgcatccataccttcaaaacacttttaccaacaccaacttcattacaaaaatcttcaactaaactttcatctcttttctgcatcttccaacccaatttttcagaaaaagaatacatcttatctttctgttcttgactaaatttagttctgaatctttttctaccaccatttgaaccagttcccattggactaattactgtaccatcagctgtagtagtttgttgttgttgatgatggttttcaggtttaactgataatccaccagtacttaaagctaataacatttgtggtgcagatgctgggtaataagaagatgaaattggtggtggagataaagatgctgattcatttgttggacttgttggtgcacgaatttgagttggaagttgatgttgaagatgatgatgagggttatggtattcaatcaaatgagttgattgtactacatcttctggatctcttctatgaaaattacagtgacatccacaagctgcacattttaatg

SEQ ID NO: 3059 - DNA, 685 bp, Brassica napus
  Predicted polypeptide sequence is orthologous to G12
gacctctctccgacacatttattctctatcatcttcagcaaatcggtcaaattctcaaaacccacctcaaaagtctctctctttggagggtttacgaattaagatcctccatggacggcggcggagtagctgacgtggcagtcgccatgacgacgaggaagagagagagaccttacaagggcataaggatgaggaagtggggaaaatgggttgcggagattcgagagcctaacaagcggacaaggctatggcttggctcttactccactcccgaggcggcggcgcgagcttacgacacggcggttttctacctcagaggaccaacggcgaggctcaacttccctgagtttcttaccggagagaaattctccgaggaggacatgtcgggtgatacgattaggaaaaaagcgacggaggtcggtgctcaggtagacgctttgggcacggcggtgctaaatagccgccaccgtgtgtttggtcagaacggagagagtgatgatagtgataagaattttcatcggggttatcgaaacggtgagtcggaagaagatgataagagtttgaagagtggcggctggttattggaacgggttgacttgaataaggtacccgacccggaaaactccgatgacgactgggaaagcaataaaaaatttaaatatattttggagcggtggctgctgct

SEQ ID NO: 3060 - DNA, 950 bp, Brassica napus
  Predicted polypeptide sequence is orthologous to G280
tcggcacgagctctctcctacctcactcctctctctctcttcctctccctgcaaaatcatggcgacggagaccgagcttgaacctcaacaatcaccaatggcggaggagcagcagccgagtcccttctctctccctccgtatcctcagatgatcatggaagcgatcgaagcatcgaacgacgcgaacggttgcaacaagacggcgatcgcgaagcacatcgagtcaactcaaacctctctaccaccgtctcacatgacgctcctcagctaccacctcaaccagatgaaacagtccggccagatcgcgatggtgaagaacaactacatgaaaccagatccgcaagctccgcccaagcgcggccgtggccgtcctccgaaggcgaagcctcagggagagtcaagccacgtggcggtcccggctccttccgtttcctcgccgaggcctagaggtcgtcctcctaaggcgaaaggaccttcctcggaggtggagacgaaagttgcggcaccgagtggctccgggaggccacgtggacgaccgccgaagaagcagaagacggaatccgaggcggttaaagccgatgttgaacctgcggaggctccggctggggagcggagagggcgtggaaggccaccgaaagcgaagcctgcgatggtgcctgttggttgctaaagttgacgctgtagcaaatcgaataagctttgattagaagcttaagcaacaaaatcctaaaagagagttcttttaaaaataattagtatttttctaagtcgagtttaatggttaattgtctgttattttaatttttaggggttggtggaaaaaaaaatgtcgtctgagaatgagagactgtaattcgggtttgcatgtggtggtgtgatgtataaatttcgggtatttctttaccctttttctaaagtaacgctttggtgaaaaaaaaaaaaaaaaaaaa

SEQ ID NO: 3061 - DNA, 581 bp, Brassica napus
  Predicted polypeptide sequence is orthologous to G481
cccacgcgtccgcaccagcgaggcaagtgataagtgccagaaggagaagaggaaaactgtgaatggtgaggatttgttgtgggcaatggcaacgttggggtttgaggattaccttgaacccttgaaggtataccttgcgaggtacagggagttggagggggataataaggggtcagggaagagcggtgatggatctaatagagatgcagctgctggaggtgtttccaatgaagatatgccgagctggtgaaagaagtcgcaagtaagctctctagagataaagaacaacgccaaaatgatcagggaaacttagagatcagtgtggtgtttgacaataaagttagagatccggttttagttggttgtagttgaagatttctcttattagatatgacaactctttgaaagaaggaaaaaaagtttgtccacaagctctctcatctcttagcttcgtttatggatttcaaaacttgaatatgaatggactcacttgtgcttccaagtaagcaagaggaggttgtaacttacattgtcctcattaacttcacgtagaatgtcgtttaaatgaaaaaaaaaaaaaa

SEQ ID NO: 3062 - DNA, 794 bp, Brassica napus
  misc_feature (765)..(765): n is a, c, g, or t
  misc_feature (767)..(768): n is a, c, g, or t
  misc_feature (774)..(774): n is a, c, g, or t
  misc_feature (777)..(779): n is a, c, g, or t
  Predicted polypeptide sequence is orthologous to G504
ctatattcgagtcattatgagcccggggaagtctccaaaatatcaaaatcctctgcttacatattctcccttgagtatcatgagacggtcttcgtagaataactcatttgaaaatagcgagttgatggaaaacatgggggattcgaccatagggccgggtcatccgcatctccctcccggatttcggtttcatccgaccgacgaagaacttgtagttcattacctcaagaagaaagctgcttctattccactaccggtctcaatcatcgccgagattgatctttacaagcttgatccttgggagcttccaagcaaggcgagttttggagaacaagagtggtacttctttagtcctagagatcggaagtatcccaatggggttaggccgaatcgggcagcaacttctggttactggaaagccacgggaaccgataaaccaatatttacgtgcaatagtcacaaggttggggtcaagaaagcgcttgtgttctatggtggaaaacctcctaaagggattaaaactgattggatcatgcatgaatatcgcctcactgatggtaaccttaacacagctgccaagccacccgactcaaccacgtcaaggaaaaactcactacggctagacgattgggttctttgtaggatctataagaagaatagttcacaaagaccaacaatggagagagtattactaagagaagatctcatggaaggaatgctctcaaaatcatctgctaattcatcttccacatcggtcttagacancnnacacantannntatacgaagaacact

SEQ ID NO: 3063 - DNA, 768 bp, Brassica napus
  misc_feature (9)..(9): n is a, c, g, or t
  misc_feature (17)..(17): n is a, c, g, or t
  Predicted polypeptide sequence is orthologous to G668
taattgaanttaccgangggaaattaaataaaattattaatattagctcaggttatctaagctagttaattcggaaagccaaaaataaacaaattataaaaagaaaaagagatgatgatcctaaaattagaaccatctgattaggcaaattcttcagaagaaattagggttttcatccaacacaatatcaccaatcggtccaccagaatcctcaaacagccacttttcaaacaaagaccattgactttggttactgcatccagttatgtctggtttggtctcatgatccggtgatactccagcctgatgatatgatgagtcacaatctttcaagtgatcaaaccccgaaaatgactggaattcccctgcacagtcctcgacatcactcttgagcacatcttttgtctcagaatctggagaaaccattaaatccgcagagttcgaaatcttcggagagttcttcacccaccctttgagcaattttgctatattctcggtgctcgaggcataagcggtagatgtttcttgcgtcctaagaaacctgcaagctgaggaagtagaacgtcttgattcagcagaagaagatgttgtggccgtggtggcaaatgtagaggtaatgattggcgccacagcaggagacaaagcctcagagagagccttcttcgccaagtgaatatcagtttgaagccttctttcccattggcctcttgagatgtttgagttggagttagcagaagaagatgatggagaagaagagaggtctcttga

SEQ ID NO: 3064 - DNA, 2090 bp, Brassica napus
  Predicted polypeptide sequence is orthologous to G1290
tggatctcaagtctttcgattgataagtattcttcgttgattcggtccttctttcttggagtcttcacttctcaccatcggatctctgtgacctttgatggagaccattgctggatttgatgatttctatgagatcagcagcactagcttcctcgccgcaccggcgccaaccgataactccggatcatccaccgtctacccgacggagcttttcaccagacccgaggtatccgcgtttcaactcctctccaacagcctcgagtccgtcttcgactcgccggaagcgttctacagcgacgccaagcttgttctctccgacgacaaggaagtatccttccaccgttgcattctctcggcgagaagcctcttcttcaaggccgctttgacagccgccgagaaggtgcagaagtccacccccgtgaagctcgagctgaagacactcgcggcggaatacgacgtcgggttcgattctgtggtggctgttctggcgtacgtttacagcggcagagtgaggccgcctccgaagggagtttctgaatgcgcagacgagagctgctgccacgtggcgtgccgtccggctgtggatttcatggtggaggttctctacttggctttcgtcttccagattcaggaactggttaccatgtatcagaggcatttactggatgttgtagacaaagttatcatagaagacactttggtcgtcctcaagcttgctaacatctgcggtaaagcgtgcaagaagctattcgataagtgcagagagatcattgtcaagtctaacgtggatgttgttactctaaagaagtcattgcctgaggacattgccaagcaagtaatcgatatccgcaaagagctcggcttggaggtagctgaaccagagaaacatgtctccaacatacacaaggcgcttgagtcagacgatcttgaccttgtcgttatgcttttgaaagagggccacacgaatctagacgaagcgtatgctctccattttgctgttgcgtattgcgatgagaagacagcgaggaatctcctggaactggggtttgcggatgtcaaccggagaaacccgagagggtacacggtaattcacgtcgctgcgatgaggaaagagccgacactgatagcattgttgttgacgaaaggggctaatgcattagaaatgtctttggacgggagaactgctctgttgatcgcgaaacaagtcactaaggcggccgagtgttgtattctggagaaagggaagttagctgccaaaggcggagtatgtgtagagatactcaagcaaccagacaacacacgagaaccatttcctgaagatgtttctccctcccttgcagtggctgctgatcaattcaagataaggttgattgatcttgaaaacagagttcaaatggctcgatgtctctatccaatggaagcacaagttgcaatggatttcgcccgaatgaagggaacacgcgagtttgtcgtgacgacagcaactgacctacacatggaacctttcaagttcgtagaaatgcatcagagtagactaacagcgctttctaaaactgtggaattcgggaaacgcttcttcccacgctgttcgaaagtgctcgatgatattgtggactctgaggacttgactatactggctctcgtagaagaagacactcctgagcaacgacaacaaaagaggcagaggttcatggaaatacaggagattgttcaaatggcgtttagtaaagacaaggaggatcttggaaagtcgtctctctcagcttcgtcttcttccacatccaaattaactggtaaaaagaggtctattgctaaaccctctcaccggcgtcggtgacactatttgttcggggtaatatttgatgtaccatatatatatatttgagttatcatgtgtcttagtgtctctgtctattgttggctcagtcatatagttttgttcgtcattttgcatcctgtgtattccgcagctttcggtgtgtttgaagcaaatgctgtaaccttttgaatctgtgatatatctattataataaaccatgatgggtgttacagaaaaaaaaaaaaaaaaaaaaaaaaaaaaaaaaaaaaaa

SEQ ID NO: 3065 - DNA, 847 bp, Brassica napus
  misc_feature (742)..(742): n is a, c, g, or t
  misc_feature (844)..(844): n is a, c, g, or t
  Predicted polypeptide sequence is orthologous to G1844
ggcgactttaaccgtacctcagaatcaaattagggcacagagacctctcggagacagaagctatgggaagaaaaaaactagaaatcaagcgaatcgagaaaaacagtagcagacaagtcaccttctgcaaacgacgcaacggtctcatcgagaaagctcgtcagctttctgttctctgcgaggcatctgttgggcttctcgttgtctccgcctccgacaaactctacagcttctcctccggggatagactggagaagatccttgatcgatatgggaaaaaacatgctgatgatctcaatgccctggatcttcagtcaaaatctctgaactatagttcacaccatgagctactagaacttgtggaaagcaagcttgtggaatcaattgatgatgtaagcgtggattccctcgttgagctagaagatcaccttgagactgccctctctgtaactagagctcggaaggcagaactaatgttaaagcttgttgaaagtctcaaagaaaaggagaatctgctgaaagaagagaaccaggttttggctagtcagattgagaagaaaaatcttgagggagccgaagctgataatatagagatgtcatctggacaaatctccgacatcaatcttcctgtaactctcccgctgcttaattaaccacctttactcggcggttaatcaaaataagaaacatataatctaaagataacctatgtaggttttacttttcgcagcttaattaaccncctttactcggcggttaatcgaaattaaaaacatataattaacaaataacctatgtcagtttaaccccaaaaaaaaaaaaaaaaaaaagaaaaaaaaaaaanaaa

SEQ ID NO: 3066 - DNA, 908 bp, Brassica napus
  Predicted polypeptide sequence is orthologous to G1844
aaaagaaagaaataaaagcaaaaaagagagaaaataaaagcaaaaataagaaagaacaaaaaacgctcagtatctccggcgagagctgaaccgaaccgaacctcaggatcaaattagggcacaaagggttctcggagacagaagccatgggaagaaagaaactagagatcaagcgaattgagaacaaaagtagccgacaagtcaccttctccaaacgacgcaatggtctcatcgagaaagctcgtcagctttcagttctctgcgatgcatccgtcgctctcctcgttgtctcagcctctggcaagctatacaacttctccgccggcgatgacctggtcaagatcgttgatcgatatggaaaacaacatgctgatgatcgtaaagctctggatcttcagtcagaagctccgaagtatggttcacaccatgagctactagagcttgtcgaaagtaagcttgtggaatcaaattctgatgtaagcgtcgattccctcgttcagctggagaaccaccttgagactgccctctccgtaactagagctaggaagacagaactattgttgaagcttgttgatagcctcaaagaaaaggagaaattgctgaaagaagagaaccagggtttggctagccagatggagaagaataatcttgcgggagccgaagctgataaaatggaagtgtcacctggacagatctctgacatcaattgtccggtaactctcccactgctttattagccccttaagtccaaaacttgtgactaaaaacaaaaataagttaccgaactattcccctataagggtgagcgttgtatatcttcacactctcttggctgagagaccctgtgtgtaaaaactacggtttgatttgagtaaaaatatatatttaagaaaaaaaaaaaaaaaaaa

SEQ ID NO: 3067 - DNA, 969 bp, Brassica napus
  Predicted polypeptide sequence is orthologous to G1844
ctctggatcaaattagggcacagagaccacttggagacagaaaccatgggaagaaaaaaactagaaatcaagcgaattgagaacaaaagtagccgacaagtcaccttctccaaacgacgcagcggtctcattgagaaagctcgtcagctttctgttctctgcgatgcatccgtcgcgcttctcgttgtctcctcctccggcaagctctacagcttctccgccggtgataacctggtcaggatccttgatcgatatggaaaacagcatgctgatgatcttaaagccctgaatcttcagtcaaaagctctgagctatggttcacacaatgagttacttgaacttgtggatagcaagcttgtggaatcaaatgtcggtggtgtaagcgtggacaccctcgttcagctggagggtgtccttgaaaatgccctctctctaactagagctaggaagacagaactaatgttgaagcttgttgatagcctcaaagaaaaggagaagctgctgaaagaagagaatcaggctttggctggccagaaggagaagaagaatcttgcgggagccgaagctgataatatggagatgtcacctggacaaatctccgacatcaatcttccggtaactctcccactgcttaattagccaccgttagacggggctgatcaaattaaaaaatccaaaacatacaactaaataaataagctttgttgtttttcacccttgaagggtgcacgttgtatatctcaatactcccttggctgagagattgtgtgtttactcctatgttagatataatgagtaaaataaaaataaaaagatctttgtaccttcgtcgagagagaattgtagtgagtgtgcttgtgtgttctttttctcttctttgcttcatggcgaagaagcctaccgtctaatttgtaacggagacgtggccctctctgcccttttgtattcgtaattcctttgtattaaaaa

SEQ ID NO: 3068 - DNA, 780 bp, Brassica napus
  misc_feature (748)..(748): n is a, c, g, or t
  misc_feature (769)..(769): n is a, c, g, or t
  misc_feature (779)..(779): n is a, c, g, or t
  Predicted polypeptide sequence is orthologous to G1844
ttagggcacaaaggcttctcggagacagaagccatgggaagaaagaaactagagatcaagcgaattgagaacaaaagtagccgacaagtcaccttctccaaacgacgcaatggtctcatcgagaaagctcgtcagctttcagttctctgcgatgcatccgtcgctcttctcgttgtctcagcctccggcaagctttacaacttctccgccggcgataacctggtcaagatccttgatcgatatggaaaacaacatgctgatgatcttaaagctctggatcttcagtcaaaagctccgaagtatggttcacaccatgagctactagagcttgtcgaaagtaagcttgtggaatcaaattctgatgtaagcgtcgactccctcgttcagctggaggaccaccttgagactgccctctccgtaactagagctaggaagacagaactaatgttgaagcttgttgatagcctcaaagaaaaggagaaattgctgaaagaagagaaccagggtttggctagccagatggagaagaataatcttgcgggagccgaagctgataaaatggagatgtcacctggacaaatctctgacatcaatcgtccggtaactctccgactgctttattagccaccttaagtccaaaacttgtgactaaaaacaaaaataagttatcgaactattcccctataagggtgaacgttgtatatcttcattctctctggctgagagacccccgtgtgtaaactatggntagatttaagtaaaatatatntttaagacana

SEQ ID NO: 3069 - DNA, 845 bp, Brassica napus
  Predicted polypeptide sequence is orthologous to G1844
ctccggctagtggaaaccggacctcaagatcaaattagggcgcaaagcactgttggagacagaagccatggggaggaagaaacttgaaatcaagcgaattgagaacaaaagtagccgacaagttaccttctctaaacgacgcaacggtctcatcgagaaagctcgtcagctttccgttctctgtgacgcatccgtcgctcttcttgtcgtctccgcctccgggaaactctacagcttctcctccggtgataacctggtcaagatccttgatcgatatggaaagcaacatgatgatgatcttaaagccttggatcgtcagtcaaaagctttggactgtggttcacaccatgagctactggaacttgtggaaagcaagcttgaggaatcaaatgtcgataatgtaagtgtgggttccctggttcagctggaggaacaccttgagaacgccctctccgtaacaagagctaggaagacagaactaatgttgaagcttgtcgagaaccttaaagaaaaggagaagttgctggaagaggagaaccatgttttggctagccagatggagaagagtaatcttgtgcgagccgaagctgataatatggatgtctcaccaggacaaatctccgacatcaatcttccggtaacgctcccactgcttaattagtcacctttaatcggcgaataaataaaatccaaaacatataactaaaacaaacaagatgtgtaattatccccttgtaaagggtgtacgttgtataatctatactctctctccggctcgagaggcttcgggtgtaaaactatttcagatttatgtaagatagaaaatctatgcaagacactttcaa

SEQ ID NO: 3070 - DNA, 552 bp, Brassica napus
  Predicted polypeptide sequence is orthologous to G1935
gggttcatgagcaagagattgataatgaaagtgaagatgaggaggaagaactgaggaaattcgaacccgatccagtgaggtttacatcaatggaggaaatgggagcatgtgaaaatcatctacttagtactcttactcgtgtggttcagagaagggaacatttgttgagcagatcctgcgaagcaccaagtacccaacagagcatggaaaatattgaaggctgggagcatgaggctgagttcaaacaagcccgtatatataatagcgaactcagccaatgcatcaaatcattatgatctgccgttgcaaggaatcatctcaaatccaacccaaactccaaaatgatgtttgggtgaatcgcaaaaaatgcaatgttgttgacaaaaataaaacggtgcgtatttcctatgtcagtgcctaacctcctatggtttttatctttcagattctgaagtctgaactatttgtataaataaaggttggaaaaggtcattttgttagaacttagaaccataattgctacgaaaaaaaaaaaaaaaaaaaaaaaaaaaa

SEQ ID NO: 3071 - DNA, 623 bp, Brassica napus
  Predicted polypeptide sequence is orthologous to G2141
gccaagttgagtttttatcgatgaaacttgccactgtgaacccacaaatggactttaaccgtgaaggtcttcttgccaaagatgcacttcaactacgagctggtacgtcatctgcaacaccgtttcctccaaatatgccaatggtttatcctcctctgccacatggattcatgcaacagaccctttcatgcatgggaaggaccgttagctctccattgtctcccccaataaatggtggatacaagcgacaggaagcaaatggatgggaaggtgatcttcaaaatgtgatacagattaactatggagctggtgatgtcccacctgactctcaagcagcagctacagatgcatctcttccatcttcaaacatgaaggttgagccatgagattttctttctgttagatagaatgttatattcttgtaatctttcttttaaatttactgtgtactatatgatgtattaacgagtactactagtctactactactactaataagcatttaagattaggtaaaaaaaaaaaaaaaaaaaaaaaaaaaaaaaaaaaaaaaaaggaaaaaaaaaaaaaaaaaaaaaaaaaaaggaaaaaaaaacaaataaaaaaataaaaaaaaaaaaaaa

SEQ ID NO: 3072 - DNA, 649 bp, Brassica napus
  Predicted polypeptide sequence is orthologous to G2291
taggatccatgcaacagactggctgctgcaggagctctattcagccccaagtgttttgtagacggctttttcaaatacttctgagtttagagcagagtgatctctgaccaaaacagtttcttatacatctggaaaaccaacctggctgagccaaggaagaagtaaggccaaaaagaaaatgaaaagacatgtgagggcatatcaaaacatcatctttgatctttcagaaccagaagttatccctcaagaatcccaccaagagtctcatgcctccactggaacaacttcttttttgtacgttgtcctttcctgaagaattatggaagattcaagagagagagagagagcaagagacgtgagtgcaggtaaaaaagaagaagatcaagttgcatacgttgaactgcattaaagtacttaaatgctcccaccggttccttttgtgttgtttttattttggatgaagaatagagagttccatcaatagttgtgttgtaagaaaagagattcgcttagaaaagtgggttgatgtgtaaattttggttaacaattctattttaacacaaatgtaaaagatgaactaaataaaatgtataataaaaaaagatagtttaacgaagcaaaaaaaaaaaaaaaaaaaaaaaaaaaaaac

SEQ ID NO: 3073 - DNA, 808 bp, Brassica napus
  Predicted polypeptide sequence is orthologous to G2346
gacttggagaaaagaagttgtagaagacgtctagcttgtcataacgaaagaagaagaaagccccaagcaacaacagcagctcttttggcttctggttactctagaatcgctccatctctttacggaagcgttttgggagatcctacaacgtggtcaaccgcaagatctgtgatgggacggtccgcaccgtgggatagccatcaactgatgaacgttttgtcacagggaagttcaaggtttagtataacatacccagagatggtgaacaataatagcacagactcaagctgtgctctctctcttctgtcaaactcaaacacaactcagcagcagcagcagacatcaaccaatgcttacttgatggacgcagaaagggttacaatggctaagtcaccgcctgtttcagtacacaatcagtactcgaaacaaacctgggagttcatgtcaggcgaaaagagcaattggccttgtgtgtcgtcccctgttttgggactgagacaaatctctgagccagatgatgacctccagttcctgatgagcaatggcaccacaatgggtggattcgagctgaacctacagcaggagcaggttctgaggcaatactcttctactcaaaattttacttggcctctttgagactttctaccaagagcccttaccagtagaaggttgctagttgctactaagacttgatagtctcaagatcttattaaattatatatttttctatgctacttaaaacccgacaatggccttgaatctggatattatttttaatggttttggctcttgattttaaaaaaaaaaa

SEQ ID NO: 3074 - DNA, 587 bp, Brassica napus
  Predicted polypeptide sequence is orthologous to G2425
tatagtcgagtcgtatgagccggcgaagcctcctttttattaagcgagagtgtcatagagcctcacatatattgttaaaagtctcttgaataaataaataaatagtaagagtaatcaataattcacttgttctcaagctcagtcatcaccatcatcatctgacttcacgttgggctcgaattgatcagagagaagtgatacgtgacgagatctgattagttcaccggaaataaaatggggaggacgacttggtacgacgacgagggtttgaaaaaaggagagtggacggctgaagaagacaggatgctcgtcgcttacatcaacgaatacggtcttggggactggcgtgctatgcctaagagagccggtctgcaaagatgtggaaagagttgtagattaaggtggttgaattatttgaggcctggaattaaaagaggcaagttcactcctcaggaggaaaaagatatcatcaaatttcattcccttcttggtaacaggtgatttaatttgtattaaatgcaaaccaatagacattaatcttgccaaattaaataaatcaataatcatgttatattcataaaaaaaaa

SEQ ID NO: 3075 - DNA, 706 bp, Brassica napus
  Predicted polypeptide sequence is orthologous to G2990
ggaaacgtgtcgaagacctacacaccaaagagacgcatggcgaaggaatgaattgtccccatctctaccgactgggaatagccgtcgggaccgcagaccgtcactccaccggaaacacgagccaccaacatcatccacgacttaaagctgtcactggaacagacaaagcactttaccaccggaatccaccgggacactaaccacaaccaccgaaaaccacctccaacgattgtattggagatataggaattcgatatcttccacacttgcgccagagctttggagagcatcaattgattgaatcaatatctcatccaaactcggccatcaaaaacgagaacagaacgtttcacacggctcgaacacttccaagggaacgatagccggcgacctccacctaagaagaaacggtgcagctccagagtccaaagccagatatccatcgaacgggagatgcgatactggaaacaaatacggacaaaaaaaaatgtagtttattatcccatggactacattcggaggaagcaaaaagaaaaaaaaactaaaaaagtataaagatacttaaaagcatgttacttacttcctttccgttacttccgttttgttatggataaaaaaattagaaaaaaatcgtttcatctttctatgttcttatgaaattttaatttgttaataataaacaattgtaaaaaaaaaaaaaaaaaaa

SEQ ID NO: 3076 - DNA, 774 bp, Chlamydomonas reinhardtii
  misc_feature (674)..(674): n is a, c, g, or t
  Predicted polypeptide sequence is orthologous to G481
gcacgagggcaaactcaccttgagctgcaaagcaaccaattgcttgagttacgaagaatagctcttaggggcgctttactgacgtgtttttcgtcgaggttgtgttggacgggccttcaccgggcgcctgcttcgcggcttctccgcgatgagcggggacgagggcgacggtcgagatggcaacagcaatgcgcgtgagcaggacaggttcctgcccatcgccaacatcagcagaattatgaagaaggcgctcccgaacaacgcgaaaatagccaaggatgcaaaggagacggtccaggagtgcgtctcggagttcattagcttcatcacgtcggaggctagtgacaagtgccagcgggagaagcggaaaacaattaacggcgacgacctgctgtgggccatgacgacgttgggctttgaggagtacctggagccgctcaaactctacttagccaagttcagagaggctgaggcggcgacatccaataagccagggggcggctcaggtgccaacgcggaggcaaagcgtgaggcggccgcggcggctgcggctgcggccgcagctgcggctgcagtttcgcagcaacaggcggcgcagcagcagatggcggcgcagctgcaagctggcatggcgttcccggggctcatgccggcgcagttccaggggctaccgnccggcatgattcccgctggcttacccggactgccgcttgcttccggcgtgccgggcctgatgatgcccagtggcgttgtgcccagcaggagctccctagt

SEQ ID NO: 3077 - DNA, 707 bp, Chlamydomonas reinhardtii
  Predicted polypeptide sequence is orthologous to G504
cacgctgggcccacagaaggtatagatgaggttgttgatcaggcggcggtccttgtcgtccgtcacgcggccgccgtagttgatttccgtgaacaagaagcgcagcaccttgaacggaatcacctcgtacttgtccaaatactcttgcagctgcgccagcgacacgttgaggtcgccgtccgtaaagtcgtagcggatgttccagcccagcggcctcgaacttgcgcctgtcctggatgacggcgtggaacaggcacagcccgaacaccagccgccgccagtcctccggcttggaggaggcggccaggtaggcgtccgtgaggcggttgtactggcggaccaggttggacttgaggcccttgggcggctccagcgtcatcttgacgccgttctgcaggatggccaccgggaagtcggggctgggcatggacgtgagccacagccggaagtccttgtgcacgcggtcgggctggatgccctccacgatgcgctcaagcgttggcatccagctgaccgccaggtggcagttctgcaggcacacccagatgccgcgctccatgcccgcctccagcagcttctcggccttggggccctggccctggcccagcgacaccttctcaaacttgcggctgaatttcatgtcctccgcaagcttcagcaggtctgtgtgacgcagcaagggacggcagttggtttgttgggcaggc

SEQ ID NO: 3078 - DNA, 667 bp, Chlamydomonas reinhardtii
  Predicted polypeptide sequence is orthologous to G729
cctgtgggtgctccgtccctgtcttattaaaggcaactcctcaaacctcctgtctcgtccgctgcccgttcattaagcattgacttgacaaacactacacgcacacatacacacacattcatctgtccaagcagacttgtgacgggcactagcgttgaccgcgccacgtaccagtccggattgcggcacgtgggtgtgagacacgcggccgtgcactgttcgtgcggtctcctgtgaaccatccgccgtcagctaatatagctgccgactgccctatcgagtgatcacacggcctcgcgcttaaggcataatacgcacacgcgtttccaactgcctcgcgggccacaccatcatcaaacacgtcagtattgcgtcggagggggcgccacagcaagctccccaaacaatcacaggtcacactgcggtttgtgtcttttcctaggtttcatgggcgacatacatactcacaaaatcactggtcattgaaggaacacgtccaaccccgtttgctgtcgattgcgtacgctcaggtattcatcgagcctatttcaccctgaccgccgaggtgaacgcatcgtcactcaaaccgtccccccaaggcctttcatcacacgcatgcaagttggttaaaacctccagtcgcaaagtttgtaggcaaccctcgtgc

SEQ ID NO: 3079 - DNA, 611 bp, Chlamydomonas reinhardtii
  Predicted polypeptide sequence is orthologous to G1038
tattgttggtggacgacgatcccaatctactccttttggtcaaggattatttggaatatcagggttaccaagtcaccaccgctgggaacggtcgtgaagctctggacctgctgacaactacagtgcccgatatgattgtttgtgacatcatgatgccggagatggatggctacgccttcatcgagcaggtgcgccaaaacccggatattagttggattccggtgatgtttctttctgccaaaggccaaagccacaatcgggtgaaaggactcaacgtgggagcggatatttatatggctaaaccctttgagccggaggaactggccgcccaagtgcaatcttgtctccgtcaagctgatcgcctattgcaacacaataatcatcccctggaagacaatgctcgggtgcaggtggccagggacgtggaactcacccccaccgaaaccaaggtgattcaattggtagcccagggattggccaaccgggaaattgccgaccacttaaaagtcagtcagcgcactgtcgaaagtcatgtatcgaatatgttaaacaagacaggattacacaaccgcaccgagtaatcactagtgcggccgcctgcaggtcgacca

SEQ ID NO: 3080 - DNA, 740 bp, Chlamydomonas reinhardtii
  Predicted polypeptide sequence is orthologous to G1753
ttttttctcgaaaaaggttacatgttatttcagcctcggttggcgagcgctgtttggcacgcacacatgtgcattaccgtacacagccgttgcgggcccctggcgctcaattgcatcccccctgccgaacgtaaatgaattccttttggccacactagcgcatcatcaaacactgcgacacaagatcctgcagtcagggccagcagcagcgccaccactactcctttgcttgcatgggcgctgcgtgagcggcgcccaagcatttgaaaaccttgccagggagcgtgcatgagcgccatgtcgctccaacaggctcctccttggctctttagcacaaggggctggacaggagcttgaactggtagcgccagcgcgtagcctcaaaaacaatgttggtccggacggtgccgcgggcgccctcaaagatgccagtgccgcccacgatggggttgaaaaactcgttgtcctgcttgtccgggaactgacccatccaggagatggccgccgtggtcgccgaaggtcagggtggtgggtgcagtagttcagcatccagccgtcgtcgccgctcacgctgttaacgaagcacgcagacacaacgtcgccggccttccgacccgagtcgccgctgccgccccacacggcctcgtccaggaatcccagagagtagccaatgaacttcgtctgggttggtctcgggcatcagaaatcaggcaccgacagcgtgtccttgtttgtaagct

SEQ ID NO: 3081 - DNA, 747 bp, Chlamydomonas reinhardtii
  Predicted polypeptide sequence is orthologous to G2574
atggttttacgccaagactacgacattaattcctcactaaagggaacaaaagctggagctccaccgcggtggcggccgctctagaactagtggatcccccgggctgcaggaattcggcacgaggcgtgttctacagctgagccaaattcatggcctatgtagttgttgctctacaaaggctgttacttgacgacttcgtcattcttcaacatagctccttctgtcgttccgatacccgaagcactatatagatggcatcccaaggctttgcgatgccacgactcactttcgggcgcgacattgtggcgagtaagccctgcgcagcactgggcttgcggcgggctcccgcatgcccccgagtagcgcccggccgggctgagcagcagccgcgcaagcacctggagcccgtgcacgtagctcaggcacccctctcgtcttccacaacgacaaatggcacacacagcgcacccgccccggttgcttcgacctcatctcgggacgcgagcgaggctgccgctgcttctgcgctctcggcaaaccttctactgatctgccctgaccagaagggcgtgattgctgctgtgagccagcttctgtatggcttcggctgcaacatcgacgcttcggaccagttcacggacagcagcaagcgaaatgttcttgcagcacatcacctttggcttctcgaagatcgaaattggacctgagtacgccacggaaactgttacatgacgttaaaataactat

SEQ ID NO: 3082 - DNA, 716 bp, Chlamydomonas reinhardtii
  Predicted polypeptide sequence is orthologous to G2574
gcacgaggagctgcctggggcgtgcgggtacttacatccaaccaggtctgtaagttttgtgtcgttgcctgacattgaattaagaaatactagtcagatcggtccggcccgcgttcggtgtgcacaacctgcaagctttgatcggcgacagagatatgattcaacgtggccctaaaacactgcttgcatgtactgcacagcacgtcgacatgtcacaggaacggtgagagagcagcatggagcaatgtggaaacccattctgccccaaataggatagttgtagggccacgaaagaatccatatcataagtatggcgcatttaaatgcttatcaaggaaacgaagacaccggggtcctcgggccggcacgaattctcgaaactcttttgcaatatggagccctgccacctgctgccgctctcacacctttgaacagttgacatgttaccgtgtatgcgcagaggagtagcagggggaaacacaccgtggggcttcacagcggggccaaccccccttcattagcccgcaacccgcctctgagtgtatcctactagggacagctcagacgctggcagaggcacggcatgtgagtggaggtggccgatggaaacttgcaggctggagggctgtccggcacaccggtgcgggcgctgcgtgtcgcgccgaatttcacagcatggcatggcggcggccggcatcagcgggacacccacgcac

SEQ ID NO: 3083 - DNA, 716 bp, Chlamydomonas reinhardtii
  Predicted polypeptide sequence is orthologous to G3032
ttttttaggaggcgcgatgtaacattacgtgacgggcggcaccgagacttcctatgcatgcgacacgcccggccttttgttaatagttggaaatgactcttgaagactgcaagtgcacaagagcacaggaaggcttgtacaccaggcagtggcgggcgggggttgtgtctttgtgcggtacaaagcgccgtttcgacggactccgctccctgagggcctccagaccttgctccagagtccagaccccttctctttgactcaaaaccgcgtcgctctcaccgccaatctcctgacccgcaacatgcacacaataaattttgaggcgcctcatagcacaaggcacctgcaagccggccacataacttgcgtccacagttctcaacggcggcggctgtggcgacaccactctcaagtctctacccagcgctcagcttctgcatcagcttggctttggcctcatagaactttacgatgtccgcgtccgcgtcagggttgcctgtgaggaacggccgcgccatttccagcacagccgcgtccactccctgcatgctcggcccgccactcgagtgcgctgcggcgtgctgctgcaccgccacaccgctgccggtgcgcgtcaccgctggactggcggcgccgttgcccggccccggacccggccctggccctaacccgtgcatgccttgaggatgcccgttcccgtacccatgcgagcccag

SEQ ID NO: 3084 - DNA, 698 bp, Chlamydomonas reinhardtii
  misc_feature (173)..(173): n is a, c, g, or t
  misc_feature (698)..(698): n is a, c, g, or t
  Predicted polypeptide sequence is orthologous to G3032
ttttttggcctccatagttcatactcacggcgtcgcgcctcgggcgctttgctcgcgacagtcaattggccatcgatccgcgaagttgcttgtcaatccggctgctttggacccgccgcctacttgcaaataggctttttgtctgcaccacactgcactcgggcaaaggcggncctttgcccacccaagcattggcctagcgcgcagccacaatccgtatgtttgaggcataatgttcagcacgctgcccacacatccatgcgcactgccgggctcataggaccctcagcagccagcacctgccaagcgtccgaccaaggcccttcccgcagcaagctttcgcccagttacacggaccacacccactcacggacacgccaggacaccaacctggcaaggcagctgtgttatttaccccacatccacactctgggggtgctgtgcttacctccatacacacacacacacacatacagacagacacgcaatgccaatgcacaaccacgctctcaatatccatgcggccaccatgaccatggaccgccacgccgacaaccaccctgcaaccagacaacacaacactggcacagaggataccgcagtgctcacaggaaacgaacacagccgcctcaactagacgtggggaggagatgcggtcgcagccgccgcgtccgcacttgttgtggagtccacagcan

SEQ ID NO: 3085 - DNA, 823 bp, Gossypium hirsutum
  Predicted polypeptide sequence is orthologous to G2
aaaaaatgtgggatcttaacgattctcctgatcgttcaagagacgaggaatcggaagggtgttcatcgccggtagacggtgaagaagggaagggtaaacgggttggatccgtttcgaattcgagttcttccgccgtggtgatcgaggatggatcagaggaagaagatgcagcagctttaaagaaacgaaacagtaacatgatttttgggttctcggtgcctgtcgagaccggtggaccagctccggtgactcgtcagttttttccacttgaccaagacccagaaatgagggcagttcccagcggaactgcacaagggttccccatggctcactgggtcggagtcaaattccggcaatcggaaccactcgccgttgctaaatccgttgaagctacgaatcccatgaaaaaaagtagaagaggaccaaggtcaagaagctctcaatatagaggtgttactttctatagaagaaccggcagatgggaatctcatatttgggattgtggaaaacaagtttatttaggtggatttgacacagcacatgccgcagcaagagcatatgatagggcagcaatcaaattccggggagttgaagctgatataaatttcagcattgaagattatgaagaagatttgaaacaaatgagtaacttaacgaaggaagaatttgtgcatgtacttcgtcgacaaagcactggtttccctagaggaagttctaaatatagaggagtaaccttgcataaatgtggaagatgggaagctagaatgggtcaatttttgggcaaaaaatatgtttatttaggcttgtttgataccgagattga

SEQ ID NO: 3086 - DNA, 866 bp, Gossypium hirsutum
  Predicted polypeptide sequence is orthologous to G3
tttttctccttcttatggcttacaagttatagtttccagaaacaaggggaaataaaaaaaaatccattttgttttaggattttggtcttcttttatcttttgggtcatggagctaggtgattgttgtttaacatcaagtccagcaagcggagagaagcgaaagctgcataggacacagcaaaaggagaaaccattcagagggataaggatgaggaagtggggaaagtgggtcgctgaaatcagagaacccaacaagcggtccaggatttggcttggttcttacaccacccctgtagccgccgctcgtgcttatgacacagccgttttctacttgcggggtccttccgccaggctcaacttccctgacctcatattccaagaagacgagcttagggatatctcagccgcttccatacgcaagaaagcaaccgaggtgggggctaaagtcgacgctttacagacctcactccatcatgcttctgcttcatcatcggaatcatcgaaccctactcgagttttccgtaaacctgatttgaacaagtaccctgacagttctgatgaagattgaaaacaatataatagtttaccataacccaaaaacctataactgttcatactcgccactttttttttttccccacttatgtctttttgattctctcatggaatagcaagtgcccaaagaatagaatcaataaaaaaatggattgattctctgtttgataaggttatgaatgttttactttgggaatacaagtttagtttatggcatgtaacttttaacatgaatggatattgatgaaacagggatatatatcgctgagttagtaaatactcctaattccttgaccaaaaaaaaaaaaaaa

SEQ ID NO: 3087 - DNA, 811 bp, Gossypium hirsutum
  Predicted polypeptide sequence is orthologous to G12
ctaacatataactttgttgtgtcggaaaaacattacatttcaaacacgacacaaccaaactaactatgtcatctccaactctccattcttctcctcccccttcatagttccagctttcttcccctgttctaataaaaacccaagcctcccgactacacaacccagagttgaggaacataggatttctccaataatttgcaaggcatggagaatggaacaggagttgttgcttcaagggagagttcgaggaagtccacggcggagaggccttacaaagggataaggatgaggaagtgggggaaatgggtggctgagattagggaacccaataaacggtcgaggatttggttagggtcttattcaacacctgttgcggcggctcgagcttatgacacggcggttttttacctgcgtggaccgtcggcgaggttgaactttcctgaccttttggcgggagagagagttggcagcgccggtggcggctctctcggtggggatttgtcagcggctactataaggaaaaaagctattgaagttggtgctagagttgatgctcttgaggcagctcaccaccaccaccaccatcataatcatcgtggtcataattataatcatggttatgacgaagagttgaagccaagtacaggcggttttttacatcgggttgacttgaacaagatgcccgacccggaagattcagatggtgaatgggaaaggaaataggaagttaaaaaaaaattgattgaatcatgaccctccaacttttatgatgtaatttttgttccgtctcttttggcggctaccccgaggg

SEQ ID NO: 3088 - DNA, 550 bp, Gossypium hirsutum
  Predicted polypeptide sequence is orthologous to G214, G680
cctttaaatgcttctatctcagaggggaggttttttaactgcagtagcaagcataaaaaagtccaggaaagcgaataagtcaatgtagatttagatagtacacaacaccacctacacgaaaagtctcgtgagctgcaatcgaataaaagtcttttaagatcaacatatgaaaaggaaataacgatatgggggaagaacattagagattgcattcaacaaacaaactttgcctttgttaattgtatgcaattgtgtaaaagtcaagttgaaggttccccttccaagcgtaccctcttgggacatttctcttcaccttgactgccagtgttcatcactctgttttctttggcttccacagaacaccttttgtaaggtttaaatccagttcggccagcttttagttttgaatgtcctaatccaatagtcagcaggccctcttctgtactgttcttgtctcttgataatgcatttttcacagtttcttgatgatcagaacaagaaccccatgtattgctgttgagatctaaagttgatatttcttcgtcttcct

SEQ ID NO: 3089 - DNA, 920 bp, Gossypium hirsutum
  Predicted polypeptide sequence is orthologous to G214, G680
accgttcactcttttccagcctcaaattaaactcccccatttttttttattttcaaaaaatttccagaaaaataaatccacatgaaattatagtggctgagatttctcgtagtattttttgtgttttaattctcacaaaaaaagagcttgttttcacttcttttgctttgctttcttcaagttctgtttttccaatttctgtatattccgatctttttttcattgccggaaactatgaactttccgactgttttccggtgaactaattttttcatgcgtgatcgtcgtttccagtgttctcatcctccatggctatttctcaaggtattggcgtctacgggttcgttttggcgaggattctgaataaaggaattttgttttaagttcattggaagaagccgtctcttctctctgttacggtggatacttaaattttttatttctattttaattctctggagatttagctttcacctgaagtttactatatgattaattaaaatagtaaaaatttattaaatgatgaggcagtaatatttgttggagtagtaatagaaaacagagacggatctctatcgattgttgtcgttggcttttttgttttttgcagtagtaaatagcagtcatcaggttttgtggagttcaaaaacggctctactatttgtagtattgaatgtccaaagaaatgaaaggaggtttgtgttttacccgttgctcgttagagaggatttgaagcagcggtagcgctgcccaggtcctgtcaatggacacatactcttctggggaagaactcgttcttaagactaggaagccttatactattaccaaacaacgtgaaagatggactgaggaggagcataatagttcctagaggctttgaagctctatggacgagcttggcaacgcattgaagaacacat

SEQ ID NO: 3090 - DNA, 434 bp, Gossypium hirsutum
  Predicted polypeptide sequence is orthologous to G280
accaaatccgtcagcaccggaaggccacgtgggcgcccccctaagaaggctaagactggtaccaacactgctcctccacctcctccaggcgtgaagcgaggccgcggtcgacctcccaaagtgttaccgtcggtaggttttcagtaaagcagccaacttaaatgaaagagaatggagaaaatggctcataccgtcattgctccacctcccgctttaggtttaatatttttttaaccttaattttttaggtgtggtttagttatcagctaattgacgttttagctgttttttttttcctttttaatttttagttaacttggggtgggggtactgtaatgattttactgtagggcttagactttacttttgttcgactccttgtaatttccatgtaattgttaagacccttttctttaaaaaaaaaaaaaaaaaag

SEQ ID NO: 3091 - DNA, 804 bp, Gossypium hirsutum
  Predicted polypeptide sequence is orthologous to G280
gcggccgcgtcgaccttcctctcactctcttcttcgctttctcttaaataatacgaaagctaaaagaaaaagctctaaatttcaatggcgaccgaagaaattagtcgaactcaaggcctcaatccttctcaacaatcttcttcacttccagactaccctcagatgattctggaagccatagaggcattgaatgagagagagggctccagtatgtcatccatcgccaagcacatcgactccactcactccgatctcccagcgtctcacaccactctcctctcccaccacctcaaccagatgaaacaaatgggtcaaattgttatgttgaacaacaattactcgaaacccgaccccaatgccccacccaagcgtggacgtggacgtccacctaaacccaaggttcctcttccacctggcgtcgtcgtctctcctcccagacctcgtggtcgtccgcctaagccgaaggacttattggctccccccaagcccaaacccgtcagcaccggaaggccgcgtgggcgccccactaagaaggccaagactggtaccgccgccgctcctccacctcctcccggcgtgaagcgaggccgcggtcgacctcccaaagtgttaccgtcggtgggttttcagtaaagtagccaagttaataaacgaaagagaatggagaaaaggactcattccgtcactgctcctaccccagccgcgttaggtttaatatttttttaaccttaattgtttaggtgtggtttagttatctgctaattgacgttttagctttttcggttttttgttgtagttaacttt

SEQ ID NO: 3092 - DNA, 665 bp, Gossypium hirsutum
  misc_feature (490)..(490): n is a, c, g, or t
  misc_feature (502)..(502): n is a, c, g, or t
  Predicted polypeptide sequence is orthologous to G481
cccgtctctcccgcccttttttttcctttttatttttttatatataatatatatatttcaattttcatttctactaagggttttgtccatggcggaagcactggcaccggcgagtcccggcggaggaagccacgagagtggcgagcagagcccgaaatcgaatgtgcgagaacaggatcggtttctacctatagctaatatcagccgtattatgaagaaggctcttcctgctaacggcaagatcgctaaagatgctaaggagactgtacaagagtgcgtctctgagtttatcagcttcatcactagcgaagctagtgataagtgtctgagagagaagaggaagactattaatggggatgatctgctctgggctatggcgactttagggtttgaggattacattgatccgcttaggatttacctttcccgatacaaagagatggagggtgatgctaagggctcggctaaaggtggagatgcctctgctaanaaagatgtccanccaggcccaaatggccagcttgttcatcaaggttcattctcaccaggtgttttttatgggaattctcaagcccctctgatgcttcccattcaaggcgctgattaatgaatcctgatcaccgttctccaattcccttatctataccccgtaattatcctgttcc

SEQ ID NO: 3093 - DNA, 843 bp, Gossypium hirsutum
  Predicted polypeptide sequence is orthologous to G481
gtttctctttgttaaaagaataatttagtacaaagaattttttttatttgaggtttttgtatggatggtgtgtgaactgatggatagttgcattttggttatgttatatatatatataaatatgcatttggtttcactttacttgctaaaacttttataaaaaattgatggatactaatatgtttcattttcattttcccagtgatctaaggtcattcaaggacatggcggatggtatggcaagggggccaacgagtccagcaggagggagtcatgagagtggagagcagtgcagttctcactcaactgtgagggaacaagaccgttaccttccaattgccaatataagcagaatcatgaagagagcattgcctactaatggcaaaattgctaaggatgctaaagaaactgttcaagaatgtgtttctgagttcatcagcttcatcactagcgaggctagcgataaatgccagaaagagaagaggaagacaattaatggagatgatttgttgtgggcaatggcaacattaggctttgaagactatattgagccacttaaaatatatctggccaggtacagagagttggagggtgatgctaagggatcaatcaggggtgaagtgcctcttaaaagagatgcagttcgagttcttgctgtccccaacccacaggtgaaacaatgatatttactttagattcttgttcttggcctaaatttgatacacttggctgtttgtttaagcattctgtaaagtcctgaactgaattaccatgtctcttgtgcattggtggtgaatgaatcctgcagtttcctatcgaaggatcattgaactatattaattc

SEQ ID NO: 3094 - DNA, 700 bp, Gossypium hirsutum
  Predicted polypeptide sequence is orthologous to G481
catcagatctgatctgagtcattgtctttttcctttcttctccagcgtccgattttcccttgaaaatccaatctctttcactcccgcccttttccatttttcgttttaatcaatttcaattttttccccactttctggattctttacatggcgacgtcggcaccggttccggcgagtccaggtggcggtggaagtcatgagagcggcggcgagcaaagcccgagatccaacgtgcgagaacaagagaggtttctccctatcgctaacattagccgtatcatgaagaaagctctccctgctaacgctaagatcgctaaagatgctaaggagaccgtacaagagtgcgtttcggagttcatcagcttcatcactagcgaagccagcgacaagtgccagaaggagaagaggaagacaattaacggggacgatcttctctgggctatggcaactttagggtttgaagattacatcgatccgcttaagatttaccttaccaaatatagagagatggagggtgatacaaagggttcggttaacggtggagatacatttgctaagaaagatgtccaaccagagtcaaatggccagcttgctcatccacgttcggtctcgcaaggtgtttattttgggaattctcaacccagtcacaagccaattaagtggtttgttccaaaactgaaacgaaacaaatccattgaac

SEQ ID NO: 3095 - DNA, 869 bp, Gossypium hirsutum
  Predicted polypeptide sequence is orthologous to G559
gtcgttgacaacgactgctccaaattctggtccatcggctgcggtgagtatgggagcagggacggcaacgtccggtgaggaaaatgcgagtgttggtgttgggtcttctgagaagcctagaattaggcaccaacatagccagtcgatggatgggtcgacaagtattaagcccgaaatgctcctctctggttcggatgaggttacgcctgctgattctaagaaagcaatgtccgctgctaagcttgctgagcttgctcttattgatcccaagcgtgctaagaggatctgggcgaataggcagtctgctgcgaggtcaaaggaaagaaagatgcggtatatagctgagcttgaacggaaaatacagacattgcaaacagaagcaacgtcgcttgctgctcagctgactctactacagagagactccagtggtatgagtgctgaaaatagtgagttgaaactgcggttacaaacaatggagcaacaggtttacttgcaagattcattgaacgatgcactgaaagaagaaatccaacatctgaaggtgctgactgcccaacctatgccaaatggtggaccaatgatgaactttgcatcttttggagctagtcagcaatacatcccaaataatcatgctatgcaggctcttctaacggcccagcagttccagcaactacagattcaattgcaaaagcatcagcatcagttcccaccgcatcaactgcatcaacttcagcagcaacttcagctgcaacaagagctccaacagcaagcaggggagatgagagttagaggatccatgccttcccccaaccgaagagatggtccatcttcatcagatgtcagctcaacggcatcaaatgattgaggag

SEQ ID NO: 3096 - DNA, 992 bp, Gossypium hirsutum
  Predicted polypeptide sequence is orthologous to G567
aatggtagaacgacaagaaaaacaagaccaaacgcaaattgcaaatcgccgaggaaagaagatttcactgaaaacgatgaatagcgtgttctcagttgacgatttctccgaccctttttgggtggcttctgctacaggcgctgcggcggggatgagccgaagccaatcggagtgggcgttagagaagtttctagaagaattttctggtgctggtgcggcgatccaggggtcacgtgcgggtgagaatgtgattggtacgtctttggcggcacctcaagcgccggtttcgaaatctgaaaatggtgacggggatggtggcgcggtggaggtaaaaaagcctaataatcttaatcctccgccgtccgattcgacaccgacggtaccgattgacgcggatgagtaccgcgcgatccttaagaacaagctccatcaagcctgcgctgctgttgctctctctcgtgcgtcggctgtgaaggcagaaggttcgtctgcgcaagctgaaaatcaagcgcttcagtcgggatcctatgttcaaggttcctcaaagacacaggaacagggtgaacctgatgctggtatttcggctgtttcaactacacaaaaaaaatcagggacacaaatgaggcaagccacaagtgggtcatcaagagaagattcagatgatggtgaacttgaaggagatactgaaaccaccgaaaacatggatccggctgatgcaaagcgtgctaggagaatgcggtcaaatcgagaatcagccagacgctctagaagaagaaagcaagcacaaatgaatgaacttgaaacacagttggtcaattaagagctgagcattcctcattacttaagcgtctaactgacatgaatcacaagtatgatgaagctgccgttgacaatagaattctgacgctgatattgagacattaagagcaaagtaagcaagccatcatccttgtccaagttgcattttcttatcctggtagagttactctgca

SEQ ID NO: 3097 - DNA, 952 bp, Gossypium hirsutum
  Predicted polypeptide sequence is orthologous to G567
tctcagttgacgatttctcggactccttttgggcggctccgccggggatgagccgaagccaatcggagtgggcttttgacaattttattgaagagttttctggttcgggcggggcgatcccagtgtcgcgttcgggcgagagtgtgatcggtccatccttggcggaacctcggccgtccgtttcgaaatctgaagaagccgatggtgaaggtgacgtggtggagatcaaaagacctggtaatcagaatcataacagtccgccgtccgatctggcaccgacgttctcgattgactcggatgagtaccgcgcgatcctcaaggacaagctccatcaagcctgcgcagctgttgctctctctcgcatcatctgtgaaggcagaagttttctctgcgcaagctgaagatcaagcgcttcaatcgagatcccaagttcaaggttcctcaaaggctcaaggacagggtgaactagatgctacacctagtgaagtcttggctatgtctactacacagacaaaatcaaaggtacaaatgaggcaaacaacaagtgtgtcatcaggagaagattcagatgatgatgaacttagagatactgaaactactgataacatggatccggctgatgcaaaacgtgcaaggagaatgcggtcaaatcgagaatcagctagacgctcaaggagaagaaagcaagcacatatgaatgaacttgaaacgcaggttggccaactaagagttgaacattctacattactcaagagtctcactgacacgaatcacaagtatgatgaagctgctgtggacaatcgaattctgaaggctgatattgaaacattaagagcaaaggtaaaccatcagcatcagttcgtcatcatcaccattgcctaagttgccttttcttactttggtccagttattcttcagttagtttggcttatggttcctgctgaaagttcaa

SEQ ID NO: 3098 - DNA, 472 bp, Gossypium hirsutum
  Predicted polypeptide sequence is orthologous to G594
attttgttgagcgacgaagcttagaaaatctttggtttgtgcttatgatgcgtcgctctgcttatgcatccaaaaaaacgggtcaacccaattcaaccaacccaatttcctgttctccctccgatctctttcgcaccaattcagagcgattataaggtcataaacttggatcaatggatgggctttttttgattctgcaatgaggttagaagggagaaaatcagtgaaagaatgaagtatctgcaagatttttaccagggtgtaacaaaatcacaggcaaagttggtatgcttgatgaaatcatcaattatgttcaatctcttcaatggcaagtagaggtaaaaaaataatggagaaagaacatatggatttgtgtatgaacacaaaaattctttttcatttctagtaattacttaactgctttaagattttgtcctccatgtgaggacatatttaaaaaaaaaaaaaaaaa

SEQ ID NO: 3099 - DNA, 1290 bp, Gossypium hirsutum
  Predicted polypeptide sequence is orthologous to G668
gaaaacttgctgtcatctttttgactctttggggagggagttggaacttggataccacccttttttcctctttttaagtcagcatcctcactgtcttacactttgatttctatatatgtaatgctgcaacatcaaatcctttgtcttactcttagactcgtcttaaagctcccaccaacataaactaaaccctaaaaacacaagaaatcaactgcagttttgataatgggaagacaaccttgttgtgacaaagttggtgtcaagaaagggccatggactcctgaagaagatctcatcttggtgtcttatattcaacaacatggtcctgggaattggagggctgttcccaccaaaacaggtttgcttagatgtagtaagagttgcaggcttaggtgggctaattacttaaggcctgggattagaaggggtaacttcacagaaaatgaagagaaaatgataatccaccttcaagccctcttaggcaacagatgggctgcaatagcatcttacctccctgaaagaacagacaatgacattaaaaattattggaacactcatttgaagaggaagctgaagaagctacaaggcaatgaaagttcttctagatacgggtttccatcatcatcatcgtcataccagatttgtagaggtcagtgggagagaaagttgcagacagatatccatatggctaaaaaggatttatctgacgcattatcacctgagaaatcaagtgacttagttgaaatgaaaccctttaatgaccacacatcttatccaaaaccaagtggatatgcttcaagcactgaaaacatagctaagttgttgaaagggtggatgagaaataatccatggaaaatggctgattctgcagattatagtgaagaagggactgttccaatgaaggaagacaagaacagcaaggaaatggcagaggcatttcaatcacatttagggtttgaatctttagattcttcactttctgatatctcaccatctatgtcacctgagacaagcctttcacaatatgaaagtaagccacacctcaatgctcaaagccaactttcactgcttgagaaatggctttttgatgaaggcaaggattaccaactttgtgacattacattagaccaaaatcttcattttttctaaaaggtagaggggaaagttctttgttttaagggcttctttggggtacttttcatcttggattataagtttttctaggttgaggtttcctagagtgaaacaaattcaatgtataaatttaacattattgttgcaaaaaaaaaa

SEQ ID NO: 3100 - DNA, 843 bp, Gossypium hirsutum
  Predicted polypeptide sequence is orthologous to G904
cttcctttacccccccaaatacaattctgttccttacacgtcatcctcctccacttgtgatacagtaaggaccaagaacccatcaatggcgtcgccgccacctttgttatacggagttattggaggtcctgtggcctcctcggaaaataatagcagtgaacgctcccattcttcttcttcttcaattgagagtgcaaagccgagtattataataatcattttgatcctttctataaccttgcttgtttctgtttctctttgtctcctcttgcgtcatctcaaccgccgttgcttgcgtcacctctctcgttcctctacctccactattgtcgcctccgctgccagccaccgtgtcagtcccgaacaatcaccgacggctttgttgcttgattctcttcctctttttactttctcttccattactcgccgccgctccaacggtgattcaacggtttccggagattgtgccgtttgtttgtcgaaatttgaacagcaggatcagctcaggcttctccctatctgttgtcacgcatttcacgcccagtgcattgatacttggcttacttcaaatcagacttgtcctctatgccgctctcctctcttcgcttccgagtccgatctcatgaagtcgttgcttcagtcttctaacgcagccgcaccgatcggaagtggcggaagcgatagtttccggcttgagatcggttctgtaagtctccggcaaccaggctcagaatcaggtgagcaaagaacgtcgtattccattggctcttttgattatatcgtcgaggaagaatcagaggtgactaggaatcaaactcatcagagaaacgtctccgataaaga

SEQ ID NO: 3101 - DNA, 647 bp, Gossypium hirsutum
  Predicted polypeptide sequence is orthologous to G913, G1753, G2514
ttttttttttttttttttaagagataactttaaacttggaatataaataataaaataaatatgaaaaataaaacaaatagaatgatgtataccactgagtctaacctaatccaaatcatatactatggatttaaaagtaatatgaggttgatgtaaatcctaaccttgtatgactagttggttaattggtatactttttctactattttttttaacagaaactggaaaaatgaagcgaaaacaaagaaaatagaaaaaaacacaacatagcaaaagcaggcttataatttagtaatgtccccataaatcaatgttaaaggtggaagctacgttatcgtcgcaatcataaacttgtgcctgcaaagcagcaggtgaagagaggagcaaaccttcagccatgctatcgattaagcctggcatgttaaacaatgcctcctcgtccatgaaaccataattccactcattatcattaatgttggtggtctccaagctccaactacgatccaacatcgagccataatctaaaacgctcttttcttcgtcgttctcagtggaaactgaggttgatgatgagcatcccactggttgaggatcaatatccgttgaagttactggtttaaaagcctcggcagcggcaaacgcagcga

SEQ ID NO: 3102 - DNA, 876 bp, Gossypium hirsutum
  Predicted polypeptide sequence is orthologous to G913, G1753, G2514
cacaaacatgactgaatctgattcttcttcaaccaatgtgcccccaaaagaccagccgccaccaccaactgttcccatccctgacgctccgccgcaagagcagtcgccgaaaccatcatctactccattgatctcatcgaaagaaggcgtaagtgggaattccacatcgagaaagttgccggcggtttatcgaggagtaagaagcaggagtgggaaatgggtgtcggaaatacgtgagccgcgtaaaacgacgcgtatatggctagggacataccctacacctgaaatggcagccaccgcgtatgacgtggctgctcttgccctaaaaggtcccgacgcggaactgaactttccggatatggttcattcgtatccgaaagtgggttctacatcggcaactgatattcgtgccgccgctgctagtgccgccgcttctagactactacccaaggctgtaaccaacactgggtcatcatcaaaaaacgaggacaccacatcgactactgctatggagattacatgttcaggtcaagaatttatcgacgaggaagagcttttaaactttcccaatttgatggtggatatggcagggggaatgctagtaagccctccaaactggataaactcaccaccttctgatgattcaccagataattcagatgtagatacactatggacttacacttaaaatagaaaaattcactgtaaaagtgatgaatgagagagagtatacagtacaatgaaatgtagaagaagaagaagcatggtttaaaaactagggtctagatgcttctgatgattcagtaatatgaaatgcagaaggtactgtcatttgtcctctttttttaactctgtctcttctggtttttatctctt

SEQ ID NO: 3103 - DNA, 621 bp, Gossypium hirsutum
  Predicted polypeptide sequence is orthologous to G1020
gaacccgagaaaaaaggcccgagtctggctcggtaccttcgacactgccgaggaagcagcgcgtgcttacgacgcggcggcacgagaattccgtggcgcctaggctaaaacaaatttcacctacactaacatcaatgacttcacgctaagccccagccagagcagcaccgtggagtcctcttctccgccgccgttggacctcacactcgctagcggatctatttcgctccccatgacggcgaatcatccggtgtttttcgttgatgtctttgcttccgccggtaagcgtctctccgatgccggcggagcccagagcgattcagattcctcgtcctcggttgttgattttgaacgaggggtgcaaccgagagtgtttgaatttgatcttaatcagttgcctgctgagatgatctgaattcttttccccgtttgtaccggatgtcgttttaagcttcggttttctgcgttttttgctttcctcttttatggtaaaagctgacatgtaacgtgtataaaagaaatgtaactcttctagggacctatttttagcaacttgaggaaatttcgaatttcctcaatgttgtttctacttacttataattgaagtatttccttttcttt

SEQ ID NO: 3104 - DNA, 823 bp, Gossypium hirsutum
  Predicted polypeptide sequence is orthologous to G1020
agaggagtaaggaagcgtccatggggtcgttacgccgctgagatcagagatccagggaagaaaagccgtgtttggcttggaacttttgatacagctgaggaagcggccaaggcctacgacgccgccgccagagaattccgcggcgccaaggcgaagactaatttccccctccctggtgaaattctcaacaatggtagtaactgtaacaacaatggcgataccaactgcaacaacaacaataacaaccacagccctagccggagtagcaccgtggagtcatcaagccacgagccgccgacactcgtcaagtgttcaccgttggatctcaatctcggacacgctgcggtcaccgggtacggatctcctgcggtcaggcttcctttccctcaaatttcgccggtcgccggttttttcgccaacggcgtctcggcagttgcagccccccaagttttttacttcgacgctttggtccgacccggtgttatgaaaggacagcagtatcaacaacggttgagattcgatcaccgtgattatcacgaaacttttaacgctggtgtacaaagcgactcagattcatcctccgtcgttgatttaaaccaccacgagatcaaacggcgaccgcttctcaatatcgatctcaaccaacctgctccggaagtcgcctgattatgattttttaaaatcgccgatatcaagaaccggaaaagaaaacccacaaattttcaattttatctctttaaatcgttatcttcttttagtcccaattttgaaattagacgagaaatatacccaaaagaattacgcgagagcgcgtaaattgtga

SEQ ID NO: 3105 - DNA, 922 bp, Gossypium hirsutum
  Predicted polypeptide sequence is orthologous to G1020
ttcgccctcctccattctatctcaaccccacacataaatccccttttaccaaaggagaacattaaaacatcgccctactcttcgttttcttcaagcggaaaacaggaaactgaggctttcccttctcaaatggcaccgagggagaaaacggcggccgtcaagggtactgggaataataacgaggttcattttagaggagtaaggaagcgtccatgggggcgttacgctgctgagatcagagatccagggaagaagagccgtgtttggctaggaacctttgatacggccgaggaagcagccagagcctacgacgccgccgctagggaatttcgcggcgccaaggccaagactaattttccggtcccttgtgagaatctcagcaaaggtaataactgtaaaagtaatggtaacaacaaccaacatagccctagccagagtagcaccgtggaatcctcgagccgtgagccggcgctcatggttgactcttcgcctttagatctcaacctcgtacaaggtgaggcggttaccggttacgtgcctacggctgttagatttcctttccagcaagcttcaccggtgccatatattgcgggccgcaaagttttctactttgaaccattcgttcggcctggtgcagtgaaaggacacccatttgaacggtttggattcgatcatcatgatcttcatgcgacgtttaatggtgtacaaagcgactctgactcatcatccgtcgttgatttgaaccaccatgaggtcaagtcgcgcccgcttctcaatatcgatctcaaccaacctgccgttccggaaattgcctgattttttttttaatattcgcagatcgtcaaagaggaaggtcaaaaaaacgagttttttaaattttcgttgtttaaacatatttttcttagcagtcccacgaaatatc

SEQ ID NO: 3106 - DNA, 855 bp, Gossypium hirsutum
  Predicted polypeptide sequence is orthologous to G1020
ggcacgaggttcatctcactactgttcaagaaaagttacttaaagaaaggaaaaccatggctcctagatcaaaacccagcccgattagcccgaatcccgacccgaattctaaggagatccgctaccgcggcgttaggaagcgcccatggggccgttacgcagccgagatccgagacccgaggaaaaagactcgagtctggctcggcaccttcgacaccgccgaggaagcagcgcgtgcttacgatgcgaaggcgcgagagttccgcggcgctaaggcgaaaacaaatttcgccgacaacaacgccaacgacttcacgcgcagccctagccagagcagcaccgtggagtcttcttctccgccgccacttgaccttactctggccagcccgtgttcttccctccctgtgacggcgcagcgtccggtttacttcttcgatgccttcgctactggcggttcgggttgccccgcatccggattcgctcaaagcgactccgattcgtcgtcgtctgttgtagattttgaaggaggagtgcggcggagagtgtttgatcttgatcttaaccagttgccagctgaaatggattgatttgcctccttttttcaatatgtcgttttcagcttcaattctcagcgttttgggctttcctctttttttatttttcccttaatttttgggttaaaatttaaaactgacatgtaatgtatgttgtgtgtaaaaaaaaaattgtaactcctagagatctatatttttggcaacttgagaacattttctcaatgttgtttcccctttattataattaaaaaaattaataacataaattaaatgctttttcataaaaaaaaaaaaaaaaaaa

SEQ ID NO: 3107 - DNA, 475 bp, Gossypium hirsutum
  Predicted polypeptide sequence is orthologous to G1020
ctcgagcggggcggccggggcaggtgcaaagcgactcagattcgtcctccgtcgttgatttaaaccaccacgagatcaaacggggaccgcttctcaatatcgatctcaaccaacctgctccggaagtcgcgtgattattattttttaaaattgccgatatcaagaaccggaaaaaaaaacctacaaaatttcaattttctatctttaaaatcgttaatcttctttttagtcccaaatttggaaaattagacaagaaattatacccaaaaaaaaattacgcgaggaggcggcgtaaattgtggaatacgtagatgaaaaacctcccttttttgcagcagagaaacgttagtttgtagtctgttgtttcatattaatttctggtaattcttttttattttcaatgaattaattagtaattacgaggaaaaaaaaaaaaaaaaaaaaaaaaaggcttgtacctcgggccgcgaccacg

SEQ ID NO: 3108 - DNA, 744 bp, Gossypium hirsutum
  Predicted polypeptide sequence is orthologous to G1082
aggctaggaatttggatagagaggatcagaagctgcagaaagatatccaagcattagataagaaaattgttttggtctctggagatggtagcagtctctcggtagctggaaatgttgtatatcagagtgagactagcaacagtagtttgcaggggggcttgcaacgcatatttgaggcaatggaaaagttcagttccgagtcctccaaagtctatgaggaacttttgcagcgtgtgaaagaaaggattgctgaagaccatgagagagtatcataggacccactaaaaaaaaaatgactatggcatcccttggaactgatgatcagtttaggcagtctattgccctctcagaaatggagctcaatgttgggttggacgggtcctgcaaacatacaacttggctggttgctctactgtcagggaagacttgattatgaatgagttggaagagacataagatgggagctaaccttggaattgttagatgattcatcatctgccttacaggagtaggtttcggatgggcttatggcatcgactgtcaagcttgtcaagagccgaagacagatattgcatttccaaaatctcactcaaggtgcaactctagatatcctgtccagtcggcatgaagcagcacccgtatcattgaagaatatcaggcaaaggaaagcagatggtgtgccaaaccattggagtaagcagattctccatcagttttgtaagatgaagagttttaaaaatgtag

SEQ ID NO: 3109 - DNA, 550 bp, Gossypium hirsutum
  Predicted polypeptide sequence is orthologous to G1084
tgagaaaagaatcaataaaaaaattgatagactgaaagtatcaacagattctcccccaccaagattttttagttaaaaaaattataaaaaaggaaggctaacattttaccttaaaacctagtggcaaatacttaacattctttagttacaatcacattttctgttaacttcaacccaacacaaatctagaaacatactcccatcttctattttagaagattggggatgagggggtgataaaaaagatgagaacaggaataagggctctttcgcgcttcgggagggaggagagaaaaagggaataagctgccccacccaggaacaaacacaagttgcttcttcacggatctgtggcaaccatttcttgatattttgatacaatggcatgtgctatgggttttaggggcatctgaaagtgtgagaatcaacgtgtaacctttaactcaccagttttgggggaaaggaaaaaaggagcttttgccatcagcaacccaaacaaaaagttaaccatgcaaatacatttcttggaccatcttttatgcatagtaca

SEQ ID NO: 3110 - DNA, 891 bp, Gossypium hirsutum
  Predicted polypeptide sequence is orthologous to G1100
ctcttgcagccctcactttctcagtgtttgtacccaacaaagtcttttcttttcttccctctctgttcccaacaatggaacagtcatccaacctcaagccctcccactccttgtttcaagttctcactccaactcaaccccttcaatttcatatttaaacactgtcaattcaaaatggatagcctttcaactgcttcagtctcgtttctacttcttgttttaagctggaaaagttgattttctttgctgtcaaacgaagttttttttttttttccttagagaatatatataatcaaaagaggagaaaaatgatatcaggagggctaaatttggtgatgactgttataggtttcacagtgagtattatgttcatagtgtttatttgtacacgtttgatttgtgctcgtattcagctacgtgcttctcggagacccttcgcaatctcttcaagatctgatcttaatatgctcgaacggggtttacacggtattgagcctgttgttgttgcgaatttcccaacaaagactttctgtgatgagtgcttctcagctaacaaagatgctcagtgcacggtttgcctttctgaataccgccgcgaagatgtgttgcgaatcctcccgtattgcgggcactccttccatgtaacatgcatagacctatggctgcaacagcattccacctgccctgtttgccgaatatcgctgcgtgaattgcccgaaaagaaaaggttgatgcaaccgttgttcagttcggccgatcgttctcattttggcacagaatcttttaatatgcatacgtacaactgtttgttgagagggcacagatttccctcaagaaccagtgagagccctgagatggacccaaaccaagagaattcatttgcaactggaa

SEQ ID NO: 3111 - DNA, 783 bp, Gossypium hirsutum
  Predicted polypeptide sequence is orthologous to G1108
gccctgcataatttccatccttggtatccaagaggatttttcaccaactagaggagccaccagggaaattataaatgcattgccaacattcaaatttaaatccaagaaaaccggaaatgtaaacgatcaggaaatttcaactagtgaaggtggtgtcctggctgcagggacggcaaaggaacgtgttatatccggggaagatgcagtttgttgtatttgcttggctaaatttgcagacaacgacgagctgagggagctgccatgcctccatgtcttccatgtggagtgtgcagataaatggttaaaaatcaatgcatcttgtcccctatgtaaaactgaaattggtgagagcagcagtacttcaccattagcacaagactcgcattaacagtgcaggcaagacaatcgtcaatggacgaatgaccggtaatgtcttcaatgttttactttgttctactggttcttgcatttaagtttgagtcgaatcaagccgagttgtcacgagtcccccatgcaagagatacaaatatatagttaggctatcatcaaaaaagaaacttgcaatgctatatactaaaaaagattgttccttgaggctaacctctcatggtcatacaaaaatattttgattgctattgctcttttatactatggtatcgcgaaacatgactgtcttgaattttggtgggaacatttcctctaaagtcggatattttgtgggtcaaaaccaatccctcgtatcgcctctcactctcccctacccccttccccctcggtccccct

SEQ ID NO: 3112 - DNA, 550 bp, Gossypium hirsutum
  misc_feature (83)..(83): n is a, c, g, or t
  misc_feature (238)..(238): n is a, c, g, or t
  Predicted polypeptide sequence is orthologous to G1108
tttttttttttttttttttttaaaaaattattatcattttttatttaatataaacaaattggtttacaccaacagttgcaatngggggaacgatactgaaaaaaaaaacatgatcacatgaatgtacgaatatctcaaaatcttttgtgacacaacataaaataatataaatacgattatgatataacaaaatacataaaaatagctatgaatacaagatatgaaggtcgaatgtttngggacattgcttcgtctttcaactgtcatttttccggtatgctgttaatttgaatctccggctgatggcgaagtacagtcactggtgttgccaacctcggttttacaaaggggacaacatgcattgattcttaaccatttatctacacactttacatggaagacatggatgcatggcagctccctcagttcgtcatcgtctgcatatgctgccaagcaaatacaacaaaccgatcttctcccgatatcacgcgttcttttgcagtaccggaagccagaactccacatgaaacgtccggatcatcaacatttc

SEQ ID NO: 3113 - DNA, 550 bp, Gossypium hirsutum
  misc_feature (14)..(14): n is a, c, g, or t
  Predicted polypeptide sequence is orthologous to G1108
aaaaaattatatcntccattattttatttaatataaacaaatttgttaacaccaacagttgcaataaaaaaacgatactgaataaaaaaaacatgcatcacatgaatgtacgaatatctcaaaatatttttgacacaacataaaataatataaatacgatttaatataacaaaatacataaaaactagctatgaatacaagatatgaaggtcgaattgtttaacgacattgcttcgtctttcaactgtcatttttccagtatgctgttaatttgaatctccggttaatggtgaagcactgtcactggtgttgccaacctctgttttacaaaggggacaacatgcattgattctcaaccattatatctacacactttacatggaagacatggatgcatggcagctccctcagttcgtcatatgtctgcatatgctgccaagcaaatacaacaaaccgcatcttctcccgatatcacacgttcttttgcagtaccggaagccagaactccacatgaaacatccggatcatcaacatttacaattttcttaga

SEQ ID NO: 3114 - DNA, 746 bp, Gossypium hirsutum
  Predicted polypeptide sequence is orthologous to G1137
gcttagcgtggtcgcggccgaggtaccatgactgcccaggatgagcaatttgagggaggtagtgaagaggttgatagctctacaaggctaattaaaaagcgaaaactgcttgatggcagttatggttgtttgcccttgcttatggatactgctaattcagggaattttaacagatattctgaatacgaggatgatgcggattcaagctgtgccaaaggccaaaatcctggatcaggtgatacagattcgtcttcaagctacaagagaatgagaaaggataaaattcgagagacggtgactgttttgcgaagcataatcccaggcggagagggaaaggatgcagttgcggttcttgacgaagctatcaactacctgaaatccctgaaacttaaagccaaaaccttgggacttaacactctatgagctgcagcctgcagctgttctcacaagtagtattagttgttatttttgtcattgttagtggagctgtgttaaataagtgaagtatacacaatcttgaatggtgtttttcatatataatttggagcccttccaaaaatagaagatcgtagacaaagaacatgaacccttcccaatgatatgagttggaaaccagtagcataaggagtcgaaatctcatctctatttcctaaaggaagcaaaggatacatgagtgtatactatgtcccaataaaggaagatgaaccatcattagtcaacatcttgggttgtagagaaagtgaaac

SEQ ID NO: 3115 - DNA, 828 bp, Gossypium hirsutum
  Predicted polypeptide sequence is orthologous to G1146
gcggccgcgtcgacattgtatcctatgatggtctgttgacattttacattttatccgatgttattattgtttccctgtgatctttctggttgcctgtcatcgcaggaaggagcgacaatttaaggttgcaatcaaactggcctccaagccagaccttcattatctgagggagtttttgagcagaaggcattttgaatgccctcaagaagctattcaagttctgaatgttgttcttagagctaaaccatctcagatatatactgaggttggaaggtcttttttccatacatcattaggtcctagaggagatcttggtaatggaatagaatactggtctggatattatcagagtcttcgactcactcagatgggtttatctcttaatattgatgtgtctgctcgatcattctatgagccaattttagtatcagagtttgttgcgaatcattgcagactatcaaacctgtcaaagccgctgtctgttcaagatcatattaaagtgaaaagggccttgaggggagtaagagttaagctcatctacatgatttatgccaaaacttgcaagattattggagtatctagagaccctataagtcagttgacatttactctcgatgacaagagagcaaatgtctctgtggtcaagtatttccgtgagaaatacaatgttgtgcttaaatatccatccttgcctgcactttaaagtggaagtcaagctagacctgtctacctgccaatggagctttgtagtatcgttgagggtcagagatacacaaaaaaactaaatgaacaacaagttagatctctgcttagagcaacttgtcaacg

SEQ ID NO: 3116 - DNA, 1003 bp, Gossypium hirsutum
  Predicted polypeptide sequence is orthologous to G1146
caagcccttctattgcagctgttgttgcctctcaagattggccagaggttacaaagtatgctggcctggtttgtgctcaagctcatcgacaggagctcatccaagatttattcaagacatggcaggatcctgcaagggggactgtttctggtggcatgattaaggagctcttaatatctttccgacgagccactggacagaagccacagcgcattatattctacagagatggtgtcagcgaaggccagttctatcaagttctattatatgaacttgatgctattcgtaaggcatgtgcctcattggagccaaattatcagcctcctgttacatttgttgtggtgcaaaaaaggcatcatacaaggttgtttgctaacaatcataatgatcgccgttctgtagacaggagtgggaatattttgcctggcactgtggtggactccaaaatttgtcacccaacggagtttgacttctacttatgcagccatgctgggattcagggtacaagccgtccagctcattaccatgtgctatgggatgagaacaagtttacagctgatgcattacagtcccttacaaataacctttgctatacatatgcaaggtgcacacgatcagtgtcgattgttccccctgcgtactacgcacatcttgctgcattccgagctcgcttttatatggaaccagaaacatcagacagtggatcaatgacaagtggcacagctgcagggcgtggaggtggagctgcagctgctggtgggcgtagcacaagaggacctggtgctagtgctgccgtcagacctctgcctgccctcaaggaaaatgtcaagcgtgttatgttctactgttaagggagtgcttgtattttgagcatctattttgttgggctttgcttattggtatttcgaacaatatctagtttgtttggtgttgcgtggattattgaactaaacttgttgaactttggtgttaaaactatgttaattttatgattatcgctgtg

SEQ ID NO: 3117 - DNA, 884 bp, Gossypium hirsutum
  Predicted polypeptide sequence is orthologous to G1146
actgtctaggccattgtcggattccgatcgtgtgaagattaagaaggcgcttagaggagtcaaagtagaggtgacacatagagggaatgtacgaagaaaataccgtgtttcaggattgacttctcagcctactagagaactagtgtttccggttgacgataactctacaatgaagtctgttgttgaatacttccaagagatgtatagcttcacaattcagcatacgcatctaccttgccttcaagttggaaaccagaagaaggcaaattatttacctatggaggcatgcaaaatcgtggagggacagagatatacgaaaagattgaatgagaggcaaattactgctctcttgaaagtcacatgccaaagaccgagggatcgagaaaatgacattttgcagacggttcaacataatgcttatgatcaagatccttacgcaaaggagtttggaatcaaaattagtgaaaaactcgcttcggtcgaggctcgtatccttcctgccccttggctgaaatatcatgaaactggaaaagaaaaggattgtttgcctcaagtggggcaatggaacatgatgaacaagaaaatgattaacggaatgactgtgagccgatgggcatgtattaacttctcacgaagcgtgcaagagagtgttgctcgagggttttgcaatgaacttgctcaaatgtgccaagtttctggcatggagttcaatcccgaacctgttataccgatctacactgccaggcccgagcaagtggaaaaagctttgaagcatgtttatcatgcatccatgaaaactaagggaaaagaactagagcttctattagctatattgcctgacaacaacggctcgctttatgggtgatctcaagcgaatttgtgaa

SEQ ID NO: 3118 - DNA, 682 bp, Gossypium hirsutum
  Predicted polypeptide sequence is orthologous to G1146
tactcgctttttccctactgatcgcaacaaaactgataggagtggcaacatattaccaggtactgttgtggatactagcatctgtcatccaactgagtttgatttttatctcaatagtcatgctggaatccaggggacaagcaagcccacacattaccacgttttgttggatgaaaatggcttcactgctgacatcttgcaagtgctcacaaacaatttatgttacacgtatgcgaggtgtaccaagtccgtttccatagttcctccggcatactatgctcacctcgctgcttatagggcacgctgttatattgaggatgagatgtcggatagtgggtctactggtggaggccgaaagccgaaagaccaggttgtagaggttaggccgctgcccagcataaaggataatgtgaaggaagtgatgttctacgtctgattaattatgtttggttgattgtgggaagttgcgcaagtatagttgcacggtttgtggaatgatggtggagtcttatttattccattggtggacttagtaatcatctaattttggagtttttgttttggtggttgggcgacttgttgtgtgaagtttgaattattataaatcacacactgtttgtggattacgaaaatttcataaatgtcctttatttttaaaaaaaaaaaaaaaaaaaaaaaaaaa

SEQ ID NO: 3119 - DNA, 484 bp, Gossypium hirsutum
  Predicted polypeptide sequence is orthologous to G1146
cagcctaccgagctcgattctacattgaacctgaaggttccgaaaccgctaaatcacgtcgtacacgcacaaccaatggttcaccggttcggcctttaccagcattaaaagataaagtgaagaacgtgatgttttactgttaaaaaacatcgaagggaaagagtaaccaaaaaaaacatatatgtacatgctttgttgtgttcacagtgtagagagactgccacatccctgactttttgaaagcgcaacaaacaaccgactgtaacagttactagcagactaacaaaaaaaaaaaaaacctcagctttttagagcatatataatctaaatgcatatacgtatatgtatatgtatgtgatacgagatttctaagctgaaaattcaacaacatttaatattactggtccgagagacacaacaaaacaactgttgaacaaaaacgatatatagctgtctttcaatccaaaaaaaaaaaaaaaaaaaa

SEQ ID NO: 3120 - DNA, 556 bp, Gossypium hirsutum
  Predicted polypeptide sequence is orthologous to G1146
cgcactaccatgttctttggggatgaaaacaattttacagcagacggaatacagtctctaacaaacaacctttgttacacatatgcaaggtgtacgcgctcagtctcagttgttcctcctgcatattatgcacatttagctgcattccgtgcacggttctacatggaaccagagatgcaagagaatgggttgaacagctgcagtaatggtcaagcgaaaggtacaagggcagtgggagaatcgggggtgcggccattgccagccttgaaggagaatgtgaagagagtgatgttctactgttagaatggatgagtggagtgggagatttgcaaccatgaatagaataacttttttcagcttattaaaatttccttgtacagtttaaatgaatgattgcaaagtcttccaaagtttagtttaagataaaaatgtgaaacgtgggaggaatgatccacagatgcaagaattgttaaaactaggttattatcttcatgtaaagaaatgctaatttagaatccttaatcatcttattctcaatttaaaaaaaaaaaaaaaa

SEQ ID NO: 3121 - DNA, 550 bp, Gossypium hirsutum
  Predicted polypeptide sequence is orthologous to G1198
acgtataattctttggcttccaaacaatataaatacaaaacaagaaaatctaactttgctgacctaaaattattcttgatacacagcaataaggattcatacttacatgtctcatgctcaggaagaatataagcttatatatatttattgatgtttcatacaacaagacccgcaaaagaccattttcttactggttgaggaacaaacttctggcgtctgcaacctagatataatattgatggtagtctaagtttctatcttcacttcagaatttaggaaggttcgcgtggacgtgcagaccaaagtgaactgagagcacgtaaacgatggaagtattcccccaaagcaagtaaacctcgagctgcttgacgggttgttaagattcgagccatctgttgcaaagtctgctggcgaaggtgatcagcctgtttcgggaaagaacacctgcttcacaaagccctctagggcctgcaatttatctattgcagcagctagttcgagctttgtagtttcctgaactcaaaatctgttgctaacactctcgggataa

SEQ ID NO: 3122 - DNA, 932 bp, Gossypium hirsutum
  Predicted polypeptide sequence is orthologous to G1198
cactgggggtattaaggaagtggaataatgatgaatggatggtagaacagtgagatctagtgcaaaagatgagaaaaaagcagcaaaagggatgccgggttttgactcacaattaccagttaccaacatactttgctcagagagaagcacaatccatccattccctgtttcaaactttgggacattcgaccaatctgttggatttcgcctagaggttgctgttaacctgagtggaaacggcgctgtgtttgattcagcaaaagtaagtcggcaagaagttccttctgattgtgaccttattggcacttcagacaagactccaacttcatttactaattatccatccaccaaccaagttgaatctccgaggttgcagttagaaaaaggtcaagaaacaaacctagtctcaatacctagtggtaatacagaaaactggggagaatccaatatggctgatggtagtccaaagactgacatctctacagatgcagacactgatgaaaaaagtcagaggtttgatagaggaaaatctagtattgttgcggtttctgattctagtgacagatcaaagagtaatttggatcaaaagacacttcgtagacttgctcaaaatcgtgaagctgcaagaaaaagcagattgagaaagaaagcatatgtgcaacaactagagagtagtcgtttaaagttgacacaattagagcaggagcttcagcgggcacggcagcagggtatattcatatcaagctctggagatcaaagccattcgatgggcggaaacggtgccatggcatttgatgtagaatatgcacgatggttggaagagcaaaaccgacaaattaatgagctgagaacggcagtaaattctcatgcaagcgatgcagaacttcgtattattgttgatggtgtaatggctcactatgatgaaattttca

SEQ ID NO: 3123 - DNA, 916 bp, Gossypium hirsutum
  Predicted polypeptide sequence is orthologous to G1198
caaaagataaaacagaccagaagacattgcgtaggctagctcaaaatcgggaggctgcaagaaaaagccggttaaggaagaaggcgtatgtgcaacagctagagagtagccgactgaaactgactcaacttgagcaagaactgcagcgagctcgtcaacagggtatattcatttcaagcacgggagatcaatctcattcgatgagtggaaatggtgccttggcatttgacgttgagtattcacggtggctagaggagcacaataagcatataaacgagttgagggctgcagtcaattcacatgctggtgacgccgaacttcgcactattgtcgacagcgtcacagctcattttgatgacattttccgtttgaaaggtattgctgcaaaagctgatgttttccatatcttatcgggaatgtggaaaacaccagcagagcggtgttttctgtggataggtggcttccgttcatccgagctccttaagcttcttgcaagtcagttggagcctctaactgagcaacagtttatgggtatccaaaacttgcagcaatcatcccagcaggccgaagatgctttgtcacaagggatggaagcattacaacaatccttggccgagacattggccaatggctcacctgctccctcgggaccatctgggaatgtggcaaattatatgggccaaatggcaatggccatgggaaagctaggaaccctcgaagggttccttcgtcaggccgataatctacgccagcagacacttcaacagatgcaccggatcttgacgactcggcaatcagctcgtgcccttcttgcaataaacgactatttctctcggctccgagctctgagttctctctggctggctagacctcgcgagtgagaagcaagataataaaatccatctcctatgaacaa

SEQ ID NO: 3124 - DNA, 982 bp, Gossypium hirsutum
  Predicted polypeptide sequence is orthologous to G1228
atttattacttgtattgatttgttagcttcaatatatggaatgttggtaactgagagagggacacagaaggagaaaaagaaagaatttaaggcatttacttcaactactgctaagctgttatggagaggctccaaggacccattaatccttatgaaaatactaacctctgctactgcactactgcttcttcttactctttcaacattctactctcattctgctttcattctctctttagatgctgagagagactgaaccatgtgccctccacccaattaaatgatattttccttttcaaatatctttacatggagagcatttggaggtggaatgcttagaacaaggttttattagctgtgagagattaaagcttggagaagaagaagaagaagcacacttttcaataccaagctttgaagagaaaatgccattccttcagatgcttcagagcgtggagtctcctcagctttttgcctttaaagaacccaacttccagacacttttgagactgcaacacatgaagccttgggagctaaacaacaatcctttcattcctgaaatggaaacccaagttcaagccctagagctggaaagttgtgtcacccatgaaacagtactcgacttacattcaccagtcaaatccgagaccaaagagcttaagaaaagcccaccttcaagctcatgcgttgaagttctcagctctaggtctaaccaacaccaaccaaagtctgacaattgtagcagagaacccaacttgggctcctcgcctcagaagattttcacaaagtcccctccgattactagagaacgaagaaagcgaaaacgaacgaaggcagccaagaataaagaagaagttgaaagccaacgcatgacccacattgccgttgaacgaaaccgtagacgtcaaatgaacgattatctaaattctctccgctctctcatgcctccatgttatatccaaagaggtgaccaagcgtcaat

SEQ ID NO: 3125 - DNA, 872 bp, Gossypium hirsutum
  Predicted polypeptide sequence is orthologous to G1275
gcggccccttcgaccaaaactctatcaaagaccaaaagtccagattttccttaaaaatggacttttctcatcaaaaccctaactctaaccctaattacactttcttccctgaaaacgtcaatcccatgcccgattttgaggtctccgattatctcgatcttgacggcagtatcttcgacgacgatacatcgtcggagaaaggcatggctgcagctactgaacttagtggtgcaacatcaaaaaatagtaacagaaaatgcaaaaatggagtggggaaaaacaaatcggaactgggggtacgagttgcgtttagaatgaaatcagagatggaggtgaccgatgatggatacaaatggaggaaatatgggaaaaaatccatcaagaacagccccaatccaagtgtaggatgcaatgtgaagaagaggatagaaagggacgtaaaggaccaaagttatgtggtaactacatatgaaggagttcacaatcatgagaccccatccatggtttactacaaccaaatgtccattatggctcctaatgcttggacctttcaagcttctcctccttcttcttcttctacatgaaaagaaaacttatatacatacatacatacatatatatatattatccttagaattatatatctgcttctttgccttatggtgttgcctaaaatggtgagctattactttttagttgacactaattttcccactatgcattttccgggctgacttagttaaaatacagtcgggccaaagctagtggattgactatccgtcgtctttgttgtaatttccatctctgttaattatcaaaactcagaactactttctctttcttttttttaaatgggatatattaataataaa

SEQ ID NO: 3126 - DNA, 547 bp, Gossypium hirsutum
  Predicted polypeptide sequence is orthologous to G1275
tcggcagagattcagacaagtctgaggttgaaatactggatgcatgggtacaggtggaggaaatatgggaagaaaatggtgaagaacagcccaaatccaaggaactactacaaatgtttgattgaaggatgccctgtgaagaaaagagttgaaagagatagagaggatccaagttatgtcattacaacttatgaggggatccataatcactaaagtgtatcttgaatcagtggttttgtttttgaccactacctaagtccggcagaagggccaacatcgatgatcgcatcagctgcatgatacttgagtcatgcattatgattaagaaacataaagatgatatcggaaaagccgaggttggttttattcatgtatgcatctttaaatttggccaactttattttgttcttgttttggttatgtacataatttgttggcttgtagaaccctgagtttcaactgatgtcttaagttgaaacacagggtatttactgaggttttaactgtttgatccagttttgtttaagagtaaaaaaaaaaaaaaaaa

SEQ ID NO: 3127 - DNA, 627 bp, Gossypium hirsutum
  Predicted polypeptide sequence is orthologous to G1421
gtcccactgagaagaatatcgttgagagaagtaaaacgacgtcgtcgttgtcaaaagcttctcggaaacggccggcggctgttgctgaagctaaaggtaaagcgccggcgaaagcaccggctggaaagaagttcagaggagtgaggcaacgaccttggggaaaatgggcggccgaaataagagatcctcttagacgtgtacggctttggttaggcacctatgacactgccgaagaggcggcaatggtttatgacaacgcggcaattcagctgcgtggaccggacgcgcttacaaactttacaactccccaacaaaaatcgattcaagaaaaaaccagccaaaaaccgttatccaactccgattataactccgacgaagaatctcataaaacagatccctgctcaccgacttccgttcttcgctgccattcgctttcccgtcgatgaagccgactctcaaagcgccaaagaatcgcgcgaaatcggaagcgaagctcgagatgttgtcgatgattcttgctgcttatcgggagaaaacctgtcgggtttctccgactattcctctttgttttccggcgacatgtttttgttcagtgcccgacttttttgacgatgatacgagtttaca

SEQ ID NO: 3128 - DNA, 494 bp, Gossypium hirsutum
  Predicted polypeptide sequence is orthologous to G1594
tttgggagtcatattagcagcttgaagttggaattctctaagaagaagaagaaagggaaactaccaagagaagcacgacaaacattgctcgagtggtggaatgttcactacaaatggccataccctacggaggcagataagctagcattggcggaatcaacggggctagaccagaaacaaatcaataactggtttataaatcaaagaaagcggcactggaaaccatcggagagcatgcaattcgcggttatggataatctgtcggggcaattcttttcagaggactgagggcgggggcaactaccgactggcttgctttctcataaatgtatatgccacatcattaattaattatatggttttgttttgcatatgccttctatgccatgatgtatattctgaatgcaaaatgtattataggacttaaaactcagatttgaatctctccctcccgtcgacttggaatatttggataaaaaaaaaaaaaaaaaaaa

SEQ ID NO: 3129 - DNA, 683 bp, Gossypium hirsutum
  Predicted polypeptide sequence is orthologous to G1655
tccatctccatctccatctcctttctgcaattattcccaactttccatggcttccttcacacccaatctagaacctgcccctgacacctctcttcagttcaagcccaagaaacccaggataacccttcaaaccccttcctcttgtcctcccaatcaacgcatccaaagaattaagcgatggcggacccaacgagaccaacacatctactcctccaagctcttccaggctctccgtcgttctcgtcgtacctccgcctccagggaagtccacgaaacggctgacagggttctcgccgttttggccaagggcaccactcgttggggcagagccattctcaccgctcgcaaggtgaccaaacataagaaagccaagctccctactaataacaggttgaggaagcccgatatttacagagagaggaggaaaacgccggctgttgagcggaagttgaaggttttgggacgtctcgtccccggttgccggaaactatccttctccaaccttatagaagaaactagcgattacatagcggctctagagatgcaagttcgagccatgacggctattaccgagtttctctgcggcggaactggcggtggaccgcagccgccggctgatcgccttccctctaatgtcaactcttgaaaaggtgtttattattaataattattattattttttg

SEQ ID NO: 3130 - DNA, 671 bp, Gossypium hirsutum
  Predicted polypeptide sequence is orthologous to G1795
aaaaatgcttcaatctttattggtttcatttattctcaaaatcaagaagctcctctaacaatttatcgtccaagcactccaattccagcactattctttcttcatctttcttgcttttcacatgttcaaaggaatacgaagaagaagaagcagcagaagcagatgatgaagaagatgatgatgatgatgatgatgatgatgaaggggtagcggtggggggagagtttactgctgtggatgaaatgatatgttcatctcggaagttgagaatagcggagtgacccctcatagagaaagcagctctgtcataagctcgagcagcctcctctgctgtatcaaaagttcccagccacagccgaggtcctccttgcctcgtcgagtcccgaatctcagctgcgtatttcccccaaggccgcctcctcacacctctatatcgaaggctggactccgcctctcctgctttcttcatcttattttgttccttacgttataaaccctcacttgaagaactacatttgtttttggaattttcgctgccaaggcggtgggcaccagttttcgacgagtttccccgtggtttacaacacaagcgacagagcaattcgtttttacagttcaagttcttgggtcccaagctttatgttaacaccattccagttgatgtaggtatg

SEQ ID NO: 3131 - DNA, 550 bp, Gossypium hirsutum
  Predicted polypeptide sequence is orthologous to G1911
aatgattaatgcacgatatatatattcattaaaaacaggaacttttttatgtaccagtgctatgagataattaattggtacatataaggaagcacaactagtgtaaaccaagtatatagaatgaagatacaactttcaatttaagatacactttgagaagaaataataggcgacatatttgctgcttgttgcaccagacaactggctgcatttgctttattaaaggctaaggcctttgtttctaccggtttctgctcatatttcactgaagcctcagattcctcattctttgttctccatccgtgaaattgtatcctttgttccctccagctttcttgtaaggaggtaagggcacttggccagactcaatctgttggatgtcttcgacaaggttctggtaatgtagcttcacttcctccacggttttccctccaactgccctggctagattgtgccagcggtctggggtatctttgtcgtagcatactaaagcattctcgaacaacttgttttgctttggtgtccagctcgaacctgaggccattgcaat

SEQ ID NO: 3132 - DNA, 606 bp, Gossypium hirsutum
  Predicted polypeptide sequence is orthologous to G1911
ccttaaaacgcgtccgctctttttcttttcttctcttttctttggcctcagacccttaatttcgattgttaattatcactgttctgcaatggcgtcaggttcgaactggacgccaaagcaaaacaagttgttcgagaacgctttagctatctacgacaaggatacaccagaccggtggcacaagctagccagggctgtcggggggaagaccgtggaggaagtgaagttgcattaccagaaccttgtggatgacatcaagcagatagagtctgggcacgtgcctttgcccccttataagaaagctggagggaaccaaggatacaacaatttcatggacgatgaagaaccaaggatgaggaatctcaggctttagtgaagtatgaaccagaaatagctgtagaatatcaacctttcaataaaaggaaatgcaaagcagcaaacatataaattatctcttaatttcgtttacatttcctgctcatatatatgttttttgtgtgcttgaatgtaacaagcagccacaacgctcctatacttgcatgtgtcaagtatgaaattatagcattggtaccttgtttttattaatgttaacctatctttgttctt

SEQ ID NO: 3133 - DNA, 888 bp, Gossypium hirsutum
  Predicted polypeptide sequence is orthologous to G1944
gtgataggagcagaagctccatcagcttatcaaatggcacctaggaccgaaaatgttagccagattggtgtcggctcaacaacagaggatgtttcaccagttagtgtagggttaactggtagtatagaaaagaaaaagagaggtaggcctaggaaatatggaccagatgggacaatggcgagggcattgtcaccaatgcctatttcctcatccgtcccgcccagcggaggtgagttctcaagtggtggcggaaagcgtgggagaggacgaggtagcgggtaccagattaaacatcagaagggaatggacttggagaatttaggtgaatgggctgctacttctgtcgggtcaagttttacgcctcatgttatcacggtcgatgccggtgaggatgtgacaatgaaggtgatatcattttctcaacaaggaccaagagctatttgcatcctatctgccaatggagtaatttcaaatgttacacttcgtcaacccaattcttctgggggcactcttacgtacgagggtcgctttgagatactttccttgtctggatccttcatgcctacagaaactcaaggaacgagaagtcgatctggtgggatgagtgtatctttggcaagtgctgatggccgtgttgtaggaggaggagttgctgggcttcttatagctgcctgccctgtacaagttgttgtcggcagctttttacctggcaaccagcatgatcaaaaacccaaaaagcagaagatcgagtccataccagctactgttgcaccaaacccgagtattgccgctgcaccagcttcaaatgctgagaaagaggatggcatagatgttgtttcgccgcaacaaaattcgaatgccctgaaacaagcctcaccggtgctacct

SEQ ID NO: 3134 - DNA, 936 bp, Gossypium hirsutum
  Predicted polypeptide sequence is orthologous to G1944
gtccatgtcactaggcaactctgacactaactcacctcatctgccactgggtagcttggtgttatctcaagtcatgaacatggacttggagagaaacctcgataatgcagcaacaggcgagggagccacaataagtaccacagcaacagcagttccaggaccaagtggaggtggggttgattctttaggaaagaaaaggagagggaggccaagaaaatatgatgcagatgggaaccttaggttaccatataaattagcgacgacttctcctactgacttctcctcttccaagagaggtagaggcaggccccctgcttcttccaactgccaccttctagcttctatagttcagttgtttgctagcacagctggaggggactttacgccacatgtggtcacagttaaccctggggaggatgttgcaggcaaaattctttcattttctcaaaagggacctcgtgggatttgtgttctgtcagcaaatggagctgtttccactgtttgtattcgacaacctggttcatctggtggtattttaacatacgagggtcggtttgagatattgtccttaactgggtcatttacagacagtgaccgtggtggtggaaaaagtaaaactggtgggttaagtgtttcattggccggaccagatggtcgtgtaattggcggtggacttgctggttccttggtggctgctagccctatacaagttgtggtaggaagcttcatgccaaacggttacaaattgcataaaaagaagtatcaagctgagcacacggcgacagccgcaaggccaatctcacaagcggaacctgatggtgatctcaagttctgcatgacacccacatccccatttcgaaaggaaagcaatggggaaccaaatcataccacaatggataaacatacaaatgttggatcctctcatgctgttagttg

SEQ ID NO: 3135 - DNA, 837 bp, Gossypium hirsutum
  Predicted polypeptide sequence is orthologous to G1944
gttagagtggtaggatccgattctccatcggactaccacatagctccaaggtccgaaaactcaacccaaaacccgaacccgactcccggatccgttccaccgccgcagccccatgcggcacaaccaggacctccgccgccggtttcagtttcggggatgccagagaagaagaagaggggaaggcctagaaaatatggaccggacggttcagtcactaaagcgctctctccgaaaccgatatcaacatctgcgccagcgccaccttcggttatcgacttctctgccgtgaagagagggaaagtgaaatctccgatatcgttttcaaaggccaagaacgagccggagaatttaggtgaatgggttccatgttctgtcggagctaattttacgccgcatatcatcactgttaatgctggtgaggatgtcacaatgaagattatatcattttcccaacaagggcctcgagctatatgtattctctctgcaaatgggatcatctcaagtgtcactcttcggcaaccagattcttccgggggtacattgacatatgagggtcgttttgagatactgtccttgtctggttcgttcatgcccagtgaaagcggaggaacaagaagcagatctggcgggatgagtgtttcattagcaagtccggatggacgtgtagtaggtggtggagtcgctggactcctagtagctgctggtcccgtgcaggttgtagtaggcagttttctggccgggaaccagcacgaacagaatctgaagaaacagaagcacgactccgtaacaatatcagctgccacaccaatggctgttattcccatttctagtgccgat

SEQ ID NO: 3136 - DNA, 895 bp, Gossypium hirsutum
  Predicted polypeptide sequence is orthologous to G1944
ggcattgtcaccaatgcctatttcctcatctgtcccacccggtacagctgagtttccaagtggaggaaagccagggagagggcgaggcagtgcttaccagattaagcatcataaaggaatggacatagataatttaggtgagttggccggcacttctattggaacaaattttatgccgcatgtcatcactgtcaatcccggcgaggatgtaacaatgaaggtgatatcgttttctcaacaaggaccacgagccatttgcatcctatccgctaacggagtgatttcaaatgttacacttcgtcagcctgattcttccgggggtacgcttacatatgagggtcgttttgagatactgtccttgtccggttccttcatgcctactgaaactcaaggaactaggagtcgatctggagggatgagcgtctcgttggcgagccctgatggacgtgttgtaggtggaggcgtagcaggccttctcatagctgccagtcctgtacaggttgtcataggaagttttgtaccaggcaaccagcacgaccaaaagtccaagaagcagaaaaatgagtccttaccagcaactcttgcaccaaacccggccacagtcgatttacctgcatcgaatgcagaaaaagaggacggcatcggtgtgcaacattcacaacaaaattccaataccctgaaacaaaactttgctactactgctagtttcagaacagaaaattgggccaacatacaggagccaagaaattcagccactgatataaacatttctttgcctgcagtttaattttataacttaacaaatcattcatgtcttaatgtaggataaagtaatttcctgacattcacctaggttttaatttttcagacatgacatagacaatatatgtttttt

SEQ ID NO: 3137 - DNA, 931 bp, Gossypium hirsutum
  Predicted polypeptide sequence is orthologous to G1944
ccatatctgggtcactaggcaactcggacactgactcaccacctgcaccagtgagtaaccttcaagtgttgcctcaggtgatgaatatcaacaacatgagctcggaaacagcgacgacaatgacttcaacagtgattccacgaccaggtggaagaacactaagtgattctttggggaagaaaaagagagggaggccgagaaaatatgatgcagatgggaaccttagggtaccatatcagatagtgacgacgacgatgaattcacctcctggtttcactttatctccttcatctcctactgagttctcatcacacaagagaggtaaaggaaggtccccagggaactggcagcttcttgcttctctaggtgagttgtttgctcacacggccggcggagacttcacggcacatgtggtcaaagttaataccggggaggatgtagcaggaaaagttgtgtcattatcacaaaagggtcctcgtgggatttgtattctatcagcaaatggagctgtttctaatgttacccttcgacaacctggttcctctggtgggattttatcattcgaggggcgttttgagatattgtctctaaccggttcatttacattcactgacaatgggggtgtaaaaagcagaaccggtggtttgagtgtttcattggctggatcggatggtcgagtaataggtggtgggcttgccggtgtactgttggctgctagccctatacaaattgtggtgggaagcttcatgctaaatggctacaaagtgcataaaaggaagccttgccgtgagcagcacacagtggcagcttctgcagtcaccaccgctccttcggccatggccattacagaagaaggaaggccaatcatctcacaagcaaaactagattgtgaaaacaacgtgaaaccaacatctccattccaagtggggag

SEQ ID NO: 3138 - DNA, 927 bp, Gossypium hirsutum
  Predicted polypeptide sequence is orthologous to G1944
gttttagctccaaaatcaattttcaaaacctgtgttagtgccaaaaactaaatcttttgctgagtttcaagttaaaagttgatatctttcaactttgtctgttttgggttcttttttattgttaaaaattagccttgtttttagctggttgagcttaaaatccaaatgcgtttttgataaaatctcagaaagtttttagttttaactatggagtcaagagaagctgttactaatactaatattagtactaatactatcaccaccaccaccaccactactactactaccactgctggcgtaacggtggtaggatccgatgctccatcggactaccacatagctccaaggtctgaaaactcgacccaaaatcctaacccggctcctggatccgctccgccgcagattcctcaacaaccggcggctcaacaagtccctcagcctgttgtggtgccggggatgcccttgaagaagaagaggggaagacctaggaagtatggaccggatggttcagtcactatggcgctctctccaaagcctatatcaacggctgccccacctccagtaatcgatttttcagccgggaagagagcgaaagtgaagtcgccgatatcgtttccgaagactaagtacgagctggagaatttaggtgaatgggttgcatgctctgttggtggtaattttgcgccacatatcatcactgttaatgctggtgaggatgtcacgatgaagattatatcattttcccaacaagggcctcgagctatatgcattctttctgcaaatggagtgatctcaagtgtcactcttcgtcaacctgattcttccggaggtacattgacatatgagggtcgttttgagatactgtccttgtctggttcgttcatgcctaatgacactggaggacagaagcagatcgggtgggatgag

SEQ ID NO: 3139 - DNA, 597 bp, Gossypium hirsutum
  misc_feature (435)..(435): n is a, c, g, or t
  misc_feature (480)..(480): n is a, c, g, or t
  misc_feature (507)..(507): n is a, c, g, or t
  Predicted polypeptide sequence is orthologous to G2226
cttgaaaaagcttacaattttttttatataatttctgttagaaaaaaacccagttcacttttcagttcttggtaccttggctgaccatttttgtttgaattgcaggttaccagggtttagccattgcttttcatttgaagctctcctccccattgtttttaaggtcatatatttattatatattatcagcacaaaaagaaaaaaatgggtctctcaagtcttccagctccatcagaaggagtgttatgtatactcttggtaaacacagctttatctatatctatagttaaaggcataatccgatcgatccttcacgttgtcggtatccatctcccaccaccatcatcggattacactgaaaatctctcggaatcattcgatttccaccttaatactcctgaaagttacattgaggaattccggagtatgaccccnacaattcatttcggtgctgttgtatgtagctgcaaacggcctcancacgactgtcaggtgtgtctgactcantttgagccaaaatccgagattaaccacttgtcgtgtggccatctctttcacaaggtgtgtttggaaaaatggttggattattggaatatc

SEQ ID NO: 3140 - DNA, 694 bp, Gossypium hirsutum
  Predicted polypeptide sequence is orthologous to G2226
gaaaagcttacatgtattactttcatgttaaacccagttttcttttccttatgcatcactgatcccatgaaaatttgtcctctttttgtgtcatatatatctgcaagagagtgacatcatttatatccttaactagttcatataatcatttgttcgaataaacttagcttaatcttgatataaaagaatgggtctctcaagtctcccagccccatcagaatgagtgctatgtgtactcttggtaaacacagctttatccatatctatggttaaaggcataattcgatcaatccttcacattatcggtatccatctctcctcgtcctcgtcctcctcctcctcctcgtcatcatcatcatcatcatcatcatcgccatcctcggatcttattgaaatccctgcggtatcattcgacatcagcatcggtaatgctgatagttacattaaagagttccggagcaggattgccatcgacccggtacgatgcggtatgtagcggcagtcaaccggagcatgactgtacagtttgcctgactaggttcgagccagaatcagagattaaccgcttgtcctgcggtcatctgtatcacaaggtatgcttggaaaagtggttgaactattggaatgtcaattgccctctttgcatgaacgctctgctgccagaaaacgaacgggcctacttttgggaagcgtg

SEQ ID NO: 3141 - DNA, 864 bp, Gossypium hirsutum
  Predicted polypeptide sequence is orthologous to G2520
ggatccgccagctatgatgagcgatggaaggtacaatctagcagagatctggcagtatcccatgagtgagtctgggataagtaggggtcagttcggacatgggttggctcagttcggggaccccagtcgagaggtttccggcaatgatccgggtagcttggagcagcagcagagaaggggtggtatgaggagaaggcgtgacggagaagttgaaacagctaaggttgtctctactagctccactagtagtggcaatgccgtgaataatggtgaggggaagagaattaaagcagcaggaggcagagaacaaaatcatgaatctagagttgaagcagaacccagttcaggcaagcttgtggaagaaaaagctcaaccttccgagccacctaaacaagattacatccacgtacgagcgcgaaggggtcaagctactgatagccacagcttagctgaaagggctaggagagaaaagattagtgaaagaatgaagattcttcaggatttggttcctggttgcaataaggttattggcaaagcacttgtccttgatgagataattaattacattcaatcactacagcgtcaggtcgagttcctatcaatgaagcttgaagcagttaattcaggaataaaccctgccattgaagtatttcctcgtaaagattatggccaacaagcgtttgatgctactggtatggcattcggttcgcaagtgataagggaatacagtggtggcacatcaccagagtggttgcacattggcagtgctttcgaaaggacaacataatcgggtaaagggaatccccttgcaattaaataagagcattaaattaatttgcagtgcttccagcttgggtcggccaa

SEQ ID NO: 3142 - DNA, 810 bp, Gossypium hirsutum
  Predicted polypeptide sequence is orthologous to G2574
gcggccgcgtcgacgtaggtgcaaagatgcgccgaggatatgtcaatcttaattacaacttatgaagggaatcacaatcacccacttccagtttcagcgactgcaatggcttccaccacctcagcagccgcttccatgatgttatctggctcttcaacatctcaaccagggctcaatggattaaacttcagccaccatgataattccacaacaagacagttctatttatccaactcaacctcatcatcattgtccccaacaattactctagacgttacctcttccccctcccattcccctttatcttcatctaattatttcaacagcttccctacaagctttcccagatttcctcgaagtctcaacttttcttcatcagaatccaacattttgcctgcagtttggggcaatggctatcctggttatggtgcagtgccatattatcaaactcagcctggtaactcaatccttggaaacgagtcccaaaaccagatttaccagtctttaccgggtaataatcagcaagggggagcctctcaacagtctttgacagaaaccttaacgaaggtaatcacatcagacccaagcttcagatcagtaatagctgctgcaatttcatctgtggtttgtaacagtgcaaaatctgaagaccaaactgatcaaaaagctcagcattttggtcagaaattgatgcaggccatagtttctcaaaatgagaaaggtcaatcatcatgttcatcaagctacttcaatggattggcatcttcaagttctcaaacaagaagttcattacttcagtcttctttgcct

SEQ ID NO: 3143 - DNA, 781 bp, Gossypium hirsutum
  misc_feature (207)..(207): n is a, c, g, or t
  Predicted polypeptide sequence is orthologous to G2741
gcacgagcctatctggaatcagatattgcactttgccttttctcttcggtttccttattttccttctaccctcttacttcccaaacagcccccgatttccacgcaaatatttgaaaatctctacagtttttactctttcatttccgatccaaacaatcatctctgaaaagtcatttcttattatttttaaatccctattttcaaggncaaaagcaataaatatgggtcaagaagtgaagatgagggactttgaagctaacggcggagacgatgaagaagcaaccgcaaacgccatcaccaccatcgttgatgacgacgacgacgatgttgaagaaagagttatcgaatgggagatgggattacctaactgcgatgatttaactccattatcccaatccttaatcccgccggaacttgcctccgctttcagcatctcgccggagcctcgtcggaccactgttgatgtcaaccgcgcttctcgcaatactctctcttctctccgctctaccggggcccactcctcaaccaccaataacaataacagtaatagcaatttccgtgatacgatagtggttgaagcggaaggatatgggtcggggtcgggctccggatctgacccgaagaagatgaggaagatggatattgcagaggaagcggattcagcggttaggacgacggagaactcggacgatccgtcggggaggacattgaaacgacagcgtttagtgtggacgccgcagctgcacaagagattcgttgatgtggtggctcatctagggat

SEQ ID NO: 3144 - DNA, 908 bp, Gossypium hirsutum
  Predicted polypeptide sequence is orthologous to G2763
cttcttcttttccctcgattccaccctctgagttcatcaaatcgacgcttctgttatcattcaccgaatcatacggtgtagagagagagagagagagagagagagagagaatattagaggattttgatccggtgagatggcgtccatggtaacgaatccagtgacgaacgcaaattctgatcgcaccaaaaggaaaaagaagaaatcaatgatcatggaagacaatcaccagagtcacgccagatggaaatcggaggcgcagcagcaaatctattcctccaagcttcttcaggctttgagccaggtcagtctcaacactccttcctcttcggctcctcgcggtggccgagccgtccgtgaagctgctgatagagctttggccgttgctgctaaagggaggaccaggtggagccgggccattttgacaagccggcttaaactgaaattcagaaagcagaagaggcagaggggagccgccgtggctgccgtcacggggagtagccgctcgaagaaaccgagatttagcgtttccaaactgaaatcgaaaagcttaccggctgttcaaagaaaagtcaaggttcttggacggttggttcccggttgcaggaagcaaccgttgcctattattcttgaagaagcgactgattacatagctgcgcttgaaatgcaggttcgagccatgaccactctcgccgagctgctatctgggctccggtgccgccagctctggctcagctcttccgccccagtcgccgccgcctagtcagtaacacctttttttaatttgcttagttgccaagtcatcctcatcctcatcttccttttttattttttattttattgcctcctcactctctaagtaatgttaaatacatgttttctttgtttttccttttccttcctcacgt

SEQ ID NO: 3145 - DNA, 958 bp, Gossypium hirsutum
  Predicted polypeptide sequence is orthologous to G2990
ccttcatctcccccccatttaacaacccaagagagaagagcccatttttccccccgtttctctatcccttttcctttttcattaccaagcttcgtaatttcttgcatattatcaaatatttctcataaaacccatctttaaaacccttttaaaattcatttttagcctttttctttaatttttacctttttttttgcttggtgttaactctagatgttaaagccatggatatagctcttgcaagcaccgcaccaaaatcgccagaggctgagcccgagcctgagccagtgagtgaaacaccaactcggatccaacccaccaagcctgtatctttcaccaacggtgttctcaagcgtcacaagcctcaccaccaccaccaccactaccaagcgccacccatcgtcataacctacaaagaatgtctgaagaaccatgcagccagcttaggcggccatgctttagacggttgcggtgaattcatgccgtcgccaacagccaccccaactgacccaacttccctcaaatgtgctgcttgtgggtgccaccgcaacttccaccgccgcgaaccggatgacccaccacccacaacagctaccccaacaatagaataccagcctcaccaccgccaccatccgccaccaccagcaacggcaggtcaaccaaatcgtagtcctaactcagcttccccacctccgatctcatcatcttactacccttcagctccccacatgcttttagctctttcaggaggtcttacaagctcccatttaccagctggtgggctgacaccaaacactgctaatcttggttccaactcaaagaaaagattcagaactaagttcactcagtaccagaaggataagatgctggagtttgccgagaaaattgggtggaaaatccagaaaagagatgagagatattcaagaattctgccgtgaagttggggttgatagagggg

SEQ ID NO: 3146 - DNA, 948 bp, Gossypium hirsutum
  Predicted polypeptide sequence is orthologous to G2990
cctagatgttagagccatggaaatagcccctacaagcacccctccactaagcaccacaacacccaaatcacccgacccagagaccgaaacaccagttcggatccatcctgccaagcccaaatcttttactaacggtgttctcaagcgccaccaacctcaccaccactacctccaccatgcgccgcccatagtagtgagctacaaggaatgcctcaagaaccatgcagccactttgggtggacatgctttagacggctgtggtgaattcatgccttccccatcagccaccccatccgacccaacttccctcaagtgtgcagcttgtggttgccaccgcaacttccaccgccgagaatcagatgacccaccacccacaacaacagccaccgctactatagaatatcagcctcaccaccgtcaccatccaccgcctccagcaagtcaagcaccacatcgtagtccaaactcagcttccccaccaccgatctcatcatcttactacccttcagctcctcacatgcttgtagccctttcaggtggtttagctggtgcattagacaacaaccaccatcaaaataactctcatttacaaggcttaggaacccttaccccaaacaccacaaatctgggttcccactcaaagaaaagattcagaacaaagttcactcagtttcagaaagataagatgttggaattcgctgagaaagttgggtggaagattcagaaaagagatgaacaagctatccaagagttttgcagtgaagttggggttgatagaggggttttaaaagtttggatgcataacaataagaacacttttgggaagaaagatcaagccattaatgaaggagaaactgggaataacaacaatactgagaatggactcagccatgaagaccaccatcaccacacaacaacaatggtcagaatctcaaccatcactttgaa

SEQ ID NO: 3147 - DNA, 760 bp, Gossypium raimondii
  Predicted polypeptide sequence is orthologous to G2
caagatcttcagcttcgttctttaatcctcttctactctatacttacttttttagcttagctgattaactctctcataggcttttccttttttttttttttttttggtctttcagcttttccttggaaaatcactggctttgatggtcattttttaatatttaatttcagcttttatgatagttttttttcttcgtttaaagtagattatgatcatttttttttgagaattttctgctttgaaaatatatagtatcttcgcgatttttagtagctgaaaaagtttgtgaagtgaaaaaaaaatgtgggatcttaacgattctcctgatcgttcaagaggcgaggaatcggaagggtgttcatcgccggtagacggcgaaaaagggaaggggaaacgggttggatccgtttccaattcgagttcttccgccgtggtgatcgaggatggatcagaggaagaagatgcagcagctttaaagaaacgaaacagtaacatgatttttgggttctcggtgcctgtcgagagcggtggaccagctccggtgactcgtcagttttttccacttgaccaagacccagaaatgagggcagttcccaccggaactgcacaagggttccctatggctcactgggtcggagtcaaattccggcaatcggaaccactcgccgttgctaaatccgttgaagctacaaatcccatgaaaaaaagcagaagaggaccaaggtcaagaagctctcaatatagaggtgttactttctat

SEQ ID NO: 3148 - DNA, 630 bp, Gossypium raimondii
  Predicted polypeptide sequence is orthologous to G2
tttaggcttgtttgacaccgagattgcgcttctagggcttatgacagagctgcaattaagtgcaatggcaaagatgctgtcactaactttgatcccagcatatacgacaatgagcttattaattctggtaaaacttcagaaaatgctggagatcacaaccttgacttgagcttggggaattcaaacccaaaccaaaacagtgctaaacctaatgctgataggcaaagtggtacgagttatcagcagcatagtctcccacttgaagcaactgattggcaatgtcggggatttaggtctatgcaggaatctcgtagaattgatgaagctggccatggatatagtgaggaagaaacaatgcagttgttgagccaaactcacattcactctccagctgtctcagttaagtgtaatgaaatgcaaagatatggacagttgaggagacctggaggcaacagtaacatatttcacattgttcctcaacacattaatccatcaccttatcagattcatattccaagaagcagcaatggagggcgaattgggagtgatctttcattatcaactagtgatcaacagtggcaatcaggtcctcaccaccagttgttttggaattctgcagcatcatcagga

SEQ ID NO: 3149 - DNA, 884 bp, Gossypium raimondii
  Predicted polypeptide sequence is orthologous to G8
ctttgttcttatgttgatgtgcagacgaattgtatctgagtaaggaagaattcgtgcacgttcttcgtcggcagagtgctgtgttttcgagggaagctcgaaatatctaggagtaacgttgcacaaatgcggcaggtgggaagcacggatggggcggttcctaggcaaaaggtgagatacttgttcctaggcaaaaggtgagatacttgtttaaggaaatttaaatttttgcagtcaacatgctgtcatttaggagtatggatgtaaaatgatttgagtgcctcttggtgttgaactgagaatcggtttttcttgaacggattctcagtgggattgttgtttggttttttctccttggatgggaaaaagaaaaaaaaaaatttctaagatgcctatttcaaagaggaaaaataattggggatggtgtttcatggtggggattacgatgcttgcgtgcaggtatatttatcttgggctattcgacagtaaagtagaagcagcaaggtcctagtgatcatgaattactctacctgatactgaatttattaccctgaattctcaacctcaatagggttccatccaacacttgtctaccttttgattttttctggaaatcagggcttatgacagggcagctatcaaaagtaatggacgggaggcagtcaccaactttgagctgagtacatatgaaggggagatggtctttgataccaggaacaaaggcaatagtcacaaccttgatctgaacctggggatatctccgcctgttagcgatggtcccaaggaaaaggaaaatgcggggcatctccaaatgaataacggagagagttttaagggtaacttttgaatcgattattttgaatttacttgtatgtttcatcaca

SEQ ID NO: 3150 - DNA, 833 bp, Gossypium raimondii
  Predicted polypeptide sequence is orthologous to G15
ctccacagtttatttagggtggttatgacatggaggagaaagctgcaagagcatatgatctagctgcactcaagtattggggaccctccactcacatcaatttcccattggagaattaccaaaaagaacttgaagaaatgaagaacatgacaagacaagagtatgttgctcacttgagaaggaaaagcagtggattttcaaggggagcttcaatgtacagaggagtgacaagacatcatcaacatggaagatggcaggctcggatacgaagagttgcagggaacaaagacctttatcttggaacatttagcactcaagaggaagcagctgaggcttatgacatagcagctatcaagttccgaggggcgaatgcagtgactaactttgacataacaaggtacgatgtggaaagaatcatggctagcaatacccttcttgctggagaattcgctaggcgaaacaaagatgtcggacctggtggtaatgacaaccttttaactggtaacaccaatgctgaaaccaacattaacatatcaccaaagaacaatggaggtcaaccagactggaaaatgatcctttatcagtcatctgaacagcaacagcccaacatcattgagaattttaaggctcaggctttctcattggcaccagaaaccatggttggccacagagaggtggatgattccagcaagatagggactactcacttctccaatgcttcttcattggtgactagtttgagcagctcaagagaaggtagcccagagagaagcagtttacctatggcgtttgcaatgcctcctccaccatcatcctagttgatcactacttca

SEQ ID NO: 3151 - DNA, 897 bp, Gossypium raimondii
  Predicted polypeptide sequence is orthologous to G481
cttctagggcttttccctactctttaaatctctccaaaatccccactacgagctaacaataccctcttactcctactatacatatatattcaacttcaactgctctttttcactgtaaaagctctatatcacaataccttattgaactttgagaattgaaggcgatggtggactcagacactgagtcgggaggaggtccaaacaacgcatccaacgcagatctttcttccccgaaagagcaagacaggttcttgccaatcgctaacgttagcaggatcatgaaaaaggctttgcccgccaacgccaagatttccaaggaagctaaagagaccgtccaggaatgcgtgtcggagttcatcagtttcatcaccggggaagcctccgataagtgtcaaaaggagaagcggaagaccatcaacggtgacgatctgctgtgggccatgactaccttaggtttcgaagattacgtcgagcctttgaaggtttacttgcagaggtttagggagatggaaggggagaagaccgccgtagcacgtgataaagacgcgcctcttgctggaggcgtcggtgctgctgctgctgctggttctagtgggatgtatgggatgatggtacaccagcagcatcaaggccatgtgtatggttctggtgggtttcatcagatgggccggggcccaaggtagagtttcttcatcactcacacgtgtatggttgttattaatttgataaaagaaaatctggtttggtttcggttcggcatacttggttgggccggggataaggccttgctaatttattattgggacacgtgcacggttgtgatagcttgtatgtttgaggagaaaggtagtgtctgctttcactttttcacacccttgatttgagggtttagtacta

SEQ ID NO: 3152 - DNA, 636 bp, Gossypium raimondii
  Predicted polypeptide sequence is orthologous to G504
ttaggctcaatactcttcaactcctccctttaatgagaactgggaatataacattgaaccaaagctgaccagcaaaataatggagagcacagattcgtcgtcggcgtccgcgcacccgcaactcccaccggggttccgattccgcccgaccgacgaagagctggttgttcactacctcaaaaagaaggccgcctctgctcctctgcctgttacaatcatagctgaagttgatctttacaagtttgatccatgggagctgccaagtaaggcaactttcggggagcaagagtggtatttttttagtcctagagacaggaaatatccgaatggagcgaggcctaatagagctgcaacttctggttattggaaagccactgggaccgataagccgattgtaacttcaaatggaaatcaaaaggttggggttaaaaaggctctagtgttctatagaggtaagcctcccaaagggattaaaacgaattggatcatgcatgaatatcgcctcatcgacaacaattccacttccaaacctcaaattgttgatcttcccaacaggaaagcttctttacggcttgatgattgggtcttatgccggatttacaagaagaacaatacccagagacctatggagacaga

SEQ ID NO: 3153 - DNA, 862 bp, Gossypium raimondii
  Predicted polypeptide sequence is orthologous to G504
gatcaaaccataaaagtcctatgatgctctccttctctggtaaactttcagaattcaaagtaaaatattctccatttcattactgagttatatatacatacatatatatatttgaaggtgtcgcaatggagagcaccgactcgtcgaccggatcacagcagccgaacctcccaccgggattccggttccaccccactgatgaggaactagtggtacactacctcaagaaaaaagctagctccgctcctttgccggttgcaattattgctgaggttgatttgtacaagtttgatccatgggaattgccagcgaaggcaacgtttggtgaacaagaatggtacttttttagtccgagagacaggaagtatccgaatggagcgagaccgaacagggcggctacctcgggttactggaaggcaaccgggacggataagccggtgttgacttcgggagggactcaaaaggttggtgtgaagaaggcactggttttttatggagggaagccccctaaagggatcaaaaccaattggatcatgcatgaatataggcttgctgataataagactaacaacaaaccccctggatgtgacttgggcaacaagaaaaactcactaaggcttgatgattgggtgttatgtcgaatctacaagaaaaacaacgcgaatagacctctggaacatgataaagatgactccatggatgacatgcttggtactgtaccgccttcaatatcaatcggtagccaacataatccaaaattccacttctcaacaaagggaacaagttttggcacattactagaacatcaagaacataatagtttgtttgatggaatgatggggagtgatgggattaacagtgc

SEQ ID NO: 3154 - DNA, 914 bp, Gossypium raimondii
  Predicted polypeptide sequence is orthologous to G1020
tcaattcccccaccattttttcctctctcaccattatctcatcactcttaaaacggagcttcctaaatggccctgagggagaaaacggcggacgtcaagggaaacgggaatgggtgtactaaagaggttcattttagaggagtaaggaagcgtccatggggtcgttacgccgctgagatcagagatccagggaagaaaagccgtgtttggcttggaacttttgatacagctgaggaagcggccaaggcctacgatgccgccgccagagaattccgcggcgccaaggcgaagactaatttccccctccctggtgaaatcctcaacaatggtagtaactgtaacaacaatggcgataccaactgcagcaacaacaataacaatcacagccctagccggagtagcaccgtggagtcatcaagccacgagccgccgacagtcgtcaagtgttcaccgttggatctcaatctcggacacggtgcagtcatcgggtacggatctccagccgtcaggcttcctttccctcaaatttcgtcggtcaccggttttttcgccaacggcgtcccggcagttgcagccccccaagttttttacttcgacgcgttggtccgacccggtgttatgaaaggacagcagtatcaacaacggttgagattcgatcaccgtgattatcacgaaactttcaacgctggtgtacaaagcgactcagattcgtcctccgtcgttgatttaaaccaccacgagatcaaacggcgaccgcttctcaatatcgatctcaaccaacctgctccggaagtcgcgtgattattattttttaaaattgccgatatcaagaaccggaaaaaaaaaacccacaaattttcaattttccctctttaaaatcgttaatcttctttttagtcccaaatttgaaaatt

SEQ ID NO: 3155 - DNA, 869 bp, Gossypium raimondii
  Predicted polypeptide sequence is orthologous to G1146
cttggtattgtttccagtgctgcttgaccaatatgtatttagaatgagcaaacaatatttggccaatgtggcattgaaaattaatgtcaaggttgggggaagaaatactgttcttgttgatgcaatatcacgaaggatacctcttgtcagtgaccgtccgactataatttttggtgctgatgttacccatcctcaccctggggaggattcaagcccttctattgcagctgttgttgcctctcaagattggccagaggttacaaagtatgctggcctggtttgtgctcaagctcatcgacaggagctcatccaagatttattcaagacatggcaggatcctgcaagggggactgtttctggtggcatgattaaggagctcttaatatctttccgacgagccactggacagaagccacagcgcattatattctacagagatggtgtcagcgaaggccagttctatcaagttctgttatatgaacttgatgctattcgtaaggcatgtgcctcattggagccaaattatcagcctcctgttacatttgttgtggtgcaaaaaaggcatcatacaaggttgtttgctaacaatcataatgatcgccgttctgtagacaggagtgggaatattttgcctggcactgtggtggactccaaaatttgtcacccaacggagtttgacttctacttatgcagccatgctgggattcagggtacaagccgtccagctcattaccatgtgctatgggatgagaacagtttacagctgatgcattacagtcccttacaaataacctttgctatacatatgcaaggtgcacacgatcagtgtcaattgttccccctgcgtactacgcacatcttgctgcatt

SEQ ID NO: 3156 - DNA, 832 bp, Gossypium raimondii
  Predicted polypeptide sequence is orthologous to G1146
ggaatacagttcttgttgatccgatatcaccatgaatacctctagtcagtgaccgcccgactataatttttggtgctgatgttacccatccgcaccctggggaggattcaagcccttctattgcagctgttgttgcctcccaagattggcccgagattacgaagtatgctggtttggtttgtgctcaagctcatcgccaggagctcatccaagatttattcaagacatggcaggatccagtaagggggactgtttctggtggcatgattaaggagctcctaatatctttccgaagagcaactggacataagccacagcgcatcatattctacagggatggtgtcagtgaaggccagttttatcaagtgttgttgtatgaactagatgctattcgtaaggcatgtgcttctttggagccaaattatcagcctcctgttacctttgttgtagtacaaaagcgacaccacacaaggttgtttgctaacaaccataatgatcgcaatgctgttgacaagagtgggaatattttgcctggcacagtggtggactccaaaatctgtcatcccacggagtttgacttctacttatgtagccatgctgggattcagggtacaagccgtccagctcattatcatgtgctatgggatgagaacaagtttacagctgatgctttgcagtctcttacaaataacctttgctatacatatgcaaggtgcacgtgatctgtgtctatcgttccccctgcatactatgctcatcttgctgcattccgagctcgtttttacatggaaccagagacttcagacagtgggatcatgataagtggccctgc

SEQ ID NO: 3157 - DNA, 770 bp, Gossypium raimondii
  Predicted polypeptide sequence is orthologous to G1198
ggagaatccaatccggctgatggtagtccaaagactgacatctctacagatgcagacactgatgaaaaaagtcagaggtttgatagaggaaaatctagtattgttgcggtttctgattctagtgacagatcaaagagtaatttggatcaaaagacacttcgtagactagctcaaaatcgtgaagctgcaagaaaaagcagattgagaaagaaagcatatgtgcaacaactagagagtagtcgtttaaagttgacacaattggagcaggagcttcagcgggcacggcagcagggtatcttcatatcaagctctggagatcaaagccattcgatgggtggaaacggtgccatggcatttgatgtagaatatgcacgatggttggaagagcaaaaccgacaaattaatgagctgagaacggcagttgaagagcaatgcagctaaggctgatgttttccatttgttgtcaggcatgtggaaaacacctgccgagaggtgtttcttatggcttggtggtttccgttcatctgagcttctaaagcttcttgtaaatcaattggagcctttgaccgagcaacagttggtggggataggtaacttgcagcaatcctcccaacaggctgaagacgcattatcccaagggatggaggcattgcagcaatctctggctgaaacattgtcgactggatctttaagctcttctggatcatctgggaatgtggcgaactacatgggtcaaatggccatggccatgggggagctcgggactcttg

SEQ ID NO: 3158 - DNA, 846 bp, Gossypium raimondii
  Predicted polypeptide sequence is orthologous to G1198
cgggagaattggggagattccaatatggcagatggcagccctaggactgatacgtcaacagacgacactgaagagaagaatcaaaggtttggaagaggtcaaacaaatgctatcgtggcttccgattctagtgacagatcaaaagataaaacagaccagaagacattgcgtaggctagctcaaaatcgggaggctgcaagaaaaagccggttaaggaagaaggcgtatgtgcaacagctagagagtagccgactgaaactgactcaactcgagcaggaactgcagcgagctcgtcagcagggtatattcatttcaagcacgggagatcaatctcattcgatgagtggaaatggtgccttggcatttgacgttgaatattcacggtggctagaggagcacaataagcatataaatgagttgagggctgcagtcaattcacatgctggtgacgccgaacttcgcactattgtcgacagcgtcacagctcattttgatgacattttccgtttgaaaggtattgctgcaaaagctgatgttttccatatcttatcgggaatgtggaaaacaccagcagagcggtgttttctgtggataggtggcttccgttcatccgagctccttaagcttcttgcaagtcagttggagcctctaactgagcaacagtttatgggtatccaaaacttgcagcaatcatcccagcaggccgaagatgctttgtcacaagggatggaagcattacaacaatctttggccgagacattggccaatggctcacctgctccctcgggaccatctgggaatgtggcaaattatatgggccaaatggctatggccatggggaagcta

SEQ ID NO: 3159 - DNA, 863 bp, Gossypium raimondii
  misc_feature (12)..(12): n is a, c, g, or t
  Predicted polypeptide sequence is orthologous to G1930
ctcttttcttcncaccttttgaaagacaaacatttaaaaaccaaccttgttcaactactgcatcctctgcctatatctttttcctgtttgtacaacccaaaagaaagaaaaaaacaaatggatggaggctgcatagccatagatgaaagcacaaccagtgattccatgtccatatccatatcctctcttttacctcccgttaccaaatatcccgactctctctgccgagttggaagtggaaccagcgtgattgtggaatctaaagctgaatctaaaaagcttccttcttccaagtacaaaggcgttgttcctcaacccaatggccgatggggtgctcagatatacgagaaacaccagcgtgtctggcttggaactttcaatgaagaagatgaggccgccaaagcctatgacatagcggctcaaaggtttcggggtcctgatgccgtcactaactttaaacacctccaagaaactgaggaagatggcatcgaaatggccttcctcaatacacattccaaggctgaaatcgttgacatgttgcgtaagcatacttacaatgatgagcttgagcagagtagaacaaggagatgctatggcttcgacgggaatgggaaacgtgtggtaggaaacgaggctgtgtttggctcttttggtgccgaagtgaaagcgcgtgaccagcttttcgaaaaagctgtgaccccaagcgatgtggggaagttgaaccgactagttatacctaagcagcatgcggagaagtacttcccattgcaaagtggaggtgcttcttccaaaggagttcttttgaacttggaagacgtgactggtaaagtttggaggtttaaatattcctactggaatagtag

SEQ ID NO: 3160 - DNA, 852 bp, Gossypium raimondii
  Predicted polypeptide sequence is orthologous to G2226
gtaaatgtttcatctttctagtccttttgagctttttttactttatggaatataagtggtgtataactctttttctttttttaagaagcctatcttatttcttggccataaactattaacaagatgccatttaaaaaagaaaaaaaaccatctttatcaatgttccactgatatcacatccaccagttgaattgcaggttaccagggtttagccattgtttttcatttgaagctctcctccccattgtttttaaggtcatatatttattatatattatcagcacaaaaagaaaaaaatgggtctctcaagtcttccatctccatcagaaggagtgttatgtatactcttggtaaacacagctttatctatatctatagttaaaggcataatccgatcgatccttcacgttgtcggtgtccatctcccaccaccatcatcggattacactgaaaatctctcggaatcattcgatttccaccttaatactcctgaaagttacatcgaggaattccggagtaggaccccaacaattcatttcggtgctgttttatgtagctgcaaacggcctcagcacgactgtcaggtttgtctgactcagtttgagccaaaatccgagattaaccacttgtcgtgtggccatctctttcacaaggtgtgtttggaaaaatggttggattattggaatattacatgccctctttgcaggactcccttgttgcctgaagaagaagcttcttgcttttggtaagaagattattaccaagtatattattatgcagagttgaggaattcccgtgtacagcgcggtatataaaaatatactgttatctttatcgagtgttgtcgttacc

SEQ ID NO: 3161 - DNA, 819 bp, Gossypium raimondii
  Predicted polypeptide sequence is orthologous to G2520
aagcataaaaaagaatccccttaggaaacctcactgggaagttacttaagttcgcaactccttaggtctctttctaagccatcatagatacacagttcggtaatgagatcaaacacattagagacaacaagcaataaaccccatcatctttcttcgctaataatttaaccaaactttacctttttgctgggtgatggatccaccagctatgatgagcgatggggggtacaatctagcggagatctggcagtatcccgtgaatgaatctgggttaaggaggggtcagtttgggaatgtgccgccgcctcattacgaccaccccaatccagaggtatcgggtggtgtgaggagaaggcgtgatggagaagatgaggcagctaaggttgtctccaccagtagtggcaatggcgtgagttttggtgatggaaagagacttaaagcatcaggatgtagagaggagaatgacgattctaaagttgaagcagcagaacccagttcaggcaagccagtggaacaaaaagctaaaccaccagagccacctaaacaagactacatccatgtgcgagctagaaggggtcaagctactgatagtcacagtttagcagaaagggcgaggagagaaaagattagtgaaagaatgaaaattcttcaggatctggtccctggttgcaataaggtcattggcaaggctcttgttcttgatgagataatcaattacattcagtcactacagcgtcaggttgagttcttgtcaatgaagcttgaagcagttaattcaagaatgaatcctaccattgaagtatttcctcttaaagatta

SEQ ID NO: 3162 - DNA, 644 bp, Malus x domestica
  Predicted polypeptide sequence is orthologous to G2
cttcaatctcaagtcccagctgaaatgcataaatatgggcagttcagtagtaggaggcctactgccgaagacattcaaatgcctcacaatttcccaccacatttcaactcaccaaattatcatcatattcagtttccgagcagcagtgaaggagggggccgcattggcagtgatctttcactgtcaatgagcgaccaccaccaacaatggcaatccgctactccgacctccgatttatttgcaactgctgcagcatcatcaggattcccaccacaaattagaccgtcgtacacacaaaacggctggctgcagaaaaatgggttccactctctcaccagacgctaattaaagctagcttagctctctttggtcatgaccccttttaatcaagatttttctgcctaattaccaccatcatcccccacctccccgattctaatttattacgatcaagtcctcttgattctgtttattttgtaagcaccaaaaatccagttctttcagtgctccaaaacatagacaaattttagtaacaaggacaggaaattctcctattttttggagaaatgaaatcaaatgtatgctctcattggtgtttaccaaaacaaaaaaagaacaatacttgactatttaaagatgagtag

SEQ ID NO: 3163 - DNA, 2234 bp, Malus x domestica
  Predicted polypeptide sequence is orthologous to G2
ggcagtttagtcgccactccaacacaagatcctgcatcacctccactctctctctctctagctccatagctcgtccttatagctctcctctctttctctctctaacttttttcctcttcggggagtttccttgttcaagttgatgcctttttgccacgctgaattctgagtttgatgtaaaaaacgaaaccgacacttaaccagacagctggtaggcaagcgagagacagggaagataaaaaaaaaatgtgggatctcaatgactcgcctgatcagcggccacgtggcgaggaatctgaaggctgctcctcccagaagacctccgccgacggagacgaggaaaagaggaaacgggtcggatccgtgtccaattcaagctcgtcggcggtggtcatcgaggaggacggatcagaccaagaggaagatcaggacgacgggcccaccaagctggccaagaagcaaggaggaggtgggggaaagatattcgggttctccgtggcccacgaggagtccatggatagtgatccgcccgcgaccgtcaccagacagttctttccggtagagctagactattcctcctcctctaatcttgacgtaatggggcccgcagagggcggcggtagcatcccaccacctccttctacatcgtcgtcgtttccccgagcccactgggttggggtcaatttcgggcagtcggattcgggcagccccggaaatccgccgcccgccggggaggcctcccaccagcccatgaagaagagccggcgtgggccccgctccaggaactcccagtaccggggtgttacgttttaccggaggactggccgttgggagtctcatatttgggattgtgggaagcaagtttatcttggtggatttgacacagcgcatgcagctgctcgggcgtacgacagggcggcgatcgagttccggggagtggaggcggacataaattttagcatagaggattatgaagaagacttgaagcagatgaggaatttaacgaaggaggaatttgtgcatgtacttcgccgacaaagcaccgggttcccgagagggagctctaaatatagaggggtcaccttgcacaagtgtggcagatgggaggccaggatgggccaatttttaggcaaaacatacgtttatctgggattgtttgacactgaggttgacgctgcaagggcttatgacaaagcagcaatcaagtgtaatggcaaagaagctgtcacaaactttgatcccagcatctacgataacgaactcaactcctctgaatcatcgggtgttattgctgcggatcacaatctcgatttgagtttgggtagcacaaactcaaagaaaaacaatcaagcattagggaatgatcatcatagccaaaatgttgcaatggaacaccagcattctgtctcgatgcaacttgatgccaattggaggagtcaaggacttcggcctaagcttaacatacaacgagatcgatcaagagacgacattgatgctcagagaagagacgggtactcggagagtgaagccatgcagcttctactccgaacaaaccttcaatctcaagccccagctgaagtacataaatatgggcagttcaacaggaggcttactgctggagacattcaaatgtctcacaatttcccaccaaatttcaactcaccaaattatcatcatattcagtttccgagcagcagcgaaggaggcggccgcattggcagtgatctttcactgtcaacgagcgaccaccaacaacaatggcaatccgcaactccgacctccaatttatttgcaaccgctgcagcatcatcaggattcccaccacaacttagaccgttgcccacgcaaaacagctggctgcagaaaaatgggttccacactctcgccagacgctaattacgctagcttagctctttgatcatgacctcttaatcaagatttttctgcatctccacgtccccgattcttgttaattacgatcagtcctcttgattatgtttattttgtaagcaccaaatcggcaagtctagttctttcagagccccaagtcaaagattttagaacaaggacgggaaattctcctagtttgtgggaaatgaaatcaaatgcatgctctctttggtgttttaccaaaaacaaaatgtatggtcattttgtccaactaacaaatgaatggagtagatcttcaactagattttctgattctgacgacaaaaaaaaaaaaaaaaaaaaaa

SEQ ID NO: 3164 - DNA, 607 bp, Malus x domestica
  Predicted polypeptide sequence is orthologous to G12
atacaaccttggtggccaagtagcatgcaaaaaaccccctcccacctttctctctctgtctctctctctgtctctctctctctgtcttccaaaaagcagagcacccctttcgcactctcagaccgacatcaacaattgaaggagaacaattgaagatggagggcggcggcggagaggctgcgaataggaagagagctggggtggacaacgacaagccgtacaaggggatacggatgagaaagtggggcaagtgggtggccgagattcgtgaacccaacaagcgctctagaatctggcttggttcctactccactcctgtcgccgccgctcgggcgtacgacacggcggttttttacttgcggggtccctccgcgcggctcaattttccagaggctttgccggtcgaaggtggctgcgggtgcggtgacatgtcggcagctttgatacgcaagcgggccaccgaggtcggcgcccgggtagacgcggtcgaaacggctctgcgacaccaccgcggttcggcggcagggaacggagacggcgatgagattaaaccctgcttcgccggatgcgtggatcgggtcgacctgaacaagatgcccgaaccgga

SEQ ID NO: 3165 - DNA, 681 bp, Malus x domestica
  Predicted polypeptide sequence is orthologous to G12
atttcaacttcttttctgattttttttttttttcatttgggttttcttgttttgtatttttaggatatatagcttctgaaaaaactacaacgacatcagaaaatctaagggtttggaatctttggatccatattagtcatattttagataggttaaattctttgccatggaaggagattactgctgctcttcgtcgtcttcttcctcaacgtccatgagcatggagaagcgcaagcatcccgatcaccaccaagaaaagcagtacagaggaataaggatgaggaagtgggggaagtgggtggcggagattcgagaacccaacaagcgctctcgaatttggctcggctcctacacgacccccgttgccgccgcccgagcgtacgacaccgccgttttctatctgcgaggcccttctgcccgcctcaacttcccggaacttgttttccaagacgacggccagcagccccacgacatgtcggcggcttcgataaggaagaaggcgacggaggttggggctaaggtcgacgctgcccaaaccgctctccactcatcgccgacgtctccatccaaaacggcgtcgagccggggtggctctcagaagcccgacttaaatgagtacccagacccaaaaaactccgatgaaagttaataaaaccgaacagagctttagggatgaggccg

SEQ ID NO: 3166 - DNA, 609 bp, Malus x domestica
  Predicted polypeptide sequence is orthologous to G12
ttttttttttttttttttaaaattcaaagactataatttcaagaaaagaaacattactgatcgcccttcagttggtttgttgttacaatttagaaactacatcaaattaccaatcgaaacggaattcttgtgattccatttcctgatcggacccaataacaccttctctgtattttcactttattgcacacctaaatacctactcataacaataaacagctggtgatcggtcggccttctcaattaactttcatcggagttttctgggtcggggtactcatttaagtcgggcttcaaagagccaccccggctcaacgttgttttggactgcgacgtcggcgatgagcggagagcggtttgaacagcgtcaaccttagccccgacctccgtagccttcttccgtatcgaagccgccgacatgtcgtggagctgctggccgtcgtcttggaatacaagttccgggaagttgaggcgggcaaaaaggcctcgaaaaataaaaaaggcggtgtcgtaagctcgggcggcagccctgggggtcgtgttagaacccaacccaattccaaagcccttggtggggtctcaaatctcccccccccccttcccccactt

SEQ ID NO: 3167 - DNA, 547 bp, Malus x domestica
  Predicted polypeptide sequence is orthologous to G15
gttgacacatgtcgcgctatgattgacttgtgatgtcgacacgtgtcgcactgtgattggcttcctggttggagggaaactcttatgggttcttgacggtataacgttgaccggtgctcaatagtttcgggattagtcaagtatggtacaaacaaaactaattagggttcagtttggtgaagcttgaagagggagagagatgattatattctgaagaagatcgaagatgctgaaaagggattggaattagtttgtgcaaacgagattgttgtgctccctaaatacaagtaaattatgtatgtggcctgaatttgagttttacgatttcaattgacttatattatatgatcgaactatttactcagcttctgtattttcaacgtttgtaagtccattatgtttgatgatggtgatatatgcgctatcgtatgtcatttaactgataggccagagatacattgctcaaggtaatatgactacgactttgcaggttgtcattatttgtatgccttcatatgttgtgctgtaggtcatgtataagtttgag

SEQ ID NO: 3168 - DNA, 617 bp, Malus x domestica
  Predicted polypeptide sequence is orthologous to G15
gaaaaagcagtggattctcaagaggggcttcaatgtatagaggagttacaagacatcaccaacatggaagatggcaagctaggattggaagggttgctggaaataaggatctttatcttgggacattcagcactcaagaggaagctgctgaggcttatgacatagctgcaatcaaattccgaggactgaatgctgtgaccaactttgacataacacggtatgatgtggaccgaattatgtcaagcaataccctccttgccggtgaacttgctaagcgaaataaggaggttgtacccattaatgaggctactaatgaaaccaatgtttcgcaaatcggcaatggggaagccgttgtcccactgaagaatattagtgaaggggaagattggaaaatggcactctatcagtcctcccagcaacttgatcagaagcaaccaagcaccgaaactcagaatgtgattcaagcccaggcagaggactctaccaaaatggggaatgctcatttttccaatgcctcttcattggtgacaagcttaggcagctcaagagaagcaagccctgataagtcaagccagcctagtttcttcggaatgcctccatctgcttccaagtttttc

SEQ ID NO: 3169 - DNA, 741 bp, Malus x domestica
  Predicted polypeptide sequence is orthologous to G15
ccctcccaggaccatatcattaaccataattcactccactaagataaaaactacatgagctattgtttgcatgtaatttagtgaaaaaaactttccacggatgagcaaaaaacacatagcctatggctatggctatgcatctgtccaggctgtgaaaatccgcatgtgaggattggtgagtgctggcctggattggactgttgggatccaagaactcactgcatcacttgaacttgtgaaaaacttggaagcagatggaggcattccaaagaaactcggttggcttgacttatcagggctcccttctcttgagctacctaaacttgtcaccaatgaagatgcattggaaaaatgagcagcccccattttgccagagtcctctgcctcggcttgagtcacattgcgagtttcagcactcagttgcttctgatcaagttgctgggaggactggtagagtgccatttcccaatcttcaccttcactaatgttcttcagtgagacaacggcttccccattgccgatttgggcgacattgttttgattagtagcctcattaacgggcacaacctccttgtttcgcttagcaagttcactggcaagaagggtattgctagacataatctgatccacatcataccgtgttatgtcaaagttggtgacagcattcagtcctccaaatttgataccagctatgtcataaccctcaccagcttcctcctggggtgctgaatgtcccaaaaa

SEQ ID NO: 3170 - DNA, 389 bp, Malus x domestica
  Predicted polypeptide sequence is orthologous to G214, G680
agaattctcttcaaattccttctgtggaggatcaacaattggagccggaacacttggaagctgtggatgctcagcatttagcttcacaatcaccaaacaggtcatcatcgcactctgataatggaggtgcagagccaaatacagaattgaagtctgctgatgacgagaaggctgtagcatcaactgctcaagttaatgattcagacaatgcaaagagtagaaaacaggttgaccattcttcgtgtggctccaacacaccttccggcagcgacatagagacggatgcattagagaagcatgagaaaagcacagaagaaccagaagaaccaaaagaaccaaaagaaccaaaagaacttgatctaaatctgttagcatctgattctaattat

SEQ ID NO: 3171 - DNA, 626 bp, Malus x domestica
  Predicted polypeptide sequence is orthologous to G214, G680
acatcaatgatccatggaaagaggtttctgaagagggacggatggcctttcaagcgctattcgcaagagaggtactgccccagagtttttcaccgccttcacactgcctcacagttaatgagcatcagtatgctacagaagcagcaaatcaaaattctgacgagaaagataggaatgcatctgcatcacaatttgacttgaaatcatggatgtcatttccgtatcctccagaagcggagaaaagtgtgtcaccagcacgaggcagcaacactgaagggctactgacactaggacttagccaagggaaactcaaggcccgtcgaacaggattcaagccttacaagaggtgctccgtagaggccaacgagaaccgggtggccaatgccagcagtcactgcgaagagaaaggcccgaagaggttacgcttagaaggggaagctcaaacttgacattccatattgcgtgcaaaatcaacggaaacctttgtttttgcacgcaggttgtattttccgctcctttatatagttcgtttgtgttttaatttcgagtccagcacatcagaaacttgtctttggcgtgtgtaccataatctatatacatttgatcgtttcaccaaaaaaaaaaaa

SEQ ID NO: 3172 - DNA, 619 bp, Malus x domestica
  misc_feature (534)..(534): n is a, c, g, or t
  Predicted polypeptide sequence is orthologous to G280
accttttaaatcctcaccttctttcctcatccgctctgcctgactgaacttcccaccaaacaaacagtctctctctctctagaaaacggtttcgctttctctctctagaaaacggttaacagtccccatctctcagtcagattctagtgaggaagctcccatggcgacggagaactccaacaatccactagtaccgccgccgccagttccctctctcccccagtacccagagatgattatggcggcaatcgaggccctgaacgacagcaacgggtcaagcaagtccgcaatcgcgaagcacatcgagtcaacgtacggagatctgccggaatctcacgtggccctcctcgcgcaccacctcaacaagatgaaggacaccggcgagctcgtcctggtcaagaacaactacatgaagcccgaccccaacgcgccgcccaagaggggccgcggccgtccgcccaaggccaagactccagtcccagctggcactgtctcctccccgcccaggccacgtggcaggccccccaagcccanggaccccttcgcaccgccacctcagcccaagacacattccggaactggaaagccacgtggccgccctcccaaaaaagccaaaacg

SEQ ID NO: 3173 - DNA, 452 bp, Malus x domestica
  Predicted polypeptide sequence is orthologous to G481
ttttttttttgaccgcagaagcatactttgtcattcaactcagattcaaatacatcatactatcagtattaaaacttaacaactttaccaccttcgagttcttaaaaatgatatgtgacaaaattaaaaacttctactcattgcttcgcgtggaatgaacaacgagatgctgtgccgggattgcaaggtatcatggaacccatcatcaagatcaattgcacattgaccacaagccatgttcactcgcaaaagcgtcaatttccatttcccatattattcaagggcacataataatcctcttgagggttgccatagttcaatgctccctgatggacaaactgtgaacttgggccaggcattgctggaacagcattccctttaaaagaaccatctccacccctagctgagccctttgcatcaccctcagtctccctgtacctactcaagtaaat

SEQ ID NO: 3174 - DNA, 660 bp, Malus x domestica
  Predicted polypeptide sequence is orthologous to G481
gtatacagtgaatcgttgtgagtaatggcggaggcaccgacgagtccggcgggcgggagccatgagagcggcggcgagcagagcccccagggaggaggaggaggaggaggcggtagcggcgtcagggagcaggatagatatttgccaatcgccaacatcagtcgcatcatgaagaaggctctgccgaccaacggcaagatcgccaaggacgccaaggacaccgtccaggaatgcgtctccgaattcattagcttcgtcaccagcgaggccagcgataagtgccagaaggagaagcggaagaccatcaacggcgacgatttgttgtgggcgatggccacgttagggtttgaggactatatcgagcccctcaggatttacttggctaggtacagggagacagagggtgatgcaaaggggtctgctaggggtggagatggttcttcgaaagggaatgctgttccagcaatgcctggcccaagtgcacagtttgttcatcagggagcattgaattatggcaaccctcaagaggattattatgtgccattgaacaatatgggtaatggaagttgatgcttttgcgagtgatatgaggaagaagagaggacatggattgtggtcaatgtgcaattgatcttgatgatgtgttcctcgatatcttgc

SEQ ID NO: 3175 - DNA, 590 bp, Malus x domestica
  Predicted polypeptide sequence is orthologous to G504
ctcgagtttttttttttttttttaaaaatttaaatcacatgttcattaaaaaaaatataataacataaaacatatatacgaaaccttaccaaaaccaaactaggaattccagttcatgcttgggagttgaaactgtgggcgcaaaaccccatctcctagcaactcaagaagtgcagcattagcgtgaaacggtgccgtgccctgtggcgtctgattcagcatagaaacaaatgagttgttttcattgatgagatcagcatgaaactttttgctcgatgaagtagtagtagcagcagcagtccctatcgatcccacgtcgttccaaaacggcgaaggaagatgacgtttcaagggtaggctgctttttgagatggaagttgatatagtgccaaactgatcatgatcatgagagtgagagcctggttgatgatcgcttgacgatagtatgccctcaagatagctctcgtgatcatcgctttctagcaacgcggtgtaatctgtagttggcagctttgatgatggtggcggcggcagcggcggcagtttttgagttggcagtattgacgggtggagaaacataccctcttcca

SEQ ID NO: 3176 - DNA, 719 bp, Malus x domestica
  misc_feature (639)..(639): n is a, c, g, or t
  misc_feature (682)..(683): n is a, c, g, or t
  misc_feature (693)..(693): n is a, c, g, or t
  misc_feature (700)..(700): n is a, c, g, or t
  misc_feature (705)..(708): n is a, c, g, or t
  misc_feature (714)..(718): n is a, c, g, or t
  Predicted polypeptide sequence is orthologous to G559
actgctgagaacagtgaactgaaactgcgtttacaaacaatggagcaacaggttcacttgcaagatgcattgaacgatgcactgaaagaagaaattcagcatctgaaagttatgactggccaagctacgccaaatggtggacctatgatgaactacgcttcttttggcggggcaggtcagcagcagttctatccaaacaatcaagccatgcacactcttctaactgcacagcagtttcaacagctccagattcattctcagaagcagcagcaccagtttcagcagcatcagctccatcaactccagcagcaacagatgcagcagcatcatcagcatcagcaacagcaacagcagcagcaacaacaaagtggggagatgaaaataggaggatccgtgccttcgccaagccagaaagataatacatcagaggtcaaccaatctgtaacgaaggattgaaatgttatcgggtctgccaaaaattaaagacggttgaggcattgttcaaaaattgtagttgcacagccgcctccggttagggtacttaccctcccttcccttcctcccccttctgtttttgagtctggttagatacacctagacgacaccctttgttgtagcctgttctgtacatatcgtttnaagtgtaaatcgaatgatggggttaatttttcggtgaataccnnatgggtgtancccttgngattnnnngtttgnnnnng

SEQ ID NO: 3177 - DNA, 692 bp, Malus x domestica
  Predicted polypeptide sequence is orthologous to G663
tgtgattggtgtagatggtctctaatagcagggagaattccagggcgaacaaaagatgaaatcgagaattactggcacagtaatttatgtaagaaacagcatgaggatcatatattatcatgtagaccctccgcctccactgagatcgcagacacagtacaacagtcaaaagttgaagtgcaattagaaaatgaccccagttgcaataataattttgcattggggtcctccatgccttgtaatttaactgacatcatggcagaagagtctgaaacaagtagtgggtcattactgtcagcatcaaagtcgagggaagaagatcgttccagctgctgggaaaatattttgatggaagacttccacacgagggagatgagcctctctgagtttctggatactgactttacaaagctaagcaatgtgtttgggtttgggatgtgtgatgtcatgagcaatgaggtgttacttgaaggagaatctggctatggattctgacgatggatcttagatgcatggctgcttaatttcactgacttaaaggaataatggatgattatgtgctaaataacaaatatgtatttgccaaatggcattgtcgaaatcctgcgtattatataacactgaataaattagttgcctagggttttgcttcagacttgtgctatgcgctttagaaaataaaaaatgcaagg

SEQ ID NO: 3178 - DNA, 335 bp, Malus x domestica
  Predicted polypeptide sequence is orthologous to G913, G1753, G2514
tggagagtccaaaaatgggacagatgcagaaacacgaggttgatgatatgatgatgagtagtacaagtttggcttcttctgtaggatactttatggacgaggaagagcttttccaaatgccgaacttgctggtggacatggcagagggaatgctggtgtctccgccgagaatgaacgactctccaccgtctgattatgatgacttgccgggaaattcagacggaagagaaggtcgtctgtggagctattagtgattatgcagctcacaccctaaattaattcacgctcaaaaataaagataattataacatgaaaaaaaaaaaaaaaaaatcggt

SEQ ID NO: 3179 - DNA, 503 bp, Malus x domestica
  misc_feature (481)..(481): n is a, c, g, or t
  misc_feature (489)..(489): n is a, c, g, or t
  Predicted polypeptide sequence is orthologous to G975, G2583
agttctgatcatgatcatcaagaggaatcactgtcatccttgacgtcatcgtcaatggtggggttgactgagggtggaatgagtgaggcagatcaggatgaagaggataaacttgcaatgcagatgatagaggagttgctgaattggaattatccaataccttcagccacaagtaatgttcacgaaggaaataatatttaaagggaattctatatgccggagttcttaaccgttaagttcttgataaaaaacaataattggaatttaacagttaaaaatttcgaagtatagaatatttcaaagtacagtagaaatatcgatagatattaccaaccatctgagctgcttgaattcctagtgttattagtcctcgaagtaaggaggcagttaagtgctcaatttgcagctacgtacggtagttaattaaatcataaaatgccaccacactgttgttttgtgattggtgattaacttgtagaanaaaaaaanaaaaaaaaaaaaaa

SEQ ID NO: 3180 - DNA, 433 bp, Malus x domestica
  Predicted polypeptide sequence is orthologous to G975, G2583
ggtgaaatcgaaaaagtacagaggcgtcaggcagcgccactggggctcttgggtctcagaaatccgccaccccttactgaagagaagggtgtggctaggcacatttgagacagctgaagaagcagcccgagcatacaatgaagcttccgttttgatgagcggacgaaatgccaagaccaatttcccaataacaactactacaactcatagtaatggtacccgtaccacagtaggatcatcagatcacccaaaaactagtagcggcgacatggattcacgatccgaacagaagggtctgtcggaaatcttgcatgccaagctaaagaaatgcggcaagataccatctccatccatgacctgcttgaagctcgacaatgagagctctcatataagagtatggcaaaaacgtgcaggtcaacgctctgataactcc

SEQ ID NO: 3181 - DNA, 697 bp, Malus x domestica
  Predicted polypeptide sequence is orthologous to G977
cactttcgaaaagaaacgtttcttttgcacagcaatggcgagaccacaacagcgatatcgaggcgtccgacaaaggcactggggctcttgggtctccgaaatccgccaccctttattgaagactagaatttggctgggaacgttcgaaacggcggaggacgcggcgagagcttacgacgaagcggcgaggctaatgtgcgggcctagagcaagaacaaacttcccttataacccgaatgcgtctcagtcctcggcctcgaaacttctctcggcaactttgacagcaaaactgcacagatgctacatggcttcactccagatgaccaaaacttcactgcaagagccaaaaaagccgcaagctttagcgtcatcgggcgcgaaaatgccggatatcaaaccggaaattcatcaaccagtagccgaggaaaattgggttgtgagggaagtaaaagtagagagcagcagccagcagttcaagccacttgaagatgatcacattgagcagatgattgaggagttgctgcattacggttccattgaattatgctctgttttgccaccacaagctacctaaagtgtacttctttactccgcccgccggttcgcctggcagtggtctcgctggattagtacaaggaaccgtgaaaatctagttaatcaattcatgcacgttactgattagaatcatttcaaaaac

SEQ ID NO: 3182 - DNA, 397 bp, Malus x domestica
  Predicted polypeptide sequence is orthologous to G1020
agaatccgacatccaacgagatccggtaccggggtgtccggaagaggccttggggacgctacgccgccgagatcagagatcccgggaagaagacccgcgtctggcttgggaccttcgacaccgccgaggaggcagcgcgtgcgtacgacaaggccgcgcgtgagtttcgcggaggcaaggcgaagactaacttccccaccccctctgagctccagctcgacgccgtcaacatcgtcaacatgaacaacgccgccaaatcagcggcggcgacgaacgtcagcaacagtcccagcagccagagcagcaccgtggagtcctcctcgccgccgcctccgccgccactcgacctcactctcaaaaacccacccgacctttttctaaaaaaaaaaaaaaaaaa

SEQ ID NO: 3183 - DNA, 572 bp, Malus x domestica
  misc_feature (451)..(451): n is a, c, g, or t
  Predicted polypeptide sequence is orthologous to G1075
aaggaaaagagaggaagaagatgaagaacaacaacaaagaggttcagaaaagaaaaataaataaaaattaaacatgagaagtggtactaggtagaaccaacaagaccaaattaagttgcaaaacatgggcgtgatgttaacgatgatagctagtccaggaaatttgctaaccttttatctccaacaaagctcatctcatccagtatgcacttaacctcccacaacgcacgcagaagcagcttcgaatctaaattgattaaggttctaaaagtaaacatcgatgatgatcccacagaaaatcagaatagtggacgaccccctgagttatttccatttccagcccacccatcgattggcaactgaacattctgcatattcaatggcaaattgaagaatggaagccccgaggacgggtcaggaaaagggttgtttccaacactaccaccaccgncgccgccaccacttcccccggatccctgtgggacctgtacttgcaactgttcctcttcatccaaaggcagcctctcataagcaacattagtaaacgatgaggcgatcacaataacgggccc

SEQ ID NO: 3184 - DNA, 662 bp, Malus x domestica
  Predicted polypeptide sequence is orthologous to G1075
ctctctcctcctccttgcacctctctctcctcaactcgtacccttccctttctctgcacttgatcccctttgttttctattcgttctagggtttgaaattatggggctctcctttctccaaaacccataaaatattgaatcttgctatattaaaatttttacatatattttactatatttttcttgttttctgttctctttagctctctgtgtatggctggcttagacttgggttcagcatctcggtttgttcatcagcagctccaactccctgatctccacctccaaagaccgccggactccgaagatgaccacaccacccccaaccgcaacaatcttttctcctctgaccaccaccaaaatgatgttgataatgacaatcctcatcatcaagggtttgacctggtgaccccaaatcctggttcgggtgattccggcggccgacgctccagaggtcggcccccagggtctagaaacaagcccaaacccccagtgatcataactcgtgagagcgcaaacaccctaagagcacatattttggaggtcagcagtggctgtgatgtgtttgattccgtcggcacttatgcgaggaaaaggcagcgagggatttgtgttttgagtgggagtggtatggtgaccaacgtgagcttgcgtcaaccgtc

SEQ ID NO: 3185 - DNA, 632 bp, Malus x domestica
  Predicted polypeptide sequence is orthologous to G1082
atgtggaaatgtatgctcgaatgtcatagtagccagtgcctagcaattagagaagccagaggtttaggtcctatcggatctggaaaaaagcttaatgatggtcatcttgagaccacattgcagcttgaacatgagcttattaactggactttcagattctctacttggattagtgcgcagaagggatatgtgcgagctttgaacaagtggcttttaaaatgtcttctgtatgaaccggaagaaacaccggatggaatagttcccttttcacctggtagaataggtgcacccccaatttttgtaatatgtaaccaatggtcacaggctttggagaatatatctgaaagagaggtggttgaatcgatgcgtattttcaccaccagtgtgcttcagacttgggaacaagataagattgaaatgcgccaaaggatggtggcaaacaaggatctagagaaacaagttaagaacttggatagaaaggaccaaaaaatacagaaagaaattcaggcattagacaagaaagttttgctagcatcaggggatggtgacggactctcgggttgctgggcagattgtatatcagagtgacactagaaatagtactttacagggtagtctgcaacgcatttttg

SEQ ID NO: 3186 - DNA, 679 bp, Malus x domestica
  Predicted polypeptide sequence is orthologous to G1082
cgttgctgtcgaagataagcttgaaatgcgccagaggatggtggcacagaaggatctagagaaacaagttaaaaacttggatagaaaagaccaaaaaatacataaggaaattcaggcattagacaagaaaattatgctagcgtcaggggacggtgacggtctctcggttgctggacagattgtatatcagagtgacactagaaatattactttacaggctagtctgcaacgcatttttgaggcgatggaaaggttcgctgattgctctacaaaagtgtatgaggagcttttgcaacgtaatgaagaagaaaggcttgctagagcggatgagagagcttcgtagggctctgcggttaaatggagttatgaccatcccttttcagccatctaggtgaaggatttggaagctcaagatctttgagaaaattgcattccttggagaaagcttttcctccactcttcgcctgtaatagctcagtaagccatacttgtgggcctgtggctttacatcgacggtgcaagatatttatctgggttgactatacagttttaatttaatgagacagccagcacagttgattcacaacttacacaagctaagacgaagggcaagcccgaggtaagttatcgccgattataaatcagcttggtccactgcccaacagcagaaatgattcta

SEQ ID NO: 3187 - DNA, 468 bp, Malus x domestica
  Predicted polypeptide sequence is orthologous to G1100
ttttttttttttttaaaataaacacatgcaccactcttattcaataacttttttttcgtcaagggctcataaatactgcccgaacttgtataaacgtatgttaaacatttaaaagagggcatatcgtttttcaattataggtcaccaaaatattttgcaataacatttcctttacgtaaatcctcaacaactcctttacgtaaatcctcaacaactccaattaacttgtacgaacgttcatcctttaattaacaggaactccaaagaatgggaaagacggcattctctatatcactgtaaagtggtctatgtatctcgatcaaaattgcctggggccagcattgagcccatggatttgttcagcaacaaaaggatcaatacgaatatcgagagttgaagcataaacctaggctccgaaacacgcctcgtgccgaattcggcacgaggagagaactagtctccagtttt

SEQ ID NO: 3188 - DNA, 579 bp, Malus x domestica
  Predicted polypeptide sequence is orthologous to G1108
taggcaatgtgtggatttttggaagtcactcttctccttctgatgctcctaaactgtacaactgtattggatatgcaatgccattcatactatgtgcaacaatttgctgctgcctaccttgcatcatttctgtcctcggatttcgagaggatctttctcagactagaggagccaccgtggaatcaattaatgctctcccgacgtacaaattcaagttgaaggaaaacgagagcaatgatgatcaggagggcaacctaggtagtgaatgtggcctcttggctgcagggacagaaaaggagcgtgagatatctggagaagatgcggtttgttgtatttgcttggcaaagtatgcagatgacgatgagctacgggagctaccatgtttacatgtctttcacgtggagtgtgttgacaaatggttgaaaataaatgcatcgtgtcccctttgcaaaagtgaggccggagagagcagcggcgaggccagggactccagccaacaatagggtaagcaagatgagctcagcgatgacgttgtatatgaaagcagagattattctaaattatggaacggttaaaccc

SEQ ID NO: 3189 - DNA, 617 bp, Malus x domestica
  Predicted polypeptide sequence is orthologous to G1108
ttcctctccgtgtgagagatcttctcactttctgtgagttagtgcttccacatccaatgaatcgttcagccgccggccttagcagttgccagggtcggtggcaatccctgtccctattctttttcctgttctcctcctctgttgttcttgattttctgatccatttttcttctatcatccaccccctcttgcttcagttaaccgaccttggctctcgactggaaaatttccttttccgatctctcctttcttattctccccataatctttccacctccatgcatttactcaaacaactttttgtctatcccacttcgcccgatcttcatcccacaattcttttgttctgtaaccttttcgttttaccgtgtttcacgactttctaggaaagtgtgtagagcttcagctcggatggtcacaccacctctttccgtttgtgtgtcagtcttggcactgttgcctatgagaggttctttcccaatggcttccttcccttggtggttccagacttgatgtgtgggatgtttgtttgaggacgttgcaattttctgtttctgttcctggggcttggttgggatttatcttcaacaactgcagggggctcagttcgtggtcgg

SEQ ID NO: 3190 - DNA, 403 bp, Malus x domestica
  Predicted polypeptide sequence is orthologous to G1146
aattttttggccacgtatcacaaatgtggtagccacgtcagtatttaacgcattaattgatggaaaaagctaacggatgtattatattgaaataaaatagtacttgaggtatgaaagtgaaatgttttaaagatgttgtatagggttgtaatagacctcaaacttgaggggttactatgtaatttacccaataaaaaatcatacctagacctctctcccctccgcctcattcctccccaccaaatgcctccgtgtctgtaaccacagatggactaattttctacgttaaataaaatttacaaacaaaaattaacaaatttttaattgataaatgaaatttttttagtttgaacaaaggatcttttttatgctgagagtgtgagagtaaactatgctttacaat

SEQ ID NO: 3191 - DNA, 682 bp, Malus x domestica
  Predicted polypeptide sequence is orthologous to G1146
gatttgtttctcgagtgactctgtgagttaattgcttgctactgctcctgctgctgctgctcagtgagtttaaatggctggttggctgttgtggaattagtgtttaaatcttttggaaattgagtgaaaaaaactagaagggaagtaaagcattgtgtttctgtgcaatctggcgaaagcttcatcgttttgaacgaatgcttctgcaaacatgcctataagaaagaaagagagctcggagcaacaccttgtgatcaaaccccacttgcagaacccagtgaacccagttcagaaggcaccgaaaactgcccaaaatggcaaaggtccaccaccccaggaatcccaaaaagccaaaccccataaccaaacttcacccccaacaaaaaacagaggaagaagaaggggcagaggtggtcggaagtctgatcaaggcgatgtttgtatgaggcctagttcgcggcactgcacggtggctcatctgcctgcctcaccaagcttgggtggtgctgcttctgtagcgaatgctccaaatgggtatggcggcaacttagtttccatggatatggggtttccgacttcaagcaagtcattgagctttgctcctcggcctggttatggacaagttgggatcaagtgtgttgtgaaggccaaccatttctttgcagagttaccagagaacgac

SEQ ID NO: 3192 - DNA, 672 bp, Malus x domestica
  Predicted polypeptide sequence is orthologous to G1146
aagttgcatcgaaaaagatcaacaaagatgtcattaagcagctcgtaaaactttacaaggagtcccacctgggcaagagaatcccagcttatgatggcatgaaaagtatttatacagcagggcccttaccatttgcctcgaaagagtttgtggtaaagttggccgagagagagggttcggctgttgctgctcgttcatttttgagggaccaagagttcaaggtcactctcaagttggctagcaaacccgacctgcatcagctgcaacagtttctacgaagccaacaacatgagtcgcctcaaggcgtacttcaagttctggatgttgttcttagggccacaacttctgaaaagtacactgttgttgggaggtctttttttgacgttgagcttgggcagaaaggtgattttgttgagggtctggaatactggagaggcttttaccagagtctaaggatgactcagtttgggcttgcactcaatatagttgctgaatacagtgaaagagcattcgaattatgaattgatacggacgaatcgattcggtggtaattttggtggtttaagattgtacttttcaaaagtcggcaaaatcagaggattaagatcatacctttgaaattttttgttttgaactggggaggagaacgcagagctgctctctgctgttctt

SEQ ID NO: 3193 - DNA, 596 bp, Malus x domestica
  Predicted polypeptide sequence is orthologous to G1146
ttcggagctgatgtgactcaccctgaaaatggagaagattccagtccccaattgctgctgtcgtagcttcccaggactggcccgaagtgaccaagtatgctggattagtttgtgctcaagctcacagacaagaactcatacaagatttgtataaaacatggcaagaccctgttcgtggcacggtcagtggcggcatgatccgggatcttctggtttcctttaggaaagcaacaggacagaagccactaaggattatattttacagggatggcgtaagtgaaggtcaattttatcaagtcttactatacgagctcgatgcaatccggaaggcatgcgcttctctggaaccaaactatcaaccaccagtgactttcattgtagttcaaaaacggcatcacacacgaatatttgctaataaccatagggacaggagcagcgtagacaagagtgggaacatattacctggcaccgtggttgatactaagatttgtcatccaaccgaacatgatttttatctctgcagtcatgctggtattcaggggacaagtcgcccagctcactaccatgttctctgggatgagaataactttactgct

SEQ ID NO: 3194 - DNA, 419 bp, Malus x domestica
  Predicted polypeptide sequence is orthologous to G1146
ggaatcaggaaaaaacaatttcagaaaaccaatgttcgaatcccactcatgttcgtaccaatggaaactgagcgagtgcaccttggacacctgataaacatacgattacaaagttagaaaacattaagttctcttcaaattggcgtcgtacaagtgcaaaagccagagtaaaaattgaaattaatgtctgcttacgtgtagcataggttgttcgttagcatctgcaatgcatctggggttgttctcatcatacaggacactatgatgattgcaccccatattttgtaaaagaaatgtcacctttttatgtatattattgtgctcttcaattatgtaaattgtaaagcctattctaacttgttttatgcaactattttcgtaaaattttgtaattataaaaaaaaaaaaaaaaaatgcgt

SEQ ID NO: 3195 - DNA, 598 bp, Malus x domestica
  Predicted polypeptide sequence is orthologous to G1146
cacgaggcattgagtttgtcaatgagctgctcaaccgagacatttcatctagaccattgtctgatgctgatcgtgtgaagataaagaaggctctgcgaggaataaaggttgaagttacgcaccgtggaaatatgcgcagaaaatatcgcatatctggtttgacatcgcaggcaacaagagaactgaccttcccactcgatcagcaaaatactatgaaatcagttgttgagtactttcatgaaacctatggcttcatcattaagcatacccagctgccttgcctacaagtgggaaatcaacaaaggtcaaattatttgcccatggaggtttgtaaaattgttgagggtcagaggtactcccggaggctgaatgagagacagattactgctttgcttaaagtgacctgtcagcgtccttacgaaagggaacatgacattatgcagacagttcgtcaaaatgcttaccacgaagatccttatgctcaggagtttgggattaaaatcagcgagaatctcactttggttgaagctcgcatccttcctgcgcccaggcttaaatatcatgatacaggcagagaaaaggattgcctgcctcgagg

SEQ ID NO: 3196 - DNA, 660 bp, Malus x domestica
  Predicted polypeptide sequence is orthologous to G1146
tacgagggtttttcattagttcccttgtaatatatccacctcaaaatattctggttcttaactttgaaccaaaatccatttccttcacaagacttgtttcataagcccccataggacacaaaacttacaaccaaaaccatcgcggatgagatgagcgatttaaacgtccgtcttccagacgataaccaaaatataagattaaagtcttgtgcaacttttagttcatacgaccttgacgaaacacaactactagaaaccgccgccagcgacaaaacggacctctacaaaacactagtcgaaaccaatgccaccaaagaccaaacggagctcaagactgattcagcagtagaacataacttctttcacattttcttttatctcaggtagggcacggaaccgcacaccaccagaacccccagctgtagatccggtagtagaacctccatctgagtactcgccttcaatgtagtatcttgcacggaaggcagccaagtgagcatagtaagcagcctcgtgccgaattcggcacgaggtctctctctaaaacttcatctctctctctctctctctctctccccctaaatctgccgatctactctgcgccgaaaccctagaaccgaaaatgcgtgagatccttcacatccagggaggccaatgcgg

SEQ ID NO: 3197 - DNA, 713 bp, Malus x domestica
  Predicted polypeptide sequence is orthologous to G1146
cgaattccgttgctgtcgacgaaacatgttttcagaatgagtaaacaatacttggcaaatgttgctttgaagataaatgtgaaggttggcggaaggaacacagtgcttgttgatgcactgtcaagacgtattcctttagtcagtgaccgtcctactataatttttggtgctgatgttacccatcctcatcctggggaggattcaagcccctcaattgcagctgttgtggcctcacaagactggccagaaatcaccaagtacgctggcttggtctgtgcgcaagctcatcgccaggagcttatccaagatctcttcaaaacttggcaggatcctcagaggggcactgtaactggtggaatgattaaggaactgctaatttcgttccgtagagcaacaggacagaagccacagcgcatcatattttacagggacggtgtcagcgaggggcagttctaccaagttctactatacgagcttgatgcgattcgtaaggcttgtgcttccttggagccaaactatcagccacctgtgacttttgttgtggttcagaaacgtcaccacacaaggctgtttgccaacaatcatagtgaccgtaatgcagttgacaggagtggaaatatcttacctggcacggttgtggactccaaaatctgtcatcccacagagtttgacttttacctctgcagccatgctgggattcagggtacaagccg

SEQ ID NO: 3198 - DNA, 535 bp, Malus x domestica
  Predicted polypeptide sequence is orthologous to G1198
attgccccactggttctgataatgtcgcggactacatgggccaaatggcaattgctatgggaaagctggccacacttgagaatttccttcaccaggctgaccttttgagacagcaaactctgcaacaattgcatcggattctgaccactcgccaagcagctcgtgcccttcttgtcatcagtgactacttctctcgcctccgagcactcagttctttatggcaagcgcgtcctagggactaatgttgttcactatcagctcgaccgccccaccttaggacctacaaaaaagttaggtatttccccccttattagtaaaccagctctagtgctgagaccatgaagatggttaaccatcaaaattgcagattcgggcttttcggacccccttttttttttccttatgatgcttttcgaaacgtcgaggattaggaaaggtcgactggtgattacctagcatgtaattaaggtaaaagaatatgtcctctttagcataaatggatggatgtatactcaaaaaaaaaaaaaaaaaatcg

SEQ ID NO: 3199 - DNA, 489 bp, Malus x domestica
  Predicted polypeptide sequence is orthologous to G1198
gctcaccaatcttgaaggcttcgttcgccaggctgataatttgagacaacaaacccttcatcagttacgtcggatattgacagttcgtcaggcagcgagatgctttcttgtaatcggagagtactatggacgattaagagcacttagttctctttgggcatgtcgaccgcgagagaccatgataaacgatgataactcgtgccaaacgacaacagacctgcaaatggtacaaccttcacagaatcatttctcatccttttgatcaaaccccattagccagcagagagctactttttagaagaagtccttgatccattattgccggtgctggatgcttctagcttgattaagctactttagaagagataggacatactaattttttctttcttattttctattttctactttttatgtcttcatgtaactacgttatcttgtaaatgcaattcaatattttctgtgcaaaaaaaaaaaaaaaaaatgcgt

SEQ ID NO: 3200 - DNA, 703 bp, Malus x domestica
  Predicted polypeptide sequence is orthologous to G1198
cacgaggggattggtggcttccgctcatctgagctccttaagcttctggtgaatcaattggaaccattaacggagcagcaactggtgggtatttacaacctgcagcaatcatcccagcaggctgaagatgctctgtcacaagggatggaggcattgcagcagtccctggctgagaccttggccagtggctcacctgcgccatcagggtcatcggggaatgttgcaaactatatgggtcaaatggccatggccatgggaaagctaggaactcttgaaggtttcctccaccaggctgataatcttcgacaacaaactttacaacaaatgcatcgtatactgactactcgacaatcagctcgtgcgcttctcgcaataaatgattatttttcgcgtcttcgagccctcagttctctttggcttgccaggcctagggagtgacatgcattagattcctctccctgaagttcatccttaaagctagctagtcccggaacataaattagcaccatgaagccgagggccatacgatatatatgatggactttagccgtttggacatcaatatccttcaagggtgtgattaaggtgcgtgaagtcagattaacgttcatagtcaccatcaaagttgtcggttgttgtcacgcatgtttgcgtagatgtattctatgttcagaactgtagtatgaataatctgacgatgtta

SEQ ID NO: 3201 - DNA, 624 bp, Malus x domestica
  Predicted polypeptide sequence is orthologous to G1482
gccgttttccgatgcctatccgggaagcaatctgaactctttctcatcggaaaatatggggatgtgggtcccgcaggcaccgcaagctcctccgcatcagtattcacaggtgggcggtgggttcgtcgggttcaaagagacaaaggagggtacaaacatgaatgccggcaaaagactctggatggacgatggcttcacagttcctcagatcagtcctccgtctcttggctccaagaggttcagacctttatgatacaacaaattagagtgggaagcgatttccgcacacttttttctccttctgcgctttatgttttcgtcgcttgattctcgaaggagcgcagacgaagaaaaatggtgtgcggaaatcacccatttagaattaagcctcacaagatccaatccttcaatccttctgaagtaaattttaacgcagggatttcgtttgtttgtttgtttgtttgtttttttttccttgtggttttacttcggtctcttcttcccacttttgtatgaggggagttttaaaggctttcaacaaactcagttggggtgcttcatcttcctcttctctctctcccccctttgtacttattttcgggaatgcaagcatcaatgtaaaat

SEQ ID NO: 3202 - DNA, 580 bp, Malus x domestica
  misc_feature (506)..(506): n is a, c, g, or t
  Predicted polypeptide sequence is orthologous to G1594
aggcacaagactctccgcggacaaaggaagatcatgagctcaaggataaactgttgcgtaaatacagtggctatattagcacccttaaacatgagttttccaagacgaagaagaaaggaaagctaccaaaagaagcaaggcaaattctctttgattggtggaaccttcactataaatggccttacccaacggaagctgattaattatctggtatggtgcaggaagctgataaaattagtcttgcccaagtgactggactggatcagaaacaaattaataactggtttataaatcaaaggaagcgccattggaagccatcagagaacatgcagtttgctgttatggacaggctttatggaccatgttttaccaaggattgatccggcaatttaccatcctgtttttactctttgtacatgattaataattaactcaatttggttatgttcctcgtttactaatgttcgttttgttattagtatgtgtaaggacaaaatattatgtangatagttgcaagatgtggatagacagctatattatgatgattgactggggacttaaaaaaaaaaaaaaaaatgc

SEQ ID NO: 3203 - DNA, 463 bp, Malus x domestica
  Predicted polypeptide sequence is orthologous to G1655
gaaggggacgactctgtggagcagggcgatcctaacaagtcgaatgaggctgagcaaaacgcttcacaagcggagaagggcgagggtaacaggggacaaccggttgaagaaaacggagtttaggagagagaggaggaagttaccggctgtgcagaaaaaggttcgggttctgagccaattggttcccggctgccggaagacgtcgttgccgaaccttctagaagaaactaccgattatatagcagctttggagatgcaggtcagagccatggcggctctcgccgagttactttctggttcaccggtgaaccgctccggctcgagtggcaactcttcgagttgacgctgagagtcgcccgcctaggcttattgtgccaggtgttttttttttcttttgtaatttttataaatattttaatcttatgaaagttatttcgtgtaaaaacaaaaaaaaaaaatgctg

SEQ ID NO: 3204 - DNA, 672 bp, Malus x domestica
  Predicted polypeptide sequence is orthologous to G1655
acctccacccaaacaaacaactcaaactccgctctctttttatcacttatcaggggtgtgcgtatatatatatcggtgattgttgaattgcactctcaacatatttcaatatcttcttccatggcggcgtcgatgatgtcgaactttgacggaagcctggacgcgttgtcgatggagtcgagccggaaaaagcggagaaaaaccggagtcgttgaagaggatcagaatcggagcttagaaaccggagtccgatggagatccgagacggagcagcggatctactcgacgaagctcgcggcggcacttcgtcaggtgcgacggagatcgtctacgtcgtcggcggcggtggcgaaggtagcgggaggcgggagagacgtgaaggaagcggcggaccgtgttctggcgacggcggcgaaggggacgactcggtggagcagggcgattctaacggctcgtctcaggataagcaaaacgattcacaagcggagaaaggcgagggtgaccggggacaacaggttgaagaaaacggaggttaggagagagaggataatgttaccagttgtgcagaaaaaagttcgggttctgagccggttggttcccggttgccgaaagacgtcgctgccaaaccttctagaaaaaacgaccgattacatagcggctttggagatgcag

SEQ ID NO: 3205 - DNA, 816 bp, Malus x domestica
  Predicted polypeptide sequence is orthologous to G1662
gaaaagcaatttttgagtaattaatcagaacatttggagaaatctttctgcagaaagacatagaattaagaaatggaaagtggttatttttcagcttggaagagtaacactgattctttgcatgggctgttgaatgcggaagaagccgaagagctgaaaatcgcggcaccattgcctgcgatcccccagccacaaactccacaggagcctatggagttcttgtccagatcatggagtctttcagcttccgaaatttcaaaggctctagctcaaaagcaaaaacaattttccgtcgaaaaaagtcccgaaacattcccagaagcaactgttgtgccacagctaacaagcaagatcataaaatctgtcaacaatcggagaacggggtcaatcggaaaatggttccaccatacggatttgagtagtagtgcagtgaagaagaaagacaaggaacgggtagaaagggcgcgagtgcattctgcggtctccattgcaggtgttgctgcagccttggctgctgtaactgcagcagagaactcgaatggttctggctcgaaaaccaccatggctttggctttggctacagagttgctggcatcacattgcatcgaaatggctgagttagccggcgctgatcatgattcgcgtggcatctgctgtcagatcaccagtggacatccggagtccccggtgatcttatgactcttacagcagcagctgctaaagctttgcgaggagaatccgctttgaaaaaagactaacaaaaaagcaagaaaaatggctgcattaatccccatgaaaaggaatgggggaaattcc

SEQ ID NO: 3206 - DNA, 698 bp, Malus x domestica
  misc_feature (617)..(617): n is a, c, g, or t
  Predicted polypeptide sequence is orthologous to G1798
gagagagagacaaagtgtggcctgaggataaagagagtgggcatccacaatcagataaaaatatccttctctgcgtttcccttctctgtgaatactattctagggtttctgatctagtttccatatttggattccttccaatccaataccgctgtgtccttgctgctcatttttaaggcaaagctaggacatggtgagaagtaaggttgagattaaaagaattgagaataacacaagccggcaagtgaccttctcgaaacgtcgaaaggggttgttaaagaaagcttatgagctttcggttctttgcgatgctgaagttgcagtcatcgtcttctcgcaaaaaggcaggatctatgagttctccagttctgacatgcaacggactataaatcgataccataaacatgaaaatggatcagggccaaccaacaaggttgaagtggaacaatatgtgcagcacttgaagcatgaatcagctattatggccaagaagatagagatcctagaagcttcccagcggtttatggcctagtttgatcatcatctcctgtatttttttctcatctgacattttattggattaggttttcctaaactctgaaatttgtatgtcttangaagcttttgggaaatgatctggattcttgccctgttgaagaactccaagagatcagtagccagctggagcgaagcttacg

SEQ ID NO: 3207 - DNA, 496 bp, Malus x domestica
  Predicted polypeptide sequence is orthologous to G1809
caaacttacagattgctaaggaacagggtgtctgctcaacaagcccgggagaggaaaaagatttacgtcaacgatctggaatcaagagccaaagaattggaggatgggaatttaaagttggaagagaagatatctacggttgttaatgaaaacgccatgcttcgaaaggttcttatgaacacaaggccaaaagtagacgaaggtattgaacaaaagcaaggatcagttaagtaagagcagacaagcataaaggagttcttttaggcagttttaggtgaatatatttagaaattttttagagatcaattccgacgaatgtgaatcacagccttcgattctccagctacatatggtatttgtgcatcacttaatttgatatgaacactcaactagctagtatggaagttttaatgaacttctgtcttctcccttttgtaccatgtatttttcatggaaaatattttttttggatgaaaaaaaaaaaaaaaaaatgcgt

SEQ ID NO: 3208 - DNA, 650 bp, Malus x domestica
  Predicted polypeptide sequence is orthologous to G1809
agctcatcagccagccatagtcagtcccaatcagagcaggagatggtgaagccaaaaaccctatgttatccatctcctcctcctcctccagtttggagcaactacagcaagtacagcagccatctggttcttcttcctcgaggcctcctcatccttctcttcttcttcatagtaacaccaagaacagtaacaaactagaagagagcgatgaagatatgttcacggttccggacgtggaggcgttgccccctcctaataatagtattaataatgcggcctctacaatcgccaaagccaccagtaacaacaacaacccagatgcccagtctggctttccggccaagcgccgccgaggccgaaatcccgtcgataaggagtacaggcgactgaagagattgctaaggaacagggtgtctgctcaacaagcccgggagaggaaaaaggtttacgtcaacgatctggaatcaagagccaaagaattggatgataggaattcaaagttggaagaaaagatctctacgcttgtcaatgaaaacgccatgcttcgaaaggttcttatgaacacaaggccaaaagtggacgaaagtattgagcaaaagcaaggatcagttaagtaagagcagataggcagttttaggtgactatattta

SEQ ID NO: 3209 - DNA, 740 bp, Malus x domestica
  misc_feature (709)..(709): n is a, c, g, or t
  misc_feature (718)..(718): n is a, c, g, or t
  Predicted polypeptide sequence is orthologous to G1902
acagacagattttctttctccttcctcctccatctttcactctttgatttcacacacatgagaacatttcccagctgaaaaactcgggctttctgaattctgcgttaaaatttcaaaaatccaatctctttgggttttctgctttgttttttagtatggtttttctcactctctctctctctctctctctctctctccacccaacatgaaagttcgaagattgtaatttttggatgttttcaatgaaagctcatatctgggtctgagaaaatatcccacctttctgtcttcttttcaggtttctgcggatttctctgctgtttttatttagcctcttgacagtctcaaaggtatcaagtatcaaggctctgaaaaccccagttcagatccccactaaccttctggttttcagttcccactatccaatctcaaccaaaccctccaaattccacaaacttcattctcttttggtctctaatcagacttcgcaatctgatatctgatccaaaaactccgaatttgtttctataaacaaaacccagatcatcaaatcttccatttttctagactttggttgacaatacgaacttggggtctcaaaaaatgcaggaccctgcaacttttcagcccatgaaaccccaatttccagagcaagagcagctgaaatgtccgcgctgcgagtcttccaacaccaagttttgctactacnacaactacnacctctcgcagccgcgccactt

SEQ ID NO: 3210 - DNA, 373 bp, Malus x domestica
  Predicted polypeptide sequence is orthologous to G1911
tgggaagtctgctgaggaggtgaagcggcactatgagctcctcattgaggatgtcaagcacattgagtctggcagagttccgtttcctgattatagaggggaataatactaaatctttctctctttggactttgaatggcaaaggctcttgaagtttatgatttctagcgtttccattaagttcatcaagaaacaaagttgtgaaaattagcagatgcatgcagacatgtatatgtaattaaagaaaaccagttggttttatgcagctaaattaaccattgtcgtggctttcgatcagtgtacgaagtagcatctatttggtctatgaaattcaatactactacgattagaaaaaaaaaaaaaaaaaatcgtg

SEQ ID NO: 3211 - DNA, 660 bp, Malus x domestica
  Predicted polypeptide sequence is orthologous to G1911
cacgaggtttctcctctctctctctctctccctctctccctccctccccttaattttccttccacgcttttaactgtagtgtttatagaaaaccatctcactctaagaaattattcaatggcatcaagctcaatgtcctcaagaggctccgactcctcctggactgccaagcaaaacaaagcctttgaaaaggctttggctgtctatgacaaggacactgccgaccgctggtacaatgtcgccaaggcggttggtggcaaaacaccggaggaagtcaagaggcactatgagcttcttgtagaagatgtcaagcatattgagtcaggccaagttcccttcccagattacaggactactggatgagaaacctcaagcttcactggagcagtataactcacagtttatccactagttaataaataaagattggtcactcgatcgcttcatcttcatcgttacatcgctagctaggcgccattttaatgttcaatgacgctgtggtcatggtatagttttgtgttcagtcgtttgagaaatcacaatcagtgattcttttatgtatgtactttgtactagtttccgtttctttcatttgtttcttgctactctaagcttaaagtatgtatgtatgtatgtatgtatgtaccaaaggcatgcatg

SEQ ID NO: 3212 - DNA, 726 bp, Malus x domestica
  Predicted polypeptide sequence is orthologous to G1930
cgttgctgtcgagccctcatccgccgaacccatttcctccgacgacgaagaaaacgacgacgccgaggccgcgtttctgagctcccactctaagtccgaaatcgtcgacatgctgcgaaagcacacttacaatgacgagctggaacagagcaagcgcaacaactccgcttatgggaagcggtctcggtccaacggatcactgggcctgttcggtacggacaacagtggagtcccgaaagcgcgtgagcagcttttcgaaaaagccgtgaccccgagcgatgtcgggaaactgaaccgcctcgtgatcccgaagcagcacgcggaaaagcactttcctttgcaaagcggaagcgctgcaaccttaacggtaagcgcttctaccgcttgcaaaggagtgcttttgaattttgaggatgtcgggggcaaagtgtggaggtttcggtactcttactggaacagcagtcaaagctacgtgttgaccaaagggtggagccggttcgtgaaggagaagaatctgatggccggggacattgtgagctttcagaggtcgaccggaccggacaagcagctgtacattgattggaaggccaggatgagtgtgaataataccaacaataatgggtcaagcccggttccgatggttcggctatttggggtcaacatattcaaaaatacctgggagcagcgggcccgggtcagcggatgcagctgcagctgctgctatcg

SEQ ID NO: 3213 - DNA, 763 bp, Malus x domestica
  Predicted polypeptide sequence is orthologous to G1930
ttttttttttttttttttcaaattaatttgttgcacctaatttcaaaagctttgctttcttcagctcagcttttttctttttgtcatctaatatacatttcacctttcttgcagcttcacagaatgctaaaaaaaacaaagaaaaattttaaaaatgctacaaagctccgatgatcctaggcttcttgctaaactctaatttcaaaaactccatctctctcattcttttgccgatattattattgcaaccgccgccaatagcagcggcagctgcagcatccactgggccagccccgctactcccaggtattttgaatatgttgaccccaaatagccgaaccatctgaaccggtgcaagctgaccttgaaccgggttcgacccattactgttattatacacactcatcctggtcttccaatcaatatacagatgtttgtccggtccggttgacctctgaaagctcacaatgtccccggccttcaaattcttctccttcacgaaccggctccatcctttggtcaacacgtagctttgactgctgttccagtaagagtatcgaaacctccacacttttcccccgacatcctcaaaattcaaaagcactcctttgcaagcggaagatgcacttaccgttatggttgcagtgcttccgctttgcaacggaaagtgcttttcggcgtggcgcttcgggataacaaggcggttcaccttcccaacatccctgggggtcacgggttttttcaaaaactgctcacgcgcttt

SEQ ID NO: 3214 - DNA, 467 bp, Malus x domestica
  Predicted polypeptide sequence is orthologous to G1930
tttaaagcaccttcttatctgtcattctatctctctgtctctctctctcctctccaccttcgaacacacaacatacataatcaacgaaacaagaacaatggatggagtaagtagcacagaagagagcacaaccagtgactccatatccatttcgccaccccatcatattgttacacgtgtggagccacttgccaagtcagcgccccaagtggacagcctctgccgcgtcggcagcggggccagcagcgtgattctcgactccgacctcagcagcggcggcggcggcactggtggcgtggaggccgagtcccggaagctcccttcctccaagtacaaaggcgtggtcccacagcccaacggccgttggggggcccagatttacgagaagcaccagcgcgtctggctgggcaccttcaacgaagaggacgaggccgctacggcctacgacgttgctgcacagcgcttcc

SEQ ID NO: 3215 - DNA, 466 bp, Malus x domestica
  Predicted polypeptide sequence is orthologous to G1944
ttttttttttgatcgagaaagatgagtgaatacgtctcaaacaacttcaaatcacattacatcaatccaaggaaaggcagattcggtcgctaatattacatgatcaaactactctagatgtcacaacaggctgccgaagcagcactaaaagccttcctacgcggctaaattaaagaacacctcaaatggggttgaaccctgcgacgatactagcagtcaagtttacagacaacaacaaacaaggacaagtgagatccaacggttgggaataggggagcttaattgccaatgtggtcagtgagaaacctcatattgcaactagaagcacttactcttcacattacacctcccggcaaagatacattaatgtcagtcttgttttttggatctgatgccaatgacgaccaattatctccacggaaggcagtcgaggatgagaagtttgattttgggtcggcacttgaaa

SEQ ID NO: 3216 - DNA, 551 bp, Malus x domestica
  misc_feature (436)..(436): n is a, c, g, or t
  misc_feature (445)..(445): n is a, c, g, or t
  Predicted polypeptide sequence is orthologous to G1944
gcgtttctttggcaagtccagatgggcgtgttgtaggtggtggagtggctggtctgttagtagctgcaagtcctgtgcaggttgtagttggcagttttctatcgggaaaccagcatgagcagaagcccaagaagcagaaacacgattacatctctaatgcaacaccaactatggctgttcctatttcgagcgctgaaccaaaaccaaacttctcatcctcaacttctttccgtggagataattggtcttcactgccatcagattcaaaaaacaagactgacattaatgtatcgttgccaggaggcgtaatgtgaagagtgtgcttttaattgcaatatgaggtttgtcactgaccacattggcaattaagctccctagtcccaactgttggatctctcacctgtacttgtttgtctgtaaacttgttgactgctangtatcgtcntgggggtttcccccgtttgaggtgttatttaatttagccacgtaggtagtaatctagcgctgcttcggtagcctgttgtgacatctagagtagtttgatcgtgtaa

SEQ ID NO: 3217 - DNA, 688 bp, Malus x domestica
  Predicted polypeptide sequence is orthologous to G2226
taaaacaaaatatatatttatatgctgattgtgtgtgtgtgacagctgcctaaaatccctagaatcccttcttcttcttcttccttcagctcctctggtcggtactctgtttttataaggactgaaaaagcttaaaagctccaaaagtcttcactctgtcggataacaccaagatatcggtgacatttcaacttcgtttgaattaatctgtctcccgtttcgtgtctttgccggttcattctggtttcactgtccctcaacaatcttttactgattttagctttgagtttggatattccggtgtttaccatacatttatattcacaaatccgaacccccataacatcggttttgttcaaatgggtctctcaagtctaccagctccatcagaaggagttctatgtgtgcttttagtaaacacagccctatcagtctccattatcaaggggataatccgatcagtcctgcaagtcgttggtatccgtctcacatcagcctcgtcatcttctttcccatcagaagactctgctgaaaacctctcagaatcatttgagttccatgtcaatccttcggctagttacattgaggacatcaggagccatatcccagcaattcggtttgatgctgtgtgtagcttcaagcagcaggaacacgaatgctctgtctgcctaaccgagtttgaacctga

SEQ ID NO: 3218 - DNA, 722 bp, Malus x domestica
  Predicted polypeptide sequence is orthologous to G2226
gtttcgcgtctctgccggttcaatctggttccactgccccttacaatcttggcaatccgattcgagccagtggaacttagtagttttgatcacatagaggtctctctagtctaccagctccatcagaaggtgttctatgtagtgcttttagtaaacactgccttatcagtctccattatcaaagggataatccgatcagtcctgcaattaggttggtatccgtctctcatcatcttccccgccgttagcagactcctctgaaaacctctcagaatcatttgagtttcatgtcagtccctcggctacttacattgaggagatcaggagcagtatcccagcaattcagttcgaatctgtgtgtagcttcgagcagcgggaacacgaatgctcagtctgcctaaccgagtttgaacctgaatcgaagatcaaccacttgtcctgcggccatattttccatcaaaattgcttcagagaagtggttgaattactggaacatcacatgccctctttgtaggactcctttcatgcccgaggaggacgcaccctgcttctgggtgaagggtttacaaagcaagaaaatcgcgatgaatgtcatgtacagcgtttaatgtacaggtatttgacaagaatgcatcgcctgccattagtgttgttaactatgttatgtgcgagttaaaccgtggtatatgtccatcagtctcagagaccacatttttactatg

SEQ ID NO: 3219 - DNA, 566 bp, Malus x domestica
  Predicted polypeptide sequence is orthologous to G2520
ttgtaacaaggttattggaaaagcacttgtgcttgatgagataattaattacatccaatcgctacagcggcaggttgagttcctgtcgatgaagcttgaagcagttaatacaagaatgaaccctggaattgaggcgtttccttctaaagatttcggtcaacaaacattcgataatgctgcaatggctttcagtacacagcctcccagggaatataaccgcggcaattcacccgagtggttgcatatgcaggttggtggtggtttcaatagaacaacatagcctagaaaactcgtcttcagatttggaataaaggcaaagggaacgcttcctccttcagtagctgtttaaaaaagtataccgcgttattaaatcaacgaagacactctcacatcctacatcaggcatggagctgtgattatttccgtcaacgatgctgctgcttaagttagtaatgtaactaaacatctccatctgtttctgtgttgaaaaaccgaacttttaacttcgtatatcatcacgcctctatagcaggctacatattcttctccgtaaaaaaaaaaaaaaa

SEQ ID NO: 3220 - DNA, 608 bp, Malus x domestica
  Predicted polypeptide sequence is orthologous to G2763
catcgactctgatttcgaatcccatagccacctccgatcgagctcgggattcttctagaaggaaaaagaagaagaaaatccagcccaagcaggaccacctccaccaccaagaacccgcccacagccacgccaagtggaagtccgaggcccagcagcacctctactcctccaagctcctccacgccctcacccaagtctccattaactcggcacccgactcctccaccgccgccgccaactcctccgcttcctcttccaccccacgacgcggccgagccgttcgcgaggccgccgacagagttctcgccgtcgcagctaagggtaagacccgctggagccgtgccattctcaccagccgccttaaaatcaagttccgtcagcataaacggcagagatccgccgcggcgtcggggagcgggtcgacccggcccaagaaacccaagttcagtgtccaccggctgaaagggaagggcttgccggccgtgcagaagaaagtacgggttctggggcggttggttcccggttgccggaaacagccgttgccggtgattctagatgaagcgactgattacatcgcggctctggagatgcagggccgaaccatggaa

SEQ ID NO: 3221 - DNA, 656 bp, Malus x domestica
  Predicted polypeptide sequence is orthologous to G2990
ctctctctctctctctctcgccaaaaaaacggaaccatctttatcactcctccatacctcccctcactttctcaacatcctcagagcttccatggcagctcagagctgtaatctgcacagaaatctaatcctaacgacttaaagcagctcccttttaactttctctgtatttgcttttgatttttgttctcattttttggagacccctagatgtttgagcgatggatataaccccgtccatcaccaccaccaccaacaacaccgccagtacaaaatccccggaagccgacagcgaaactccgactcggatccagcaacccttaaagcctctgtccttcagcaacggcgtcctcaagcgccacaaccccacgcaccacctccaccaccaaaacatccccatcacccctgtcgtagtcacctacaaagaatgcctcaagaaccacgccgctgcgctgggtggccacgccctcgacggctgcggcgagttcatgccgtctcccgctgccaacctcgccgaccccacctcactaaaatgcgctgcatgcggctgccaccgcaattttcaccgccgtgaccccgaggtaccccgtgcagccaaacacccccgccgcaacaacgcatgtcatcgagttaccaaccccaccaccggcaccatt

SEQ ID NO: 3222 - DNA, 669 bp, Malus x domestica
  Predicted polypeptide sequence is orthologous to G2990
accctattgaagttttcacctttgagatttcactccctaatatcaaaaccctaattaattcccaatccgcccgtcaatttcttatgcttcttctcgcctaaagatatggactttaccaccgtgaccgccaccatccaaaccccagatacggacaccgaaccgccgtcgccgacggaccccaaattcaacttcttcagtggcaggtccttatccttcaccagcggcgcattccagcctcagccgaagcgtacaagggtggttgcctacaaagaatgtctcaagaaccatgctgccagcttaggtggccacgctctcgacggttgcggcgagttcatgccttccccttcctccaacccagctgaccccacctcgctaaaatgcgccgcttgtggctgtcaccgcaacttccactgccgtgatcagtacagacccaaaaataatgttattcgcaaccgcctgctaccagcgccgaaaacagctcacaacaaccacagctcaagctccagcccgagctccagccccaaccctactttgagcccgcagtctccgccgccagtctcccacttgcccccctcctatttcgctgccccgccgcaaatgctactcgctctcagctccggcttttctggtccgcccgatgagcacccccaccagcaccagctcaatccg

SEQ ID NO: 3223 - DNA, 648 bp, Malus x domestica
  Predicted polypeptide sequence is orthologous to G2990
ccccatttaagttttcaactttgagctttcacaccctaagaacaaaaccctaatcagtttcttatgcttcttctcgcctaaagttatgaactttaccaccgtcaccgccaccatccaaaccccagatacggacaccgaaccgccctcgccgtcggaccccaaatccaacttcttcagcagcaggtccttatccttcaccaacggcgcgttccagcctcagtcgacgccaacaatggtggttgcctacaaagaatgtctcaagaaccatgctgccagcttaggcggccatgctctcgacggttgcggcgagttcatgccttccccctcctccaacccagctgacccgacctcgctaaaatgcgccgcttgtggctgtcaccgcaacttccaccgccgtgaccagtacagacccaaaagtaatgttattcgcaacccccaccgcctgctaccggcgccgaaaccagctcactacaaccacagctcaagccccagcccgagctcgagccccaacccaactttgagcccgcagtctccaccgccagtctcccacttgcccccctcctatttcgcttccccgccgcaaatgctgctcgctctcagttccggcttctctgggccgtctgatgagcacccccaccagcacaactc

SEQ ID NO: 3224 - DNA, 621 bp, Malus x domestica
  Predicted polypeptide sequence is orthologous to G2990
gattgcaaaagagcgaagaaagactggtggaggatttctgcagcgaggtggggattgggaggggagttttcaaggtttggatgcacaataacaagcacggtcggaggagattggagagattgggcagcggaaacggcagcttaggcgacggtgggaatatgaacaaaaatgtcagtgagatcaacggtgatggtgaaagacttggttttgactccatgaatgctcacatcgccagctacaatgtcaatgccaaccccctgaacgaaggcagcagagcaagtttccacctttccaccaatgggtcgtcgtcttcgtcgtgaaccagagagaaagatggaagcttttgggagatattaaagttaattaatcacgcttattagtataaacatctcttgttaattcgctagctcgttcgttaattaatagctaccgcgtactgaccgatctgctactgttttggcgaggccgagaggaagggattagagaggataacgattaaagagaaagttaatcatatgtttagctgaaagatattattcttaatgcaaagttaattagtcgatgtttttagctttccattagtaatataaagttgctttcttatgcaaaaaaaaaaaaaaa

SEQ ID NO: 3225 - DNA, 388 bp, Malus x domestica
  Predicted polypeptide sequence is orthologous to G3061
ttttttttttttaaaaaatgaagaacgttactaaattacttagtacttgatatcaaaaacaaaaaattggatccaagaaggataccgaataagctctcatctttttaagaaatttacaaacaaacccttaacttcaaagatgaacgtacaagaagagcgtttcgtgtgtaaatttgtaataatttcttaaacatggtcctttaatggcttaacaataacccgaatacatttctagaaccgtaaatccgcctaagatggtggtatcagcagatagatttcgggcaatgaaactttgtcgatgaactaccggctgcgaagaatgcaacagttacagtgaacctaaccttgaatttctgctcattcgttttcagtttcagcttccatggca

SEQ ID NO: 3226 - DNA, 862 bp, Citrus sinensis
  Predicted polypeptide sequence is orthologous to G3
ggggggcaataaaagtggagtcgccttaattatttttgggttgggcatcggtatgtgtccctcagaactcacaacaagaagaaaactttgattaattatctacgaaaacgacatggaaggaggcgggtgctgcagcacttcgacttcaacgaaaagcccagagaagcggaagccaaggcagcagcggcaacaccaacagcagcaggaaaagccgtacaaggggataaggatgaggaagtggaggaagtgggtcgctgaaattagagagcctaacaagagatccagaatctggcttggttcttacaccacgcctatagccgccgcacgtgcctacgacacggccgtcttctatctccggggcccttccgctcgtcttaacttccccgaattgattttccaagaagacgatcttcgagacgtttctgccgcttcaatacgcaagaaagctaccgaagttggcgctaaggtcgacgctttacaagctgctctccatgctgctaattcagaatctgaatccaattccaattccaatttcaattctattcgattgtccgagaagcctgatttaaacaagtttccagagagttctgatgaagattgataacacaaaatacttgcaagctcacaattacctaccctagtctttccacgtttacgtactgttttattcccatcatcagtttcaactttgaaaacgtacggaatcacaaggattctgtttcatatatttatattatatataggtcgatcttcttaattagtatgtaacacgtacgactgttatttatttagttgattaattagttatggtcttaatttttgagttaactaaaaaaaaaaaaaaaaaaaaaaaaaaaaaaaa

SEQ ID NO: 3227 - DNA, 893 bp, Citrus sinensis
  Predicted polypeptide sequence is orthologous to G8
cagagttatattgattgtttagcaaatgagtcagaaaacaagtctttggtgtatatgaatcactatttgaatcatacaacgaatttgaagaccactgctgttattgttgcctatagacactcaacatcgcgggatgaaaataggctatggtggtgcctgcggcagtttcatctgataataaaactgagaggtgttgggggcagtagtattagttgaagtgaaacagagattgacgtctgacggattgagaggttttgatgagagaacggcagcggagggaggggcagccgaaaatgggaatcctgatgatgctgcactagataacagtgacgctggggtaccactgacctggccatgcatttgccatgcccagttaggaaggccttgtggaggacccaattcgattctcttctctgttgctttttcctcagtagtaagaagaccaggatatgcaccattccagaaaattggatgctctgacgtcctcataagtcctttggaagctgaatcccccacagctgcagtagtagagttctcggtccttgaagtccttccaccatgggcaccataagggccagaaagaaactgggaatgcccttcatttgccttgggaccactgccaaacgatgaagatatccccaagttcaaatcaagattatgatcaccaccttcattactgccctcagtaatcatctccccttcatatgtgcttggctcaaagttggtgactgcctccctgccattgcatttgatagctgccttgtcataagcccttgcagcttctacttcgctgtcgaatagcccaagataaatatactttttgccgaggaattgccccatacgtgcttcccaacggccgcatttgtgtagtgtcacccctctatattttgagc

SEQ ID NO: 3228 - DNA, 588 bp, Citrus sinensis
  Predicted polypeptide sequence is orthologous to G12
ggggatggttagagaatattattaattctttcagtttcaaaggaggccagttccggaaaatagaaagggggttgagttgattgagccagccagcatgcagggcggacccgcggtggcggagactacggcggcgaggaagagatcgatggacaggccttataaggggattaggatgaggaagtggggaaagtgggtggctgagataagggagcccaacaagcgctccagaatctggctcggctcttactccacccctgtcgccgccgctcgagcttacgatacggccgtcttttatctccggggcccctccgccaggctcaacttccccgacctcctcagaggagaaggcgctgccgggtcgacgccatcgaatccgccctccacaacaccccggaccaagagattcctccgcctcataatgattccggatttttgaaccgggtcgatttgaataagttacccgacccggaggatttggatggcgccgactggcaaacaaactaaaattaaactagctctgctccgctccgctacactaagatagcgaaagaaacgagacgttttcccgaaagaaaaggaaaaaaaaaa

SEQ ID NO: 3229 - DNA, 588 bp, Citrus sinensis
  Predicted polypeptide sequence is orthologous to G47
ccccggaggcggccgcgatggcccacgacgtcgctttctactgcctgcggaggccgcggtcgcttgacggccttaactttccgtcaatgttgccggcaagcgtcgtccatgcagagctgtcgccgaaatccgtacagaaagcagcttcggacgctggcatgggagttgatgctcagatggttttaaacaaagacaagactgatgaaaatgaaaatgaaaatgaaaatagtggagcgacgcaagtgcttgatgagaagcagttttgggaatatgattacgagtttgaagattgtgggacatcggaagagggagagttgaacatttctgttgaagattatctcaagactcaagtcgatcattaggtcttttttctttttctttttatttttttggatagtaataaatatatagtttgagaataagatttgtaaaagaccaaatgttgtcttaaaaccaaaagtgcagtctgaaaatttttcctaatagttgaattgctggggccacttgttcgagtctttatgtgaatttcttttctcttttcacaaagacgtagaatagcagaaattctataaaaaaaaaaaaaaaaaa

SEQ ID NO: 3230 - DNA, 866 bp, Citrus sinensis
  misc_feature (835)..(835): n is a, c, g, or t
  misc_feature (866)..(866): n is a, c, g, or t
  Predicted polypeptide sequence is orthologous to G214, G680
gggctataggtcaagcaattgacatagacattcctcctccacgtcctaaaaggaaaccacgcaatccttatcctcgaaagacctgcacaaatgcacctatgtcacagataggagcaaaggatgggaaacttcgaagttcagtttcttctttgcgttgcaatcaagtgctggacttggagaaagaaccaatttctgataggcctaatggtgatgagaagccaacttatactatcgaaagtcagaaggacaactgctcggaagtgtttatactgcaccaagaagctcaccgttcctctgtttcttctgtgaataaaaactccatgccaacaccagtggggctcagagactcttgcaatctcagggaatttgttccatcactgaaagaagtggtaaatcaggatgaaacacgtgaatcttatgtcactgttgaacttaaagcaaatgagaagtttggtaaacctgatgccaaactggcacttcaggataatggctcaagtaaacccttgaacttggagaatgcctgcccttcacatgagaagtcagttcatggtgaaaaaagagatgatgtggccgatgcattgccgacagctgaggtgcaagctacgcagaactatccaaggcacgtaaatgtgcacattctagatgggagccttggaacaggtactcaaagcccttcagatatgcctatgcaggagtccatatttcatcctataggagaagttcatggaaatcctaatctgttcacaaatccagctgcgtctgctactactgaaaatgagagtaatgtgccaaaatctactcatcaatcatttccaactttccatccctcctttancccatttcgccatgatcaagatgactatcgn

SEQ ID NO: 3231 - DNA, 839 bp, Citrus sinensis
  Predicted polypeptide sequence is orthologous to G214, G680
tttttttttttttttttgaaaacatactttctgcgcgcagaggccaaatcacggcctgttcaatacttgatgatttttgtccaagtcgtctattgaaaatggaattaagtgcagttgcataagttcaggaaggcaaataagtcaatgtcgacgtataatatagtacaacacccaactacacgaagagtcgtgaaatagacctcataataaacataacgaaataggtgggaaaattagaaatccatgcaaattaacaaaagtttcccttgcttaactgcatgcaataaccaatgtcaagttgttgctccttccacgcgtatcctcttggggcatttctcttcggcttggttgccggtgttgagtattctgttttctttggcctccacagaacaccttttgtaaggtttaaaaccagttcgacgggccttcagtttaccatgcccaagcccgatcgtcagcagcccctcccccccattgttctcgactccggacaccgtgcttttctccacctcttgatggccgaaacaagaaccccatgtcttgctgttgagatcgaaaagtgatttatctccatctttcttattgccgttttgcttatcctctacattgtcctgctgcattttgtccttcagatcatgtggaggtgaaaagctttgaggcaatacctctctagagaagagtgcttgaaaagccagccgccccacttcagaaacttccttccaagaatcggtaatgttactgctgcttctactacgacggttaccaggatcggtggcaggaagactcggatcaatttctttagactcctctttgcctttctcttgcttttctaatgcatc

SEQ ID NO: 3232 - DNA, 899 bp, Citrus sinensis
  misc_feature (876)..(876): n is a, c, g, or t
  Predicted polypeptide sequence is orthologous to G261
tttttacacacaccaaaaaaaaagtaacttaaagagggaatatctatttattgtcaaatccaaccaataatacccaaaaaaaagtaacgtaagatactaaggcattaaaagctaggaaaacaaccaaacaatatcaagtcctctctgcaggggtaagatggcccatctgttctgcaagactatttacattcctcatattccaccaaaacttgccatgatcggcaggtttgttttcattctttttgccatcacattcctttctttctgactgaacttcctgggcgtcagaagaaccaggattctcagtcaaaaattgttcccaaaacacatcattgaccccagcttgcagaggaatggtggttgcagtctctggctcctttgaaggaacaggctctgtagctgcagtcacagcaggctctgagttcatgtcaattccaggagatttagggcgagcatcaacattaagttgtatgcaagatatagctggactatctgcacaacttgtagattcatccaactccaagcttgaattaggttggaagcaactttgaccaacgtcttgaacaatattctcccaaaatgtcatggaggactccaactgctcaaacttctccatgttcgaagaagaaatatcagcactatcagcacctgctacaatttgggaagtccccatcggattgtcttcaatgttggcttcatcatagaagtaatcaattcttggcagccttctcttcctatcatgattctccaagtgcgccccgaaatttgactcaagtccgggtttttgcaaggctcgacctacaaaagacaccatcttctgctgcctctgttccatcagttgaaaacgctccctcaaaagctgcatttgcgactcanatccttgccgctcctgctcatgt

SEQ ID NO: 3233 - DNA, 805 bp, Citrus sinensis
  Predicted polypeptide sequence is orthologous to G280
tttttttttttaaacagccgctgaacataaaatttacattcaaattacagtcacattaacctctcaacattacaactccattaccacaacactcactccctaacattaattttaaaataaaataaaataaaaataaaaccatcaattagtaaaaactaacacacctaaaaaagaacctaatttaattaactaaatcaactccccttctctttctttcttcttcgtcagcttaatttcagtcaaccagctaccggcgcaacagctggcttcactttaggtggccggcccctccctctcggcgctccggtagctggagccgaaccagaagaagccgcggctgaggcgggagccggacccggaccgggcgcagtcttagccttcttaggaggtctgccacgtggcctcccactcccacccgaactcttcttcttagacgcagccggcggcgcgaatggatctctcggcttcggcggacgtccgcgcggtctcggcggcgacaacactgtcccgggcggcaacggatccttcggcttcggcggccggccacgtcctctcttaggcggcgcgttagggtcgggcttcatgtagttgttttttaccatcacgagctctccgctctgcttcattttgtttaagtggtgagcaagtaaggtagtgtgagccggcggcagatccgggtaagccgactccatttgcttcgagatctccgccttagacgaccccgccttctcgttcaatgcttcgatagccgccatgatcatctccggatattgcgggagagtaggaggaagctgttgatgttgag

SEQ ID NO: 3234 - DNA, 784 bp, Citrus sinensis
  Predicted polypeptide sequence is orthologous to G481
tttttttttttttgttcatgcaatcatctattaaataaagaccctaatttacagcactaatcatcggactaccacagttgttttgttgataagggcacgtaaaagacaaagtgaagggaaaaaaatccgaaccaccatcaccctcaacaacaaacataaaaggaaaaaaatctgaaaaaatatagaacttcagatcaagcagataagttaatatcaaagatgctataggtgttgaaactaaacaatttgagcaaccctaaaatcataaaatatgtgacagtgaagctagaaaccacttattcatttccctgcatggatggaacgatcatatgctgcccctgtgcttggggattaacatagttgagtggaccctgaagagcatactgtgcattttggccaggcagagctccgatcgtgtcccttttagcagatccatccccacccctagcagatcctttggtgtcaccctccatctccctgtacctcataaggtatgccttaagaggatcaatataatcttcaaaacccagagttgccattgcccagagcaaatcatccccattaattgtcttcctcttctccttctgacacttatcactcgcctcgctggtaatgaagctgatgaactcagagacacattcctgtacagtatccttagcatccttagcgatcttgccattagcaggcaaagccttcttcatgatcctgctaatgttagctattggcaaatacctgtcctgctctctcactcccccagcgtgcgggctctgctctcccccgctct

SEQ ID NO: 3235 - DNA, 885 bp, Citrus sinensis
  Predicted polypeptide sequence is orthologous to G481
tttttttgcacataactaaaaatccctttcatatatcatacaacaacaacaattacatcaagaggctatgaatggaacatagtcactgtgaatctcactcccctcaattagtacttaactatatatatatatatatatataaattctttacccaaaactcacataaataaacataggaaaaaaaagaattacctaatcatgttcatatatgataatatgatataacaatttaaggtctatctaaattaagctatataagtcccagaagctgatgctccaaaatagacctaccttgacctaatagctccactgctgccaccgccgcctctggcggaggcagcagctgacgcagcgggggacccactctttccagcacccatctgatgatgctgatgaaatccaccagagccataaacgtgtccttgatgtcccatcatcatcatcccaccgtacatccctccattgtaacccccaccagcaccgccaccaccactggccccaccaccagccgctgctccgccaccggctgacccagcgccgcctccgctaccaccgccgtccttctccctacccatggaagtcttctctccctccatctccctatacttttgcaaatagaccttcaagggctccacgtactcttcgaagcctaaagtcgtcatggcccacaacaaatcatcaccgttgatcgtcttccgcttctcgcgctgacacttgtcagaagcttcgccggttatgaaacttataaactccgacacacactcttgcactgtctctttagcgtcctttgatatcttcgcattcgctggcaaagccttcttcattatcctgcttacattggctatcggcaagaaactgtcctgttctctcgccgacagctcgctg

SEQ ID NO: 3236 - DNA, 914 bp, Citrus sinensis
  Predicted polypeptide sequence is orthologous to G559
cttttactgagaaccaacatgtaataaaagaatcgtactagctataaaagccagccacagcccactgaaaggaaacttcaacatagcgacctaagactgtaagataggagcaacctaccaaatttgaattaacaaatcacatgcagagacccacaggtgcaaaaaagtctctaaataagccatatcatgtaatatatatctcccataatccaatctccatctaaaatccaataactgcctagaaataagctatagatgtatctaaaaacactaaaggaacatggcaaaatgagcctatctgacaactgaaactgggattctggtaacaactgctcgattcattcctcaatcctttgatatagacgggttgacatctgaagtattctctttctggttgggagaaggcactgatcctctcattttaatttccccagtttgttgttgctgttcctgctgctgctgttgcagttgttgctgctgcatctgatgcaattggtgctgctggaactgctgctgctgcttctgcgagtgaatttgaagctgctggaactgctgcgcggttagaagagtatgcatagcttgattgtttgggtaaaattgctgaccagctccaaaagacggatagttcatcattggtccaccattaggcattgcttggccagtcaataccttcagatgctgaatctcctccttcagtgcatcatttagtgcatcttgcaagtggacttgttgctccatcgtttgcaaacgcagtttcaattcactattttcagcagtcagaccattagtatctctctgcaataatgtcaattgagcagacaatgaggttgcttcagtttgtaatgtctgtactttacgttcaagctcagctatgtatcgcatcttcctttcctttgacctggcagctgactgcc

SEQ ID NO: 3237 - DNA, 802 bp, Citrus sinensis
  Predicted polypeptide sequence is orthologous to G567
atgcaacatttatattgatcactgtcaatacttacaactgaaagtcaatccgactattatttgtttcccaaaatcccagcctaaaatgactattttcttctctaatgtgcagagaagattaatttgaaaagaaaagagaaaaaaaaaaaaaaaggtgcagtgcagggcatagtttattgataaatttagaccaattggtgtgttgtaaccatttttaggatgaagacaacaaggaagactgatttattctacctctgcttgttattctttgatcctgcatgcggaagtccagtgtcccagccaggcacagccccaggtggactgactctatggcctaccccctgtggcacatgctctaagccaacggcatgctgcaagggagatgtttcagtcatgtttttgccccctctatcactttgaggatttccaacagtaggaagctggatattactagggaaactgctgtccaagctctggtgatttggggtgggagtactaatacttggaattgcttggtgaaagaactggtttgggtttggttgcattggatgagtagcatttctagacgcatcgagtgggacgttgactaatggcatgccaacacctggcacatcggatctggctaaaagcaggggattcaacccagtcactcgcttaactgtttcttcagccattttcacctttgctcttaatgtctcaatatcagctttcaatattctgttattgacagcagattcatcatattttctggttcacgtcggtcagaccttttagtaacgaagaatgttcagctcgtaattga

SEQ ID NO: 3238 - DNA, 842 bp, Citrus sinensis
  Predicted polypeptide sequence is orthologous to G668
tttgatgaaaaagactaaggatatcatatatatgatcatcacataatattgtgaattttacactatgtcctattgatgaaggagtcccatctgaaacttaattaaggccactaaatggaattataatcagtagaactgtagaagagcaattacaaaataattaataaacagatcaaaaagagtctttaatgaaagccctaaaaccagacgcagctctctcatcagaacatatcagtgtcctcatgatcatctaatttaaggtcattaagataatctttccctccttgatcatcaaaaagccacttctcaagcaatgacagctgtggcatttgatcatcatcagcaccagcactaggatctaataacaattgcttgctctcataatcttgaaaagtgctagactcaggggtcacagattgagataaatcggtagaatttgacgaatcaaaagactcaaaaccaaacaacgattcaaaagcctctgataattctatgccagtactgttgcttgcaactttgcttggagtctcttcactagaagcagattctgccccagcaatgtgattaacattgttattaattgaattctgatcagtaacacctgagttcgaagaagcacttttttgagcgtttctggtccaccctttgagcaacttagcaatgttctcagtgcttgaagcgtaagctggtgcttgaactgctggttttgtgtaggaaatgaacccattagcaggcttcaattcagacaaaatactcgctttatctggtgacaaggccgcacatagagcttgcttagccatgtgaatatcagtctgcagccttctctcccactgaccccttga

SEQ ID NO: 3239 - DNA, 394 bp, Citrus sinensis
  Predicted polypeptide sequence is orthologous to G729
tttttttttttttttttagcaagaacttctatttttatttttttccgcattttcccatcatccaaacaaaggaatacaacagaaccacaaaactgaatgaaatagagatagcaacaatttaaaataagaaaaaaaaacgtgcgaagactcaagtacaaaaattctctcaaaatggaagcttgacaccttgaactggaactagaagctgaccttccacgaatgaggcagtggcgattggttgacatgcagcggcgagccaaggacgatagacgacaatggttgcagtgcgtgtgtttgtgtgaagaagaagaagaagaagataacagcagttggccggctacagaatgtgtttgtttgtgagtagaacaatgaaggggaggaggaggaagaatag

SEQ ID NO: 3240 - DNA, 900 bp, Citrus sinensis
  misc_feature (32)..(34): n is a, c, g, or t
  Predicted polypeptide sequence is orthologous to G1020
gcggggcttcaagagctaacaaacaacttgcnnntctgttcaaaatggctccgagagataagctcaacaaaccatcctctaacccgaatccgaattcgaaggatatggagatccgatacagaggagtgaggaagcggccgtgggggcgttacgccgccgagatccgggacccggggaagaaaacccgcgtctggctcggcaccttcgacaccgccgaggaagcagcacgtgcctacgacgcagcagcgcgtgagttccgcggcgccaaagccaagacaaacttcccaacgccaaacgaaatccttggcaccctcgcccgcagccccagccagagcagcaccgtggagtcatcctctcctcctccgccgacgctgctgccacagccacagccgctgccacagctaaacctagctctcaacagctaccgtaatgccggcgcgtgcctcccagtcgccacggcgcgtccggtccttttcttcgacgttttctcctccggtggtactgttgcgactcaccgtgatgcacgctgtgttggtttttatcccggcgggacccagagcgactccgattcgtcatcggtcgtcgttgattacgatcctcgttcgtctgagagaagattgattgatcttgatcttgatcttaatctccctcctccacctgaagtggcttgagtttttggactgaagctaatgctgacgtgtacggcgatggtgatgtgtatatagtgaccctagcaagatcctttggtcgatcttcgtatttttgtttttgcaactggaaaatctaggacggttactccacgttgtttttaactgctgccgttagaaatatatatatatatgtgtttaatgcttagtcaaatgatataagagaagtgagaacccttttttgaaaaaaaaa

SEQ ID NO: 3241 - DNA, 886 bp, Citrus sinensis
  misc_feature (13)..(15): n is a, c, g, or t
  Predicted polypeptide sequence is orthologous to G1020
gggggcgtccccnnntccttttatgttttgtcactcgctcaaaacaacaaacactacccacttgaaataaaaatataatacggaaataatatggcgccgagagagaaggcgtcgggacctgtaaaagttaacggaaacagtaacggtattgttaaagaggtgcattttaggggcgttagaaagaggccgtggggtcgatatgcagccgagattagggatcccggcaagaagagccgtgtttggcttggaaccttcgacaccgctgaagaagccgctcgggcctacgacgctgctgctagagaatttcgcggcgccaaggctaaaacaaacttccccttgccttctgaaaatgtaaccaacaaaattagtcacaacaatatcaacatcaacaataataaccagagccccagccaaagtagtaccatagagtcttcaagccgcgagccggctctgatgatcgattcgtcgccgttagatctcaatcttggtccggcttgcgccggcggtggtgccggtggaggatttaacgccaccgttcggtttcccttccagcctgtggggggtgctttcggtgcggcgaaccaggtgttttattttgatccggtagctgcgatgaagagtcagcagtatcaacggctcaggttcgaccatcaccggaattataattttcatgcggcggcggtgacggcggtcggtgacggaagtgtgcagagcgactctgactcatcatccattgtcgatttgaaccatcacgatgataagccactcagagttcttgatattgatcttaatcttccaccggaagatttcgcctgatacttttgccgatgaatacacgatcatcggagatcgtcggaaatttcctttcatgatcatatttttagcg

SEQ ID NO: 3242 - DNA, 712 bp, Citrus sinensis
  Predicted polypeptide sequence is orthologous to G1100
gaagttctgggttctgttgaatttggagaatcaagtagttttgtgattaaaacaaaagaaaagttaaacaaaaatgatttcttcagggatgaatttggtgatgacagtgataggattcgctgtgagcatcatgttcatagtttttgtgtgtacgaggcttatctgcgctcggattcacttgaactcatcaagaagatcatttcctattgcctctagatctgatcttagccttctggaaagagggttacatggtgttgaacctgtagttgtggctaactttccaatgaagaagttcagtgatgagtattttgcagctgcagaagatactcaatgtgctgtttgccttgcggaataccatggtgaagatacgttgcgcattcttccctactgtggtcactccttccatgcaacctgtatagacatatggttacaccagcattccacatgtccagtttgtcgagtatcattgcgtgaattgcctgagagaaagcgcttgatgcaacctatctttagttcagctatccggtctcattatggcacagaatcttttgatacacattcatataattatttatcggggcatgggttttcatccaggacggttgtcaaccgtgagatggactccgttccagaggatcattgtgcatcggatgatgatataacagattctggggggaacatctccccaaccaccgagggtaaccagacgaca

SEQ ID NO: 3243 - DNA, 778 bp, Citrus sinensis
  Predicted polypeptide sequence is orthologous to G1145
tcgcgtaatacgtggaatccagatgtaacagcaacaggcagcagcttgcctaagcagggaatcttttttgtcgattcaagatcagatcccccagtttgtggagctgaaaatttcgctgaatggggattcaaacaatggggtctcaaagtaatggccaacagtctcatttacaaccttctttggtgaggcaaaactcgtggtatagtctcactctcaatgaagttgaaaaccagttaggaaatttagggaaaccgttgggtagcatgaacctcgatgagcttcttaaaagtgtctggagcactgaagcaaatgattccacagggatagacattgagaattcctccacagcgtcatcttctctccagcgtcaggccagcctgacattggctagggctttgagtggtaaaacggttgagcaggtctggaatgaaatccaacaaggtcaaaagaagaggtatgggcaagagatgaagagccatcagagggaacctacgctaggagaaatgactttggaggacttcttggtacaagcagggctttttgctgaagcatctgttagtcctatggatttggacacggtcggggtggtgacaatgcaaagttttcccgaaaagatgagcttatcaccttcctcttcaattgggacattaacacctcggcggaagagagatgacaatgcattcgagaagagtattgaaaggaggcttaggcggaagataaaaatagggaatctgctgcacgttcacgagcaagaaaacaggcctatcataatgagctg

SEQ ID NO: 3244 - DNA, 754 bp, Citrus sinensis
  Predicted polypeptide sequence is orthologous to G1145
tttttttttttttttttacgatagaaagaaactatatactgaacattttgtaagaactcaactacacagttttttcggcaaatcttaggagacaatggtgacaagtaccatgaaagttctaatgcaactgatatcacagagaagtaatcacaggaacaagaagcagtctattagcagaagcaatagacagctgcttctaaaagatccattcatataggacatgtttaactttcaccctcaaagtaaactaaaggaaacatcgtcatatctacaaaactttcagatacagagactgtgtcagaatggggatgatgatgttctccgaagctgatactttggctgaggtggtggagcactgaacatcttctccagctccttctgcttccttagcctttcattttcctcttccagacgagaaactttgttctctagttcatttgtgtaagcctgcttccttgctcgtgaacgagcagcagattcccggttctttatcattctcttctgcctcctctcaacagtcttctcaatcatatattctgaggcgcctcttttccttccaagtgattgtggatctgatagtgttcccattgagggtgaagttaaggccacctgattctccgggaatgaaacatccattactgcaccagtcaccatgttcattggctgcggtattggctggcctggcatataaactcccatcatactttgttgtgaatgctgatattgtggatgtgggtacggcatccacggacct

SEQ ID NO: 3245 - DNA, 886 bp, Citrus sinensis
  Predicted polypeptide sequence is orthologous to G1146
attatatctaaattacaaggttggtggccttctttatggtgaagttcccacaggccatttgcccgcaaaacattcgaaatatgcaaacatttggacatataaacaattaaacatgctgaattaatattttggatctttgtaagtaatgcaaaaaaaagtgaggttgggggcagacaatatttacgtcatgtattaatagaaatgaaaacaattattcccaaaaaaagtcacttagttcaacgcacgggcttaagttgaacaagccattttttgttgttacttcatgattgtagtaagctgatggtagtagatcatgctccctgattattcctccatgaactaaacctttctgaggatcttgaatagatttatagagatctcagataatttcctcattgtgtgactgggcagagacaactcctctgtacttgattacttctggccaatacatcgaggccaccacctcggtttagcccagcactttcaacttcattaaactattcacttgagcctttgcagttgttcccgtttcatttgaaaagactgccaccattttgtgcatttctttttccaacttttgatataaattgctcatgaagtcatcttcctctgaatactgtatgacaatgaactgttgcgtccgatcgaacggctcatcaacagatcaaacagactttttccaacccttttccataaattacatttgcctaattcctaaagtttcggctctgcccaatgtcggccgtagttggctgccgcagagatgtattcgacttcaatttctctacagcgatttcaaatttacttcagcctcatacgaccgcactcccattggcaattaatttcattatccgattttactatacgtggaacagatttgagcaat

SEQ ID NO: 3246 - DNA, 830 bp, Citrus sinensis
  Predicted polypeptide sequence is orthologous to G1146
ttttaattttaacattaatataaaataatattatttcattaaattataacttagtacaatataccttaatgcaatacaattaacagtgtaatgcaatagtgtaaaagcacaaagagaacgttcatatcaataatcagatgtttgatggaatacgggaatcccaacaaacaccattgtagaagcatgctcctttaattttacaacaaaagttaaccatgatcagccccatggatccaagccttccattcatcttttgattgcaacctgtttagtaaggtccagtccaagcagcacggcacaaaattcaggtcacaattgcacaattaaaatatcactggcatccattacagacaagtatcgcatgcaatacactggaaggcaaaccatctatggagttctcaaaatagatctaaatcttgacatccttggctcatcagggcaaatgtcgaattcttatctcatggaaaggcaaccctaacagtaaaacataacccgcttgacattctccttcagggcaggaaggggtctgacagcagcaccaactccaggtccacgtgtgctccttgcaccgacccctccacccatgcctccacgtccaatagttccactggtcattgaaccactgtctgatgtctctggctccatatagaaacgagctcggaatgctgcaaggtgggcatagtatgctgggggaacaatggaaacagaacgagtgcacctagcatatgtgtagcagaggttgtttgtgagggactgtagtccatcagctgtaaacttgttctcatcccatagaacatggtaatgggcaggacggcttgtaccctgtattc

SEQ ID NO: 3247 - DNA, 950 bp, Citrus sinensis
  Predicted polypeptide sequence is orthologous to G1146
ttttttttttaaccaggacaatatgcagctaacatttttaaaataaggagaatcagaaacatttttaaaataagaaatgaagttttttggcatttaaatttacaaggcattaaccaggacaatatgcagctaacattttaaaataaggagaatcagtttctacccttgatgtccaatttgaaactactcccaaaataacagtactgtccaaaaagggcaccacgctggtactccatataccaaaacacgtcaagccttgatgaaaaccatgacaaagaggattgatgctggagactactttcagcagtaaaacattacatctttcacattatccttgatgacgggaagaggccggatagccaaactcccctccgccgtgctcctagtccctcctgtggatccacccgcagatgtttcgtcttcgatataaaaacgagcccgaaaagctgctaaatgtgcataatatgcaggaggcactattgaaactgatcgagtacaccttgcatacgtgtaacacaagttatttgttaacacttgcaagccatctgcagtaaaacggttctcatcaaacaatacatggtagtgagttgggcgactggttccctgaattcctgcatggctgttgaggtaaaaatcaaattctgtagggtgacaaatttgagtatcgacaacagttcctggtaaaatatttccactcctatccgtcagatcacgtctgttgtgctcagcaggaaaaaggcgagtatgatgccttttctgtaccacaacaaacgtaactggtggcgcatatccctcctcaagtgaggcacaggccagtcggatagcattcatttcatggagcaaaacctgactgaactgcccttcactaacaccatctcggtagaaaataatactctcaggtttacggttggttgatattttgaaggcaattaacagttccctgatcatcc

SEQ ID NO: 3248 - DNA, 546 bp, Citrus sinensis
  Predicted polypeptide sequence is orthologous to G1198
tttttttttttttttttcttagaaaaaaaaacttaataactttatctcatcaaacattcaaattcatttgagaaacattggttacaatgacaacagacactggaataacacttacaacttacaagagtcccagagaagataacgattatgcggcgaataataaacagaaatacatatccatttcagagaataatggacaaattctaccagtacgacctattaacagaaaaaccagtaccaacactaaagtataaaaatctaggacataagaaaatctaaacagataaaggggggaaaaattgtcacaactacagaacaattatctttttcaggatgtaattcagattccttccccccccccctctcaaggtgcataatttcacaaatctacctggcaaaaaacacaatgcatcttcactctcttgggcgggccatccagagggaactaagagcacgtagtcgggagaaataatcatggattgcaaggagtgcacgagcagactggcgcgttgtcaatattcggtgcatttgttgtaatgtttcctc

SEQ ID NO: 3249 - DNA, 678 bp, Citrus sinensis
  Predicted polypeptide sequence is orthologous to G1198
gtggaaaacacctgttgagaggtgtttcatgtggttgggcggatttcgttcatctgaactccttaaggtaatcggtaaccatctggaacctttgacagatcagcagttgatgggcatttgtaacctacagcaatcatctcaacaggctgaagatgccttatcccaaggaatggaagctttacagcaatctcttgtagacacactttcagcttcttctcttggccctactagttctgggaatgttgccgactacatgggccaaatggcacttgcaatgggcaagcttgccacattagaaaattttatccaccaggctgaccttttgaggcagcaaacacttcaacaaatgcatagaattttaactgcccgtcaagccgcccgcgcccttctagtaataaatgactacacttcacgccttcgagcactcagctctctgtggttggctcgtcctagagggtagggactgacaatatcactttcgctggaattcatcagtgcttgtaacagaaaagttctgctatttcacctaaattttggatccattgaaaatgttgggaccataagtggtgaggtgtcatgttagtcactcttggatagcccagatattgttgttacttttgtatttattgctgcgttttaccagatgccagtgttaagaagtaaaaaaaaaaaaaaaaa

SEQ ID NO: 3250 - DNA, 836 bp, Citrus sinensis
  Predicted polypeptide sequence is orthologous to G1198
gactttttaatggtctgccgatatgttctgtgagatctgtgagatccaaggaaagcatttaaagtcttgctgcaacatcaaagttgcttgttcataattatattggatcaaaatctctgctgcatgagcttaatatactgtgcagcagcatttgatgtagaatattctcgctggcttgaagagcacaacaggcatatagttgagctaagggctgcagtcaattcacatgcaggggacactgaactccgtactatcgttgacaacgttacatcacactttgatgaaattttcaggcttaaaggcattgcttcaaaggctgatgtcttccacatcttgtcaggaatgtggaagacaccagcagaaaggtgttttatgtggattggtgggtttcggtcatctgagctccttaagcttcttgtgaatcagttggagcctttaaccgagcagcagttggtaggcatctataatttgcagcagtcatcccaacaggcagaagatgctctgtcacaagggatggatgcattgcagcaatctctggctgagacattggccaatgggtcacccagcccatcgggaacatctgggaatgttgcaaactacatgggtcaaatggccatggcaatgggaaagctaggaactcttgaagggtttcttcggcaggctgataatctacgtcagcaaactctacaacagatgcatcgtatattgaccacccgacaatcagctcgtgcgttgctcgcaataaatgattacttctctaggcttagagccctcagttctctctggctggcccggccacgggagtgagagacagttcctcttcaaaaagttattct

SEQ ID NO: 3251 - DNA, 874 bp, Citrus sinensis
  Predicted polypeptide sequence is orthologous to G1276
tttttttaaattaacacacaaacttcaatagattagccgaaaagcagttttacacaagttctagtcattacaaagtgtttagccaagtactgcaagtactttccgaacttcctgaaagaaaaatgcttgatgttaatgcaactctctctcgctcttcatcaaatttaatttacttgtacatataaaagatttttcacttgaacatatgattacaacaagtagtctcggttttccttcccttgtttcccccttcaatgtacaagaaagattctttattgtgaccattttttaccactcagcttctacagcagaaatgaggcatgttggggttgatgatcgactgggtgtaacggtcgtggaccattgtgttcggataatgaaggtgattggagacgactgaaggtgcagtaatcattgaagggaatcctgatgatgctgcagtagagaagcgtggcactgcagctgacccaacaagaggggcttcaaattgccatgtccaactagggaaggaattaatattccccttctctaatgctctttcatttagtaagtgattagaaaatccaccactccagccaggaggagaggactcaataggcatagcagggttacacggtgcaggctgaacccttgctgtcgcagcaacagaattctccagttgcgtttttcttgctccgaaatcattgggcatgttattccagccgttttggaatagaaatttgctccaattgttttcatcctttcgaccatcgtttgatttcggaggagcaattcctaaatttagatcaacttcgttgtcgccctcagcagggttggtcccatagatcgaattctcatcatatgagttgggatcaaaatttgtgactgcttctct

SEQ ID NO: 3252 - DNA, 780 bp, Citrus sinensis
  Predicted polypeptide sequence is orthologous to G1543
tcatcatcacccccttcaacaagccggaggttctgcgatgaaggatttggacataaaccaagtaccatcagaagatactgaatggaataattggaacacagcaacagcaacaacaacaggatcaggaagcatggacgatgaagaagagagctgcatcaacgttgacggcggccctcctcgcaaaaagcttcgcctctccaaagaacagtctcgtcttctcgaaaagcagaaagaagaactggctacgcagttgaagctgaagccacgtcaagttgaagtctggtttcagaatcgtagggccaggagcaagctgaagcaaacggagatggaatgcgagtacttgaagagatggtttggttcattgactgaacaaaacaggaggctgcaaagggaagtggaggagctcagggctatgaaggtgggcccacccaccgtgatctctccccacagttgtgagccactcccggcatcaaccctatcaatgtgtccacggtgtgagcgcgtgaccaccaccgccgttgacaagggccccaccaaggtcaccaccgcctcctccactcccgcggcattgtctcctaaagtcgggacgccggccctccagtcacggtagccttcggcggcctgatggaaagttaaacgtggcaaaacattaatcaaaagcaaaaggagaaattagttttagaggatgttcataggaaaagaaatatgcaagtgtgcatgcaagataccaatgaagataagatactatcattgatatatatgtgtggtatctgatctgct

SEQ ID NO: 3253 - DNA, 903 bp, Citrus sinensis
  Predicted polypeptide sequence is orthologous to G1635
taaaatagcagcatttacttgaacattaactcgccaagaaaatgaaacttgttttcagatattatacaaaaaggtagaacagaattggtgacaaaaaggaattcacagaccaaagaaggaaaaaaatcaaaaggaacgtaaaaagctataatttcaacagagagaaacggcaatttaaaattgaaacatacaaaccggacacctactaatttgaacagttgcagataaaaaactcggtgactagataacaatttgcacagctgtggaattaatacgcattacttcatttaccatcccctatctagcagcagaagaccgcttcagtcaaaacattatctgtgctacccaaatcagttcctcaagtccttgaacaagagaactatctactaataagatcatcagctctacaaatcatcggctttcctagaaatatgggcggcatctttaccattccctttgatctcttccattgcctactgctgacaattgattgtccctttccactatacgttttttatacggcacaaatcctttcatatgcttatctgttctagttcttatcacagagaaggcagaattctcacttggtttaagctcaaaggctacctccagccacttatcctccttatccaaagattgccgactactctgagagtcaacatcagaacttttgtcaatactgtcttcttcattaactgacttagagttcgaaccagtcaaagatccttccttcttgaattctctaccctgaacctccttaacactagaatgtaaacgtaaattttgcacctgctgattatttggagtgacagcatatggcaaaccatgagagaaattccaccatggaagatgagcaccagaaccagtatccaccatatttgagtcatcatctgtcgattgcat

SEQ ID NO: 3254 - DNA, 885 bp, Citrus sinensis
  Predicted polypeptide sequence is orthologous to G1635
ttgaaatcatctttttctttttcccttttttgacaaagaggaagtgtaatttctgtttgtttgagctacatagaattggtagattttgaggaaaaaaaaagaaaaaagaagaaaggagtatgagctttaatttatgtatggtgattttgattgcggagaagtcgaagacagcgggaactgctgttattgcggagagtgttgattcctgaggcaatatttaatcttgagaagagaaggagatcttgcttagttacaagaatatggctgttcaagacgaatgtggaggtaatcattcaaattcggttttctcggctggcaatggaattgaatcaagttctggcctgcatactgtaactggtcttgaagtaaaggatcagttttcttgtgggaacgattttgctcccaagccaagaaaaccatacacaatcacaaagcaaagagaaagatggacggaagaagagcataagaaattccttgaagctctaaagctgtttggtcgagcgtggcggaagatagaggaacatgtgggcacaaagactgcagtgcagatacgaagccatgctcagaaattcttttctaaggttgttcgcgagtcaaatggctgcagcacaagcccagtggaacccgtcgaaattcctcctcctcgaccaaaacgaaaacctatgcacccttaccctcgcaaattggcccatccacctgttaaagaaagcctaaatccagagctatctagaacatctttgtctccaattttatcagtttcagaacgagagaaccaatctccaacatcagtattgtttgcaataggctctgatgcctttggttcctccgattcaaactctccgaatggcagcttgtcacctgtttcatctgctgtccctgaacagc

SEQ ID NO: 3255 - DNA, 840 bp, Citrus sinensis
  Predicted polypeptide sequence is orthologous to G1655
tttttttttacaataaaatacacgaatataaaaatctcataaaaataaaaacaaagtagaaaataaagaattaaaagagaaaaaaaaaaacaaaaaactaataacacctggcaggacaaagccacggccttctacgatctaacaacgttcaagccaagccgatcatcagccggcgaagagccggctagaatagcggtgagagcagtcatggcccggacctgcatctccaaggcggagatgtaatcagtcgcttcttctagaagattcaacgacgaaaccttccggcaaccgggaatcatccggccgagcacgcgcaatttcttttggacaggcggcaacttgttcttcctcctcatcgcttcctccggcttcctcctcaaccggctacagccggtgactctcactttaacctgccgcttcttgagcctcaaactggggggactcgagagaatcgcgcggctccaccgggtggcgcctttggccgagacggccatcagcctatcagcggtttctcggattgccttgccggttctggccgacgagctccgacggcgcacgtggcggaccgcttggaaaagtttggacgagtagatctgttgctccttatccgttctccaacgcttcgtaacctcccgatacgctgcgtttcgggaatcatcatcatcatcatcatcattgcgttggcgacgacgaatcaactcatcttctcctcctactccgtcgtcgttgttccctattcttcgcttcttccgcttcggctccatatcgagcgacgtgtcgcaatttgattcgtcgaaagagtccataatcaaattctgttatggttttttttttattgat

SEQ ID NO: 3256 - DNA, 902 bp, Citrus sinensis
  Predicted polypeptide sequence is orthologous to G1844
tttttttcatctaacctcctgccagtttgtgcagttttttaaggccattatttataaattgttgtctcatatgttgttgcatttctgctcaagcatggttacacaaatcacaaaataataaaacattctgcaagtttgatgatggcagatgataaaaacgcagtcagtgggaacttctacagaagccgctccctgattatctagccgccttatagtagtacagagcattacaatttattcgctacgtagaattagccactgataacagtcttacatattcaccaagtacaacagatgggcggctgaaaagtacacttggaaaagcgcctctcctcagcttatctaagcaaagggagggttgccatagacgctgctgttgtatcattaccactcttctcccctgctgcaatctttccctctagaagctttttctcttctctcagcagcttttccttctcttggagtgttctaatggatcccatcatcagttgtgtcttcacagctctaatttctgtcagtgtattgttgagtagattctctaactgcagaagatcagctgcagtgaactgctcaaagtttggaccttcaagttgcctttgaactattttcagcagttgcaggctcgaatatccagcctgagggtcctctgccttaggtgctcctgaagctacagcttcctctgtaatgcgactctggtagcgctcaaggatgctggccaaactgtcggcgctacagaactcgtaaagcctaccgcggctggagaagatgacgagcgccaagtcgacgtcgcagaggacggagagctcacgagccttcttgatcaatccgctacgccgctttgagaacgttacttgacatcggcttttgttttcgattcgctgcagttgaagctttttccggcc

SEQ ID NO: 3257 - DNA, 838 bp, Citrus sinensis
  Predicted polypeptide sequence is orthologous to G1930
gaactctctcagcctcttcttacttttacagaaacctcatattatctacaacacaaattgtttggatcctctaaaatattgactccaaacaatctgactacaccgatatttggaacttggctctgcatctcttcaaagcctgacccatttccattttgttgcagcttgcaatcaatgaacaactttgaattagacccaacaatagatctccaaaagctcaccgtatctccagctttcacgcctttctccttaacgaatctgctccacccctttgtcaacacataactctggctgctactccaataacagtacctcaacctccaaactttctgagtactatcctcaaaattcagcaacacccccttggaagcaatttctgagcttaatgcaaagtgcttctcagcttgttgctttggtatcaccattctgtttaacttccccacatcacttggtgtaagcactttctcaaaaaggaattcaacaggtgtttcctgaaaacaatttgacccaaacaggtcactaaaacctgagctattattataacaactaatgccgacacatgcataattttgtttgctttgctcaagctcatgcttataagtatgcttccttagcatatcaacaatctcagccttagaatgtgagctcaagaaaatcttctccatgtaatcgtcttcgtcatcagtctccaatgaagttctgaaatttgtgattgcattttggccccggaacctcagtgctgcagtgtcatagaccctagcagcttcctcttcttcaatgaatgtaccaagccacacacgttgatgcttctcatatatttgtgcaccccatctgccat

SEQ ID NO: 3258 - DNA, 904 bp, Citrus sinensis
  Predicted polypeptide sequence is orthologous to G1930
tttttaattataaaattttgttacaacctaatttcagctttcttcagcttttgtcacttgtaatttacaattcaaccttttccttttcctttgcaacttgcaactactggcaccacccttccccagtctcttctttccccttaaaactcctcaaaattccaaaaactccaaaaggaaaaaagaaaagaaaaattacaacaagaaataagattacaaaaaagaagaaaaaagaaaaaagatgttacgaagctccaatcattctttgttttttgctgcactctagagacaagagctccatttctctaagccttttgccgtcgttattattattaatgttgcacccaatcttatcgacaccaacaagaccattcccaggaattttgaaaatgttgaccccaaatagcctcatcatctggaccggctcgaccgggttctcgaccggtcctgttctggctttccaatcaatgtaaagctgcctatccccaccggtcgatctgtgaaagctaacaatgtcaccggctttcaaattcttctccttgacgaaccggctccaccctttggtcaaaacgtagctttgactgctgttccagtaggagtacctaaacctccaaactttgccggtgacatcctcaaagttcaagagcagtcccttggaagtgcttccgctctgtaaagggaagtgcttctccgcgtgctgcttgggtatcacgagccggttcagcttccccacgtcacttggggtaacggccttttcaaaaagctggtcacgcgctttaaggacccggtctgaaccgaaggcagtggcaacaccatcaccttccccgtgtttgattacacgcttgccgttggcatcgaggccgtagtttcttttgctctgctcgagctcgtcgttgtaagtgtgctt

SEQ ID NO: 3259 - DNA, 831 bp, Citrus sinensis
  Predicted polypeptide sequence is orthologous to G1944
gagggggaaggaaaaaaccggcctacggtgaaaatcgggtaaactttttcttgagaaatatttttctcaagaaacaaacaaagaaaattattttctttgctttttattttttgtaaccgaactgtgatttttggagatttcacttgagagaagcttctgaactacactgtttgagctctgcaaatgtgaaaaaggtctgagacagacagtttcagttgaggtgaggtctggccgttatgctgatatgagtagtcagagttggcgaaaattggatttttgaataactattaatcaatggaagcaggagaaggcatgagcacaggagttacagtgataggagctgaagcaccatcagcctatcacgtggctccaagaaccgaaaatccaacccaggtatcaggatctctggcggtgaccacgtcccctgttagtgtaggattgactggcacccaagaaaagaagaagagaggtagaccgaggaagtatggtcccgacgggactatggcattgtcacccatgcctatttcgtcctcagttccgccttctggtgattttccttctgggaagcgaggaagaggacgggttagcggtcatgaaagtaagcactacaagaaaatgggaatggacaatttaggtagtgtcggtatcaagctgtctctctagctgcatttgttgcattttggcactgttttagctagctctgaattactgaaatggatatatcataatactgtgaacatgcaaggttatatatttgatgagagtgaaatgattttgttttgttgaatatttattggtattttctgcatttgactgttgctaatttcttat

SEQ ID NO: 3260 - DNA, 948 bp, Citrus sinensis
  misc_feature (928)..(934): n is a, c, g, or t
  Predicted polypeptide sequence is orthologous to G2226
gggggcaagcaagccattatcaattcaaaacgttaaacaactacttgcacatgagatagtgttcttagtcttttagatagactaagaaatttcagctcgtcctaatcttattaaacggttcctgatatttcatcatcgaccccaactttgggttggaattgctatcttcttttggctcttttccaggattctgcagtcatcatttttcctttttaaaaattttcgcttctcagatatcaaggaagcagtcacaagattttgcttgatttctgattcagtatctcaaatttagtacaaaattgggtatctgtaaatttaaaattttaattcgaaaacatgggcctcgctagtatgccgtccgcatcagaaggaatgctatgcttgattctaatgaacactgctatgtcaatctcaatcgtcaaaggcatattcagatcaatcctcaaggttgtcggtttccagcttgctgactcatcatcgccaccgtattcatatttcgcatcacctcaagttgtctccgcagagccatatgatgtaaatttaagtcctccccttagctatgttgaggagttccgaaaccagaaccctgcaatcaagtatgaaacattgctccattgtgaagatgcagagcatgactgttctgtgtgtttgaccgagtttgagcctcaatctgatatcaataacttgtcttgtggacatttgtttcataaagtgtgcttggagaagtggctggactatttgaatgttacgtgcccgctttgcaggacacctctaattcctgagtttgaagacgatccctcttgcttctggtgagagtgttttatgagcttgtctagttgaggagacttctatgtacagcatgtagtgtacaggtatttactaatgcatcggccggagtgtagtgttgtttacacgccttctatgtgtnnnnnnnatctcgagtccttt

SEQ ID NO: 3261 - DNA, 726 bp, Citrus sinensis
  Predicted polypeptide sequence is orthologous to G2251
gaggcttctctcctctcctctccttactgttactactttttctcatttacatcttgcgtaagcaaaccttcaagtttctatcattcatgctgagttacatagtttcagtatctacccatttgaaatgggcatgcaaattcttgattcaaaactctctcttcggccatcggattggcatgcatggcgtgccagctgaaattggcgaggaactactgaccgttggacgctacgagcgcaacaatgataatgaggccgtagaatgtgcggtgtgtttatgcgagattgaagagggagaagagattagagagctgagatgtgatcatatctttcatagagtttgcttggatcaatgggttgggttattcaggcgggttacttgtcctctttgtcgtgattttctcgattcacgaagagctgttgtcgagaatgggattgagattttggtgtttaaaaggttttgttatctcgattcatcaagtgatcgtgattcatggtggttaaggtaaattctaaccatcttcataataaacatagatatatagaatttgcaaatttgtaaagctcaaatagcaacactctatatatattaagagtgcttgcttatgtatgtgcaagggaaacgtaaacaaaatcatgtgcgtgtattaacactctatataattaattaattattatccctctaatcttcaaaataagatagaatttgtgcaaaaaaaaaaaaaaaaa

SEQ ID NO: 3262 - DNA, 817 bp, Citrus sinensis
  Predicted polypeptide sequence is orthologous to G2747
gaggggcaaactaaaccgacttgtgataccgaaacaacacgccgagaagtacttcccgcttgactcttcgtcgaacgaaaaaggccttcttttgaacttcgaggatcggaacggcaaggcctggaggttcaggtattcgtactggaacagcagccagagctatgtgatgactaaaggctggagccgctttgtgaaggataagaagcttgatgctggcgacaccgtgtcctttcagcgcggcgttggggagctggggaaagatcgcctgtacattgattggaggcgcaggcctgatgttcatcatgttccagatcccacgacgcttgcacaaatgcagtttcaaaatcagctccgctttcagcagtcgctgcgctggggcaccaggctctactcgctcccccaatctttgtcaaattatggtcctttcagttacaatacgattcacaatccttattaccaacatcatcaacaacaacagattcttggttttggtggcaatgcgtcatcgacgatgccggtacagtattacctaaggccatcgtcagtttcacagcaaattgagggagggcatatgccgatggtgattgattctgtgcctgtcgttgttccgggcaaaactgccagctctactgcagcaaagcggctaaggctgttcggggtaaacatggactgccctacacaagatgatcaatctccagccactagtagtagttccacaaggcaagctgcagcatctgagtattcaagcaaaggaaaatcttccttgtcttttgatttggatctataatttgctatatgcattaatataatttcaagg

SEQ ID NO: 3263 - DNA, 954 bp, Citrus sinensis
  Predicted polypeptide sequence is orthologous to G2859
cttttctgtaaagcgctgagttgaagagttgctaaacttgtctaatggcattagagaatcgtaacacatctgatgatcagcctgctggagtcatgggttttttctcaaatggcagcttttttgatcatcatcaacagcctcagctttgcatgagctttgctgataacaacattcaaagtgaagccttagttgttccttccataggattgatagctgatttcagccatgataccagtaacggaaagaaggcggcggcgcatactgttgaaagttttatgaatttgtctcccactccggcttctggaagtgggttgttaagtgtaaataataagggaactggcatgcagggcttgagtggaagaaaaagaaagagaaacaatgagagagtggtggagaaaccaaaagaagtgattcatgtaagagcaaaaagaggtcaagccactgacagtcacagtttggctgaaagggtgagaagagagaaaataaatgagaggctgagatgcttacaggacttggttccaggatgctacaagacaatgggaatggcagtgatgttggatgttattattaattatgttcgatctctgcagaatcaaattgagtttctctccatgaagctttcagcagcaagtatgtactatgacttcaactcggagctggatacaacagaaacaatgccggggacaaatgaatgtgatgcacaagacatggagaggatggtgagagaagggtatggaggcccttcttacttccactctgcttggtctctttgaatgcaagacttaaatataaatttcctatgttcttgcttatcaaaagaagttgcaaattaaaccctgttgtatacaccatatatatgcttatggcaataaacaataattataaagaaaagcaaggatactgtaatctcgtattaattcccgtataaatataattaatgcatgtaaaaaaaaa

SEQ ID NO: 3264 - DNA, 743 bp, Picea glauca
  misc_feature (677)..(682): n is a, c, g, or t
  misc_feature (698)..(700): n is a, c, g, or t
  misc_feature (720)..(726): n is a, c, g, or t
  misc_feature (729)..(734): n is a, c, g, or t
  misc_feature (736)..(740): n is a, c, g, or t
  misc_feature (742)..(742): n is a, c, g, or t
  Predicted polypeptide sequence is orthologous to G12
agggtgtagaagtcaatctgtgcattccttgcatttcattgtgatttaattcagttctgtttttattgttgctagggtttacaagtcagtttctgaatttccttccgttcaattgtagttgatattttggaaaggatgtcggaaaagaatcacgaacaccaccatctcttccaccatcagaaggaagatgagaaccagaacgccgccgccgcctcataggcgacgccgtacgagaaggcgatgaaggaggagaagcatcataagcgaatggaccactttggagaactgggaacagtcgctgctggaacgtttgcactggtactgtatatatatctcttattctttaattctaattttactagtgacgaggtcaattgatttttatggatagaaggtattaatggtttccttaaatctgaattcccttgattgctggtgagtctataaactagatcatcgaagtactaattaggtcattcggtatgccgtaggagaaacatcaagcaaagaaggatccagagaacgcgcacagacacaagatcgcggaggagattgcagcagcagctgcagtgggagcggggggctacgtcttccacgagcatcacgaaaagaaggaatctaaaaaggaagtaaaggatcaccatttctagccgcccactgtcagtcccgatgcattnnnnnnaattttctttcgctgnnnaattactgtcatctgggacnnnnnnnagnnnnnntnnnnncnt

SEQ ID NO: 3265 - DNA, 709 bp, Picea glauca
  misc_feature (579)..(581): n is a, c, g, or t
  misc_feature (615)..(619): n is a, c, g, or t
  misc_feature (647)..(647): n is a, c, g, or t
  misc_feature (649)..(651): n is a, c, g, or t
  misc_feature (675)..(675): n is a, c, g, or t
  misc_feature (687)..(688): n is a, c, g, or t
  misc_feature (704)..(708): n is a, c, g, or t
  Predicted polypeptide sequence is orthologous to G481
tatgtccatgctaatcaagtttgaaacaaatccattaatcgaaatagatagacgtgaatatttttgtacgaaactttacaaaaataactccatgtcattgcctacaatgacaacaattcacatatacagcaatataaaaatcacaacttcaatgtacaatatcacaactgcctttcattgcatcaagttaaaagctttgcccaataacacaaaattaagttaaatgaatggttcttcgattgatccttcacaaaactagccattaaatttgattggctacatactaatcagcaattcatgacctctcatgcatcattacagatcattgccctgcattgtcaccatatgatgctgcatctgagactgcatatttggaatcccttgatgtacatttgactctttctttccgtattggtctactccagattttgaagatcccttattgtcaccctccgcctctctgtacatgagcaagtaaaccttcaagggctcgatataatcttcaaaccctagcgtgctcattgcccagagcaagtcgtcaccgttgattgttttcctcttctctcgctggcatttgtnnntggcctcgctggtgatgaagctgataaactccgnnnnncattcctgcacggtttccttggcgtctntnnngatcttgccgttggccggcagcgncttcttcatganncggctaatgttggcgnnnnnc

SEQ ID NO: 3266 - DNA, 854 bp, Picea glauca
  misc_feature (39)..(45): n is a, c, g, or t
  misc_feature (762)..(768): n is a, c, g, or t
  misc_feature (773)..(773): n is a, c, g, or t
  misc_feature (795)..(797): n is a, c, g, or t
  misc_feature (813)..(814): n is a, c, g, or t
  misc_feature (818)..(818): n is a, c, g, or t
  misc_feature (821)..(822): n is a, c, g, or t
  misc_feature (826)..(827): n is a, c, g, or t
  misc_feature (829)..(837): n is a, c, g, or t
  Predicted polypeptide sequence is orthologous to G481
acctactgaatacagacatttgtgaaacaacatttcctnnnnnnnttctcagcacagttagtaacaacaacccacccacccatttttccagtcttctgagcttgagagacttctttagcactttaaagccccctcctgagcttgagagatttctttagcatgcaagagcttgacccattccagtcaaaaactggtaaggctgcaaagctaagaatcggttgggttggtgatgccattctgcttaactaaggcgcctgttgtccccacataagcaataaaaattaaataaaaacataaaagaaaagtaagtatttctaccattggcccctgggggcttgctgctgctgctgctgcccactgctatttcccccactgctatttggggcggccatattgtaagccccaatcatgtggccgtggtgaccatagaccattccacctggtggttgcccatacgctgcctgctgctgcatatgtggcagagactgagactgtaccctattatagctactagggttcataccactgtaagcattagcattagagttttcaattgaggagccattaatggaagtgttaccttccttggaaggaatctggtctccttgtttggccatggagaccttctcgccctccatttctctgtatttgtggagatagatcttgagcggctcaacatagtcctcaaaccctagggtcgtcatcgcccacagcagatcgtcgccgttgatcgtctttctcttctcccgctggcacttgtcnnnnnnntcgcnggtgatgaaactgatgaactcnnngacgcactcctgtacnntctnctnngcgnncnnnnnnnnnttaccgttggcgggcag

SEQ ID NO: 3267 - DNA, 882 bp, Picea glauca
  misc_feature (2)..(2): n is a, c, g, or t
  misc_feature (4)..(12): n is a, c, g, or t
  misc_feature (22)..(24): n is a, c, g, or t
  misc_feature (32)..(38): n is a, c, g, or t
  misc_feature (40)..(42): n is a, c, g, or t
  misc_feature (68)..(71): n is a, c, g, or t
  misc_feature (845)..(847): n is a, c, g, or t
  Predicted polypeptide sequence is orthologous to G481
gntnnnnnnnnnaaggaacagnnncgattccnnnnnnntnnnaatgtgagcagaatcatgaaaaaagnnnntccagccaatgccaagatatcgaaagatgccaaggagacggtccaggaatgcgtttcagagttcataagtttcatcactggggaagcttctgacaagtgtcagagggagaagaggaagaccatcaatggggacgacctgctgtgggcaatggggactctagggtttgaaaactatgtggagcccctcaaggtctacctgcagaagtacagagaattggaaggtgaaaagacatcaatggccaaacagagtggtgatcagtcaccttccaaggatgcctctagtggcagtactgttaatgggtctagtgcaggcaatcccagtattagccctggaagctctgctaaatatagcgggggctactatccacaggcctatgggggccaagctgcacagatgtatggacagcatcagatgctaactccttatcagatgcatatcaacactggtaaagctggtggtgcaggagctgctaacagtggagatcatcatcctagagggcagtggtagaagtagaagagtggacactgattttcctgtttactgtatagtgagtggttgttgcagagttctggatgtgtatggggatggaattatgaaaagaaaagttttgctttcgttttctctgcttcttcgcctctgtaaacagagtacatgggcttctcatgggagcttcatgggcatttagcataaattgaggtgaggctgtatatttctgtcaactttaaaatttcaaaatcctgtatagcgcaatttagcttcctgtggttttttannnaagtagttgctctcctatgaaatgggtacaactca

SEQ ID NO: 3268 - DNA, 905 bp, Picea glauca
  misc_feature (763)..(769): n is a, c, g, or t
  misc_feature (862)..(869): n is a, c, g, or t
  misc_feature (874)..(874): n is a, c, g, or t
  misc_feature (876)..(886): n is a, c, g, or t
  misc_feature (897)..(897): n is a, c, g, or t
  Predicted polypeptide sequence is orthologous to G481
gttttgcaggtttctcacctgcggcgcgcgtttggttcgttggatgacaaaaacacattctaattgtatttattcatctcccctccaagagagcagcggcagccatggcagacttagcgagctccgtcaccagccaagaaagtcctcactcagaagacacgaacaataacagccacaaccagggttccaatgcccgggaacaggatcgattcctccccattgcgaacataagccgaattatgaagaaggcggttcctgcgaacgccaagatcgcaaaggacgccaaggacaccgtccaagaatgcgtctccgaattcatcagtttcattaccagcgaggcgagcgacaagtgccagcgtgagaagcggaagacaattaatggagaggacctgttatgggccatgggtaccttagggtttgaagattacgtggagcctctcaagctttacttgcataaatatagagagatggagggtgacagcaaaggagctgctgctagcaaatctggtatgggggatcccactaagaaagatttgagtaattttggagcagtagcaaatattaggtgaataaattctgttcaacaaaaccagggattgaaccatattcaacaggtcagattttgctgcaagtggtcatttgaaaatgtgtatgcgttacgatgcttggaagggtgaaattgtgggcttggaagctcctagtaataaaagacatgtttaattttttgaaataataaaaaatttgtgattaatcattgacatcnnnnnnntttgctgagtaatctatgtgatccttgtacataagagaaaatcctaagtttgatatgaaagatgtttttttatggcagtatatttatatgacnnnnnnnnggctngnnnnnnnnnnntcttgttatanttatttta

SEQ ID NO: 3269 - DNA, 652 bp, Picea glauca
  Predicted polypeptide sequence is orthologous to G663
ttttttttttttttttttggacgggtatttcctgattataaccgactggcttatgaacaaaagcggcttcttcaacctcattgtaaatgctatttgcagaggaaataataatagcagtggaggaagaagagatgatgagatcatcataacagacaacaatcacattttcagtatcaaacatacaagaatgtggacgggcatttcctgattagaaccgactgccttatgaacaaaagcggtaagggattcgatcaacttcatctccgccgatacagtacctgaatctgaacaagggcttggattttgtttcgtagaagatattagggttttgcccttgttcatagaattggaagatgtcgatcccttcttcagctcctcgtaatacagcaagcaataacttcgtctctttcacccaactggttgggtagcttcgtgcctttcacccaactggttgggatttagtggtcgagtcatacttacagccgtattacgctctgtcggtctaacgaacttcaatctgccaatgcacgcattggcatgagttttcttgctcaaacgagtattcaagcagttcttgataccgttatcggtgccctcaattagtgaccaccagttttccagcagtttatgaagtcttattataagctcttct

SEQ ID NO: 3270 - DNA, 530 bp, Picea glauca
  Predicted polypeptide sequence is orthologous to G1063
ttttttttttttttttttttagggttaagggtggtaattagttattaaacgggactgcttacacaagtaaaaagggcccccgatatggattcacaaagacagctgcttaacaatactaaacgttgaaaaccctatttaactggatacattaaaaacaaacttaccaaatctttcatgattttagccctgggggatgactaaaccctaaccccccagatcaaactggagatactaaaaaaaacccaagacccttcccccccccccacaaaagagactaatatttactttctgagtttatagatttaccccgctcctttggaattccctcctttccctttttaagggtgattagcttccagctttttcactttttgctggagcaaccttacatactgaatggcctcgtcaagaacaataaaagggtccatgcaatctcccccgggaattatacttttccggagtttaacaggtcttttaatctttcctttcctcgagttcttggctgatcctgaatgtcccaaaaggcattt

SEQ ID NO: 3271 - DNA, 852 bp, Picea glauca
  misc_feature (2)..(3): n is a, c, g, or t
  misc_feature (15)..(20): n is a, c, g, or t
  misc_feature (44)..(49): n is a, c, g, or t
  misc_feature (740)..(745): n is a, c, g, or t
  misc_feature (769)..(770): n is a, c, g, or t
  misc_feature (780)..(781): n is a, c, g, or t
  misc_feature (783)..(783): n is a, c, g, or t
  misc_feature (806)..(810): n is a, c, g, or t
  misc_feature (823)..(823): n is a, c, g, or t
  misc_feature (825)..(827): n is a, c, g, or t
  Predicted polypeptide sequence is orthologous to G1108
tnnaagaacatcaannnnnnattttatttagcagcaagacagannnnnnaaatgcaacttagcactcatcacataaaaaaccttggacaacgctaaaagaccactgccaacctatgtgaccaaacttgacaactgacaactacactgcaaacaagcatgttgcatagccaagaagattcatggaaccggcattgcttttgccgaacatgtctaatttgttaaggggggcttcgaagtatatgcattgcccatactctagattattattgagcaagccgaaatgctttggcaatatactcaaacatttatagtataacagccttgctccatttcttcaactgtgcattttcaagcaaaccctatggcttgcccagtatttttgagagatcttctctgtttataatgttagtcagcgactcagcacaactcatgtacagtatgcaacagacaaagttcctctgctttagctaaggtcacaaagattccaacggtagaatttcctaattcacactccctcattacgagaacctctatctctctgttcttctgtttcatgaaaagattcagcttctacttcactagaatcaccaatctcatgcttgcagagaggacaagaagcattaattttcagccatttgtcaacacattctacatggaaatggtgcgtgcaaggaagctccctcagctctacatcatctttgtatttgccaaggcaaatgcaacaaaccgcatcttcagcnnnnnnagatctttcattgtctgtaccagnngctacaaagnnancctcatataaactgtccgagtcnnnnncattgtcatcttnannntcagtgctttcatgttcaacttttc

SEQ ID NO: 3272 - DNA, 692 bp, Picea glauca
  Predicted polypeptide sequence is orthologous to G1145
ttttttttttttttttttctatgaaaatcagcacctgaacaagaaaccgaccattacataccttccaaagatggaaaatatcaataatccatgattatacaccgctgtaaaatctcctgtaagacactgcaatcagcctatatataacaaaagagtttgggattaatgtacattgtagcaaccagagcctcccagtcaaattccagcattaatcgaagaacagaggctttctaaacataagtgaagattcagaagctatattttgtcacataattgccattctgatcttcgagccaatggtgcacatgactacaatctctgtacaaggctcaagatccatgttcacaagctgcttttgggtcataaaatcatcattcagtgcatcatgcatgccatatacacatgctgccacttttcagagacaaaaatatatacaatcatcaaatagatgccttgtagagaataccaaactgactacacaacttcaaaatggggcagtcatagtccttcgaagcggatgttttgtttgtccaggttgtattgaatgcagcaggtctgcagctgcctgctccttctcagcctggcgttttcttctataagcttattcacttcaatctccagctcatttgtgtaggcctgtctccttgctcttgaacgagctgcagattctcgattcttgatcatacgcttct

SEQ ID NO: 3273 - DNA, 833 bp, Picea glauca
  misc_feature (3)..(8): n is a, c, g, or t
  misc_feature (45)..(48): n is a, c, g, or t
  misc_feature (422)..(422): n is a, c, g, or t
  misc_feature (576)..(576): n is a, c, g, or t
  misc_feature (724)..(725): n is a, c, g, or t
  misc_feature (746)..(747): n is a, c, g, or t
  misc_feature (769)..(769): n is a, c, g, or t
  misc_feature (775)..(776): n is a, c, g, or t
  misc_feature (799)..(801): n is a, c, g, or t
  misc_feature (813)..(816): n is a, c, g, or t
  misc_feature (822)..(828): n is a, c, g, or t
  Predicted polypeptide sequence is orthologous to G1145
tannnnnnaactaaactaaaacccaagttatcataacaaaccgannnntaaccattcaaaaagctacaaagtacacacaataatgtgtgcttacaaacaattttatttggttttcataaaaacataaaaaaagaaaagccatgatcagtgatcaatttgtggccacaaaatttcctgaaacataacgctgaattaccccaatgtaggtcattctggaccacagcagacccgaaaacaaatttacagtggcacgcaaggccctcgtagctatatacttgcatggcttcaaaccaaaggctcctcttacttgacgaaaactgacaatgtatagctttctttggctctgctatcctaaactgtatgtctccacaactgtcttcaatatagaagcagctaagtccctcctaagtcataagtcgtanacctcatcttccaatacactaaactatctagcttatcagattggaatagagatacaaaattacagatagattagcgaaactgtgccacaaagacctcttcaaaattagaagtatgattgtctacaactccacttcaaaaaggagcagaactagnccttcgaagagtgtgctttggttgtggtggaggtacagtaggcagcaatttctccaggaactgttgttttttaagcctctcattctcctctttgagctgcatcacttcattctctagctcatttgtgtatgcctgctttcttgccctnnatcgtgcagctgactcacganncttaatcatccttttctgacgncgctcnncggttttctcaataatgctctcnnntgctccccgctnnnntactcnnnnnnnctctg

SEQ ID NO: 3274 - DNA, 689 bp, Picea glauca
  Predicted polypeptide sequence is orthologous to G1146
ttttttttttttttttttaaaagcaccaaggccagaagatcattatctgccttcttgtacgaattattcattcacatgatattctaacaagagataacacaacataaaaccaaacaataggttttcatgggcactcagatccgaaggacctcaatgcttctgatttggttattctgtcaaggatcagttctgtagaagccgtactttgaagtgtgatgaatgaagtttattttatacaaatgacagtctagaatacatgattcatagaatacattagcagtagaacataactctcttcacattttccttaatagctggcaaaggccgaacagcagcagctccagtcccaggacgagtgctacgggtacccgaactactagcagctacactcctaccaggaagtccactatgtaaagatccgctgtctgacgtttcaggctccatgtagaagcgagctcgaaatgcggccagatgcgcataatatgcgggaggaacgattgaaacagagcgtgtacaccgagcatatctgaataccagcatgactgcaaaggtagaaatcaaactcagttggatgacaaatcttggaatcaactacagtgcctggcaatatgttaccacttctatcaacactagtcctgtcacgatgattatgagcaaataaccttgtgtgatgacgtttttgaactact

SEQ ID NO: 3275 - DNA, 938 bp, Picea glauca
  misc_feature (802)..(808): n is a, c, g, or t
  misc_feature (813)..(813): n is a, c, g, or t
  misc_feature (815)..(815): n is a, c, g, or t
  misc_feature (817)..(822): n is a, c, g, or t
  misc_feature (869)..(870): n is a, c, g, or t
  misc_feature (872)..(872): n is a, c, g, or t
  misc_feature (878)..(880): n is a, c, g, or t
  misc_feature (899)..(900): n is a, c, g, or t
  misc_feature (918)..(924): n is a, c, g, or t
  misc_feature (928)..(934): n is a, c, g, or t
  Predicted polypeptide sequence is orthologous to G1146
cggtggaagaaacactgtcttagttgatgcactgtcaaggaggatacctttggttagtgacaaacctacaataatctttggagcagatgtaacccatccacaccctggagaggattcaagtccatcaatagccgctgttgtagcatctcaagattggcctgaagtcaccaaatatgcaggcttagtttgtgctcaggcacatcgtcaagaacttattcaggatctttataaagtctggcaggatcctgtgcgagggactgcaactggaggcatgataaaggaattgttgatttccttccgaaggaatacagggcacaagcccgagcgaataatattttacagagatggagtaagcgagggccagttttatcaagttctgttgtacgagttagatgctatacgcaaggcctgtgcatctcttgagccaaattatcagcctccggtgacttttgtggtggttcaaaagcgtcaccataccagactcttcgcaaacaaccatcaagatcgaaatgctacagataggagtggaaacattttgccaggcactgtagttgattccaaaatttgccatcccacagaatttgacttttacctctgcagccatgctggtattcagggaactagcagacctgcccattatcatgttctttgggatgaaaacaaattcacagctgatggattgcagtccttaactaacaatctctgttacacatatgcaaggtgtacacgctcagtttctatagttccaccagcgtattatgcccatctggctgcatttcgggctcggttttatatggagccnnnnnnntcagntngnnnnnncttatctagtggtgttcctggtagtcgcatgactgctgctagttcanntnctcggnnnactcgtgtacctgcgggannaactgttcggcctttgcnnnnnnngaannnnnnngtca

SEQ ID NO: 3276 - DNA, 871 bp, Picea glauca
  Predicted polypeptide sequence is orthologous to G1198
ttttttttttttttttttaactcatgatcaagtcatattcatcattgaacaaggggagtccagatttttgtcgtatttctcacaaacaggggaagtatggcttccctgcatttgagattgaaatattacttgattaatgcagccaaacaaatgatatatactaatagaccaaaaactgtcgacctggctattatgttacatttgaaaccacagtaaaaagttacttgttcatggaggtccaaccttgtgtgattatactggataattacttctaaatactttacattcctatctagctaattcaaagaaataaagcctcctcagctttgaaaatcctatcttcgatgtcaagggaatagttagcttaatttcttcaatatgaaaggctgagaattatcccaggcacaactggattctcaaaaggtgatttcagacttcctcccacaacaatgatgcaacaagatttcaatcattgtacaagagttatttcaaaataccaaggggcaaagccaaacctctacacggttcgaagcatgtattctgtatttcatcttcaatacatccaccctcgcaacccttcatcaactccatcctgtcagagatggagaagccctttcaggattgctcatagacgtggctatgcccattgcctagggctgcaacatgatacagatcaaagcacataatttctaacaatttaatctctggggcgagcaagccatagagagctaagggcacgcagtctcactcccggtccgtttcgtctcaactaccaggtaaacaactgctactgcatgggattcgaacaccaggcggcctgtgtgtcggcgaagcaattactcaaagacaataacggctaagagcgcgttgt

SEQ ID NO: 3277 - DNA, 882 bp, Picea glauca
  misc_feature (778)..(779): n is a, c, g, or t
  misc_feature (786)..(786): n is a, c, g, or t
  misc_feature (843)..(845): n is a, c, g, or t
  misc_feature (853)..(879): n is a, c, g, or t
  Predicted polypeptide sequence is orthologous to G1198
tttgtcgtatttctcacaaacaggggaagtatggcttccctgcattggagattgaaatcttacttgattaatgcagccaaacaaatgatatatactaatagaccaaaaactgtcgacctggctattatgttacatttgaaaccacagtaaaaagttacttgttcatggaggtccaaccttgtgtgattatactggataattacttctaaatactttacattcctatctagctaattcaaagaaataaagcctcctcagctttgaaaatcctatcttcgatgtcaagggaatagttagcttaatttcttcaatatgaaaggctgagaattatcccaggcacaactggattctcaaaaggtgatttcagacttcctcccacaacaatgatgcaacaagatttcaatcattgtacaagagttatttcaaaataccaaggggcaaagccaaacctctacacggttcgaagcatgtattctgtatttcatcttcaatacatccaccctcgcaacccttcatcaactccatcctgtcagagatggagaagccctttcaggattgctcatagacgtggctatgcccattgcctagggctgcaacatgatacagatcaaagcacataatttctaacaatttaatctctggggcgagcaagccatagagagctaagggcacgcagacgagaaaagtaatcactgatagcaagaagcgcacgtgctgcttggcgagttgtcaatatcctatgcatttgctgtagtgtctgttgccgcaaattgtcagnntggtgancaaaaccttcaagggtacctaacttgcccattgccattgccatttgtcccatatagnnngctacatnnnnnnnnnnnnnnnnnnnnnnnnnnnacc

SEQ ID NO: 3278 - DNA, 890 bp, Picea glauca
  misc_feature (22)..(26): n is a, c, g, or t
  misc_feature (812)..(817): n is a, c, g, or t
  misc_feature (854)..(858): n is a, c, g, or t
  misc_feature (864)..(866): n is a, c, g, or t
  misc_feature (872)..(873): n is a, c, g, or t
  misc_feature (875)..(886): n is a, c, g, or t
  Predicted polypeptide sequence is orthologous to G1198
tactctaatattcacatctcannnnnattatttcaatttcttcttgaatcttgaccctgttttttcccatcatttatcttcctacatttgacctgaagctgccaagcatggacagagtcaaacttccatacacacccttctattcaatcttcttttgcaaattaaccgacacccaataattacatatacagtccaggcaattaagagataaaaatatcaaactaagaaaagttacaacattgaatatttgtacaatcttcagaaagctatacattttattctcaagaaagatgatgcaatgaggttctctaaagacatctttctttataatctatattctggctcacctgcttagcttccttccatgtaagttacaacactcgatgcttgaaagagttgtaacaaatgtgacatcaggctgttcttggctcttggtaaatggcctttaaacgaagtatagatgactagttttgtcagctcaagcagttcaccaatagacttcaagtcatctcagggattaagcttactcacgaggacgagcagcccataaagaactaagggcccgtaatctggtaaagtaatcccccatagcaaggagacctcgagctgcttgacgggttgtaaggatgcgttgcatctgctgcagagcttgttgacggagattgtcggcctgatgtacaaagctctcaagcatcccgagctttcccattgccattgccatttgccccatgtagttggcgacatttggtgcacccaatgaacctgctgccagagtgtcaaccagggactgctgaagtgcttccatgccttgnnnnnntgcatcctctgcctgctgtgatgacagtttcaagctnnnnnctgcgnnngattgnngnnnnnnnnnnnnctca

SEQ ID NO: 3279 - DNA, 515 bp, Picea glauca
  Predicted polypeptide sequence is orthologous to G1275
ttttttttttttttttttgtgaaattaaaaaaaatatatactaagaaggagaaccgtacaacaagtacggatagtacaacatacaaactttctgaaattagcagcaaaattgtagatcgggttgtgaagttgatgtgcagaggtattaacaacaacagggccgagtgattggaggctgccaccgaacagctgaagcaaccatcaggacgtggaacagctgatgtaacggctatgtgtgattgggcttcaaagaagtggacgtagccaccagctagagaagccacgggctgcagccaccaaggtatatctaccgccacagcccgtcgagcaaataacgctcatgcaggggtcgagggcagtcgtacgcatggagaaagggaagtgacgacgcagggggtgcagccaacagttggtgggcagagtattgaagtagtggctcctgtcgcagccacaaggagaacccagccagccaccaggttgtaggatccacctgtacatcgtcagtagatctggcc

SEQ ID NO: 3280 - DNA, 887 bp, Picea glauca
  misc_feature (776)..(779): n is a, c, g, or t
  misc_feature (789)..(794): n is a, c, g, or t
  misc_feature (848)..(860): n is a, c, g, or t
  misc_feature (865)..(865): n is a, c, g, or t
  misc_feature (867)..(869): n is a, c, g, or t
  misc_feature (876)..(881): n is a, c, g, or t
  misc_feature (883)..(883): n is a, c, g, or t
  misc_feature (886)..(886): n is a, c, g, or t
  Predicted polypeptide sequence is orthologous to G1482
tttgcaggagatacatattgttgtggggaaactggatcggtaatcttgaatttgttgcagattcggagaaagatgaaggttcaatgcgacgcgtgccagagcgcggatgcatctgtgttttgctgcgcggacgaagctgccctctgtatgaaatgcgattccaaagtccatgacgccaacaagctcgccagcaagcaccgcagactgtctctcctcgagcccagctcatcatcctcaacggattctctgagatgcgatatatgccaggaacgaagggcgttcttcttctgtcaagcggatcgggctgtcctgtgcagagattgcgatttatccatccattctgcgaacgaattgactgcaaaacataacagatttttggttcctggcaccagagtttctctgaaaccaatggagactttgtcctgccctgagaaagcggtggccactgtcaccaaggcattaatgccacctgcccaaaggatgccgaatcatgcccagccatcaatggatctgcctgtagaaaccgtaacaagtaccagtaacagcgacttctcacagtatttgaacgaggttgagcaattcctaacttcggcttcccctgagcgtctcgactggggtggttcatctgagggtgacgctattggaaagtacatggactcggactgggcacccaatctgggcctcctgcctgaaggtttctatggagactcgctggcagaagtccctcacatgccatcgcccataacagattctggattctgtatatatagccgatnnnncatcaccatnnnnnnaaaggcaaagcagcagcagctgcagcaggtgccatattttcttcctggtttcgnnnnnnnnnnnnntaacntnnntgttccnnnnnntntant

SEQ ID NO: 3281 - DNA, 503 bp, Picea glauca
  misc_feature (465)..(465): n is a, c, g, or t
  misc_feature (485)..(493): n is a, c, g, or t
  Predicted polypeptide sequence is orthologous to G1798
gcaagatactcagtatttaaaacaggatattgcaaatatggaagaaaaaattaagattcttgaatcaagacaaagaaagatgttgggcgaggaactggcatcatgcgcattgagggatttaaaccaattggagagccaggttgaacgaggattgagacatatacgagcacgaaagactgaaatattggtggatcaaatagaacaacttaaaagaaaggaacggatattaactgaagagaatgctttcctcagtaaaaggtttgtcgatcctctctatgagaatggttccgttttgacaactgctgcaaatggattaggaagcatccaaaatagtgaagtcgagactcaacttgttataagacagccgagatcattttcttgttaatacttctcattgatattcactgatgataataaatctattatatattattaataaaaggtaaaggcacctcattgttcagnaacttaaaaaaactgtcatnnnnnnnnnatggacgttt

SEQ ID NO: 3282 - DNA, 808 bp, Picea glauca
  misc_feature (767)..(773): n is a, c, g, or t
  misc_feature (782)..(787): n is a, c, g, or t
  misc_feature (789)..(799): n is a, c, g, or t
  misc_feature (801)..(803): n is a, c, g, or t
  misc_feature (806)..(807): n is a, c, g, or t
  Predicted polypeptide sequence is orthologous to G1798
agacgggggggtgtttctgtaatttctatttttttggtttttatgtttttggattctcagcttcagcttatgagtcgaggagccgcttgggttctttttggaagccattacagggtttaaattttttcgccttccattttctggtggtgattgttgtgattccctgattcgagagtctgattcattgcttcgagggcattagggagggcaagagagaggagaggagtctggagaatggggaggggaaagacccagatgaagaagattgagaacgtgaccagcaggcaggttacgttttctaagcgaaggaatggtttgctgaagaaagcttacgagctctcagtgctctgcgatgcggaagtgggacttattgtcttctcaccacgcgggaagatttatgaattttccagtcgctgtatgcaaaagatgttggagagatatcaaacatattcacaagaaagtgacataagtaatgctaccaaagagcaagatactcaggaacggatcttaactgaggagaatgtttttcttagtaaaaagtgtgttgatcaatatgctgatagttcggttctgaaaacacctaaaattcaagttggaagtatccaggacattgatgtggagacccaactgttaataagacctccaattgtacaaggtcacccttatctggatagttttcattgatattttttcattccatttcaataatttatataataaatttgttattattacatatatgttaatttttttatattttcattatnnnnnnnaacattatnnnnnnannnnnnnnnnnannnaanna

SEQ ID NO: 3283 - DNA, 798 bp, Picea glauca
  misc_feature (11)..(16): n is a, c, g, or t
  misc_feature (52)..(59): n is a, c, g, or t
  misc_feature (773)..(781): n is a, c, g, or t
  misc_feature (789)..(790): n is a, c, g, or t
  misc_feature (792)..(792): n is a, c, g, or t
  Predicted polypeptide sequence is orthologous to G1798
attaaaaattnnnnnnatcaaatttcaacctttatccaagttgtgttgatannnnnnnntcaaaaatacttagaaagacactgcagttgtaatgtctgtataatgaaaaaatgagaagcttgcagtcgtactgtctgtataatgaaaatatgagaagcttacatatgcattagtaacaattttattatataagctatcgataggaaggggatcttatacatttggaggtctcataaccagttgagtctccacttcaatgcgctggatgtttccaagctggagtacaggtgatgtcaaaaccggaccatccacgtattcagcacacttccttttaagttgttctatttcatccaccaatactttagtcttttgtgctcgtatgtggttcaaccctcgttcagcttggctttctagatgatttaattctttcactgaacatgatgctagatcttcccccatcatctttctttgtgttgattcgaggatcctaattctctcttccatatttgcaatttctcgttttaaatgctgattatcttgttctttggtagtgttatctatgtcactttcttgtgaatacttttgatacctctccaacattttttgcatactgggattggcgaattcatagagcttccctcggggggcgaaaacaataagtgccacttcagcatcgcagagcaccgacagctcgtaagctttcttcagtagaccgttcctgcgcttagaaaacgtaacctgcctgctggtcgagttctcgatcctcttcatcnnnnnnnnncccctcannantctcgt

SEQ ID NO: 3284 - DNA, 873 bp, Picea glauca
  Predicted polypeptide sequence is orthologous to G1798
cagtagcactcattatcgggtcttaattgtaccccctgtccttcgacactggcgattgttctcattgcctgatctgatcaaactgaggctctgtgattgattgttttgagggcaaaagagaggagaggagaatggtgaggggaaagacccagatgaagaggatcgagaacaccactagtaggcaggttacgttttctaagcgcaggaacgggctgctgaagaaagcttacgagctgtcggtgctgtgcgatgccgaagtgggacttattgttttctccccgagagggaagctctatgaattcggtagtcccagcatgcagaaaatattggaaagatatcaaaaacattcggaagaaaatagtataaataagatattcaaagaagaaaatactcagtctttaaaacgggaaattgcaaatatggaagaaaccattaggattcttgaatcatcacaaagaaagatgttgggggagggtctggcatcttgttcattgaaggaattaagtaatttggaaagccaagctgaacgaggattgagccatattcggtcacgaaagactgaaatattaaggaatcaaatcgaacaacttaaaaaaaaaggagcgtattttaagtgaggagaatgcttttctccataaaaagtgtgttgattcccgatatatggatggttcggtttcgggaagccctacaattggatttggaggcgtagaacaggtgacgaatcggtgactttaacatcatggagtgccttaacaacacattatgtcaccgactgtcctacacctcggagacgcatgcaaggctatagatattttctgctggttgcatacatttttatcttattgtttacatctctaattaaaatgagtatca

SEQ ID NO: 3285 - DNA, 883 bp, Picea glauca
  misc_feature (792)..(797): n is a, c, g, or t
  misc_feature (827)..(827): n is a, c, g, or t
  misc_feature (829)..(835): n is a, c, g, or t
  misc_feature (860)..(864): n is a, c, g, or t
  misc_feature (869)..(881): n is a, c, g, or t
  Predicted polypeptide sequence is orthologous to G1798
gacccagatgaagagaatcgagaacgctaccagcaggcaggttacgctttctaagcgccggaatggactgctgaagagaccttacgagctctcggtgctctgtgatgccgaagtgggacttattgttttctcccccagtgggaagctctatgagttcgccagttccagcatgcaaaaaatgatggaaaagtatgaaacctgttcacaagaaagtgatataagtgaatcaaacaaaaagcaagatcctcagtctttaaaactagaaattgaaaatatggaagaaagaattaggattcttcaatcaacacaaagaaagatgttgggagagtgtttggcatcatgttcaatgagggaattaaacgacttggagagacaagttgaacgaggattgagccgtattcgagcaacaaagactaaaattttattggatcaaatagagcaacttaaaaggaagttagatgacattcaagtcaaaaatggttatagttcaacaccttcagttggattgggaaggatacaacacatggaagtccagactcagctagttatcagacctcctgatgtacaaggtcatctgtaaatgtgaattcgaaattgcattggatttgatgagtagttagaggatatttgaaatattttggtttcattttagtttcctagtttagttgatcttgggaatatctttccaggttatgtaaacagtttgataactgccacagggaggttttaccctgtggagaaacttataaatacttattatttttgtaataatatcatcctcattcgtgggcnnnnnnggatatggaattttaatacagactgagacnannnnnnntattctgctacagctttagcttttnnnnntatcnnnnnnnnnnnnntg

SEQ ID NO: 3286 - DNA, 822 bp, Picea glauca
  misc_feature (8)..(10): n is a, c, g, or t
  misc_feature (12)..(12): n is a, c, g, or t
  misc_feature (19)..(24): n is a, c, g, or t
  misc_feature (48)..(50): n is a, c, g, or t
  misc_feature (191)..(193): n is a, c, g, or t
  misc_feature (235)..(235): n is a, c, g, or t
  misc_feature (260)..(260): n is a, c, g, or t
  misc_feature (285)..(287): n is a, c, g, or t
  misc_feature (345)..(347): n is a, c, g, or t
  misc_feature (438)..(438): n is a, c, g, or t
  misc_feature (818)..(820): n is a, c, g, or t
  Predicted polypeptide sequence is orthologous to G1809
tcccgagnnnanttcaaannnnnnctgtttagttcaaagtgatgcggnnnatggcagaaggtaaaacaggagcccgggactgcagcaggaggatgtaaaatatgcgtcatgccgaaacatccataatgaacattgcattgccttgtatgttcaggctttttttctcactgttggaagcgatcttgaataannncttgaacattcggtggacatgtttggttccttctagtgctanctgcattttctaccagtgattttanctgccagcaattttacatggggtannncagacaagccagagttcttcattggcagctctgttctctcaagactggacaacaatcnnngcagtctgttgcgcacactataaataacggaattctatactacaccataaagaacacacgcgtctaaaaagattgctgaggaacagagtanctgctcagcaactgagggtgaggaagaaggcttattcgaacaagttggaaatgaagtccaaggagcttgaacagaagaagagagggtgtcaactttccagagtgaatatctcatgcttaaacaggttctgaagaacatgacagagaggagcagaggaggtggatttcgtgaagtagaagggcagttatatgatttgcaacatttgaaagatgttgcagtggctcaaattcttttgtattgggctgtgttttcattttgtcaatcaccataaatcagttttcaaccttttcttaggacgtgggctatgttaacgtctaacatgttgacttttgttggaagccatttaaataaaaatagaaaaggaaattcctgcctttttnnnca

SEQ ID NO: 3287 - DNA, 835 bp, Picea glauca
  misc_feature (45)..(53): n is a, c, g, or t
  misc_feature (761)..(762): n is a, c, g, or t
  misc_feature (772)..(773): n is a, c, g, or t
  misc_feature (812)..(828): n is a, c, g, or t
  misc_feature (832)..(834): n is a, c, g, or t
  Predicted polypeptide sequence is orthologous to G2226
gatcatctccagaccttctcaggccaccttagaaaacctaaagtnnnnnnnnngaacaacttctaagttctaagtcttctctacatataggctttcctgctatatacagaagaagtattcactacataaccttcagaaaacaggattgctttcaataggagaagcaacaaagcatcctgtagaaataagcacttttcctaaagatgatttacaataaaagattacagaatctccaattatagacccagataactggatgaagtgttgaaggatccttcaaagcaggatccaagcaactctaactttcaatccatgtatgatgataagcagcttcttggaaggatgaacaccaaaataccgattcatctgtaagctcctgttccctgagcctgatattcttggctgcttcttcggatatcagacatgatctacacaagggacaggtgatctgctgatggtccagccatttatcaaggcaaggtctgtgaaaaaggtggcagcaagtcagctgtctgatctcaaccccttcctcaaatttggataaacagactgcacactcaacatggctattgtcactaccaacaaacccatcagtaaaagattggaaccttttgatgggtaggctctgcctgatttcctctgcaatgaactgcgcttcggaatggccagtactgactgcaggggtattttcaggtgggtaaggccatgatgggtcgataaaatcaggttcagtgcctgtggtaaggcctacaatctgaagnnaagacctcannatgtccttgataatggcaaaagacagagcagtattcacnnnnnnnnnnnnnnnnnctcnnnc

SEQ ID NO: 3288 - DNA, 668 bp, Picea glauca
  Predicted polypeptide sequence is orthologous to G2251
cagagaacaaaatgcacgggttccctattggttactgggataatgtagaagtcccccagctagtgctcaaccttgtgtttgtcttggaattgagcaggcttttggccaattggcttctctcccctttcggtataccagaccatcaatatggcgctccccgggatcagcccctcaccacttggcccatcactcctttaactaatactatcagtgttcgttattccggccttatcttctccgcttctatttcgccttcttcccctgtccctccataccgtgaccagcagagcgttcgtgagaatttgcccaccgtcttcgactacgggagtctcagagctgatcgccatgaggttgttgtctgtactgtttgtttcagtgactttgtgtcgcgggatcgagtgcgccggcttgctaaatgtggccatgttttccatatggagtgtttggataagtgggtcgaatatgagaactacatttgccctctctgtagatctcccatcttttagacacaggttgaaatcatcatcatcaactattataagtctgattgattgctgtgaattgttaatgtaagtctagtaggatagattttatggacattttgctggccacatgaaaaggcttctgtaataaaaatgtattgtggatttattgaccttttaatcttt

SEQ ID NO: 3289 - DNA, 648 bp, Picea glauca
  Predicted polypeptide sequence is orthologous to G2990
ttttttttttttttttttggttatttgtgtttttttgcttgtggagaaggaaggagaagggtttgtggtcttcctcaatcactctgaaggcaacttaacaaccaccatcatcaccatcaaggatttgtaagtggagcaagggttcaatttcatttgccaaccggtgttgaatcttccattcataggtatgtatctagattctaaatccctccattcataggaggaggaggagtggcctgaagacatcatggagggtgatgtgaaaacatcatcacaaccttctacacttattgatacacctactcctgcacacaccaatggtcatccactatcagatacagggtcttctattgtcaggggcaagcctgacaaagaaccccttatcttttctcgtaaaagggggagaggcagaggtcgacattgatattagatagctagttgttgttttgtttcatttgtcattgtatatcatagatctacagactccatcatgagatacattttataattatatatgtgttgtcattttgtattggagaggcccttcaacattcaatatcgactttgatgtataattttttatttggcatccactagtgacagggcttgttgagaggcccttcaacattcaatatcgactttgtcagc

SEQ ID NO: 3290 - DNA, 802 bp, Picea glauca
  misc_feature (2)..(8): n is a, c, g, or t
  misc_feature (21)..(28): n is a, c, g, or t
  misc_feature (82)..(90): n is a, c, g, or t
  Predicted polypeptide sequence is orthologous to G2990
annnnnnncccgcgccatcgnnnnnnnnaaaagaaagtcggggctgccgaaaagacagagttttaccgggcgggggttttannnnnnnnncttttggattattccctcgagtaaaagacggctacttgatcggcgaattcaatggccgaacttcaccgagtttatgcggcctctcttcatatgcgccaaattccgaattttatggataaaattcggcgaatgcggtgacgctcccatcccccttgaatttcctgaaaaattgtggtgtctctcatgtgcgtttccctgctcccgcgtacggaaacttggtggaacattggaaattttctaggttgaaagatttcaacacagggaatgatggcagttgtacagggtaggtgattcttacaaattggggcaaggctttttatttcttacaccatttagtttgtagttgtgggaagttgcgcgtttgtttttcagcattttttttctgaatagaagtttttgcaagtgataggggcgtttcgctatgctagtcttgccacagagaaaattagtccttaacatgttgtcgatttattttcttgactacatacatactgagaatggaagtgccctcttgagctaaagggaatgctgcaagctttggtaaatttaataaaggaatcgggtgtttttgctcaatcatagcaaacatccgagtctgctgtgcattgatacgttattaatggcaactgccaatgcatgtatagactccgtaagaaactgataagtgaatcttttgattaaataaatatttaattaatgtcaaaagtttaca

SEQ ID NO: 3291 - DNA, 880 bp, Picea glauca
  misc_feature (2)..(10): n is a, c, g, or t
  misc_feature (57)..(60): n is a, c, g, or t
  misc_feature (776)..(776): n is a, c, g, or t
  misc_feature (799)..(799): n is a, c, g, or t
  misc_feature (853)..(853): n is a, c, g, or t
  misc_feature (858)..(859): n is a, c, g, or t
  misc_feature (864)..(868): n is a, c, g, or t
  misc_feature (870)..(877): n is a, c, g, or t
  Predicted polypeptide sequence is orthologous to G2990
gnnnnnnnnnttactcaaggccaaatggcagaaccaaagaccatacaggcacagccnnnngaaccctaattgaatataaaagctgcctagaagagggaataaattactttacacttatgctgacttcgatctctgcagtgaaagatctcaacagaagatacccttctcgtgatgaaggattcaggagtgagatccaaaggaaagagatatttttcaattcataaattcaggaaataaaaaggattaagcagaaaacagctgtcccccaaaaccccgaaagaatgcctgaaatccatagaaattcaataaaactcccatgtcggtaacataattttcaagatttcttaccgagagtatgcttgttgttatgcatccagaccttcaaaacacccttcccgacaccaatttcattacaaaactgctgaacaatagcctcatcctgcttctgcatcctccaccccatcttatctgcgaacatatacatcttctccttctgatcctgcgagaacttggtcctgaacctcttcttcatgcctctatgatgatggtggctgaggttattattactgttgttgttggtattgccatctgggtcatcagactcggtgagaccagagcttagcgccatgagcatatggggagccgaggaaccgtggggcaaggggagggggtaataggggacaacgggggaacccggccctgacgaggatgcgccgccacgcttcttgcggaggcagcactcgcaggtggggggcggttgctcgtcgccctcgacntcacggcggtggaagttgcggtngcatccgcaggcggcgcacttcaatgcgtcgtcttcagcgggcatgaactcccngcagnngtcgnnnnngnnnnnnnngat

SEQ ID NO: 3292 - DNA, 817 bp, Picea sitchensis
  Predicted polypeptide sequence is orthologous to G261
ttttttttttttttttagagcatcattacacacgccttgtccttggggattctgagaatgactgtgcataggcttgcgtctgtgaatatttttcaacaaattcctttgtccccgaagaaaatcttcatttgcgaattcccattgatctggatcaactttcctaaagccatatgtattgagctgtctgacaaagctggagaaattgttgtgcttgaagtacttgggcaacaagtctcgtgcgaattccggggggttccacacaatgaagctgttattcccggggctccatgaaactatcgagtccgtggagttgtcgtccaccatgtcatacgtcttggtgagaaacggaggcaccgcattgccaccgctgttctgagatccatccatatcctaaaaccccagaaatcgaaaaacccaaaagcgaaaaaacccaaatcaatacatggactcagcccgccgcggtacctcaaatttacatcattcggaacccaaacactctgatttctcagaaggtgctggcggagtccttagagcaacatccgccgatccctggtcggcatcgtttatggttgagactaggacggtatctgatcgtcttcgagcccccaactttcgttcttgattaatgaaaacatccttggcaaatgctttcgcagtggttcgtctttcataaatccaagaatttcacctctgacaatgaaatacgaatgcccccgacagtccctattaatcattactccggtcccgaaggccaacacaataggaccagactcctatcacgttattccatgctaatgtattcagagcataagcttgc

SEQ ID NO: 3293 - DNA, 349 bp, Picea sitchensis
  Predicted polypeptide sequence is orthologous to G663
ttttttttttttttttttaattcaaaatagaatggtttgcctctttaatgggaagaaatatacatccagtaacaaagttggttcggcctccctttcattgtatcaggtgtcattcaacaaaggaaataatgacaactacgtttgaattttatcactttctcgtgtccattggaaaagtaggcacacaacctcaatttcccatttcaagagaatgctacaatagattatgtaaccttaaaattaagttgattcaagttctctttctaaagtttgaactccggcctttatagcaaaatggagcaattttatttacagctcgatatctgcatcattactagtgcctttcccc

SEQ ID NO: 3294 - DNA, 801 bp, Picea sitchensis
  Predicted polypeptide sequence is orthologous to G1145
ttttttttttttttttcctgtaagacactgcaatcagcctatatataacaaaagagtttgggattaatgtacattgtagcaaccagagcctcccagtcaaattccagcattaatcgaagaacagaggctttctaaacataagtgaagattcagaagctatattttgtcacataattgccattctgatcttcgagccaatggtgcacatgactacaatctctgtacaaggctcaagatccatgttcacaagctgcttttgggtcataaaatcatcattcagtgcatcatgcatgccatatacacatgctgccacttttcagagacaaaaatatatacaatcatcaaatagatgccttgtagagaataccaaactgactacacaacttcaaaatggggcagtcatagtccttcgaagcggatgttttgtttgtccaggttgtattgaatgcagcaggtctgcagctgcctgctccttcctcagcctggcgttttcttctataagcttattcacttcaatctccagctcatttgtgtaggcctgtctccttgctcttgaacgagctgcagattctcgattcttgatcatacgcttctggcgccgctccacggtatgatctgctatagactcgcaccctcgtttcttccagacagggtgttcagagcccgaagatgcggccatgagagggatatcattattactgtttgcctgagccgataattccccaaattgttggtgctggttgtgaaattgcagccattccggatgctgcaggttttgacctgcaagcacagaatccattg

SEQ ID NO: 3295 - DNA, 730 bp, Picea sitchensis
  Predicted polypeptide sequence is orthologous to G1198
ttttttttttttttttttacatgaaatgaaacatccaccctcagctgatattgattcatggaatgacgaagatacatctgagtgtggccacccttcttttttataaatatgtacagaagtatctcggtgtttcatgcttcttcagtggtcaaatttcaactagtaatttcaaacactacctttctgtaaatcatgactaagaattttctatctgcaagcctgattagtagcatgcaggtgtgtaaagtcactgatcataaacatcaatgctgaatgttaatgttgcgtttagcatgagctggagactctgctctgctcagagcataaatcgaattaacaatacacaatgttgtgtaaatttctaatcctaaaacttgggctgatcccatggtagtaacttagacatgcagtgcaaattatcacgaaaactatggaccgaacctaattaattatccaataaaggcattggaatccacgaggcattgagctgatgatctgcaaagtgattaatactcattctctgggtctagctgaccaaagagagctcagtgcacgaagtcgagagcagtattctcctattgaaagtaagcttttggctgactggcgcgtggtgaggattctgtgcagctgttgcaatgtctgatgtctcagactatccgccaagatttctagattggcaagttttcccatggctatggccatttgtcccatataattggccatgtttgaa

SEQ ID NO: 3296 - DNA, 135 bp, Picea sitchensis
  Predicted polypeptide sequence is orthologous to G1228
ttttttttttttttttttacatttcatagtttaaaccattggttaatggagtacagttcgatatgtcaattgtacatttaaatgtcacaaccatgggccaatgccaaatggactacagttttaagaagttaatgc

SEQ ID NO: 3297 - DNA, 575 bp, Picea sitchensis
  Predicted polypeptide sequence is orthologous to G1463
ttttttttttttttttttaagaaacttgattgctattagtttctagaacttcacagcatatgacagtggatttcctcaaaaccttgctgctttaaagcaattgtcgcattctgcatacgacttataattctacatatgatactgcaacttcaaacggaaccgcagctcttgttcaatagaaattacagctggcatcaaagccatattttaacttttacacacgtattcaataaaaaagaatttatattttaagcctctatggatcaaattctgaagaaatgggctaaaacaacttccggtagaaagctacttgagacggtgatcgatcactataatggaaattttgatcttcggcatttctatggccccgttatttaaagaaatgcaccaaatatctacaaggatggcattccagaactatagaactcatattatggaaaaagggtcgttttgcaaccctcatcatccagaggccatcatttgcgagttaccaggagttacatttttaatgaaaaactcctcgagtttgtctcaagcaaacagagattttttcctcaagctgagctatttcgcta

SEQ ID NO: 3298 - DNA, 507 bp, Picea sitchensis
  Predicted polypeptide sequence is orthologous to G1476
ttttttttttttttttttggtcgtagagatgttactgttctacttgagggatatagctactttatatacatctgagtgtaggagctagagtagctcccgcttctaggccgactatgacgtactgatcccacagatccactggtccacccactggatcttcaacactcccccatcagtgcggtatagtcagtagtaactgactcccctagcttccttgtccacttccttcaagagctagtaacaatacgctcaatcgcttcctcgatctctggatgcgtgtcaaggcagttgaaatctcccgttacgatctgggcgatcctagcttgttctgaagctatagagccagcagagtcagacgagtagtctacttctgctgtagctgtagcagtagtctctttgcctttgttcctagctcccctatgctccttatccttgtccttgctctcaatagctttgaagtcgaagaataagcttccggatatgtctcttataagggcattggtgtgc

SEQ ID NO: 3299 - DNA, 770 bp, Picea sitchensis
  Predicted polypeptide sequence is orthologous to G1798
ttttttttttttttttgaaataaaaatataatatttattttcaaatattaaaaattttcaatatcaaatttcaaccttgatccaagttgtgttgatacttggtttcaaaaatacttagaaagacactgcagttgtaatgtctgtataatgaaaaaatgagaagcttgcagtcgtactgtctgtatagtgaaaatatgagaagcttacatatgcattagtaacaattttattatatgagctatcgataggaaggggatcttatacatttggaggtctcataaccagttgagtctccacttcaatgcgctggatgtttccaagctggagtacaggtgatgtcaaaaccggaccatccacatattcagcacacttccttttaagctgttctatttcatccaccaatactttagtctttcgtgctcgtatgtggttcaaccctcgttcagcttggctttctagctgatttaattctttcactgaacatgatgttagatcttcccccatcatctttctttgtgttgattcgaggatcctaattctctcttccatatttgcaatttctcgttttaaatgctgattatcttgctctttggtagtgttatctatgtcactttcttgtgcatacttttgatacctctccaacattttttgcatactgggactggcgaattcatagagcttccctcgtggggcgaaaacaataagtgccacttcagcatcgcagagcaccgacagctcgtaagctttcttcagcagaccgttcctgcgct

SEQ ID NO: 3300 - DNA, 772 bp, Picea sitchensis
  Predicted polypeptide sequence is orthologous to G1798
ttttttttttttttttggatttcaaaataacatcaacaaacatagttaagtatcacaatgacgactatttacatgaaggtgatcttgtgcaaactggaatttcaaaataacatcaacaaacatagttaagtatcacaatgacgactatttacatgaaggtgatcttgtgcaaactggaggtcttatatccaattgagtctcgacttcgacttcaaagtattgtacacttccaaatccaattgcattcattgctaaaacctgtttacgaaggaatgtgttctcctcaagtaagagacattcctttcttttaagttcttctacttgacccaataatatttcagtctttcgtgctcggatatgtctcaatccccgttcaatttggacctccaattgatttaattccttcattgaacatgtgcgcagatcctcccctgacatctttctttgtgttaattcaagaatcctaattttttcttccatatttgtaattttccggtttaaacccttgttatcttgctcattggttgtattatgtgtactatggtgcctctccaccattttctgcatgctgggactcgcgaattcatggagcttcccactcgaggagaaaatcataagtccaacttccgcatcgcagagcaccgagagctcgtaagctttcttcagcaacccattcctgcgcttagaaaacgtaacctgcctcctgctggcattctcgatcctcttcatctgtgtctttcccctcaccattcttggctctcctctgtgtttt

SEQ ID NO: 3301 - DNA, 847 bp, Picea sitchensis
  Predicted polypeptide sequence is orthologous to G1798
ttttttttttttttttggatatgatataataatatagaaaagttcataataaactaagaacatgcttgaatttcaaaataatatcaattaacttagttaagtactcaatcagaattattcatgaaaatgtaatcttgtataaattggaaatgttatacccaattaactttaacttagttatgtactcaatcataattattcatgaaaatgtaatcttgtataaattggaaatgttatacccaattcagtgtctacttcaattttctggacacttccaaatccaatttcagccattgttaaaacctttctctcaagctggtctacttcagccattaatatttcagtctttcgtgctcgtatatggctcaatccctgttcaaactggatgtctaactgatctaattcctccatcgaacatgtttctagatcctcccccaacatctttctgtgagttgatttgagaatcctaattctagcttccatatttgcaatttcacggtttaagtactccgtatcttgctccttatttatactattttcacgtgaaccctctcggtacttctccagcattttctccatgctgggattggcgaattcatggagctttcctcctggggagaaaatcatgaggccaacttctgcatcgcagagcaccgagagctcgtaagctttcttgagcaatccattattgcgcttagaaaatgtaacctgcctgcgggcggcgttctcgatcctcgtcatctggatctttcccctcgccattcgtatctctcctcttatttttccctccaagcaatcactaacagactctcaggtcgggcataacagaactgctcggggggggggg

SEQ ID NO: 3302 - DNA, 704 bp, Picea sitchensis
  Predicted polypeptide sequence is orthologous to G1809
ttttttttttttttttaataatactaaccgtccagcttaaacttagtgtacattacagattataatgtatgtacattattattctcattacagcccaaaagcaagctgatagttctagcatacatttttgaaagacacatgaaataatccagctttactgatcatcttcaagtgacataattcaatatggaggctcatatagtcagaggcagtgaggttcaaacacataattagaagtgtaccagcacgtcctaatactagtctttgttcttgatctctaaaaccagagaataatatctctggaactggtacacaattgtttattcatattgtactagtaatactctaactaaaacttcgttatctatgttgagtgtgaagttctctcgtgtgtgaaacactgcccaagaaaatgtaactgatgacagaaaggagagagcacacattctgaagggtgctaacaaatctataataaaagcaccttaagattactattcatattcagtatcctactacaatttaggtttctgcgcctgagttaccagatcctgctacaatttaggtttctgctcctgagttaccagatcccttttttttcattgttgtattcttcaaaatctgtctaagcatctgattttcattctgcaaagtggaaagcctttcccctaaactccgagtttttgtgctcaatttctttaacccct

SEQ ID NO: 3303 - DNA, 924 bp, Picea sitchensis
  Predicted polypeptide sequence is orthologous to G2141
ttttttttttttttttatagtcaaaagtattgatgacttagcaccatttccaaattagagaaaaaactgcggttccatctagaagggaggccccgaatctatttgtagatgggatgaaaactgcaaagaatttgagagactcagataaccgggaattcatgacatatatacactcctggtaggtaggttaagtagtagcatgtatgttactatgtatgctgcaactgcaaccaaacattgataaaagtaacacagtcaaactgtgataagtttttgcagtggaggagatcagtgtcagtgtattgagtattagagtggtcgctgctggtgctgatgctgctgcagtctgctttgcagcaaccccatgttatacatattctgcagctcgctgtcccaaccttcctgcctctgaaaatttgtaccatcaaacatttctgcagagtctactgaactcatagtggaaggtatatccgatccgggacttggtactgtctgcagagaagcctgcttcagctggtccaagtggaagtatgttggagacattcccttgcttgagaagcttccagacatctctttggcaaagaaattgtcgatgttaaagtcaagctttggattgactgtagccaatttcatggacaagaactctacttggtgttgaagagattgaacatagttgatgatctcgtcaagcattactgctttaccagtgaccttgttgcaggtaggtaccaggtcctgcaagaatttcattctttgattgatcttttctcttctcaccctttcagctaagctatggctgtcagtagcctggcctctccgtgccctaacatgaatataattatcgtccttctgagagacatttgaattcttctccttccccttctttgagttggagtccgaggtctcgtcattattgtcatcgtc

SEQ ID NO: 3304 - DNA, 766 bp, Picea sitchensis
  Predicted polypeptide sequence is orthologous to G2146
ttttttttttttttttccaaacagaaacccaaagaaactgaaatttcatattcaaatttcatagatatgcctgtacacagaaacctaaagaacaatgccaaatttattgacagtttcagtttatcttctagatggaaggaaaattatattgacagtttctctgccagatggaagactgaagatacatagacttatatcatggaattaatattggaagaatacgatcaaagacatatacgatatacagagggctgctcacttagcgaacgaaataaaacctaatttcatgatccgaattccctggcctgcgtattccagatcaggtggagcatatctttagaagcgctccaccctcgacacggtgtaatattttatgttgttaacatatccacattatagtatatactaccagctgctgcgtgcaaaatgcctgtcacccgtgcttgtccagcccggggttcgaccttgcggcatatacatagacctggcaagcagcataagtaccctaatttgtgtaccagcctgtgagcgcctgcatggcctggacctgcatcttgagcgccacgatgtagtccgtgacctcttccaagaaaacgggcgtgtccagccggcggcatcccggaatgagctccctgagtgtctgcaaacgagaagccaccgagcctgtttctgagcggatgctagtccccgacctggacgccactccgaacagccgcctgatggacttcttcccggaaaagatcgttttgcaaggcctgctattctt

SEQ ID NO: 3305 - DNA, 812 bp, Picea sitchensis
  Predicted polypeptide sequence is orthologous to G2226
ggtgttcatttttctcacttctctctttgttcatgcagatctggttggttgtgccttgtgtcacagaaaatcctaatgggtctctcaagctttcccaccactgtctccgaaggagtcctgccaattctgattgtgaatactgctctgtcttttgccattatcaaggacatcctgaggtcttttcttcagattgtaggccttaccacaggcactgaacctgattttatcgacccatcatggccttacccacctgaaaatacccctgcagtcagtactggccattccgaagcgcagttcattgcagaggaaatcaggcagagcctacccatcaaaaggttccaatcttttactgatgggtttgttggtagtgacaatagccatgttgagtgtgcagtctgtttatccaaatttgaggaaggggttgagatcagacagctgacttgctgccacctttttcacagaccttgccttgataaatggctggaccatcagcagatcacctgtcccttgtgtagatcatgtctgatatccgaagaagcagccaagaatatcaggctcagggaacaggagcttacagatgaatcggtattttggtgttcatccttccaagaagctgcttatcatcatacatggattgaaagttagagttgcttggatcctgctttgatggatccttcaacacttcatccagttatctgggtctataattggagattctgtaatcttttattgtaaatcatctttaggaaaagtgcttatttctacaggatgctttgttgcttctcctattgaaagcaatcctgttttctgaa

SEQ ID NO: 3306 - DNA, 844 bp, Picea sitchensis
  Predicted polypeptide sequence is orthologous to G2425
ttttttttttttttttattaaaaaaaaatgtatcagtgcacgaccttaataatacttaaactaacatatcttggcatttacaagggttacaaaaatatttctcaagcttaaaatgttattctgtgacgtattcactaaggtcttctttaatatagaacctcgctggaactactttgaagaattttcctgttatattatacacaaattcaccagttttctccataaaaggtcccccaaagaatggagcaaagctttttccattctcgttgagcatccgtactacaacgtcactgacgtcttcgttacccaaaaagatattgtctgcagcaaaaacaagatttcctaaaatttcgaatttagactttatttgaccatcgtctcctgctagatacacctctcccttagcatctttcgtaactttgagtttgaactcaatatgaagacgtattttttcaactttgacttttccaaaaccatcgccacgtacaaagtctcctcccaataagctttttactaaaggactagacgaagtagctttgtaatgtcctttcactgtaatatcacatgtcaagtccatcgatgaaactccgctctcgacatcagttaccatcttatgaattttacaatctttaactcctttagctactccgtcgacaagagtgatatctaataaatcagcaacggacactgacacattcttcagctcaagtggatctatgggaggaatccccaattctttcactcccgtttttcctatgctgcttataactgtttgaagtaattctctctggcactcgttgtctcttacactacattttggtagtgaagacacaaaacttgcgtc

SEQ ID NO: 3307 - DNA, 558 bp, Picea sitchensis
  Predicted polypeptide sequence is orthologous to G2741
ggtcagcagcagcaacgtccaggggtcgagcctccgaaaaggatcgaattggaggaggaggagtcatcagtgggaggtgtgacagagaacgtgggagaggagccagctcggacgctgaaacggccccgattggtctggacccctcagctccacaagcgattcgtggacgccgtcgcccacctgggcatcaagaacgccgtccccaagaccataatgcagctgatgaacgtggagggcctcacccgcgagaacgtagccagtcacctccagaaatacaggctttacttgaagcgaatgcagggcttgtcctccgagggtccctcttcatgcgaccagctcttcgcctccacacccgttccacccagtcatttcctgcacagggacgacatggtggtgcccctcgttcccatgggtatgggtgttccaggattgggccacggtcatatggtgcccgggccaccgcactacgggggttttgatcccaggtatcttactactctctccaggcagcaacagcagccgccccctccacagagactgggcccttctgctgcaact

SEQ ID NO: 3308 - DNA, 785 bp, Picea sitchensis
  Predicted polypeptide sequence is orthologous to G2990
ttttttttttttttttgaaaagggtaattagcagcccattaaattactcaaggccaaatggcagaaccacagaccatacaggcacagccgacagaaccctaattgaatacaaaagctgcctagaagagggaataaattactttacacttatgatgacttcgatctctgcagtgaaagatctcaacagaagatacccttctcgtgatgaaggattcaggagtgagatccaaaggaaagagatatttttcaattcataaattcaggaaataaaaaggattaagcagaaaacagctgtcccccaaaaccccgaaagaatgcctgaaatccatagaaattcaataaaactcccatgtcggtaacataattttcaagatttcttaccgagagtatgcttgttgttatgcatccagaccttcaaaacacccttcccgacaccaatttcattacaaaactgctgcacaatagcctcatcctgcttctgcatcctccaccccatcttatctgcgaacatatacatcttctccttctgatcctgcgagaacttggtcctgaacctcttcttcatgcctctatgatgatggtggctgaggttattattactgttgttgttggtattgccatctgggtcatcagactcggtgagaccagagcttagcgccatgagcatatggggagccgaggaaccgtggggcaaggggagggggtaataggggacaacgggggaacccggccctgacgaggatgcgccgccacgcttcttgcggaggcagcactcgcaggtgggg

SEQ ID NO: 3309 - DNA, 432 bp, Picea sitchensis
  Predicted polypeptide sequence is orthologous to G2990
ttttttttttttttttttcttcgtttgtgttatttggctattggagaaggaaggaggagggcttgtggtcatcatcactcattgtggagatagctaaacaaccatcatcatcaccatcaaggggtttttagtggagcaaggtttcaatttcatttgccaatcggtgttgagtcttccattcataagtatgtatttaaatcccaccatgttaatgctatttttttcatagatttatgcatgtttgcttgtctctttgcttgcatacatattgcttcttttttttgtcattttgccatgattttcatgcccataaaacaatgtaagggttttttctaaatgggacagcaagcctgagccttgatattaattttttatccaccctcttattgtcgtttttcattgctaataatataatctagaggtttgattttc

SEQ ID NO: 3310 - DNA, 785 bp, Populus trichocarpa
  Predicted polypeptide sequence is orthologous to G2
ggcggatcataatcttgatttgagcttgggcaatccagcttcgaagcaaaacagtatagaatttggtcaggataggcacaatgttgcaatggagcaacattcagcaaccatgccatttgaacctaattggcaaaatcgggggcttagacccaagcagcttaacctttgtacaagtgacaatgatggacatggaagagatgggtatggagagactgaaacgactcagcttcttagcaaaatccacattcaatctccagcatcactcaagtccagtgaaatgccaagatatgagcagttcaggagatcactcggagatagtcagatgcatccttttcttcccccacagtataactcaccaaattatcaaactcagcatccaagcagcagcaatggaggccgaattggaagtgatctttctctctctccatctgagcttcattataaccatcattatcagcaatggcaagcaggtcctccccggtttgcaaatgctgcagcatcatcaggattccaacagcagattaggactccacaaaactggctgcagaaaaatgggttcaactctctcatgagaccttcttaacccatacataaagtagccgttccatcttccttgctatgcaatctcaatccccaccttgtttgctagctgggtaaaacatgtaaagagcaaggcttttaactacgaggcaggttgtttttcaatccactgtccacccatccccagagagaaccaccaccaagaaaatcacgaaattgttggtcaaaaaaaaaaaaaaaaactc

(The sequence listing continues in the following parts.)

What is claimed is:

1. A transformed plant having greater seedling vigor or increased plant size than a control plant, wherein the transformed plant is transformed with a recombinant polynucleotide encoding a polypeptide that has at least 95% amino acid identity to the amino acid sequence set forth in SEQ ID NO: 230, and wherein said greater seedling vigor or increased plant size results from expression of the polypeptide in the transformed plant.

2. The transformed plant of claim 1, wherein the polypeptide has at least 98% amino acid identity to the amino acid sequence set forth in SEQ ID NO: 230.

3. The transformed plant of claim 1, wherein the recombinant polynucleotide comprises a constitutive, inducible, or tissue-specific promoter that regulates expression of the polypeptide.

4. A transgenic seed produced by the transformed plant of claim 1, wherein the transgenic seed comprises the recombinant polynucleotide.

5. A transformed plant cell obtained from the transgenic plant of claim 1, wherein the transformed plant cell comprises the recombinant polynucleotide.

6. The transformed plant of claim 1, wherein the polypeptide is SEQ ID NO: 230.

7. A transgenic seed produced by the transformed plant of claim 2, wherein the transgenic seed comprises the recombinant polynucleotide.

8. A transformed plant cell obtained from the transgenic plant of claim 2, wherein the transformed plant cell comprises the recombinant polynucleotide.

9. A transgenic seed produced by the transformed plant of claim 6, wherein the transgenic seed comprises the recombinant polynucleotide.

10. A transformed plant cell obtained from the transgenic plant of claim 6, wherein the transformed plant cell comprises the recombinant polynucleotide.

* * * * *